United States Patent 10,563,263 (GENETIC POLYMORPHISMS ASSOCIATED WITH STATIN RESPONSE AND CARDIOVASCULAR DISEASES, METHODS OF DETECTION AND USES THEREOF) - sequence listing, part 7

SEQ ID NO: 254 - DNA, 1355603 bp, Homo sapiens
cacagttgtcatggaatcagtcattttaaaagtttgttaaaagaaggtgtggaatttaaaaataacaatctgtattaattaccaaatcaatctatcatgtaaaaaattgaaatatgcctatccaagtaacagtggcatagagaacctcgggttacaatcttgtcaataaaaattcatttcagaactctttcctaaaatatatagttattcaataatacttatcgtgagaaaaaaaatccccatataggaaatagaaggaagaaatatttactcatgtaaagtataatttgagcaacaattggaacacctttgtctttttgctctttttaaactgttaattaataagaaaattttatattaagaaggcttttagttaaaattcaaattgctttgagagacgtaacaataaactcttttttattttgtttgagcttttatataagagtgtagatacttatttggaaattttattttataggaaataatcttaacactgatttatagtgagaaaaagaggacataatgttaactaaaataagccacatgcagaatgaaaaatactgcataatctcatatgtggcatctaaaaaatagtcattactggggcagggcggggagtgctggaaatgggaagaagcaggccagaaagtacaaacttgcagttatgtaggacgaatgcctaataaataataataaaaataataaattgcacagcataatgattgataggctaatttgcttaactataataattatacacacatacatatacacatgtatacacatgtaaaaaatctatatctctcaaagcatcatgttatacatcttaaatatatacaataaaatatcctaactcaaatttaggtactttgagaaagacaagcttaatgttcgtgactatttctactagattcatttttgctgtccgtaagcaaagccgtacctccactaagaacctgggtccaactaagatgtcagagagaatacctcctaattctttcaggctgccatgttaacatttctttaatattaataatgattcctgtgctttcatttattcaatatgtgtgtgcattatctgcagttacgggttagtgaagtatgaagcacaaacatgttttgctccatatcagaatatgaaagccaacaatttagactttaaaaagaaatgtattttccatagcttcatacagagcgtattttcatattgtagtaactattgccattgagaacaaatcaggataagctttgtgttattaccaactaccattgacccttaaataatgcaagagttagaggcaccaactcccacacaaaaatctgcatatagcatttgactcccccacagcttaactattaataccctactattgacttaccaagaacataaacagttgattatcatatattttgtatggcgtatgtattatatatggcattcttacaatgaaataaactagagaaaaaatgttaagaaaaccaaaaggaaaataaaacatagttggtatttattaagtggaagaggatcatctcataaagactcatccccagccaggcgcggtggctcatgcctgtaatcccagcactttgggaggctggaacgggcagaccaattgaggtcaggagttcgagactagcctggccaatatgttgaaaccccttctctactaaaacacaaaaagccaggcttggtttgcaggcgcctgtagtcccagttactagggatgcagaggcaggagaatcgcttgaacccgggaggtggatattgcagtgagccgagatcccgtcactgcgctccagcctgggcagcaacaaagtgaggctcccactcagagagagagagaaaaaaaaaaggctttgtcttcctgttgagtaggctgaagaggaggaaggggaggaggaggggtgtctcaggggtggcaaaggtggaagaaaacctgtgtataaatagaaccgtggagttcaaacccgtgttggtcaaggatcaactgtactctaagagagtagaagttggaactctcattcaggccatactgaactagaaataccattcgacccagccatcccattactgggtatatacccaaaggattataaatcatgctgctataaagacacatgcacacgtatgtttattgcggcactattcacaatatcaaagacttagaaccaacccaaatgtccaacgatgatagactggtttaagaaaatgtggcacatatacaccatggaatactatgcagccataaaaaatgatgagttcatgtcctttgtagggacatggatgaagccggaaaccatcattctcagcaaactatcgcaaagacaaaaaaacaaacaccgcatgttctcactcataggtgggaattgaacaatgagaacacatggacacaggaaggggaacatcacacaccggggcctgttgtggggtggggggagcggggagggatagcattaggagatatacctaatgttaaatgacgagttaatgggtgcagcacaccaacatggcacatgtatacatatgtaactaacctgcacgttgtgcacacgtacccaaaaacttaaagtataattaaaaaaaaaagaaaaaaaagagaaggaaaaggttgggggaaaggtctgcaattctattttggatgttgaggagaagatgagtgggacagctgcagcttgctcactttagagggttggcacagttgtgccctgctttgccaagaagaacacgcacaagggatagctaacaggcaaagtagacctggaataagggatgagggcttggagtggaaatggcctataaagtctcagtcttcccagtgagtggtccatgagtccgtaagtcaggtagttttgcccttattttattttttattttgtaaaaatttatttgtatagacttagaagtgcagtgcggttttgttacatgcatatattgccctgtgctgaaatctgtgcttttagtataactatcacccaacttaaaaaaaaaaatactatctggctagaaaactgatttttccattattcttgttatatccaaaaggtctggttttagcgactattctattactgtttttaaatgtctcttggtcaaatatacagttttcattaatacaaatactttgttacacattaattgtgcagatttccactggaaaatgaccatactttgtatccttccggccttgtcactgttgttggcattattctaaggcttgccgtgaatacagaacaccactgctgtcatttttcagtaagcattgccatgtttttcttgtctcatattggcttccagtgggttctgatatgatttcttctgctctggattcttatcagtatcttgctacctcattagcaagcatcgtttagcagaaacacctgagccgacatgatgccaccttgctcagccttttgcctttctttgggactgtccaacctagcttcctttctctttactacaagaagaccgtcagccctttgtgagctgataattaataatcaattaaggtttgataataaaattgcactatattgtactttggcacctgaagtaatttattttcataacaccaggagcagctcatcaccaattataatgaaagtaggttcacagtctatgatttttttctttcatataaaatttgtgtaaccagaaataataagaggtgtataaaagaagtgtcatgtagctataatacattgattaatatttgttgtcacattaagtgggcttgggatccttacaagaaaggtgctatttaagcataaaatattggtgttgtgtctgtactcgcatagcttataaattatatcttgagagttcacagacacaaagcaagtttttaccattgtcagcaagcaaagccaatgtagctgttggagagggagcctcctgcgtcatcaaaagaattcccagctgagccctgatccccttatcactaccataagtgatggtcgatggtagttcaggtataaagaacacagttccaattccaggtgccaggctgaacctgatatggtaacagggaaaagatcttctaactcataaacacagaaaactagatataaataaggattatggcaaataactcggatataacaaaacgcagtctcttctgaaaaaaaaccaaaaaccaaaaaacagcatgtgtgaaaacaatgtattttcctccaaaactgcaggttgttatatgccaattagcaagttgaataagatattcaggtaaaacactagaatgtgagattatacatttgtatacaaaaatttttgccaaaatctcatatgtaaatttattcatctctgtgcagttcttaaagtagtaggttcctaataaatgtcaattgaatgaaccatatatcctggtgagtatatgcaaatgccacaaactgtcaattaaatttaatcttgtattttaccttgcattgcacttgtgctaaaactattccccattaattggattctttatatgtgaggtatgttaatctgatatgatacaaacaacttgttttgtggtgttctaattcttttattcaaattaaaatggggatttgtttagtgaacaagttaagaacactatggtggaggcactttacttagatttgtgtttcattagctcattaatacagaattaaacatttcatctcaagcatgcttacatgcctagtgtatacttagccctcaacaaatgttaatagctcctgttttgccactgagtgtaagggtaccttcgaaacattctgacattttgcagtttgccaatgtatttattagatacttcatgtcatataatctatacaacttgtcttatagcttcaactgctaatttggggttcctctcagttctctaaaaaatcggaacatccttaggtcagaacttaaatggcattgctaattagagcatgagtgccatctagtggtagacatggctaactacaggcttattggtgaacaaaaaaaaaataggtggtgaaaatgttctgcttcttcattataatgcagtctcttggagttagtctcagacaaacaaatgagacatcctatatatacgctactcagccaataaaaatttaaacacaaagtatatcagattgaggggtggaagaatttagttcctggtccacaggaggcatacagtctagttctacacctaaagatctacacaaaatgttttaagctggattctaagtacattttggaaatattgtagatgagaccaggaatgtctaatatataaaggtgagaatcatatttgatagcaatatttttgaaggatgattattttgatggagggccaaatatcaaagacaggtcaagttaatgtacctgacagacttgggagacagggaagagatgggaaatgatcaagatgcaacacacatatggccattctttaaaaccataaagaacaaattagactaattctaagaaaccattagacatttttatcccatactgagaagaatggtatgtaaacagtgacaatacagaggtatttacctggtcatgagcaaatgaatctttggttttgtttctttatggaaacaactttatatccagaggtcttggtgagagaatgctacataaaagaaaaattagacatctgtaaaggtaagtgaattaaaactgatagagatcctgagacttaaaatatatccaagaaaaaaaaatagaaatgcatatctaaaggaatctactggatgaaaactaagtaaactttacctttaaattagtaagatttcaacttttacttctattttctaaaatcttaattaactgcaaatgtttatggtttgcataaatagttggaccaaaatgtcacaaagggtgagcataaattccacctacaggagattagatatttgcagcttctgtaagtaagagttggtactgtgaccaccaaaagcttgaccaccacagttgaattagagctcctctctcatacttcttaatggttttggttgccgatgttatcaagacatccacaaagtagactatgttctttagcgttgtttactgaagcagctgttaaattaattaagttggtatattttccaagtctgattaagatatgtttacttctgctttcacaaaacagctgtgatatgagtactgagacacatcttctaagaaactcaaaatataattaaaatcatattttgtccagttcaagtaaaagtttacttttgcttcttcatgtgttactttgcacttatagggaatactggcatatattgaaaatgcaagattttgattcctttaatttttatcttagtacttacccattcaccattattggtaacacattaacatagaggattaaaacatcaaaacagaaaatgcaaatgctaaaagaagctccagtaggcaaggcagatgatccaagaaagatgactgatctagacatgaattcaccattggtctgcttccctacagttatgctatgatttgatggaacataataatagttatgatctgttaactagaacctagaacttatctgagtcaaatgaagggaaagagaaaggagggcatgatttcaataaaaatctgttacacaaataagacaaaagctcagaggcacctcaactgctacagatgtgctgcatctgcttgcttgcccattggggacgatgagataaagagattaagacatttacacaaagatggctagacaacaagatcagatcagcaacatgacagctaggttgaggtgtcataaccatagcatagagaaagtgacctactgaaccacttaccccacttacaaacaatgttttaattaacttaatgtacaaatgatattttaccagggtacaggatgagctggttaattcaaaaatgtcattagcatcaaacagagaaaaccagtgatcttttaataatgccattttattaagaaaacagcattggaatttaataatggggcatacatacttttatatcttttaaagacaaatcttacatcaaaacaactataacttaaaatcccattctcacatgtcaatagtagaaaatcttggtcatggtatgtgaaaagatttgatgtttacttggaaaacacaaggtagtttgtttctttttagtggaactctaacaaggagttttgtttgtttgtttcttattttaagcactgttgtttctctaattccagacattgacctgcttaaacctgaacactgtggatataaaaggatacagaagtgtacctgatctatagagcccttactctccaagcagaaaattgtaaaaatatacagtacataagttaactccataacagcaaaattctaaagaaagatgagtcagatagactaacagtttgtctgttacatatatagatattaatagggaatatataattgtatattattacaaattagaacattaaaagtcataaaagacatgagaataaatatagtcactctttctgggtcctgaatgaagtgtagccaggtaacctagtcacccccaaataatgattgaagtcaacattttaaatttgaactgacagaaatagaccttactatttttaattaaacagattcaacgtttcctttctctccctctaaagcatcagataacttcgcaaggaaaagtgctattacattatctacttgtttcaaaaatatattcacaccatagtcttgtgataatattgctctctttataaaaagtagaaacattaaaagcttttatttagttcttgcttaagaaaggagaaatatttagtccatttacatcatgtaaaaggtaaattttcttgttcatgttaatggtaggagggcaccatgaatcatgtgaccgatagcatttccttctttacattggctgctaacaaagttaatggcagacctagcaccatttgtaacaaaaacatcaatgcagttttctctataaacctcatttctggcttcatcttatctctcctcctatcactttaccgtttgtcttgatctcactgacctacattttttattcatttttttaaactgaatagatttttataagccaacttacatcctttctagggcaaagctagttgaaagaaattatgtgacataatgactcaaaatgcccaaattatcggatcatgggtaatatagaatggtgttctaagaagggaagagaactttcagaaagctttctacactcccgatccctctttcaggctgcatgtgctcaattatacacttttaaaggcaaaaacctcatcgaacaataaaaagaatgcgttagagctcctacactttgaatttattttgtgatgtatttaatgtggttataaaagtcctggtagttctctctgtgaaccgacagcctgacagaggagaagagccagtggggcagagaaaaagccacagaaggggaatctccacaacgatccctcagttaacacataaagaagataacctagttactggaaagcaggaacacgaatataaaaagtatggaagagtggagaagtattaaatgcacacaaatttgtctttgctacagaacaagcaatcagcctagatcctgaggatagcgattaaaagcagagactgggtgtttgtacatcattggatgaatgagaagcagccaagaaacaggaaaagactaattttaattaccagaaaaactgcaagagaaagaacacagggctagtggtagacggcttccagctacaggctgcctggcactgtactctccttgccaattagagccagtcagaccccatcgggggattcagtgagcagaagaatcagcgtcagtccagggtcaggctgctctcaaacacacatgaaaaacggacaccagcggacacggggtgcgaccctagactcccatgcagtttcttatacagacacagagatagaaagcagtacgtgggatttcctttccattaaatacaggtgcaaaccacattctctatggaaatatattgcaaaggaaatgttatataatttatttaacaaatacccaattaccatcagcccaatcgtgggaattggaaaacgactcaaagactgagaggaaaaaaaaaaaaaaagtagagaggaggactggcagaacaatggcactaaagctgccacactgtggatttactacctgtgttatttttccaattacagccattgtaatataaaaattccgaaaaaaaggttgctgagaccattccttcgcttttttttagaactgagtcaacaccccaaatcaaagagaaatataaacaggcagagcctgatagtccttagatgaaacgcgtaagtgcagaaacaaaagagaagtgcttcccattcaggacttaagaaaattctgcaaagtgaaaaagtccactctcaaaccgacctaagtgaacgcgtcagtctgtgctgctgctgtcagaggtgtgagccggggactacaggaatcagagtgaagacaggagcggaggaagggactctcgcctggatctcccgtgccgactccagccagcacgtttgctttgtaatctatgaatgttaaatacggaggggttgcagagcagaaacgctcggggaaggggggcaggtcctctgtacttagcagggaaggaaaatgccggttgactagtgagacgagtggagaaacacagagcaccctccgggaggcgcacagttcgttaagcccagggacatgctcaatgaacctttgcagcaagaggcagtgaggcgctggacgcgggcgccggtgacagcgcgggcggccggggaggggcgaggggccgccccgggaggacacagccagtcagaggcgcggggcgcagggcgcgcggacgcattggaggaaaacacgcgagccccaaacacaccagccgcaggaggcgccgcacctacttcccaatataaccaactacggcgtgggggagcggaactgcgagaaggcggcagccaaagtgccattaaagctcggggcggagaggatgcgttacctgggtcccgtctgctgcgagaggcagggcaagctggaggattccctctgaatgattaagaactccgcaattcgcctctgccacaggctgcaaaggacccgaggaaccgctctctctgaactgtgctgatgggcaggaggatgggagacaggaattgagagtcacagaggaaggacagtggagtctggcatcttattggtaagtggctgacattcctttgccagtgactgcgttctgtgattgtgcacttcatctcccagccacttaggatttttgacacactctgttctgcaaagccatcctttcttgccatgttgccagaatgtaaaaactgtaagatgaagcttttttaaataaaggaaacaaaacacgactttatttcctgctgggattttatggcaaaaagttgaaacaagagtaaatataacctatttgtatatctcctaatgccacccaaaataagagtaagcaattcctacacgcaaattgcaaattgtaaggcaataaatgccaggataaagtgaggatgtttctacaaaagaaactaaatgtttggaaaataggatgccgttctcaggtactgaatgtatgccttatgtttgagcaatgagtttccgagactaaataattgggcatctggcattgcaataacttgttaaaattcagtagggatgctctataagtggagttctacaaagttcgtgagactgagaaaaactgtatcttggattatgctgagcttttttctaaaggttgtataggattgtgatagattaaaaaattatgttcagacatccttaccatgttttgtagggagatatacggaagagaatatcaatttgcacatacacaaacctgagaattactctgatgacctgaacaataagttgtttcaactatatttatttgcgaaagaaccagaatccactaaatattttagaattatattacttttaaatcttagaactgttctcccaagaaaaatacaatttcatgtggtaatttaaatgcaggtgagaagcaaaaaacttttaaactgttgtatgttcaatgccttacctacatttcattcatttgtttcttaatttaaaagagaaaatcatttagagggtcaatacttctactttgattctcaattacgactgtggaaataaggatgaaagaagtagatgttcattagaatactagcatttaaaattatagacaaatagtcaaatttaaaaattaatgcagatatcatcgattactgttgaattgcaacagaattacagaagtacttatgaccattacagggagcttaaaggagttcattatgattaatattgtgactctcagtattttaaaaaataatgattaggtcattaactgtttttgaaaatgcctgtagtcaattttgagcaattctcatggttgcttgcatattctcctatttcatgctcaaattattctaagttaagtggggactagtatgctgagtcttaaacttaacaggcataagtttactctgactctaatcgaaaagaggtatgagtaagaatatgtcatataaaactaatgataacaaattaaagatattacataaaaagatcatctaagtccattaaagggaaaaaggcaaaaaaaatcagagttaaagttataaaaagggaaattcaatataaagaatagaatttgacaaatagctggagtgtgagggaatgatattaaagcctatctgaaaatagaaagtcagtgaaatgattattacaagtgccagtgtttttgcttaggaattggtgtatcctttaaattatttaaaacttctgaaaattgagaaaggaggagaaaaactgctaattttaatttctttctgattccatagacaactgaacagaaagttagattcttaaaagttatataaaaatataatcccatagattaactaaatgccggactttgtctataagttgtgaggcacatgcacaccaaggtgcttttggaaatacatccaaaaagctacagttgtggaatttttaaatgaatagctgaaatacctgaatgtttctcaaggtgagcagttagtacttcaagtattaggtggtctgaaacaattcttagtcagggagccaacctgaaatcaaatcatgaatctatacatagaatatgtttatgtaagatgaatcattaaaattagtagcatgtaaaaatttacttcaatcttatgtgtccaattaagtagcgctatctgttagaaatgtaccaggtttggctgatatgtatttctttaaatgtctcttttacttcacagtttagaaaatcttgaccactttcagggtagaggtaggagtgtgattgtctgtcacagctgacttagcaatatggaccagagggtgccagtaaagggcaaagggcccgcataggctggccaaagcattttggagtttgtcttacttctagacaaaataaaggcataatttgtgaagattaaaataaaaatgatgaaaacttctctagatggctgtaatactgtgaagatgatttgactgtagagagtttgattggctaaaacaaagttgtagcagagtttagtgtctccttcatcagtcaaaaactaatccagaattttatgaggctcagatatttacaatattgtaatttgccgaatccattctttctcatgtatcttgattacctattgtctttgaactttcttttaaaatacgggtttttaaatttttaccaagtcgttggaaatttatttctcttactttaaataataaactcatacattcatgtagtttgttttcttgaaattctgactccaggagttgattttatctctctttcttctttctgacaatccaagcataaagtaagagagtaatatgtttctcacaagatgttaagaaccgtgttgtaaggctgtgctaacatgttacatgaacttcttaacactttatagcaggaaagagactggtcggaagctcaaagcggtagaatcactgcagaggtctattttctgagcatttgtgatcaataactccacattagaggctggtacattttaaaaagtaatgaagtatataaaactcctaatgcttaagatttaagattaaaaactattatgaactatattccatctccctacccactcaagtaagaaatcctgttttatgatttttggagattcaaatgtgtattgttagaagtgttctaataaactgaatattattagtttatgttttttccagacacttaaacagtgttttagttaattattttatttaaattgaatgacacaaaatatagtgttttaatacagtggctataaaagcaatttttaaagggaaacatgaatttgctttttaagaaaactggttttacaatggatttctttcatcaaaattattttgaagtattgaattgaatcccaagaaattgacacaacactgtataacttcagttatgttttgcctattataaatatttgcataagctaattgtagataattttatgtctattaatccccataaattaaaacacacgtctttagttttatatcccagagtagtgcatgttatatttttgacattataccctcctcaaacataagctcatacgtgttacaaagctattcaaagtatggtagtttctcttttctccagtgcagggaactgggaactttccagagaggccacaaagtaattgtgaaaaataaatcaagattgtctgttttatggaaataaaaaaaagaatctcatttttaatctaatataaaatagtgtgagatctatcattcatgagaatcttaagaaattacagtcatattcatttcctgtgtatttcttaagctagaatttcttgtgatcactgccatttttaaacgtttcagaaaatgtttcattagatacattttaaaacacgggtgtaaagttgttttttctctttttctaagtggttcttaaaaactcataatgatctaaataacttgttgcccaatggccactttttatttatttatttattttcacaaatgaccttctcataacagatccgacaggactcacctatttcctcttatgccagtcatgtttccaaatatttctcacactcaatttgcatagagcggagatctagataaaaagcaagaagccaatacattttatgagttttctatgaaaaatattgttacagttagtatctttactagaaaatatggagccaattaaagggaaagtgactaaactgaacagaatccaaataagcaattgcattttaggcaaggaatatttcatttatctgaatgatcaaaaattctctttcataaccattgactggaaaagtataattatatatttaaacattttatgaagggcgtagagatgttcttcataggattcttatagctgctaacaacccagaaaggagaacatctcatcttccattactatccagtagtaaacgtagcatatgtttaggaagagaaatgttgctgattatataggtgataaaaagttgattgaaattctcttccttttgtgagttataatattggcagaagcattcatcatgaggctaaaaatactgagatgctctcatcgagagatattataatgatagtaataaagtatctggagctgcaaccaggtctattaatgtatttttacaaatatttcattagttgcaggagtttgtatttatcatataaatagtagagaaatgggatgttgattttgtgagaaatttacttttaagtatataaagttttatctttattttcttaaataattaatgttatacttagaagtattaaggatttttttctgaaattaaacgaaatataaaggcaatactcaagaatttagaacaactattctaattcacctaggttctcccatttcagttacatgcaagaacttactttcaattatgcaatatttgttgagatactattgttcttgagcctttaagtgtactaaactagacaaaatccctgatgattaaaagtaatattattggaagttacaggtgagtgacaacaggaatttttaaaagaattttattgttttctaaaaatacatttttatttaattggcagtttcatgatcattaaatatgataggaattcctgggcactggaacagattgaccccaaatatatctgaaaacactgtgaaaagtctcatgtttaatctgttaggtattgtattttgccttattttgttattttaaaaccttcttcttcatattcttttctaaaagatatagactggcttaatattatctcccatatagcaaaaattattaaaacaacttgttagtgaccactatttcttttctaattttgtattttcaatgataagaatttcaaaagttatggcattgataagagaattgaaactctaagcttcataattctatttaatactctcttcctccttctgtgatgctgttattctaatgtgtgagctggtgaatgagagttcatgctaaaataaccgtatcattcaaattcagcacaaatctcatgatttattgatgattaattgtggaacccttaggaaaaagtgacagaataaataccatttaatattggaaggggccatgcgagctcatatttttacctactcataataaacaaagtttcttcactaataagcaagggtataaaaaggtgaagtgatgtgttcaacattgcaagtaatgcaaaagatggaattagaacccacatctcttaaatttgaagatcagagctttttatggcttatacttcattttagactgtggacatcttgattatttttgtatctattcaaatcaaatccttatattagaatataaatatatgtaatttccttgttgccactgattatacataaaacattgtcttttaagattagaaatttaagatccaattatattaactcagtggaaactgctatacccgcattctcttaaccaacaactacagaacttaattgctagatgtgaactttttcacaatgaacttggtatgcactcaccagctacatcaaatgacagaaggggttttttttttgacagttttaattatgaaacttgggaatcttttagagtattataatgaagtagaaaaaaggatttaagtgattttattccatggcatatatgtaagggaacatccatttgccctataatacttcttaatttttcccagactggcaggttttctttttttcctagtaataaatgtttaatggaagccctaaatcaaacagaaactcagcaagaaatgtagatgagagtatatttctgtgtttgacaaattttgggtaaactttaattcatgggctttttaaaggtagtagcgattttagagcatttgataataaagcagagaatatatctcttgaaatatgcactacttttctgtgttttaaaattcaaatgtcaacttgtatataaattctagtttttctgttacaatattaaaggaggttaatagacaacaaatttgaaaccgtaatagtatttaatcgtcattgtatctgaaccaaagtttacttatgcttaattttaataatgtcatataaattgttttagaatgaatatatacactaaaaattcctcagtagaactgaatatgataaaacataaaattaccatagtgcaattgagtggaaggcagtttaaatattgctgaatttctggtattacattgcttgtacagatgccttctcctgatgctttaattgacaaattatgacaagcaatttatgtgtttgggggaatgaattcaagttttaagactttttctttaaacactgaatatttaaagatggcgcgataagtgtagcagagatgaggtaaaagacggtgactaaaaaggttaatattttatctgaagtcttttatatcctaagtatataaccccagtttgcaaataaaataaagaaaatataaaacatgtccttgaagcccaatgaatagtcattttagttctttgaatttttactttccttagttatttattttcctaaaacttacattcaattctttaacattttcaaataacagtaatcttagtaagaaggagtagttatctgagattgaagttaagtgatccagaattgattttatgaaaattatacatattaactgttttaaaaatatatgactgtgtttgtttgtttctcattctttaacgtggtcttgttagtaagtgccacagtgagtaatttaatgcaatttcaacattaatttactcacataaatggtctactgtggacagtggcagtacaaaggaagaatataaaagagaataaatagttcaaacctggtggaggaaatacacccatagggtgaatataattcaatgtgaaatgtgcagtcatagaggtatatgtgactaagatacagattttcaatatttctccttctggagacttctgttacttttctcctaatgagtctttccagcttggacaatttcatgctaacattagttctctaactgctgcatttacttttcagtgcctaagttattttaaagtgactttggttccaagattcacctaaccactttaaatgaatgtgatgttttttgacatctcattatgttgctaactttaatatctcagagccatctaatctctcatggtatagccaaactcaaggtaaaaatgaatgtggctgagatgctgtggaaaaaaatgccatttctatatgttataaataagactgatttctttcatttatgtagtatgatatattaatgctgctgataaaacttattttgcaggagtggattaactatgaagccaatgaagctttgcttatatggccgtttccaaatagtaatagtagtaatagtggcagaagtcatagtaaacattattttaataattataataatatagctaacatagggagtcatatggattaaaggatgtggtatttgaattttaggttcagttttgactttaaaacttattagctgtataattttggacaagtaaaatctttctttacgtacaaaatacctgtcataatattatatacaagaaaaaatatctacttttcaatggtaaaaaaattatagtattaaaatcattaaaggtttgagtctaggaagaaatttttattttacttcaattttcattctaagcttatctgtctacccaaatattctattttttttttaatgagacacaatcctgttctaattgtggaaggggatattgagatctttagaacatcagcatttaaagattattctgtgtatctcatcttttattcaaagaattttcttgaatgtatacttctaataaatctggtatgtttgataccatatgcttttggggattcaaaggaagtgagaagtttgaccactgacattgaaaagatggaaaatcgttcagtcaggacacagcttaataagaaacttaaggaaaaaatacctgtaaaagactgtagaaacactggaggaacagaaatggtcattgtggtgatggattaaactgacttcttagacaaactcttttcagttggtgggaagagaggcagaaacaaaacaaatgtgtaggaaaacagtaggaaagctaattaatgtacagaaagaatgcttttaatgcaaagagagaggttaaaaattataaaatgaggaaatttggaggattctaagataaactgaaaaaattgggattttgttccaaagcaagagaataatatttatctcaagattagatgatatttgagtttcttctcagtttttccctttactgtgacttgtacaggtcaccttgcttctctccctagtttattaatttctcaatcaaaagaattataatcaatgaatttaaagcatattcttcaggttttgatccactgttactctatgactgtgtgagttaggaggttttgacaaagagaagaatggaatgaaatgaaaatctagggattgacaactgcatctagaatgaactccacagaagagagagaagagagaagaaaccacattcatggcatatggtgaggtcacaaaaagagcatgggcttcttagactcaggtttaacccaggtgtttccctgagcaacaccataacctttctatgttttcatttctttccctgtaaaagatgatattgactactaactcatagtttttttttgcgagaaggaaatgagactgtagatttaggaatcaaaattacttccttcatatctttagctatagatgcttacaaaatttctttttatccttagactttttaaggtataaaattatttaaattttgtataaatatatgtggatacaatgactctagtattctaaatatgcagaaaatcactattttcttggctggatgctgtgtattcatgtatgtttgctgatggtgacatgttttattttaatgaccttattttatttgctcattttgacagtgattacctcttctggacattttactttaattttgttttgttgggctagaaaagggatgtccttcatttccctttacaaaattatttagagcatagattctattttgtaagtagaggaagatatttcacataatgtcttttgaatcctgtgtgataacaaaatagtacagaatacattcatttgaaattaataatgttccccaattatattattttttcacttttattgtctgttttgctacttcaaaaaagtgatcttatgaaacagacttgtgctataaatgtggcgtctaatgctaactctcttttttttttttttttttgagatggaatctcgctctgtcgcccaggctggagtgcagtggcgcgatctcggttcactgcaacctccgcctcccgggttcacgccattctgctgcctcagcctcccgagtagctgcgactggaggcgctcgccaccacgcctggctaatttttatttttatttttatttttgtatttttagtagagactgggtttcaccgtgttagccaggatggtcttgatctcctgacctcgtgatccgcccgtctcggcctcccaaagtgctgggattacaggcgtgagccaccacgcctggcctaatgctaactctttaaaacaaactgaaactgaaatcttttaaattgtgaattgtaattgtattttacagcaaaaatacaatgatttaagcttgcaaacattttacaattttttttccaaaaatgacatctagatatattactatggtagcttttttggattggctactatgtcaatgagttattataaaataaaaacacattttattatatgtgtggtaaatcatataatattttaagtatgtatgtcctttatacccgtgcaataagtaaacctcttcctgaaacatttactgattattctactgttgcagaagatataatatagtagaaagaaatggaagaaagaaatctcagataagaatattttctttcaaaaaggtatgagaaaaatttattgggtctggaactattggatagagaggaaaaaaaggtgaagaaagccaccaagcagacaggagagggagctgatagaaagcaattttgtactgttcactgaggaagtcattaaataaatattcataccatgagctatttgaaaaaaaaaccaaacaaacctggaattgatatttcacctgaaacaaaggtgtcttttaatctttgctccatgtatttttcttataagataatagttcttaagatctaaattcatggcttagtttttctttctttttttttttattattatactttaagttttagggtacatgtgcacaatgtgcaggttagttacatatgtatacatgtgccatgctggtgcgctgcacccattaactcgtcatctagcattaggtatatctcccaatgctatccctcccccctccccccaccccacaacagtccccagagtgtgatgttccctttcctgtgtccatgtgttctcattgttcaattcccacctatgagtgagaatatgcggtgtttggttttttgttcttgcgatagtttactgagaatgatgacttccaatttcatccacgtccctaaaaaggacatgaactcatccttttttatggctgcatattattccatggtgtatatgtgccacattttcttaatccagtctatcattgttggacatttgggttggttccaactctttgctattgtgaataatgccgcaataagcatacgtgtgcatgtgtctttatagcagcatgatttatagtcctttgggtatatagccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgcctgttcatgtccttcacccactttttgatggggttgtttgtttttttcttgtaaatctgtttgagttcactgtagattctggatattagccctttgtcagatgagtaggttgcgaaaattttctcccattttgtaggttgcctgttcactctgatggtagtttcttttgctgtgcagaagctctttagtttaattagatcccatatgtcaattttggcttttgttgccattgcttttggtgttttagacatgaagtccttgtccatgcctatgtcctgaatggtattgcctaggttttcttctagggtttttatggttttaggtctaacgtttaagtctttaatccatcttgaattgatttttgtataaggtgtaaggaagggatccagtttcagctttctgcatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttagttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatgggagtggcattgaatctgtaaattaccttgggcagtatggccattttcacgatattgattcttcctacccatgagcatggaatgttcttccatttgtttgtgtcctcttttatttcactgagcagtggtttgtagttctccttgaagaggtccttcacatccgttgtaagttggattcctaggtattttattctctttgaagcaattgtgaatgggagttcactcatgaattggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttcacctgcctaattgccctggccagaacttccaacactatggtgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcatgtggtttttgtctttggttctgtttatatgctggattatatttattgatctgtatatattcaaccagccttgcatcccaaggatgaagcccacttgatcatggtggataagctttttgatgtgctgctggattcggtttgccagtattttattgaggatttttgcatcaatgttcatcaaggatattggtctaaaactctcttttttgtttgcgtttctgcccggctttggtatcaggatgatgctggcctcatacaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagaccctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgataacccctttatcattttttattgcgtctatttgattcttctctctttttttctttattagtcttgctagcagtttatcaattttgttgatcctttcaaaaaaccagctcctggattcattaattttttgaagggttttttgcatctctatttccttcagttctgctctgattttagttatttcttgccttctgctagcttttgaatgtgtttgctcttgcttttctagttcttttaattgtgatgttagggtgtcagttttagatctttcctgctttctcttgtgggcatttagtgctataaatttccctgtacacactgctttgaatgtgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagattcttaatcctgagttctagtttgattgcactgtggtctgagagatagtttgttataatttctgttcttttacatttgccgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgctgacagtggggtgttaaagtctcccactgttaatgcgtgggagtctaagtctctttgtaggtcactcaggacttgctttatgaatctgggtgctcctgtattgggtgcatatatatttaggatggttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcaagtgagatgggtttactgaatacagcacactgatgggtcttgactctttatccaatttgccagtctgtgtcttttaattggagaatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagcacttccttctggagctcttttagggcaggcctggtggtgacaaaatctctcagcatttgcttgtctgtaaagtattttatttctccttcacttatgaagcttagtttggctggatatgaaattctgggttgaaaattcttttctttgagaatgttgaatattggcccccactctcttttggcttgtagagtttctgcccatggcttattttttcacgttgcgtatcgaaatgccagctattcagaaatgccatacagttgcttggataaatattaatttagaaggaagaaatgacctagtgttctcatttataattcttataacttgtccggtttagacattatatatggtccaatatctcctacacatcagatttttttttcccaagatggagtttcactccctcagaagtagtcatcattttatacatgtatcattctatttatagataatgttgtttcaatttttcttaatataattttgggtagctacataacaaaaatgtatctaatttttaatagagtacttttgataaagttatacatgatttatatgaatagttcctcacctaaaattatctatcaatttatttctcatatgaaaacaaataaatatgaaattaaaattcttagttatgaattttatatgagtggatcttgaagtagtattgctaggtcattgagaaggtacacttaaaattttgcttttactgccaagttttcctccatagcgatgatactaatactcccactattagtgtattacagtgtctgtctcgtcccactgtagccaacacactgtgctaccaaactgcttgttctatgcctaacagaatggttctaaaagaaagtatgtttttattttaatttatgtttaatatttgaacatccctttatgtttataacacattttttatttgacctatggttcctacccattcgccagtgatgttctgagttgatctttttcctagtccctttacatattaacagaaacaaacccatagcagcaagaggtcaatctaaaatgctttgaggcattgccagattttataagaaataaaatgcatatctgtgaaaacatagagatgtttgtacaaataccattgtcttcttttctccctccactgtaagcaaaagatccagtggagatccaatgaagagaagataattttatcttcttcaatcacataaaataatccagataaatgagcctgttttctcatattcaaagtagccttctgaatatcactcactcaacactgcttcagggaatctcactgggaatttttttcaccagactggtttctctccctctattctccaacatgtcaataattctgatgggataatctttcagagactcaagcttgtcatgtcatttctttgctctaaaagctttaatcgtttctactgcttaaagaatacatttcagatttggcagtgttccattaaggagttctataactgtccttcagcaactcttttctaggctcctttgcagctacaacaatgcatatattttaaattgagtcacagtactaccaaaacctatcattagttgtcccatctctatacttttgctgacatcattttctgccaaaattaatgctctgggacatatttttccttcttttttcttttcttttttttttttttttttttttaacatggagtctcgctctcttacccagggtggattgcagtgatgcgatctcggttcacagcaacctccatctctcaggttcaagcaattctctgcctcagcgtcccaagtagctgggattacaagcacgccccaccacgcacagctaatttttgtatttttagtagagacggggtttcaccatcttggccaggctggtcttgaactcctgacctcatgatccaaaagtgctgggattacaggtgtgagccactgtgcctggccaggacatctctttacaaaaattacttttcctatcaggagattgcaagctgctttaaggataagaaagtgttttgataattttgataaactgctttgcctaacataaacacgggggtatttatttaattaattttttattaatttagagcataatttaatttaattaatttaatacattctgctctaaataatataatgctttaaagaggccaacattgaaaaatacttcataaagaacaattacctttagtgaggtataacacagagtgagctctcagttaagttgttataggttcatttctggtccttgacctaataacatcaataagactaattatttgtccaagctgtagttccctaattggaatcaagatataaaacttgtatattcttaaagaaattatgataaaagtttttttacttttaattgacaaataatagttgtgaatatttataagatacacattgatgttttgataacatcattgatgttacatatactgtagagtgatcagatcagcgtaattagcatatctatcatctcaaatatttatcatttctttgtgttggtaaagatcagtattctccttctagctattataaactatacattcctgttaactgtagtcatcagtggtgtataacaatgctagaactgattcctcctgtctagctgtaaaatttaaaatccattgactcaatgaattttacaacgccttcattgcttgttacaaagcatgtaacattgcttattacaaaaacaagggcagtagaccaacgcttcttttagctctgctgaaacatgaacaaatacttttcattttttacatcatttataattgtccataacttctacaaagttaatacttaacacaaaaagaaggatatatattattttacaatctcttatatagtacatatatagtatatataatacatctttcattataaaatgtaagatgtattattcattttataatgaaagatgtattatacattatatttggacttcaccactgaaccaaagcacaagtagctctgataagtaaaatttcccatctgtaattgaaataaatcttaaacctaattgttgtattgattatataatgctttttcaattcaacaaattcacaactagctaaaatgtcatatttctgtatcagataataaagtcataagaggagtaaataattgaaaactgaaaagacttgttttcaaattaatattaaacgattgaaaattttgaaaactgaattaagaatagagtccattaattcaatttcataaattcatgtagaaacatcagcaataaaaaagaaacaaatatgttgtagaccaaaatgaagatcttaaagaggaattgatttcaacaaaccacaaagcacttctcagcttttcagatcattggctatatttaagaatgggagcagactattacctcttttattcctcttctgcttctatcatctttatcttgagatgccattcttcagaccaatcccttctccacaagagtactgtgtcattaataggaaatactgttgaactgcgtaaaggttccacattcttattttttctatcactagacaaactcagaaaagccatgctgctcttcattgtattcactttgcctcaatagaaaacactaaaagtaaaaatgaaatggaagaccaagacttccccttgagatgagaggaaaagagagagtgtgcaagtgtcaaacacaaagaatgctagctggagtcacgtacatttcagagtcacacaattaaaattaccttcttacctctgtgattttacagaatggtggacagttgcttaacaagggaaagaatgaatgtgtgtgtgtacttgctcctgagcattggatccaaaaacaaagaaaccatttgttgccttagcttgtatggcccttgtgttgagaaatagatggcctgaaagaatcaggagtaccctatctaacatttaaaaggaatgttacttagtatttataaacttctaagaaaaaatgtcagaggtttttacactttaaaatgtgtaggagctcagagtattaagaaaaaactcaaactttctatatttgtttttaatttgttcagtaattttaggcaatagattattgtttcatgcagagaagagatttactgacggttcagtttcatgaaatttatgacactctgataaaaacaattacctagcaaatatttgctcagcagcagatgaatggcatgggaatacagacatgttggactattttgccaaggtacctccaagaagagggaaaaatgatgcaggaagtggaaaaacatgataatctatgatacaaatacatgcaaactttgagataaagataggaaaaatataaaatataattgaatgattagaaccaaaagcattttgtcactgtatttgtgtgtgtgtgttttaaagacaaataccatgaaaactctcaaaaactgaatgtgtagcttaagtaagtcacagagaaagctcttttagcttgtttcaccataaaatttagtatatgtagtaaatacattttataagatatgagataaatattgcatcagcctgattaccataatatggatacttgagaatatttgttgcacattatactaaactttacagttaccagttaatttcatttcttttcacatagcttcactttgaaaaacatgagatataaattcaaagaaaagatgagaaatcaaagaaatgttgagtttatgcaaaagtaaaagtgaaaaaatgagaacaattctattcaacttaggtttatttgatgtttactatgtgcaaggcaagctgacatctgatgacatcaacccatttttaaatattagtagtgtttcaaccttactctgaatgatttattcaaggaacaaaatcttgcaatatcaatttttaaatgttttgttgatgaatatatagagttgcatatttgtgtatgctttcagctaccttttacggtgaaagaagagaaagagttgtcataaatctgaagtatttagcattaacatttctttagtcacaattttagggctcattattaaacttttgaaaactgcaaagtgtaattaatgccattccaatcatcagcatcatcatcaacttaggaggaactaaaccaaatgtattaagagaaagaagtgtaaagtttgttttaattttgaactaatctcctcaaaccttatttctcatttgttcaatgagaacacaaaactgagcctggcctggcctttaattttcagtacattaacttatgtttcatggagtaggtatttaccaccaggagccaactccaataacttttctctttattttaaaatttgcctgtaacatttatttgtgcaaacactttctttccacatctgcttttgttcaatcatttattctctcctcaaggcctctatccttctgatttttgccatatctttaatatcttcagtctctccatttctatcaccttctttcttttagcctaacacatatgcaaagtggtacagtcttaaaaataaaagtaagcctgtttctcctcttgcctctacttaagtaaccactctcacacttcactcatttgtatgcatgccttactttcctcctctgtgttcactgaaaacaatttaactcatctttttatcctcatcacctagtagttacttgcaagtagacaccacatgcttattgaaggaatacatgactgtatgaatcctatcatgttcttttatctcaaattgattgccctcattaagtatagtttttgagatctatgaatgtcacttaaatttactacaataataagtagcataatagcaataaagagcatgccccaatcttttagttcaacacagaaaggtgtcagtgatagtttatgaaggatgtgcaaatggatatctattatatgaataagagctcataatttagttgtaatggctctgagtcaatgataattatttaaatatttttgttgactgataagccctaatctggccatggcactagcctaatttggcaaatgatttcatagaaacaatacaaaagtatatatgccaatgtgtttccaatctctatgactttgcacctgttgctccattggcctgaaacattacttcctctctcttctcctgaataatttctacttatatttcatgtcgagaatatcatttctctagaaatgttgccatcaaatttgtgtctctcattattttctctttcagcaaaatcattgcatacatagcatagcatgtatcattatatataattatttgaacacatactgagtatgtcccttccacagcatacctcccttctttatttttttaggagaacattttatttatttttaaaagtttttctttattatactttaaattctggtgtacatgtgcagaaatacctaacgtagatgacgggttgatgggtgcagcaaaccatcatggcacatgtatacctatgcaacaaacctgcacgttctgcacatgtacctcccttcttcttcttctttttttttttttttttttttttttttgagacagagtctctctctgtcaccccaggctggagtgcagtggcgcaatctcggctcactgcaagctccgcctcctgggttcacaccattctcctgcctcagcctcccgagtagctgggactacaggcgcccgccaccacacccggctaattttttgtattttcagtagagacggggtttcactgtgttagccaggatggtctcgaccttctgaccttgtgatctgcctgtctcggcctctcaaattgttgggattacaggcgtgagccaccgcgcccggccacctcccttctttaaactctaagaattcaactcttatttcatgtatttagcaagcagtacaatgcctggaattcagtgggcactcgataaatacttattgaatgaatgaatgaatgtggatgagcatagacgcagtctgggacaggtgtttaacgtacagctccagtaactgaagaattcacgttttcattgatctctgtagcatgctactttaactcctagggactgcaatccttctcatacatttacattttaatttaaatttctcaagatctatagctctctttgttgtcaggctcaaattatcttgaccattcaccttccattcttttatagagatatcccctggaccttggattaattctgctaaagccgttcctatccttataagaaaataaagagtaaatattaggaaaggagttgcaggaagaaaatatgttttttaaacaacattcgcaaagctcattttttagaattttgttaagaattagaggtttaaaacaaaagtgccataaaaattaacttctaaatttcattagtttatcatattagaataattagaactcgtcatctagcattaggtatatctcccaatgctatccctcccccctccccccaccccaccacagtccccagagtgtgatattccccttcctgtgtccatgtgagttagtgggtgcagcgcaccagcatggcacatgtatacatatgtaactaacctgcacaatgtgcacatgtaccctaaaacttaaagtataataaaaaaaaagaataattagaacttgcacaatcaaagatctggtgggatatacttaaccgaataacagtagaatatataatgccttataattgaggaatggctatttgccattaatgaaaatagactacagggagcttcctattcgaaaaagtggcttatgtgttagcatttacttctgtagtgccattaacttaaaaaatgctaaacttcctttatagatattgagtgaatcatcataatttgctaatattaagtattattcacattcaaatttttctactcataccactctgacacataacaaaattaagacagtctcagtttaaagacatagaggatataatttaggatattagacggcattaactaaatatctcagaatctagaaattctgccagcattgattcagaatgccacctgtagtagcctggcctctgtaatatactatttcatgtgaccatttcagctccgtggatgttcgatgttaaatgagacagtgtgagagaattatgttaatatgcctaaatgtagtccactggttattcagtcaacaaaatgaactaaatccccattatgttctatggtctctcttaaagtgttaatttaacaatatgcactgcagaggggaaaaaataggctttcttagacctagtaggtaaagaacatgaagtaacaatcaaattctattatgagatattgcacataaaagattattacatgcatgaaaaccaggccttcctctaacatttgtggggtctgggacaagaatatatatagtagcctgcaaatcatatctaagtattaaaaaattataaactaagctaacaaaattctattctccaactttggtaactatccctttataagtcccaaaaagccagttgtgaatttggaattttctaactccttttattttggtacgaaaatgtgaaatctggaagaagctggctccaggtccctgtctctaatctgcagcccgcccatcttatttacaacaccaaaaagggctttgtgcacaaaaatgagcagtctagtcctcatttccaagctccattcacctcttccacatcttctttaccactccaacctacaagtatacacagcagtccagccacagagatggaccaagtaaagaggcctacctatgcaggccctgttgacaggccttggatcattttgccacagaattctgagatccaagtgttctacatatgttctagagcagacttggcatggataattctcgttggctgtcaaaatccttttcccgaggggtggggcgtggctagagaaaagccaaagcagggtcctctgtaaagtgtcgggtcctctataaagtgtcaggtcctgataggatgataataatgcaaatataaggaaactcttatggggaaattttacacggtctctctactatcaatgttattaggagagacagcacaacatagtgaacaaacaagttgcctgagtacaaaacccaactttaccacttactctcctggtgtagttattccacctttctgtacctcagtctcctcatgtataaaatgataatactacttattgcatgatgttattgtgaagattaggtgctatgcaaagcccatgaaatacctggcatatagaaaacactaaataagtattagtaatgattattttgaagtgctaaagaatgattgatacagtcaggatgcatcccatgtagggtgtgaacaagttagtatgccacatctaagaaggaagataaaatcattttaatcccagagtgatacttcctttatattatgtgattttaaatcttttgatttcaattacaagtaaagcatttattaaacattaggtgaaataattatacatatatcaaacagcacacaaataatacttattgactgcatgcctgatagcatgctaaaaacattttatgcaacatcacatttaattctcaaagctaacttaaaattatgcactcttttctaatctgtgtgcaaatgagcatctacgaaagcatgtttttcatctggtcccataaaatacattacctgagcaaattaatatagttgtatctgtatgtacaaactttattggcaaatgagaactgcaataaattacaaaagattttactttagctttctacatgagaagttctaaaagccatttcagaactgaggacaattttttgaagtatgctatgcattttcatcatatatctcaggattattgccagatagaagtatcattactcctaatcttaatagattgcaaaactttaagcatcggggtgttcaataacaggattgactaatgtaaaggaagtaatacttagtaaacaagctgattacatttaacataatttaaagaaatctcactgggcaaataacccattgaaaaccagtggtaacatggatgtaaaactactctgccgtaggtgagtaggtctcacctaataaacacttcaaaaccaaggtagagtcttgagtagcaggtgagaataaatcaagctgctgtcagtcaagttattattccaggatagcctacagccagtagtggacataaatggaatatgtacccaggtaaataactctgtgtatagagacctgtaacttgcaaaagtctaaggagtgagacctggtgcggtggctcacgcctgtaattccagcactttgagaggccaaggtgggtggattgcttgggcccaggggtgcgagaccagactgggcgacatggcaaaaccccatctctactaaaaatacaaaaaaaaatctgggtgtggtggtgcacacctgtaatcccagctacttgggaggctgatgcctgagaatcgcttgaacccaggaggtggaggttgcggtgagccaagattgagccactgcactccagcctgggtgacacagcgagacccagtctcaaaaaagaaaagtctaagaaatacacatttagggactgtaagtgttcactgtgggatgctagaaaaatactataaatataggatattagaaaaatagtgtacattataaataaaacttgtctgcagtccttttcttgaaaaatatatagtatttatagattttgttacctgtttcataaaactcctttatgatacattgtttataaattatttaccagtttactcactgggtggtacaagagagtcattttctcagcactctagctaggaatttaagccgagaaaggtataatatcttcatgaggtttttgtttatttattttagttttttcatcaattcaagaaaatatcttacacaggcaggatatgtactagaaaagtagtaatactacataatacaaataaggaaactcaaatgtcttactaataatgcaatattgcaaataagaatactcaaacatcttactaataatgcaataaatataacttgcccattgctatattataaattgtcaggcttaactggagtttagcattttaagataaagtctcatgtataattgacgaagtcccttattttatctcagaaatgatttcataaaattgaagtgaattaggaaaaagaaacatttttaaaagttacttcgtgttaaagtttattcattatatttataatatacattttttattaaaacagtataattctgctgtgtccatctatctttttaacatgttggtaagagagagagaaagtatgaattttgtcattttaaacatggcaatgattatccatttttaagtgattaaccaaaacaagaagaatatgagtaaatatcaaaatgtttttcagtatatttgaaaccaaaaagtaacaaaatcaataacagccaatatttacatattaagaacttactatcttcatagccttttatattctagtcttctactctaacttctttctgcacatgtgaaatagatgtgttataaaattatcagtattgagaaatggtaatatgcaacactgatcttattgaattttggcaaaaaaaaaaaaaaaccaaaaaagtgtatgtgtatggcgtgtgtctttcaaaataagggcatttaaattgaaattataaaatataaattgtaactaacattgtatgtaaaataaatagataatttaacagtcttctaagagctccaaaagtaagtatataacattttgttacaataatcatgtggacatcagtttccagcaattaatctggtaaaagttcatcgataaattcagccatctgagcactgaaaataactcgttattaatggaatcaactggtctacttttcagtatatgagattttactctattaatcagaacagatcttcaaaatgcctaaattaacacctccacaaatgatagcacggactgacattttcacagctcatatacaaattaaacaagtatcctgtgactcctgtgtcaaatatggcagcatttacatatatttttatacaattattttaactttcaatagttgtgcaaattgacttgtactcttgaaggagtacagtttatgggacttttacatgatttgtgcagttatgttaaatgtatctaacatattttcaaaatgtgtatggaaagttaattcttttttcatttcttttcatgaaaaaaagcagtatattttatttttttccaaaatataattggaaataaaatgagctgattcacagacgtatatactctaaagcttaaaaaaaaatcatggcatcctatttaaagcattttggaataactttttctttttgtttagatgagttcacagtcaatgcacaaagtctttaaatgatagtaaatcagactgtgacatcagcttataggtaaagtccaaggtgacccaaaatactaactcaatggagtaactttaagatctgcactaaataggtttaggaactaatgtgcaacctaagacagaacaagggtatctcagtacaatggtgatgtcacattaaaatgctatggcatcaatcactgcaaacaaaacaaaaagcacattaatcaaccttaagggaaaaaatcaatatccaaatgattcattttcccccagtatttctctattttcagaaattacttcatataaattttcacatagcaaaaatattacccagtatcttcatttaaatgttttcacattaattagttataaaataaattattggctagggaattgatacatattgattattcatacttttcacctgaagtgtatttttctggtgcctttctaagtcatagtgcatcatgtgaaacttttagtttttcaactattaccaaactacattatgctacagtttcagtttggcaaagccagtttctgactaatgaggggtacaccacgaaattctgtattgtttagacaagaaattcaagaggaccttaatccagtgaaatgaatactgccattttggcatttcttacatcttaagcccacatcttaggtaaaaatggtttctattctgctgaaatgcaccagaaatggcttcgccttcaattttccttagtgtgttttcatggacaaagttggattaacaatccatgactacagccttgaaaatactgttaatttcatataaacttatagttaatttaaattttggttgctgcttctgctgctgtgtcgttcaatccctctacccttcctgggagagaattgggaaacatggtatagtatatgccatgcctgttctaagtagtaaaacatatgggttaagaatattaatactggagccaaatcacctgggttcaaaattcagtgcttccatttgtacaatttatattctttgcacctgactttccttatctataatgacctgcattacttaataaattgaagttgacttgtgaaattaatttaacttgagcaattgacgtaattgtagcaattgacttaacttcatttgcatatttacctgagttaggtagataaaacagaaaagtaaatatacaaatttcagattttcatagaaattctgctactttttgaaacaggactgaaactaatatattcttctttattaactacagtccatggttaccctaattccttcatgtgctagttactccagacatataacaaaaatctattcatcattgcaggatgggaagctacatgaaataaataaacgtttaaaaaattctccagataaagaacagaaagtgagagaacagaagcaaagtaataataatttttttcaaatcccagtcatctctaggtatccatggaagattgcttccaggaccctccccagcaatggaaaccaaactcaggagaagttcaagtactccagtcagcctttcacatccatggtttctgcatccacagttgggtgaatccacagatgtgtaacccgtagctaccactggctgactgcacttgacttatatatatttgggctcctgtatatccctattgtcaattgtctatacagcactggtaaaaaaaggactgaaaatcaaatattttatatttttattttgttacagccttacatgactctgatcatctctattttccatgttttccaatttaaaaaggaaagaataaagtcttgcttgttctatttctaattttatttccaaagagtgggtgatgttgtgaatctagttgatggtgagagtattatgcaatgaattagtttctatgataactactttttgttttatagcaaacagccattaatttaaaacttgtaaattggaaatccggaacccattgcagtacagctagtagaaacacattctttcagactgtgattacttccataaattcttgagtatcgagaattactgccaaacaaaacatcttcctgatgaaatgtattgactgacacttcagtagaaagaaaagtagaaaatgagactatgagaagaatgtctattttacataatataatttgaaaggcaaactaaagtgatttgtggatttgtttatgttttagggtaaagaaaaaagaagtgcaaaagaaatttataactggtttatcatttgaaatatatgaacttttaaaatttggtagagaatgtcatattctttatttacattaactattaatattagtatttgtcagaaaaaaattctccaatatcaaagtaaatatttcaaatagaaaaaaacctggagaacaaaaagccatactttaaggaaataaagatttctttttaaattgaaagactaaatccaaaagtaatatacaagtgtacacattcaggttaaggtatttaccatgtttgttgaaaaaataaactctttaatggtaaccgaatatatttctaagagttactcacatagttactattgtttatgcattacatatatttagcaacttacaatttttaggggcttcttagagtttcagaattttcatttttttcctcaacaaataaacacataattgaaaaattgaatatatgttttcatatacaataatacttttccgatttaagatgttaatcacagcatgtttttaactacagcttgctcttttaaattcagctcagtctataacaattattatgtatgttactattatgtatgcatatgtatacattaatgtcctacatatgtatttgcgtattaatgtgtatattaatatcatcataagcatacatgtatattacataatacttgcattatttgagttgtatcagcctcaagttcagaatagcatcaattaacatggccaaattacttataggaagaggaagtaaaagaatccctataatttagcaaattaataatttgctgacttcaaccacattactagaagctgtttcaggagatgtgtacttttctccctcatcatattatcctttctaattataaggtggatcttctttttataatgtatttcaagaaaggcatttctaattttacaacttagtttaattcaatgtaatggcatcagtttagttggtcccaaaggaaaagaagcaaataactgaatcgttaatgccatccaaaattttctcccctttgagacctgcttaattttcattatctataacgactgcagccaatggtgcttatgtctgaaagtacagcatttatttgggatactcagcatatcattcataaatttttctgcggtgatttcattttacatgacaaaaatcaccaaggggacttccattactagaaacaagcttggtttatttttgtaaatttattttacttcaacagtcaacagcaggtattgattacccactgcgttgagagcattgtactgtgtattgtaaggaaaccattacataagaagtaaaatatttgctgagagaatcactgacttatcatctaatgaaggagagaaggaaaactttacacaaatgattaggtatcagtcaatccatccgtttgctcttgattcattaattcatcgaagtgtactaagaagtagtctcttttttcagggattgtagtttatataaagacataaggaagtgtttattctttcagaactcgtagtggacaggcaagccatgatagaagtagtcccacaataatagggaaacaatatattatcactaggagtgttagagaagcataatgggaatagttagctctgactattcttaaaggatgaattacattttaatgttgaagattaaagaaagtgtagttcagtagagaaaatacaataaacaaaggcacagaatttggcaagagtagttatgctaaggcagttgtgaagttgtaaatagtggtttagcatggcagaacaaagtgtatgatattgactgggagatgtatggttatatgtaaggatattgtatgcatgttacatattaatggtataaatgtgtgtgtatatgtaacatatgtttacatatatatacacacagagagataacatacatggtataaatgcatgaactttgctgagcaaaatggtaaaaaatcttgaaaagtacagctatgctccatgtaacatttcagccaatgacagaccacatatatatggtcatcccataagattataacgtgctatttttattgtgctttttctatgtctaggtatattttattataatacaaatacttaatgtgttataactgtctacagtattcggtacagtaacatgctgttcagttttgtggcccaggagcaataggctatatagcgcaggtacataatagtgtataagatttaggtttgtgcatacaacactgaaattgcttaatgcatttctaagaacatatccctatcatttcgtgaaacatgactgtatttttaggagttttaatttcattaaagtgctaataaattgggaacatttttgaaagagtagttaatgtggccaaactctcacctctgaaagacatctagtggttacatgttggatgggttgacttggatgaagagtggaaagtattgatacatgtaatagacatgatgataatttagggggaatgttcctgagtcatgttgattctatgtgttctgtgagcctagtctcagactttttcaatctgtctgtaatgctataataaaagaaacttttctaattcttatatctaatgatatcttacataccacaattgcagcaactacaaattaaactttattaaaatttgactctagtacacagtgaaatctcagctccagagcttgacatacagggcccgtcatcctacttttagactaatattcctctatgaccccacctctactccctcttatgtgccaatacatttagtcaatgtacaataatctttctatttgtgtgacaaaaagtttaggaccaatttgctatgctttgaagcctctatttgtggcatatggtcattctaaaaaagtaatgacagagctgagattatttctgtttagaatctactcctatatgtcaaaagtttttgaagagcctactcctaaattctccagtgaactaattttttgctgatagcctgaaatcaagttcaatcgactttcataggaaagaaaaaaataacaactaaacagtcatgccaaatgtacattctttttctaaattcttctggggtcttatgcaactttgggtcttttaagtcatcttctggatcttcttattctgtcttttcaatatatatgtttttttctttttttgcattcacatctgaggtttcttggaacatatgagctgattgatacagctgtgggatccctggtctatagattctttgaattattccaaattgttttctctacttctctttgttgtctttgattttgtaaagtttttgccacaaggatatttcccttttctgaagggtgtttaagatgtaattgaactttgggagtttctgaatggtcacaatagaagtaaaacaggtcagaaagaggagcaagggcagcaggtaatagaggatgatataatgagggcagaagcctaacaagataaaaccattaggcttaagttgtgatttgggagcacctaagtgagagttttaagttttgaaatttttttatttgccttatccaaggaatattttaagaaagtaattttggatcctatatttctgttggaaacttcctcattccctccaaaataatatatcaatcaaataagcagatattggatgtttgttccatcttattctaatgtactttttagatgaataattttgctgtatctgaagttcctcaagtggccgctgtaattctgttatccttggaaagcatgccatttagaaaataaataaatacaaatatttggatattaatataaatacatgtaagatgcaggagtttagtcttcaggatgcaagaactaggactgggacaaacccttgagagtctggaatcacaacttattgcttgtgcaacttgtctttagccctcaacctaatggctggctgttcatgacaaacctggtaatctggtgtttcctgaagggctgggtggctgtttgaagagaagatttctctcaaaccagactttcacagagagaaaaaaaaagctctcaaggtttttgatatgagatgtaacacaacatttgtcttatgaagaggctgattcagcgggccttactttgaactcattggccattcgaagctgactcaaaaacaaacttataggaacctatgtctgccctcttctctatatggacttacacttgtaggaaacgaagaacataggcagagttaaatagtactattgttggcaataaagcagtattccacaaagatgaaggctttccaaagtgttccttaaaacttttccaaagcgttccttaatccttagcttggattagtacaagctaatccaagtattccttaaaaacttatcttctttcctagaagcattgggaaatttgacaaaaaaagtataagctcaaatccaatggaagacttacctcatcaccatggtcagagatccccaagtagaaggctcaaggggtagggtattcataggtgtattgaaaggcaccttaaatcattgataagtcgacttgaataatatgtttttctaaaaaagataatacaattcatattaggatttaagtgctcagtttattgttcagatgagtgttaggaagttcgttaaacaaaaattatttgcaaattcatcttcctaagctaaaaattttctggaatgtgagtcatgctaattctaatgtagaccagtaattctagaactttaaatcgtaattacctagaaggcttattaaaacacatatttctatgccctattcccagaattcaaaatatctgggctaggtccctagaatttccatttacgtgatgctaatgttactgatctgtgaagacactttgagggctactgataaaacatagttttagtcagttttagtcagtaatcccattatgctctatagccagtgaaagcttcacagagaacaaatataactatgagtggcaatgaaattgttttaatacagctcacatttgtcagtttgtaatatctgagatgtttattacttaagaggatattggaatcttactattatgcctgactaatttaagatatccaaattttatgttattcctctaaacaagaaagagatttctctaatgtcaatgaccaactcaatataattaactgagtacaatttactcttatttcctagaatttttttacactatgaaaatagtcaggtcagtcaataagtcttaatataaactgattgaggagacgtgcccattggctttggctgacaatgctacactcagtgcaggttttatcagtatgtgctgacccctgacaatcccattttctccttttctctttcaatatctaattttctcataagctgtatggtgtacattttaatgcttgccatatcccagctcttaccaatcatattcataatcattttataaaaaaagtacactgcctctagatatctgcttatttttcccaaatgcatgctgcccctaagcttagtccattctaacttattgtcagaaccagaatgagtcttgccctgaagggaccctttcaaactcactgttggttctgaatgcatttttgccttcaggctccctctattccttcagaccgatcatccaggctccagtgaatgttgcctttgggttgtctccttcggtttcaatttcaaggcttgcatgctttttaccctcaggttttcccttttcagtttctgtatgagattttaagggcctcgtggctttaaacactttctcattgcagtattttcctgtttcacgctccagtaacatggatatgggcggctgtttcattgatctgatgttccctcttaaaaatttcaatattctcttttcttatttattttttatattatactttatttcaaactataaacttattcactggtaagccatgtagtatatatataaaatgaagtgtctcaccaaatacgtattttctacaggaggaaatgatttccacacctacgcaatcataaccagtggaaatattggtactaaacaaaagatgtgtacttgttttaatttaagcataaatggttttattggaagctagttatgtagctcacagaaataacacagaacttagaaccatgctccaaaaaactaagggtgggtcaaggaggctaaatggaaactagacagctggaaacacagccatgtacatatcaatagaacagtttggttagggcaccaccagtaaagatgctggatactgatgctacccccagaactgctgccagtagatgctggatgccaccagcatcatattttaataatttttagaaatgcctctatttgaatcaccaatatgatgttctaggtccctaggtcccagatgggaacataagattggctgaactaagttcatgcctctaggtctgggtgccagacttcaagctgaagttcaacaagttcccagcttcattgacttggggaatacaagacagggtcctgctgcaattcatggtaagcatgatagtaatgcccagacactgaagtggttcatatgttatgtccaagaaaacattagaaatgtagaaaatatttacaagatcattaccttttacttgtaaatggtatcttacatgtgcttgtactaattttcatttttgaatgtaacttttcttttatttggactgatatttttttcccttactggctgcccaacaccacttttctctttgttctcaactcacctggaatacaaggtaaattatggacactacctgtaggccaaattccagcttatcactaaattgacaagcatgagcagcctcaagaagcacaatttaatctggttacagataacttaaattatgctgtctcttgggatagatggttggattacctttgaaatgcctgaagaattccatgcacctctgtatgttctcatgttgccttcagtgagccagatctgtttatcctgaagattttctagaaaagccatttatctcttcttccaatgtcttgcctttcatgtgtttctgaactctgtctactataaagttcgtatctaaccagtacaaagcaggtttgtattgctcacaaacatattaaaagtttggccttataataaataatgcccttggcttatttcaggatgggaagcgtctgattctttctggtcctttctaagtgtgtttttaacaacactaggacaatgttgccagatggaaaagaaaactgctttatcctacaagtatgtctaggtgactgaaacctatccagaggatggatcgtttgtttcaattatacataaatcaattatgtcttttattgaacatgattttaaagtaaaacttttaattatgatcttttttttagattcaataaaaattagagtgcctactttgtgctaggcactgttctcagggctaagaataaaatactgaaaaaaagaagtggaaaaaaagtgcccactgtaatagagcttatatcctagtagggctgtcagtcatatatgtaataagtaagtgaaacatgaaacataagtgtgtgtgtgtgtgtgtgtgtgtgtgtgtgtatggtcataaatgctgaagtagggaaggatgttggtagtattgaaataggtagaaaagacattgttgaaattttatctagagttgccatagaaggttgtatttaaacagacagtgagggaaaaatccatgtggatataaggaaaataatattctaggtagaggaaacagggttaaaaaactatctgaggcagggacctccctagttttttcctagaaatatagaggaggcaggtttagtttaataagagtgagtattgtggtttggggtaattgaagggatgacgacagaaagaaaattcggaagttactataaagactatgtattttatcctgagtgagttgggaagccctgaagagttttgagcatagtaggctttcttctgactgagtagctcaaccctttggaaagaatgttcaggagctcagtttttatacatcaagtttgtgttagctattaggcagctaagaggctatgtcacataagtggtggtaaaataaacaagtctgacattcagtgaagaggtggaggctggagatatataaatatgacagccataaacacacaaatagtagagaaagctgtatgctattgctgcataactaaatacctcaaaaatcactgtttacatttatatatatgtgtatatatatatattttctcacaatattagagttagggagctataacttgcagagctaagcagctttaccacacatacatagaaagttacatgccaggatttaatttcagagatctttgcttctggagagccagttcaatccattacaagccctgcattctcagctcctcctggagctgtctgctcttcccacagttcctcaccagtctgctgtgtgtcctatgcttgcttctccaatttggccaggttcctttttctgcccaaagtcttccttcattgtcattaatcaaagactggcactcttctggtcatctgagcaggaggcgaggaaaaatgaaaaatgggcaaggtcccacagagctcagaaagataatgagttcaagactctgtagacagcactaaatgatgaggattgaatggaggttggggagaaagggaaactgatggtgggcagttatatatattatataatttataattatacattatatatagttataatttatatatacacatacatacatatataataatgtatatataacttgattaataaaggaaagcatattatccctccctccctccctccttccttccttctctccccttgcctccctccctccccacctctctccctcctttcatcttgtctttttctttttttcagagacatgatgcttatactggtcattggttttaagtatctgggcaagacatccattttataatttgaaaatttattgcaatgaggattcatggtatttatttactaaatggatgggtaggccttgccaattaattttttcttagactttcttgtccttcattatcatggaaacaatatgtagactattcttttacaaaaagcctgaaccattgcttggcagagagggaactttacttcattttacttctgctgtgctctatgaccctcctagtggaagatgcttcattggtttctattaccagcatgcaaacagatttttaaaagtttctcagagctaaatgcacacagaatatggcaaatacttccctttagtcatttatgggtctgaatgaacaataggttttcttctctgaaaacatttgtagagccctttcatcccattcagaattatcctgtggaattcacacaccttctcattgaaagagtccttgctgccaagtgttattaacattcctgtaatatcctatttacaatctgtattttgagtttccagtctctctattaatagttctattaatattcctatactgtttcatcttctctcattagtaataatgccatatatacagactccagtgtggttattttctcttcttattaagggattctacatatccccaaggtttcttttgtacatatgtgatgggtaaagtttaattccagtaatattattgctagttatataaatgccacttgtgattgtaataattgctcataaagtcatctaactgtagaaatcagtggttcataaaacatgatagtaatctcacatatataattcaaatgcaatttcatagtaagatacatatttagtatatattgttcatttgctgatttgaatatattaaaatattgatatttaacatgacaacatagccttctagactggttattttaaagttaattaaactcaggaatgtgaaagagaggagatcagtttacatattataccagtaaatgtgggtatgtatgggcctgtaaataagctgttggttaggaaatatggaattttattttgttaactacaaccaagacaacaataacagtaagtctaatactaggctataatatcagaaaatctcaataccgggcttttgaagaaaaatacaataaaaagaatggaaatattcaagctaagaaatatacagaattttaaatgtgcatatgcatgcaaaatgtatattatctgagaaagtttttattttaaaaatttagatttatacgggttgtagaaagtccacaaattgcagaactgaaaaacaattacactaaagctatcatagttgaaaacatggtcatattctcattaataattaactagcttattatcaggttgatcatttgtactaagatgatgtggaaatagaaaatttgattagtatcagacaggaagaaaagaaatgagcttaaaatatggatttttttttcattatagagaagctatgcaagaaatttgctcatagacctatagggcacaaaaagaaaaaagaactcagacaatgcatcattttgcattgaatttgaatattttattgttgttaaaagcatgtaaccaaaataaacttagtcttctgtccccacattaagatctattcccaaatagtagtatattaaaaataaacaaaaatctgactcaaaagctcttcaaagtgatatgtcttcagtgaaggcttttgaagaggcagcaaaagaagtatcctatgagagagtgcaagtaaggcatcctgactcatgtcttcccaatacctcacacagtattcctactattctaatctccctgcgtctcttcctccaaactccaacccctctggatttccctccttccacaatgttgtaacttcaccacaatttctgagatttttttttctttaagtagcattgtgtaaatacaaatcactttaaattctttgggaattgtccaatccaccactagcccatgatgcttctctgaacaacagatacctgtgatccaacaggttgtaagaaatgacttttcctttgatggccggagggagagggaaacactttgcatatctacattttgtctctttctgaataccactgcatatgaaaatttgtttcaagaaaagaattcatgaaatatgcctcttcatatttcatgcaaagactgagtgtgtggggagagggacagagaggggactgggatggcagtatgtggaaagctgtatcagcagcagtggtagtgaaaatctgattccgcccaactgagtttgcaaagacaccagaagtttctggggtgtgccctcaaccaccaggaaggccagagaggtgaacgtggaatatggacagaccttggcttctacctattgctgctgtaaccactctgatctacttcaggctctcaagaaaagttcttagccaagataaaaaataacacacactccagataagatctacaggcaaagcaaaatcttcataaaagaagatggtatagacttcgatgtgaggacaattttcagttggatttgacttagaaggggagacaatctctgtgaacttgcggtcaggtgcagtggccccacggctgttatcccagcactttgggagactgaggctagaggactgcttgaagctaagagtttgagaccagtctgggcaacatagtgagaccctgtctcaacaacaacaaagaaaaataggcgggcatggtgtcacacatctgtagtcctagatacctgggaggtggaggtgggaggatcacttgagcccaggagttcgaggttacagtgagctacggttgcactacctcactccagtgtgggcaacagagtaagatcctgtctcaaaaaaaaaaaaagtctctgtgaatttataaattgcagattcaataattaaagccagtgcctcttgattaaattgggctcagttggagaacttaggaagttgtagtggagttattcaagatgaagaaaaaaacccaagacaattttgaagcaaattatcttttcaaaaatgagaccatgaaccagattcagactgtgctgatggcttcagcagacctaactaaatctaaagaattcaagacaacaagcaatgttggagcacaacaggcaagatggtctaatgaaagaaatccaaaagggacaattataattgggtagcatatgagaaccaacatgtataccagtcttttagatatagcggcctacctgggcaagggattgggaagcatttctatgtatcagcaaatattttgaccatttaactagtagcattctgacagagaacttaagcagagatgtttgccactggtatgatgtatagaggaacactaacataacagccagtataccactctctacatataggtcacaaaaacttctctaccagaagtattgtgagaaacatttataactctagaaattgactaggataataagggtagagtgaaggggataggacagagatacccaggagaggactcaggataacactatcagtctaccctgcatgcaagcattgaagggggtacattatctgtaatggattttataaacaataataaaatcacttaaagtctgtctgcttttacatcaccacacactagctattctaaacaatgccattgataaaatgccaggaagaatttttctatttaccctcctcccactcttgatacattactagaagaggtcaaaaccagaatccaagaaattgttaaattcagtattttaaggaatcacttggcaaggaagttgacaagaagtagtagtgaaagatacggagattaagaacatagtcatctttactgatgaaataaaagaaagaaaagaataaaagtctaggaaaagaattacacgtcaacatcacaatgacaaccaagggaagtagaagctaatagtctagttatccaagtaaaggtattattgaattgctaaccaagagatgaacagggattttagcaaggacaatttcaggcagagaagttgaagccagatttgctgtcctgggatgaaaactgaaaatttatcacagccagtaaaaggagctttcaagaactatttatttaataatgggaagatgacgataaatacatggcatcattagttcgaggacatgcttctctttcagctggcaagagatttaggctgtatgtaaagccaggtggattccagaggatttcagagaggagattgaggaggagcatcaaagaaccaggatgaaataagagctacagttcaagtaacaaaattgtattgcttactttgtgagtgttaagaatcatataaaagaagaaaacttattgagaaatgtgtaaattggaagaatacaagtttaaaagagaatttactgaaaactcataaataaataaataaataaataaataaataaataaataaataaacgcatgagcatatgtgtgcctgcatgtgtacagaaacattttaggaaaccatacacattaaaggagtcataattcattatatgttcaactacaaaagcaaacatgtctcctcctcttgacactttagcctctttgagaaaatactcttttagactacagtatacatttcttacttaaaattaaataattagccttctttttgaaattttaagaagttgcaaaggggttttgttaagaaaaataaatttgctgcttaatttcatatctctctagaccccatccagtaaaaatggagtaaactgagaaagtaacctctactggcaacatattacaatttgtgtacacatgtacatgactaaataagtgtgcagtttttacctattcaactctcatatcacataaatttatgtgtgcctgagtgtgtgtgacttgctactgcctttcactgtctaattgattcattcatccagaatacattgattaagtagtactggataatgttaattgctgggtcaaatttaccacaacctagattatcatcaactcaaaggaaaacctctttatttaaaatgagtcatgagtcaccccatttgtttagttggttagttttcatgcccttgttgctttgcagctctccacaaccaagttacatcattttcactcttctgtcaatatgttcttactacttttcttctgtcttgtctctttaggggcacttaacttcacttgttagcatagtagctgcatgggcatgatttgccaattcattctgtgtacacatttataattctattggcatcaaatcctaaatattagaatccttaatgagcagcatgtagggaaagagcaacctgaaccagaaaaatgtacagaaaactaaagaaaagattttcattatgaagaagagcagaggttttatcagagaacagtcaaaaggcatctgttagtccagaagtaattgaataccagcaaaagaagacttttttatatttaaagaaatgtgagaaatgactgatgactgtgaatgcctccatccctttatttaccatctgaatcatgagtaaggttcttatagtctttctagcattgaactaaacttgaacccaaatgtttcaaaatgaaatttgtataaaatatcacaatctctaataatacattttatttccttttgatatatcaagattattttcatgctatccacaaagtatgttgtgtcaaaattagaacagcaaatttgcacttacttaaaatattcttgtaaaaaccagtactttggaaggggatagtattatttttattaaaaattaccttacaattttgggaagtctcatatttctaaagttttattcaaattaaatcatgtataaatgttaatttagtaatattaaaatgtatatttcatataaaataaaaagtattcttttttaacttttaataaaattatctaatctaacacttaaaacttaatggtaatttcctattttaaaaaagtttgctttttaatttgctctttataatgaaaacattagcactgattttcataaaataaaaagcaagatgataccaatgtaaaagcatttcagttttttaattaaatgcctgttagagtctgtgtttcccattatagatgaaaatataattgcaaagtaggatacacataacacagtaagaaacacacaagttaatgggaaatattcagattcaccatgaccatgtgcaaatctgaccatattaggagcatgctgttctctccagggctgtgcaaagtaaaatggcatattttcagtagtaaatcatagtcagttgtcctaaaaagaatgaaggaaacagaattccaaaagtcagaaaggaatgtataagcacagaagtcttgagattagaaacaaatagcctccaaacaccagtgaatcttaaaaccatcaataaattgtagaacacaaacatatctcctctactgtcaccatctttatctgcaataaaaggaaatgaattatttcatagtgttgccatctctttatgttgtgttccattaataatagcaatatttacatgtaagtaacttttgaaatctagaggtgattattaactcagaagtaattttaccaaaaagttttaaaggctacatgcacttttgaaaccataccacctacacatgtggacagatatacaaacacagaggcctcattagagttgattcatgctttatgtgacaaaaaggaaaagaagaaaaaaaaaaagcttgattctttttataaagttaaagttgaactataaatacagtgaatgttggacacattttaaaacatacgtgtttggcatattattttgatttcatagttttaactcaatagaagtgtttttaaaattaccttgactctgttgtgaaaacctgataaagcattttattatcattacattctcatctgctcattagtgactgtggaattttttataaattagcatacacataaaatgataaaggaagttatatgttgtttattaaatatagatacacgcatatgccatatattcaaataacttttttgctagtatttatcctttttgtttagagacagagtcttcctctgtcgcccaggctggagttcaatagcacaatctcagctcactgcaaccttcgcctcctgggttcatgcgattctcctgcctcagcctcctgagtagctgggactacaggtgtgtggtaccacgcccagctaattttttgtattttactggagatggggtttcaccatgttgcccagggtggtctcaaactcctgagctcaggcagtctgcctgccttgacctcccaaagtgctaggattacaggcatgagccaccacgcccagcaagctaatatttattctaatggccattactgctgattgtaagtacctataatgttagtgagggtatggccaaacagacaaaattaagatcaacaaatttttctctgttaaatacatgtggaaattgtccatcctttaaaaacagtagctacaactgtttttaaaaagtcttcagtagataaaatcaatacccaacatggatgagatgtgaattagtgttacatcaaggttattccccagtgacctaagccatgtatgtaaagtaaattgtgaccaccatgcctccaagatctgactatgggaacctaattgatcagtggccccagctcttacattgtgaaatccagcactgcatttatgctgaggctacacttcctactcactgccgccaactaattactgagcacagcaggaatactaagttccacagcaggaactaagccagttcctgggaggcatagatctcttttgatggtgactgcgattcaagggcttctcactggccccactaaattttcttagaactagatctaggaccaatccaggggctttcatccaaaatcacttacttccctctcttctgcacaaagatcaaaccttttatttccatgagctagctcccttagccttcttcccacttattttcccttttctatcattagcagttccccagtaaatcacttgcacatcagattccttcttggcatttacttcaccaaggacactgactaatacacaaacatattggtatctttggaatttaatggaggaaactgcttagaaatctcctatagatttctaatatagcaccaaaaagcattcttttagtttttgaaatactcttggcatatgtagtcagaaaatgtggcaatattatcatggtaaccagatcctaatgcagctcaaagcagcctcacatttttattttccttctctttaaaacgctattgttctcctaaaataaatattggcagttctgccaatggagacatgtgcaagggaagcagacaatcaatgttgactaaaaaaaaaaaaaaaaggtgaaatcttccatagaagtctgagagtaggaagaatggctgaagtgtcatctttgtcattgaaatgcaagaatatatgtgtggcacgaagagatatgtaggaaagtgccatgtacagtaagaataaatggtatgggaaggagatattttagagtattcagaagaggagaagtaaagtaaaaattaaaaagctttagaattcaagggaaacttcattagatcactttgtaaaactaaattaatttcaaaagttcaatttctgcctctgtagaagcagaatatattagataatttataatgttgtaatatgaagtctagctctaatattctatgactcatttattaatttattaagtaattaatgcaaaggtgatacagtttggctgtgcccccacccaaaatctcatcttgaattgtaatcctcacaatcctcagaatccccatgcagcaagagagagaccaggtggaggtaattgaatcataggggtggttttccccatgctgttctcgtgatagtgagtgagttatcaggagagctgatggttttataagggtttggtagcttctcctgcattattctccttcttgccaccttgtgaagaaggtgccttgcttccccttcaccttctgccatgattttaaacttcctgtggcttccccagccatgctgaactgtgagtcaattgaacctcttttctttatgaattacctagtctccagcagttctttatagcagtgtaaaaatggtctaattcaacagtagatgcctactttattctagggactaagctacaaatctcctacaagaaacaaagacaagtaatcaacaattgcaattataatgtgatacattctctgaaaaaatatgcctggagtgtcatgggatataggataggagtatttaattcctccctgtgagaagtgtcaagaaagacattttagatgaaagcggagtgcacaggtagactaagatatgggttcaattcctagatggtctagagtagagaaagatagcatctaaaacagcagcttgtttaaaggtattagaatgttaggggatacaatctattggagatattaataccatgccttgagcaaaggatgcccgtgagaagcaggctgggttaggctggagaaatacactggccagttcttaaagcccttaggaaaccaggcatttcattctcaaagctgcgaagagccccagagaaattttactaaaagaagttacacagttaattttggctagaagctcactttgaatgtagtaaatcgttaagtatgtgaagacaaggcagagaaacattaaaattctatacaaaataaactagttcacaatatgggtgactgagtatattttgtttgagtaaatagaaagtaattgtgaaaaaaggcagagagcattagatttctagaagtttgaaaataattttaaaaataatcagatctcctttagaacatgtgaccttaagtgaataaatggaagaggaaatctccctgactctttttctagattcttaccttgtgttagccacagttccaggagagatttccccaccttgtctggcatcattcatggtggttggcgatgactcatccttaccctaatttgaaagcaaaaataggaagccgacaaggttgagcattactggcagactttgaaaatatcagtgtggaatcatttgatagaaaactgacttttccagagttgatcctctggaaaatgaggtgtttttttccccaaattgattcttagattataaatacaaccctcctttcagataattccttaaagtatattactctgaaatttttgctgtaactctttatagcttagaaatgaaccaggccaggcgagggtaatggggccaatgagggtcaggtgaactttaagtggaggtcagaaaaaaagcatgggtgaaggatgattgaaaaagagagtttgtaaatcaaggtaaaaaatataccctgcttcaatttttcctcgaagttgccagtggagaggtcagattgctggatgtcttgacatcatgtatttgtttatgtctctcccatgctgcattgtaatcatctctgttatggcgaatgcattgcaatgtgattattagtttataggtcagtccttcccattgaaataagcttctagagggcaagtactgtgtgttttatgtattcattctcaggaccttacatcagtaccagacatttttcaggtacttaataaatatttgttttagaatacaaaacttgattagtactatttttaaaaagaatttagatagcttgaaaatggcctgttgcttttacataccgggtctttatcctttagctttacttctcttccaggaattaccctactaaacatataaacctcatgagcatccttggctttctgcaaacccctgttcacaccagtgctactgcttattgcagtgcaatagggttaaagcccagccctcaggcttgttttctggcttcagcagggaaggatttaattagccatttaacttcctcaggtgtaggggacagagctccctcttccgataatgaggtctgcgttgccagccagccacactggtttctctcttcaggctgcctctctccagcacagctggtgagctggcttcctgacgaccacttagtccgcactggtatgaaaatggttccgtcaagaactgtcctggccgtgctctgggcagtatcttccccctccctaataacttcaaactggttgtgactccagaatctatctcctgtctctgactattctgctttactgagtgacgagagaagatcatctcatcttctctttttgcacaggtctcaccctttcttccctcaaggagattttgcgtgcaaagggagttttggtttcatttttggtctctctttaaaaattggtatctgtgttcagaaataatgtttcttttcctgaaaataattttaaatggtttctattaataaaaatgcaagcaatacagaaaagtaaggagaagaaaatgaagagaaacagcctgagcccctatatccaggcagaatcatttctagtatttggcaagctacctccatttccatatgcatgcagataaaaaaaaaaagatagatggaccaagagatagacaaatatacttttacaataaatgagatctttatatacatgcttctaattaagtaaaaacaagtattatatttatatgatcttttttgtaccacaccatgctggccatttttaaaccttaaatatattttacagatcaaggtatacccatggttttaaaataacttttttttttttcaaatccactctagtggacctcactcagataatatgtgtacttctccctgttaaacttcaacattaatataattagactagagaacatcaaaaagaagttgctctaatagagcactgtgagtaaaaactaagaagtacaagtagcagtactaatagtaatatagaagctgactctcaacctggaatgaacatgcaaatcatctgtaaatctttctaaaaatgcagatacagactcaataagtctgtgaccggtcctgatattctacaagcttacatggccctgcttgttgctgttgctgaccttgaaatactctttaagcagcaaggcttagagtatacaatgtatcaggcactttgctaggatcattcctcagggttatattcatgatctcattaccaaagcctataactactgcatttataagtgtggaaactgaggctcaaagaacataaaatatatactagaggtcactctactctctgcttaaaaagaggtgtttgaatttagacctgtctggctccaaacagaggttttttttgttttgttttgtttccctgtcatgtaaaacacactaatgcttctttctagaaatcccagtgctgagagtgatgaggttaaaatctgtagcatcattaaattatgcataaactaaaaatgtcaaaagagtccacaaaaccaggacaaagggttaccttaaaaaacaaaacaaaaaaattgcacaagttaaacagaaacatcaatagaattttgcacgtaatatatggattagggaaacattttaaaaagactttgcaaatttatgaatattacagtaaaagttacaattagtaaaagctggaatatatctaacttaagtttagcatcagaaaattttaaagtcaatgtataagccatgtacttcatatatatttgccctataaattatatttttatttttacttcataaagtctagaataactgttgcttactcaaatcatttgctttatttatgaacaacttttcagtatgttaagtgaagtcaatcctaaagattaagtttgttgtcattgtcttaaacatagataaattggacaaattccatgaaaaacacatttatcaaaattggcacaggaagaaataggaaatacaaatactccagcatcaaaaaccttcccataagaaaagtttaagctaaggcataaaggttttaagctattcactggtgaatacaataaaaaaaaagaaggaagtaataatacaatcaaacaaactttttcacaacacatttaacaaatgatcccaaaagaaaattagctgataaagtacttagtgtatatttccatttatatgaagttgaccatttatatgaagttgaacaatggcagaactactcaatgttgatagaaaagtgacagttgattataaagggtttggaatgaatgggaagggagttgagggaacttttctttggtgatgaaattgttgagttgtcaaaagtttatgctcgttttccagaactcaagaatgtgcacatttcccaactgaatttccttaagacaaaaagaaaaaaaaatagataaggtaatttgttctcaaaccaattcatttgcatagtaaattaataaactagcattaagtttggaaaaaaaatgatgtcattggggctattcaattgaataatatcaaaacaggatcttaaaatgttttgaatgataaaattatgattgatataaatatctggcttataatatgattaatttgaaggacataatacatatttgcatataaaatcccattatgtttagtagttgccttatttgtaattacaactgaggttgtaccttaaattgtttcctagttttaccatatttaggaatttgagttcttcctcacctagaggttagttcttccaggatgaataatacaatttttcatgttgctgattattatatgcttactgaatctttttttagcttgctttttgttttaatttctatgctttttaaaaaattgagatatagcatatactcagaaaagtgcgcaaatcttaagtgtaccattcaatgaatgtttacatatgatacacctttgtaaccatctccatggtcaagatatgaacactttctgtatctcaaatgattcctttgcactttattccagccaatagcaccttcttcccacctctaaaaatgatcaccatttgacttctatcactctatattagttttgcctgtttttgaacttcatataaatgaaattgtgcagcatatattctctatttctggcttcttttgctgaatgttatatttgagattcatctttgcagttgttgtgacatattcgctccttcgttttaacttctcattgctatatagtattccataatatggatttagtacaatttatttattctaccattgagggcatttaggttgttgatagcttttggttatacactaagcattcttgtaaatttttttttggtggacttaagcactaatttggtggctatatatcccaaagggagatggttgagtcatagactaagaatatacttagctttcgtagaaattgtctttttagagtttgtctctttgaattaggagccagacatgtgcatgcgttatatttgactggtatgtctctttatggtttggttttttttttttttttttttttttactttaagttctaggatacctgtgctgaatgtgcaggtttgttacataggtatacacgtgtcatggtggtttgctgcacctatcaacccatcatctaggttttaagcctcgcatgcattaggtatttgtcctaatgctttccctccccttgtccccccatcccctgacaggccatggtatatgatgttccccttcctgtgtccatgtgttctcactgttcagctcccactgatgagtgaaaacacgcggtgtttggttttctgttcatgtgttagtttgctgagggtgatggtttccagcttcttccatgtctctgtgaaggaaatgaactcattttttatggctgcatagtattccatggtatatatgtgccacattttctttatccagtctatcttccaagtctttgctattgtaaatagtgctgcagtaaacatatgtgtgcatgtgtctttatagtagaattatttataatcctttgggtatatactcagtaatgggattgctgggtcaaatggtatttctggttctagatccttgaggaatcaccacactgtcttccacaatggttgaacttatttacactcccaccaacagtgtaaaagcgttcccagtttctccacaacctcatcaacatctgtttgtttccagattttttaatgattgccattctaactggcatgagatgttatctcattgtggttttgatttgtatttctctaatgaccagtgatatcgagctttttttcatatgttttttggccacataagtgtattcttttgagaagtgtctgttcatatacttcacccactttttgatggagttgtttttttttcttttaaatttgtttaagttccttgtagattctggatattagacctttgtcagatgggtagattgcaaaaattttctcccattctgtaggttgcctgttcactctgatgatagtttcctttgctgagcagaagctgtttagtttaattagatccaattagtcaattttggcttttgttgcaataacctagaactgtagaaaccctagaagaaaaccttggcaataccatttaggacataggcatggccaaagacttcaagaatatttttatctttttattttcttaatttatagagactgggtctctctatgttgcccaggctgatctcaaactccttggctcaagtaaacttcagcctcccaaattgctgggattacagacgtgagccactgcgcctggcctttgaacctttttaaataaaacttgatgtcacttataaatatctgtttacatcatgcattttttataaagaggctggtgtatattttagagtaatttaaaaagtgtgattgctagtgcaattcatttcaacaagcttttcttgagtatctactatatgcccagaaaggctcagtagattcaaaaagaaaaagaaaaagaaaaacatgcatcacggcacaatgttcttaaattacaacatgtaccagccaatagacatagtgctattagaaactaaaataattgggatgatgtaaaacatgccgcattgaaaaatagcgaggatattgtaatcttttactgcataatatgatgtatacataagaacaaaaaatcagatactctgtatatatgttcaagagagacactcatataaaaacagaagaatgcctagaattggttataaattctgcactttcgtgaattattcactgtttttacaaaacatctaacaatacatcaatactctgcaaagatttaagtttctccaataacatcattgaaaatcacattttgtttctgcaaccaaataaataataaatttattttatattagcacataaatgttcatgtcaatatgatttatttatttttctgatgtatgggcctaaaaacactattttaaatatcactaaacaggaatttttaaaagtatacatgcaaataccagaaagagggattggctcaagatccatactgaacaattgattaaaatacaaatcgtgtaaatactacttttattttagatctgtcttaagtaaaagtagatttacatgtgactggtcatcatctaaactttgaaataaatgtagataaaacaaatcaaaagaaatgtaaaattagaaacaacatttcaacctgaggctagctcaaagctatgaaaatatgaaagagaaattgtagtaatattctttttctattatcaaaggaaactttcttgttttctctctcctataaatattatttatttagcaactttatttccttcttttcatttaatgtcgactgacaactcttaagggaattgtcataaaatatcatatgatcagaaagtaaaactctggtttagatatgaaagtttatgatgatagtagtattggtaggttatcagtaacaactttgttcaccaagttaagactgatgttgcatgcgggaagtgtttgtttttaagatatttttatatttccaaaaaagcagtgaaaaagatacaattatgacagacgtttgaactaaaatacaaactcttgctatgactttatataatatcatttaaaattaagtaacatgtcttttggtgaaatattgctgccatatgcttgacttcaccttcttgatttgaagcaacttatttattccaatacgaactactttacttttgggccaggcacagtggctcacgcctgtaatctcagcacttttggaggccgaggtgggcggattacctgaagtcaggagtttgagaccaacctgaccagcatggtgaaaccctgtctccactgaaaaaaaagaaaattagcctgtcatggtggtgtatgcctgtaacctcagctattcaggaggctgaggcaggagaatcacttgaacctgggagctagaggctgcagtgaaccgaggttgcacccagtgaactgggtgacagagggaggcccttctcaaaaacaaaacaaaacaaaaacaaaccaaaaaaaagtactttacttttgaggagaagctccccattgttggtaaaagtgctgtcttaacactcccaaatatatagaaacatgaaaaccacaaatacacacacacacaagcacacacacacaatttaacctaaagaatcctaaatgtggtaataactgatatgtgaaaatttcaggtaatgatctcagtgtatccaggtttccagactttaatattaaaagataaaaagcactgaagctttttaaaaaatagattaaaagttacctcagtgtttgtcatcctatagatatattcacaaatacaaaaaattggacatttatgtctactgtagtatgacatgatttgttaaaaaaaaagtttctgatattttccacaaaagatacagcatctaattttctttggtatttggaaaatcaatcttatttgtatgaatttctttacaggacacaggagattaaaggaaagagaaatctgatggaaacacatcagggaaaatagttctgtattttccaatgcttgaaaattacagctcattgtgtattttcatttcttttccttttcatgattgcttattttgttatttttctgcttccaaccaaaccaatcatactgttttttacacattactgattataattgagtaatatgaaggttctggtagcccccatgtgtaatttgttttcttctcatactaagtagacaggataagtggtgctagcagttgcattttatgacagtaagtgatggtattgagtttatgtggtcttctgtggcacacacataggcttcaaattcagatatgttggagaaggcatttgggatatgttgcaccccttaacactgttagaaaatgtaaggtttaacaaatgatcaaaatttaaagtaaaagttaagtgatatattgttccaggagcaacaacatcaacaacaaaattacaagcacaatgctactgacatttatataataatagtaatgattaattctttgctaaaacattgacctgaggatatttaatagctccactgaaaacaaataattattatggcattagcctccacacattaagcactactccatagattctggatacagtttgtatattatttattacagtggtccttagtgatacacattttaaatatctctgagatttcttacggagatagaaaatgaccaaattcttatctgtaattttactcatacaaaatcacaggtgaactgtagaactaaaagcatcactaagtggtatggttaggctttgtgtccccatccgaatctcatcttgaattgtaatccccacaatccccacatttcaaggaagaaagcaggtggaagtaattgacccaggagggcagtttttcccaacctgttctgttagtgaatcagttctcaggagatctgatggtttataaggggcacttccccgtttgctaggaacatctccttcctgctgccttgtgaagaaggtgccttgcctcccctttcccttcccctgtaagtttgctgcagcctatccggcagaactgtgagtcaattgaacctctttcctttataaattacccaatctcaggcagttctttatagcagtatgaaaatggacaaatacagcaagattacccttaagctttctttttctcttcaataagccttaaatgttaagtgtatgttggaagttttcatcctatctttgctaatatcactgttaaatttcaattcaattattaattaatggggatttaaaaattatctaaaaatgaacacaaaaattgatattaatgtcatttctatttccttgttcatattagtaatttgatacctaattagtgactatttgtattcacggataatattttttcttgtgtgggaaaggaaattagttttcactgatattaagcatactacttgcagaaagacatgttgaatagatattttaaattgttgattaacaataatctgtgttggtatattggtagaaatgtaaatgtgtacaggtactatggagaacaggttggaggttcctcaaaaagctaaaatagaactaccatatgatccagcaatccctctgctaggtatgtaccccaaagaaaggaaatcagtatatcaaagagatatctggatgcccatatttattgtagcactattcacaatagccaagatttggaattaacctaattgtgcatcaacagatgaataaataaataagatgtggtaatgtggtgtatatatacacacaatgaagtactattcagtcacaaaaaggttaacattctgtcatttgcaagaacatggatagaactggaggacagtacgttaagtgaaataatccaggcacagaaagacaaactacatatgttcttactcatttgtgggagctaaaaattaaagcaattgagcttatggaaatagagactagaaggatggctaccagaggctgggaagggagtgaaatggggagggggaagtgggattggttagtggatataaaaatatagtgagaatgaataagatctagtatttaatagcacaacagggtgattacagtaaacaataatttattgtacatttaaaaaatcactaaaagagtataagtggaatgtccatagcacaaaaaatgacaaatacttgaggtgatggttaccccatctaccttcatgtgattattacacattgtatgcctgtattaaaatattgaatataccctttaaatatatatacccatctacctataaaaattaacaaaatacaataacttgtatgtctataaacttaaagagactccatttaaagagatctcttggcaaatttccatttggataattttaatggtacataattagttagaggaaaacagaacttagaagaggcagatatgaaagacaggattctaagattcatcctgacaacagaaaattaaatctctaataaagaggaaatactgtattaagacttcctgcaagattttccaactctatctagataaacaacacagcaaatccataaagaaatggaattcctgccatatgcactgcagttttagatgctatggttagaaaaaaaaagtggagtagcatgtaatgaccatgatatctatcctgagcatcagtaagcgctgtcaaataaattcaagtgaatctatggggccaaaagtacagaaagttcaaaatcagtaggatcttgcaaattctagaatatgttcactggaaacataagtgacctcacaatttaattggctaacgaatatagaatacaaaattttatgatgtatccagtgcctacctttccagctaaatttatgagccttttcctccttgtagtttatcctcgagccaaaacaaattaactttaggtccttgaaggtgtcacactgtttcacacttctttgcctttgtacatcctatcctttctgactataaagcccttaatcacccgtcaacctggtgaactccaactcattgtttaagacagagctcagagtctctgactgccttcagatagatcagattattgtctcctttctgccaccattgcttcttgcacatgcctgcatgccagctttgtaggaataaagagattgcctttatttatatctgttttctcttctatccttgaactatgtgtggacaggaacagagtactgttatgctttacattccacatgtgtaacacgaagcctaacacattatagatacccaataggtgcaaagtgaataattttattataaaacaaaacttcaaaattaaacatgattttatggtaaattgtttattattgatcataagggctgtgaaaattcataggaagaagagaaaaataaaggcaattgcatttagcataagactgtaaagtggagttcaagttatttattgaatatattaatttgaataggcttgaaagagcatgtagggcattcaaggcaaaggaacaaggtgataatgacaggaatctgaatacgccattacatatttcatctgttatgaggttcctagcaacgactaatcacaaagtggtgtggagagagcatttgaaagcagtggtttagctatggcatcaagttcccacgttcgttccattttctaccctgagtctggtcctcaggttaactcttttaaaggtagcaagattttttgccacagtccactgcgtcagctacaaacaccatcctatcagcagaagagaaggggcagattcccaaatttgctgtttttctcagtatgaggaaagatttaacagatttacctcagccagctccccttaagtggccagaacaaagtcacaaccatttttggacttgggaatgggattaatataactaatatttatcatttgctcctacatcacacagggaggcagcacaaatctctgaggaagagaggaaggaatagctattgaatagggaaccagcagtttctgacacattttaagaaaaataaaaaatagatttgtataagtgttttgaggacgattaaatgaactagatggtctagaaaataaggcattgagcattttagacaacgtgcataacttctatacttctattaagggagaagattttccttagagacagttgcatttgttctttttaagagttgctgcaaattgttgcccacctactgagaaatcagtttttttttttttttttttcagaagaacatataccctgttgtcaggaagctatggagtatatggtaaaatggaaatttttattttccaaatgcatatgcagccccctgaaatataaatataagttcatggaatagtatttaaatatttgtaaacaaaacatcccattgtacattgctttttcaattactccaacaatgttcttcctcatttctcaataaaatggaaaggctgacttttcaaagaaataaatcccttttttgcagcctcttcgatatgtttagtgctttttattgagtggaactcttcacaattaactgtggagctgcaacctcattaatttaacaaagaaatatccttacttccataaacataaagcgtaggcagatgtgtagaaaacatttctcaattttattcacccaaacacacaagctttaatgatcctttctacattttcccaggaaatttggtctagttccttttctctgtttcaattaatctgtaacttaggagaaaaaataataatcacaaatgcatttctcagaagtttcaatctcatacctaaacaatgatctcaggatgatatcatatctacttattgatccttctaacaccaacaaattgaaataaaccactgtaaggtacagcactgatattcttagtctctttccagttattttcaaattattacgtttctataaatcaggtttccttaaacatttatacttaccttctgtcttaagaacaagagtaataaacacacaacttttaaaatgcatagcatgtagtgtaaaaataatcacattgaatattttgttagattagcaggcaggtagggatcttatcaattattaagaaggaatttattaatataatgcttgagactagtagatgtccccgttttagagccattacacccttttaaaaccagtataatatcattttattaaactaaaatgaaattcatagataatataacatacaaaattttaaaaatctatgtaatgaactaactacaacataaaagagaaacaaatgtttgcaattctaaactaactttcatttctgtatgtagatgcttagcaagtctctgtgatgtattatggtggagtagttagatgtttactcctacatacagaatcaccccaggtcctgtgttgccaatgccagtggtgcctaatcattgtaaccgccagtgttctccaaaagcttttttttttttttttgagactgagtcttgccctgtcgtcaggctgcagtgcagtggcgtgatgtctgctcactacaacctccgcctcctgggttcaagctattctcctgcctcaggctgtgagtagctgggactacaggcgcatgccaccatgcccagctaatttttgtatttttagtagagacggggtttcaccatgttggccagggtggtctcgatctcttgacctcgtgatccgcccgcctcggccctccaaagtgctggaattacaggcgtgagccaccacgccaggccaaaaacagatatttaaaatgtgctttctgggagaaccactgccttggattgagacgcttttcattttagtgcaaggaattatggaatctgagaatgaataaatagcaaggaagaaaacctttaacttatatttcccaattctttggcctgtgagtttaggtttgctgatctcttttatctaagacacaattctaagtgttattccaaaagtgaaggaagaaatatatgtgaactatactttacgaaagactgtgaaaattatctaaattattacataaatatagggtagatatatctccattaaaatgtttcagaagagtttcaaatacaatgatatatatacattacacaacaaggaaaaacatagctacattatgacttggtatttgtatgatttcacgtaagtaaagtacatttaaatagcattgagggaaatacgccagaatcttcacagtggttaattctagattttaggattatggtaattatgtttctttctacattcccccttcttattgatgatttccaaaatattacaataaatgatttaaacacacacacacacacacacacacgaagaagacattagataaagccagagaattgacaagggttgttgttcatcaattatttactttttattttttaaatcttccctgccacctgttttttcttctcctgaatgcatttactgtgttacttctgtgattattcttccttctcccatcagttaaatttggatattcttcagtgttcttccctcagtttccctcttctttccttttttaaattctttctcactggtattattcacacatgtgtcctctcttctaagctccaaaacaactgtagtctcaagatgaagttactgattcctaggcactaacttgattacgtcctttggtatcaggtggcacttcagacgcattacacctaccattaagctcatcttgtttatacattagcatattccttcttatgatcactccaactctcaggcttaaaatgccagtgatcactgcaaatcttacttcctaattagtgtataatattgattctttcttcatgacaaccttctctaatactggctctagaagtgttctttttttaaagaaaaaaaaagtataacttttatgtgggtatatccagaatttgtatcagaggaactcaagggtggcaattttgtagcaagagggaaagttgtaatttcaaaatatacaacatttttagtggagaaaacattagttgtttatgttaaaattagaggaggtgaatgaattgtggggaagtgagtgtttaaacttccaccccataagtcactcatcttgattcccattcctgcagtgagcaccgcaccaggcccttgaggcctcatcactgtattctgcaaatggccctctctctagggttgagagcccttaatgtagatttctggcatcgcatccctagaatattttatctttattaagagtttatcacattacttaactgacattattccttgttcaaaaaaatgtgtataattgctctattttaccaataaaatggagatcttcagttattatttgagtgcttgaaacccttactgaagtattgcctttatcttctccccaccaactacgtatccacacgtgctacacttgagcataaataaactactgttccccatatatgcttgtgtcatttcctatcatacaatactgtgctctcttgttctatctgtagaacagtctccccaactcaagaacaacctctatggcagtaattctttgaatcttcaaacagtatagcagttggtttgtagtctttgtgacttttgtttctctgtgctctgcactttgattatttaagttcatgtattagaaatcctatttggccctaggcaacttaagggcaggtatctggatgattatttttaatgtttcccagagcataaatcattgccttgaacatactagaggttcactaaaaattccttgagtaaatccacaaataaatacagatgatgatatttgtgttgtccagtgtactgttaaatacttttaactttacatgttatgttttcagactgttgagttgttttttaattaaatttatccctgttttcttaacattttttgttaccttctacttctagatttccctttttctcaactgaatttacctttttcttcaactgtctcagacaatttttctgattttctagtgagctggtaatattgtgctaataatatgatatcagttttaaagtgtgggaaaaaaagtgctctaagttttaggaagcattgcattgaaaagcctcataactttataagatctttcttttttgttttatttctcactgatttgccaaaatattttcaaattttctctcaaacaattaagtatccaaattttgatcacggcagaacttcatgttttctaagatatggtttatctgattaatatatttttcagtaattaatcaaataggattataattgtggcaaagtttaattttcattttcacattatgttggtgaggaaagaagatttgttaagaaagttacatattcactagtaaccaatttttttttttttgaaatggagtctttctctgccacccaggctagagtgctgtggcataatctctgctcactgcaacctctgcctcctgggttgaagccattctcctgcttcagcctccccagtagctgggagtacaggcaggtacccccacgcccagctaatttttgtatttttagtagagacggggttttaccatgttggcccagggtggttctcgaactcctgaccttgtgatctgcctgcctcagcctcccaaagtgctgggattacaggtgtgagccaccgtgcccggcctagtaaccaaattgttttatatatggctattattaaagattaagattaatattactttgcagcttgagatcctgagtttttctaacatttttgaaattttggaattatcataataaaaagaattacttcatactttttggtgccttgtaagagtttttctaacatttttgaaattttggaattatcataataaaaagaattacttcatactttttggtgccttgtaagagtttttctaagagtctccaaagacacattagcttaatcagtgaagtaaaatatcagtagatttaatgataattttgttattttggaataccatttggatagtaagaaaattttataagcttatgtttaatatttatttttaaatatttgaattatttaatgtaaacacaataatgctgaataataacatttcagtcaaggatgggcctcatacatataggaaggtggtcccataaaattctagtggagttgaaaaattcccccctcctagtgacattttagctatcataacactgttgcacaatgtattaccttttctacgtttatgcatatttagatatataaatacttaccattgtgttctaatccctgcagtattcagaacagtaacacactgtaacagatttatagcctaggagcaataggcacacctcctaccaccatgcagtttaaaaccagataatcagtatgttgagcccattgagcactttagtactgcatcctgcattggtatgattatcttatactttgcacatttttattttataataatttgtattcattcattcgtctactttccaacccacttgttccaggtcaggatagtgggtcgctggagcctctcccagcagctcccaaatgcaaagtggaagccagccctgaacagggtgccattccatctcacacacacccacactcaatagactgtgatcttttagacaagccaattgtattaggccattcttgcgttgctgtcaaggaatacctggagctgggtaatttataaagaggtttaattggcttatggttctgcaggctatacaggaagcatggcgccagcatccacctctggtgaggtctcaggaagcttttactcattgcagaaggtgaagtggggggccagtgagagcaggatcaagagagtgagggggacaggtcccagacttgtaaacaatcagatcgtgcgtgagctaactgaaagagaactcacttatcagcatgattcactgggcagggattgatttgttttctcatcaacattataatgaaatggtattgaataaaatgatgtaactccaggacctgctgtactttaaccaagaatataaacatgcatgaactagtgtagttattggtatggaatcaaaggaatatatatgagatctgttttgatggaagcaacaatcaaggtggagtctaatatgaatttgatgttctgatactggtccagctaaataatggggttacagtaattatattaataatttcaaaggctctataaaatgtttaccatatgccagatatagcttcccactcttttacatatataaatgaatataatctttataacagtatcgtggtggtagcattacttttgtccctatttcatagatgaagaaaatggagggttggagaagttcagtaaactgaccattatcacccagtaagtggtaaagcttgattttgagtccactgaatctggctgtgggttttttgttctttccttactgtactagggaaacagaagatcagagagaaatttagtcctgtgaagaattttgaattgaggttatgccaagcacatagatttagaatacattatctctaaatctcacagcaattctcacattgattaactcttatgctcttaaagaacagagaggatacctgagttatctaagcagaaaataaatgggagtcagagctgcaattcaacctcaggtagcacatggttcaaaagtccctgctttccctactttatctggtataaatttaaagagtcataatttttatatggttcttccttgggccatttatttactcataaaataaaaatattggaagttgcttatataccagatacaatgtgaggtactgagatttttgtgataaacagtaattgaggactcttagatgacaaacaagcacagaaacaattgcaatgttgcaggaggaagtggaagggacataatactcatagttcttttacagcatttaccaccgtcatacatttaatccaggtggttgtgcacaatcatctccctagtacttcttgatatccgttaggacccagagtatacctttgtcttttctaataataaatgtggtaccctgtacaaagtaactacttcataaatattagcagaagtgaattcaattcattgcaaactttgtatttcaaaatgtattacagttaggtctgttacccaaggctaaagaataacaagacattttttagttgaaatgagaaagtaaataaattttattttccctaagacacagtcttcttcctgcagattcaatttcacgggcatgcaacctatgtggccacagagtcccatggtcagaagggccaaatgcttagcctaatgctatgctgtcactgtcttgaaattcttaataatttttgcactattatccctaaattttatcttgcactaggctccacaaaatatatgtggctaatgtaaatagcctttttggaggagaggtgctgagaacagatgttaagggaatattaaaccttgggttcaggtacaactatttcacctcttctagcaaccttccacaagaaaaccctcacacacatatacttcacatggaggtcagtgtcttttttctatgttctcctagtgcactcatcactcactttgcatgcaccaaaggttgatgtgttcttatctgtgccctgatagtgctgataatggggtcttttggcaagcaatcattgcaattacagagactggtaaatatgcttatatgattttggaggaatactggtaaggtcgaagtatatgacctgttaagaattttttccttcggccttgagatcaaggccgtgatctttaagaccaagtgaaatcttggcacattccttacctgccagatgaccaaaaaattaaaagtaaaaataaggtataaatcttgagagggaaattctgattttgtcaggaggatgcaccttgtagtaacgattcaccaaaggctaatgaaacgtagaaggtgtgggaaaagcaacagcagcagcagccacagaaacatgagaaaaggttgcctcccaataaagagtggcaaacgcatatgttatgtaagacctgtacattatagcaactcggagcaatctaggcactgagtagccaaatgctgaagactagtgggaaaaaagaaatcactgcatgtcaaggtagaagaggatgagaaattaataggatggagaccttgaatttaaccacatatccttgcaagatgtttactgtcatttttaaatttttgcttaagtaaggaaatcaatgtttatcaattctctactcaattttgctttcagagcttatttatgttatacacaaaagaaatatatgatacagttattagtctcttcattgggcatcagtgaaaataaatcaacacaaaaacacaacttctgtaaaatatttggttgagagaataattagttaataaccgattaaaaaaattgaattggacattagccttaaactgataatattagtgtataaataccagttcacataatattagtaaattcatgagagaacattgaagttatactgtattcaacatagcaggccttttgtgtctaatcttaattccaatgacagcaacataaaactaattgtaatttctatatctagtatacaaatattttataaacaattatatttatagcagaaagcataccagctattatgagccactgtaaaatcttgtaaatagcatttatatagtatttattatgtcttggcaaacactttatacagataatcatatataactataagcactttatatagatcaactattttattctcatttaacgctttaatcctataagataagcacaatcattatactcattgtttagacaaggacatggacgaatagtgttttcacgacttgcctagtgtttcttagcaagtaaatgacagagtcaaaattcagtctcagtcccagacaccagggatccagattttgtgcttttagccactttactgtatatcgttgctgaagaaagtcatttcgcattaaacaagcattaaataagctaccagttagcaacttgtgttaccatgttatcattagaaatacattggtaattttaaagtatctaagtgtatttttaattaaagtttagatagcgagtaaaactctaaacaatacgggacaaatatccataccataaatatttcacatgtaactttactttttatattaaatgagtgttaacatttaaaaattgtcatctgggctagccttgtcatttggcatactctgtttacttgcaaggtagtctttataggtgcaggtctatgataattattaaatatcagtttttcaatggttttcctagccatttattcagggaacagatagacatttactatggtgaatctggaacgtacctaaggtaatataccactttttagaaaaattctgtttctctttttggagtctaataccttggggtataataagtgcttaataaatacttttaaccatgatgattgtttttaatagataaatgtaaaagttcataagaacccacttcctcaaatattttgttcattcatatgtcactaattctgaatattatgtaaaaagagacaacggggatattcattgacatcaagaaccacttatgttttttaatgcgaatttttttcttttaaatgggatgtcttattacaaagtaagtagatcagcagccccttgaagttattatgggcctgttgtggcttataaaacagaaaggcagtaaaaggcacagaagcagaaattggggatgcaaaagatttactaaattttacagttttctcagcattaactctgttcatagctgtaagtgacataataacttattgattattaatcaatttcagccagtgaaatacattgtgaagttttaaaattatttgcttatcagatcatgtgataaagacagctaaatacaataacagaacaaaatccacaaatcccttatacctgtgcaagttgttgtgaaatgtttctgtattaaggatcttagttataagggaaaagaaaaagttatagcctgaaaaaaaaagaaatgtgtcaaaggacaaagtacttcatactgtcaggaaggtaatttctgatgtattgtgctcaccagaaaaaaaaaaaaaaaaaacggccgggcgcggtggctcacgcctgtaatcccagcactttgggagaccgaggcgggcggatcacgaggtcaggagatggagaccatcctggctaacacggtgaaaccccgtctctactaaaaatacaaaaaattagcccgtcgcggtggcaggcgcctgtggtcccagctattcaggaggctgaggcaggagaatggcgtgaaccccggaggcggagcttgcagtgagccgagatcgtgccactgcactccagcctgggcgacagagcgagactccgtctcaaaaaaaaaaaaaaaaaaaaaaagccttatgtctatgaaagattcctgactttgcaggaaatgcaggaaatgaaatcgagacctaaatcaaacacagtgataaagatgtgccatttgtgtatatctgcctttctaaactgaagaatttatagactgaacaaacaattcctaccacttgcggtcctgttactataactttggtcattttcccctttgctctaggattagcaattacattgaaattcctacatgaaaaactggaacaactgcacaccttgaatccaggtagacctggatttgattactggggctaatcaggaaaacagaacaaatgtgaaatagtttggtggtctctggtgctagttttgctttggaaccaaatgataaagttgttgaaaggtctgtaaggcacaaggaaccaagacgaacccagaaattcacagagtagaaagctgttacctcccttaagactggcaagtcagagagttgaggagtgttacagagctccagagtagagaccaccacttgggaggagctggaatcatagtgaggctgctttgtgagagctgagcccaccaagggagaggttgtctatcaggagctgaaatcacagaagaggcacttcatctgcggggatgctgcttagagcagaggaagggaacttactttggcttctttttgtcaccctccagtttcctgctaggtgtctcattagctaaaggctggttggcaacagaacttgagcaacctagtttttatgtgttggccatttatgatatagaatagagcagaggaatgacaaacaatggatacgaggagaaaaagccaaagcaaaatggagaaaaacaaaactaactcaatgatcttggtcaaatagtttacatacctaaatctccatttcattttcttcaagattggaggaatgctatccaaattacagcatttttattaagattaaatgaaatcagattaataaagtatgatatccctggaatatattaagtggtgtattaataatgatttttcttccccaattttgcaaacaggagccaatacatgagaaagaaagaaaatgtgttttttgttgtttagtttattgttttactaatagttccttagtgcagacctatcataattgtatgacttcttcagtattttaggtgcaatttttaaaagtagtatcaatataacctttctaacaatttatcttagaaaagttaatcggtagtccaatccatctcagattacaatccatagctaatataagtatacctcatttattgtattttgctttattgtgcaaagatatacagagtacttgggtattctgtgtatctcctaaatatctgagcttatatatgacaacagtagttacatcatttttatggaacaaagacttacttagtttatcacacttaagagtacatgttacattatttttgcattaaaaattgtcaaaatgttgatcaattgcacttataaaaaactacctaaaaactggccaatttgaaagaatgtatgtaaaagaaagctcaatgaataaaaatgtacaatatttgaaaaattggaatcaattttaatatccattaacttagaaaccaactaaatatgatttaagtatagaatactatgaagtcattaaaattatgatacttatgtacatctacaaatggtaaaagttgtgtatgttatattactgaataaagtaagcatattacaaaacatcatggagccatttttgttatagatgtgtgtttgtattcaggtgcagaaaatatatacaaaaatctaatgataattgtagctatatctgggtggtgttattatggtttatgtttgttgtaccctttctgtgtttcagtactttctggtactttataataatttttttgagattgttacattaactgtttaagaaactaaatgccaaaaatggcaacttttactttaagaaatgggttctccaattttcattgcttatttattttattatttcttgaattttaagataaattatttgtatagaatttctattctaggacatgtagtacatagctgttagttgaatgagagagcacatataggagggaccctagaaattttattaattgacttgtgacttatagatgactagaaacaactttcctctaatttaaacttaccaagttacacatacaggagtgaaaagcagggttagttctcttaaagcatagttattgtttaatttagttgtaatagatattaattaaatacagaaattatttttaaactttaacaagggcatttctctatgatctctgttgccagacactaggaagtaatctctgaaggataggaagcaaagcataaatcaaataagatagtctctgttgtacgctggacaacacaacagaagattgaaaatgtgttgctattgtttttctgtttttttttttatttcttattttgttttttggttgttaatatatggctattcagttaatatatgactaactgttgttttcttttgacattaaatgtgacccatgttgggaaggctaaaaaccagctaaatttacaatgcagagggtaagaaaagttaaccagagtccacaaagttgatgaatgtaggagcagaaaggcaatgtcaaatgaatgcttttgtgaaattagcagtgacaaacttagggacagtttgtaataaccacccctgagtttatagccctttacatttcgtctggcataatatatcattctatttttattttaaatcaccaaatgaggcgagttagggaaatgcaggtcagggcaagtacagttatctttatgaggaaccccaggctcagagaatttaataacttgtctaaatctctgactttcaaattagtgccctttcccctgtgcctcatggccatactcgatcacttcaaataagtacttaaaactctgtgaggcatttggaaataacatattgatatataacatataagataatataatatagtagaaatatttctgaacattaatgatttctacccaattagatactgttagtacacctatttatctttaaagaattggcttcaaatcccttatcactaccaccattaagactgggtcttttgtcactatctatcaaatatcctatgggcataagtaatttttgttcattaatatctatcattctcacaaaagtaaccataataattataaaatgctgttttcaatataatgcattattgattaatctcattaatatgtcattattgttagtagtactacccatgtataatttaaattaatgtgtgtctaaaacattgattcagtctgagggaacttggatttctgattataagcaattatgaaaccttaacacccagagttaagcctgttgaaatatatttagaaatacttaaactctgaaataaatgtaatagccccttgtggcataagagaagcagtttctgaccatctgaccatttttaggtagaaacaaaatctcagtgattaaagtgctgctctattgagaaggatggaaacgtctcgtaatatcttaaaagataagacagcgctaacatgtggcatacagaagacagccatgtcaggaaaaaagaaaaatttacacaagaggaagaacaatagtgacagtgttattaatggccacggaaggagtagctgtttgtgtcaaataggcataccctgaatagtaaggaagaaagtccggggtaggtggtaaattacaagtattttttaccaaccccgtctcctgtggatactaaagagccccccagtattagcacttaaagttgtgtgtgatcaagagatacagcagtcattagtgtgagaaaggagattaatggtaagtaaaagtatattgttcttaatataattcatttattcatggtaagtaaaagtaccttttccacctttcattccatataggccccacaaccatgcatattattattattattaggtttctatctttttttaaaattatactttaacttctgggatacatgtgcagaacatgcaggtttgttacataggtatacacgtgccatggtggcttgctgtacccatcaacttgtcatcgacattaggtatttcttctaatccatgcatattattaaactaaatatactgtatactaatttaagaggtcacacctaaaaaatattatcagatatgattgatgcaaaacaaataaaagccttacctttctgatgtatgtatgatttggaaatgttctacctaatgcatagttgtcatgtaggatcatccactattacctctactcctcccccaagaaatgtatttcaattttactattcttgcccctgtaaattagagattatgtactctgttattgaaaatacaaaatggtgagagtgatagatgtatccaataggctgtaatataatgagagtacaaatcattataaatatatacttatatggaagttacttcttttacctggggcatgtatgaaatactagcatttacggtagctcttgagtgatgagtggaatgccagctaagaaagagtaagggcagaaaatcaccactaagataaacgtaggagaagagacataaaagtacattaatatcaggcttgttgagtagagtgagggaaactaagagatgtaggtgcctgtgtatagtggtagaagcttatatgcatatttggattgtataagcatggaaagagagggtgaattaacaaatgaaattgggactgtagtttggataaagatttagcaggcaagctgagtattttggacattattttgtgagcagtcaggagccacgaactttatgttcagggcaatgacaagaacaagataacttacattgagagacatgatgtgatttttcaaaaaattaagtattcatagtccttcaatatataaattggttttatttctttttcatctattctgtttaagtgcattggttttaaatatgatataatgtgatattcattcaattttattcaaacagcatcaatatttaaattgtctgtaatttacatgaatggttcaacatagatgttttagttgaattaatatcttgcaataacttcagtggaaatgcttttgttcctttgaaaaatatctactagttaagtaaatgtatccaactgtgaaaataatgtgataaaaatatcttaatatacattaaagttcattggttttgaaaaataattggttttagatacaaagctattaaaattagtaaaaatgcctaatttaggataaaatttgttcatttctgtgcaattacttttggctatgatagaaagtatttgtgatgaaaacaatattatgactttggtgacagtaagtagtacttctgtttcaggaaaaataaaatagatgagattcataaatttaatggaccagtaatttaaaataagcatccaagatgagaagaacagtcgcctaattgtttccttttaactagaaacatgcagaatataatattgccacagagttgtctatgattgcatagatttcaaagtgttttcataggttttattttatttgatccccagggtaattctttaagataggaaaaacaagtggtaaaatatgttaatattttaatgacttttccaaggtttcaagtctgacagtaggacccagttgtgtttttattttattttttatatcttctttactgggagtaggctattattagactttcttttgcacaaaagcattccaattttttttcagtcaaggcattcaaaaactagtctactaaatacgtatgaagggtgtatctgatttttctcgctgtcatactgcttgcatttggatgcattaagacttaagtttattatatgacaggctttagtttccttgctgatatactttgcagataatgatttcaagactcttgcaaaagcattgtagttctcaatttataaatttaattaggaggaatgtcctgttataagaatttaaaatcacaatcatatctgttgtgtatgtgtatacagtgctacactttattagctatcactatgttctgtgcatatttgcaagtaatgtgtctgtgttaaaaaacattattcaatctacactgagttcacttttcttataatccaaataattggagttagataaatatcataaagaaaaccactggtgtatccttttatccaaatgtcaccttgtgtcttttaatccaatgtcccttgcacatacagtccaacaatttttttagtgttagggaggcatacaaatatgtcaaagtcatcaaccattagacaatatgagtacaaactgagatggggttggagattatatacgttccactggaaaagagaagaacaagcaaagcaaaaatatgatgtattaccactaattcaaaacctgaaaattttctctagggcagaatatatttcacttacctatacattattacaatgatttaattttgaccaagaccataaggatttttttctgtgatatttacataattttgaaatcaaatccataatagcataccatacataatacaattttgtaacatccgtgcatttacagagataataaatttcttcatattttgagttataaaaattactttaactatattactatattctaggtgaattaatattagaatgcttcaccaaaacctttatatctatttttgaaaacttaagccattattgatacaattaatttgagaaaatttattttcaagaaccatatttgctttattttggtaatagaaagcaccttagttttaaatgctaatgtctttcctacataggtaaaacaatttatactttaagttaggtgatgtctttctcttaggattgaaacctgtataaattgaaggtaaaaggccagtttacatagtaagaaaagtggtgagataaggaagtaaataagattttaaaaatcaatataacattaaactaaaaacaattaggtgggaattatactccttatataatttctgagcgaaaaaaaactaaattttaagcctcaataaatttgctgtatctaggttctgttagaaaatgtggaattctatatatctcatttgccctgtagttaactgagagggggaatagaggtttccttctctaaataaataattaagcagcatttaccaaatcagagacaacacatttctcattcatggcttcaataatctcaaagagttggactttttggtcataaaaagatatttgttgacttacttactgatgaatgtttaggtctgtaaactggattgaaacagatgaatttccatcaggcatatggtattattcctgaagaagcaggtattaaccttgagaagcgacatagttgacaaagtaggccatgcaagacagtgtaatcagagcagtacaggttggaagtctgctttttatttcctcgaggtacccagactaattttccacttacatagaccacaacactagtggctgaaaaagcagaagactttatgataaggtcacctacaccacaggggacaactgcatgaaaagagaaaaatcagctctctgctacgaggttttcatcgtctgacttttggcaaataaaaactgctagtaactgctgtttgtctctgagggaagaaaacgatagtcttcgattgtttaatataaaatattaattatctgattcctgaattcttcttaaagacaataatgagtcactttcctttaatctcttatgtacatttttctttcaattactttagtctatactcgtattcatagcatgcttaagtttcccataaatcttaatagaaagtatttttcagagactaaaaggtttccacaagagatactaatggtttcacactagtcaccaacttgattttttctgcttctcagctgtctttagtttcacagtccagagaccatctgtctagacaggtgttatcgcactggtatctaaaagtagaaactgaacatcattatttttgaaatctatttagaaactgcaactctagtgataaagcagtactggtctaagttgtgcactgttacaaatcacttccttagaacagatggactacaaaatggcttattttgcatgggccagctgtgaacttaagtagagaataggaattgtggatgtcaattacattgcacagaaattttcagtcaagaaatttaccagataaatcaaaaggagtttgttatgagtaggcatttatctcatggatttattttttaaataatgtccactgttaatacagggaaagacaaatatgaattaatcttaaagatattagtataaaagtaaattctgctaaaaaatacttcaaggcatataaatgtatgggccttgactatactccacaaattttagcttgaaaggcaccattctcttcattccaaatttaaaatacctgggtattgatatctgagtcttttctactgtgtaatattggagaacttaccgttatgaacaaatttatagataatgttgcaaaagaatagttaattccattacatagtcacactgtgtcaccccaggaacgtctttacagcataaaaatataatgtgtatacacacacacacacacacacacacacacacagcataggcacttagcacagtgctgcacacatattatacaatctggtattgtgttcattgcccagactcccacttcctagttaagttgccttgagacccttacttgaaattgtggtgtcccagtatttgctgtttttctatgtaaaatagggataataagcctttcctaaatcataaggttgctgtgatgataaatgacacaatacgtataaatcacttcgaaaaaactgacatttaataagaaggcaataaacattagctgttatcattgctgctattatttctgtattcaaagtgggttggcatgttatgttacaaatcacctgaactcaaagtaccttttcctgaaagaaaaatagatatcaaatttggacagatttggttgaaatcatattctattatttcatagttaatgttggtgtcttggtacattaaatcgtaatttaaaacatactttttatggcaaagtatggatctgagttaaaatcattaaacatttgggaaaaaaattttataaagtaatgacccaaaaaacaatcaacgcttctttaggacctgcaaacaatatttttaaagagagaggaaaccacttatctttctaaataaatattttttctacatgtggtttaaaatattttttctctctctctctttctttctctttctctttctttgccagccctgctcccaaggaaaacaatagataagaaataatataaagcaaattccagagaggtagggggaacctaaggtaaagaatcaaatcatgtaagaacaatattcttcaacttcttgatctaacataaaacttaaataaatgttagcttattttgaccttggtgtttatgcatactataaatcctaaatatattgttttttggctttcatttgttttttactctatattaaatattgtaattttcaattagaaatgatatcatagcataattgaatgtattttaggatgacattattacttgtaattagtaatctattaagctttaacaaggtcttaggggctgaagcaaataaaggagaaaataaaatcaactttttgggatccaatataatttagatgagcaggaaatataaaatatgttgaacaaaggctatttctccataatacgtttttaaactactataaaaatatattcaaataaaatttaaaccaaagtgtacaataaaatattacctacttataaatgttgcacaaataaaaatataaatagcatactaaagaaaattaaataaaatgcacttggagatatagaaacatagaactatctctgatgaaaattgagtcattctaaaatgtgctgaaatatatttcttacatgacttttgtaaaagcaataagaattaatatgattgtattagtccattttcacactgctgataaaggcagacctgagcctgggtaatttataaagaaaaagaggtttaatggactcacagctccacatggctggggaggactcacaatgatagtggaaggcgaaaggcacatgttacatggtggcaggcaagagagagaaggagaaccaagtgaaaggagtttccccttataaaactatcagatcttgtgagacttattcactaccatgagaacagtattggggaaaccacccccatgattcagttatctctcaccagtttcctgccacaacacatggaaattatgggaaccacagttcaagatgagatttgggtgggaacacatgataaaccatatcattctgtccctggcctctcccaaatctcatgtcctcatatttcaaaaccaatcttgcattcccaacagtcccccaaagtcgtaactcatttcagcattaactcaaaagtctacagtccaaagtctcatctgaggcaaggcaagtcccttccacctatgagcctgtaaaatcaaaagcaagttagttacttcctagaaacaatgggtacagacattgggtaaatacagctgtcccaaatgagagaaattaaccaaaacaaaggggctacaggccctatgccagtttaaaatccagtggggcagtcaaatctatgaactacaaaatgatctcctctgactccgtgtcttatatccaggtcacactcatggaagagatgggctcccatgaccttgggcagcaccacttctgtggctttgcaggatagagcctgcctcccaacccctttcacaaatcggcattgtctgtgacttttccaggcacatggtgtgaggtgttggtggatctacctttctgggtgctggaggacggtggcccttttctcacagctccatgaggcagtgccccagtagggactctgtgtgggggcatcaatcccacatttgccttctgcacttccccagcagaggttctccatgagggcctcacccctgcctctaacttctgccaggacatccaggcatttctatacatcctctgaaatctaggaggttcccaaacctcaattcttgattttgtgtgcctacagtctcaataccatgtggaagctgccaaggcttggggcttgcaccctctgaagacacaatctgagctgtatcttggcccctttttgccatggctagagtggctgggacacaaggcaccaagtacctagactgcagacagcagggggttctgggcctggaccacaaaaccatatttttttctcataggcctcttggtcagtgatgggaggggctgctgcaaaggtctctgacatgccctggagacattttccccattgtcttggcaattaacatttggcacctcattacttatgcaaatttctgcagccagcttgaatttctcttataaaatgggtttttcttttttaccacatcatcaggctacaaatttttcaaacttgctgtgtttcccttttaaaactgaatgttattaacagcacctaagtaacctcctgaatgctttgctgcttagaaatttcttctgccagataccctaaataatctccctcaggctcaaagttccacagatctctagggcaggggcaaaatgccaccaatctccttgctaaaacatagcaagagtcaccgttactccagttcccaacaagttcctcatttctgtttgagacgaactcagcctggatttcattgtctatatcgttatcagcattttggtcaaagccattcaacaagtctctgggaagttacaaattttatcacatttttctgtcttctgtgccctccaaactgttccaacctctgcctgttacccagttccaaagttgcttctacattttcaggtatcttttgagcagcaccccactctactggtaccaatttactgtattagtccattttcacggtgctaatgatgacagactgaagactgggtaatttatgaagaaaaagaggtttaatggactcacaattccacatagatagggaggcctcacagtcatggcagaaggcaaaaggcaaaaggcatatctcacatgccagcaggcaagagagaggagaaccaagcgaaaggggtttctccttataaaaccatcagatctcgtaaggcttattcactaccatgagaccagtatggggaaaaccaccccagtggtttatctcccattatctcccacaggttatctcccacaatacatgggaattatgggagctgcaattcaagatgagatttgggtggggacacagccaaaccatatcaatgctgtgtttctgtgtcattgcttgaataaaactttttgattatgttttctttgtataatgtatgtatacactagcacagcaccaaggtggtagtgggcattcaataaatatccattctcttctcacccctatgccatgctgttgcctttcctttacatctttttcttcaggtcaaatatctttattattttcatcctttaaaatgtttctttgcatcatcatcttatttattctcccatgtggaccttaacaattttttatttcaatttagaatgagatttatagcatggattcatataaattgaaggaaattttcacaaatatgaatatcccagtgtagtgagttgaattgtgcccttcaaaggatttgtccaaatcttaaccctggaacttgtgattgtgaccctatttggaaaaaagggtctttgcatgtttaagtaagtgaaatatcttcatatcagatctttcttgtttaaccaggtgaaccataaatctaatgataggtgtccttcaaaaaaaaaaaaaagatgtagatagagaaagagacacataggggacaaggtcatgtaaagatggaggcagagatctgtaaaatgtatacctaagccaaaaaatgcatgaagccaccagaaggtggaagagtcaaggaaaattctcctctatcatcttcaaaacactgtggcttggctgaatccttcattttggtcttctggcccctagagctatgagaaaatacagttcttttgctttaaacctccaattttgtggaattcttttatggcagacctaggaagctgatatatgtagtttgatcagtaaatgcatagaaacaaacattcataatgaacatcatagcaaatgttaagagaagaaacatggaggtagacgtgggattaaatgtattttaaacgtcatctgacataatggttgaaagtagttgaatcagataaattaatgagtattaaagacttttgtagttcatgaagagctcactcaccctggatgtctcaactgtagcactgttgacatgttggactggataactattggaggctgtcctgtgcatttttggatgtttagcagtattcccgtcatctaccaagtagaaggcagtagcatcctgagttatgacgaccaaagcgggtgtagcattggggcaaggaaagatgttggtcaaagagtacaaagttccagttagatagaaggaatacattttagagatgtattgcacagtatgatggccgtagttaataatttattgtatatttcaaaactgattttacatgttctcactacaaaaaaaataagtagttaagtgatggatgtgttaattcacctgatttaatctacctacaatgtgtgtgtatatatatatatacacacacacacgtgtatatatatatatcaaaacatcagattgccttccataaaaatatacaattgttatttgtcaattataatttgtaaaaatgcaagaaagaaaaaaatatttttagaagatcaggactggggtgaggtgaatgaggcatttgccatgggcacaaatttaaagaaggtacccaaaagctgattgatcaggaacaatattttaatgcaatattttttaaaaattaaaaattatactaaaattaatgattaacaaaatagcaacttttaaaataaagacaagattagtaccattactaaatgttccctgttggtgaggaagtggtaaaattgccctctgttaatcaatgcaccgatgtaatataagtgatattgctgctgtgaaatcacttgatctgctctattctcattagtctcctcatcactaaaagaagtttagcattcttgtgatgaaggcaaccagatctcagtttgaattgtgactctgcacctacttgctatgtatccttagacgtgagtgtagttgtcagcaaattagattaataagtacacttatgtcgtgggatttgtgtagataactgagataattctagtaaggtaggtaacacagtgcttaaaaagtaatcacgctatagtaaccaaaagcataaaaaaattacagatgacataagggaactatcttctgtagtaatcaaggctttatttaaaattttaaatctacttgtgcaaagaatatgttatgtcctggacatgataagtgagctaaactgtactaactaccataaatgttgttaatattactgtgttttatgttaccttaataaatatcacagaatcttgaattcatagccagtcctacagcatcatattcctacaacatacttagcatctagtcatgcagcaactcttaagagatcttttaacagagcttgtgagttcttttattttttaaccccactttctaaatttcaaacatgacaaagacaagagcatcattttgctgtcgttttctgataaaatgtctgcaatatatgggcagtcaagagcccacttccaggataatagaagtagtaggaaaacctaaaccttagattgagtctggggtaatgcgattcagaagctgctttgaacaaaattagaaagaaaacagaattaataaggaaaccctagcatcccatgagacaagacagtaatctgaggatacactcagaatttcaagttaacttggagtgtgctaatattttctaggtttgtctatagacctgtagagaaaaataaaataatttctatttaaggacttagaacaattttcattttcagttagaaatgacaatgttattcccttataatcacacatgaaaaatctaagttaaacaacgtaaggggagtatctgcaaacttcatggtctaagaaaatctgtgttaattattttttaaaaatagtctgaaagaggaaaacatttgtcatctgagtgagatttgaaagagacatagtttaaagttttaatagaaaacacgaaggatttgcccaaagtctaagattttactcatgatgtcacacttaaaattgatcaaaaagtaaatacccatacaacaaatgggaaatatgcagaaaaatattttgtataataataggtatagagaaaataaagtgcagataacaaaatttcattagtgtaatatactcaaacatatgcttaagtacttatagagtaagagaacatgttaatggtttggccattgggaactgtgtgcagtattataaaaattatgaatatgtgaacaaattttgttacagactacattaattaatatattacatatgtacaattttggagaatattaaatggaatgtagttcctataattattttcttaagagtgatattcagatactacagtaatacatttggttgtcatttatatcaaatattaaatatttgctttatgatatagacctatacacagacatatatgtgtatatgtcacattcttatctggatgaattaacatatcttaaacagttagattaagcctgtaattttcttatctttaagtcatttcactgtaatgtcttatattgttgaaagcaactaatatcagtattactagagaaatgggttattttgcactttttcttcataacttaaagaacacagtagcactgagattgtaacatgatcgttcctctaaagagcactccacagatgtccgctaaaaggtattattaggtgtataaaattgtttaataaggaaagaaaaccacaatatcatatacatcttttgtaacattaacagtacaagactaatcctacgagaccaaaagtcactgagatgaaatataaaccaaaaattcataaaactcaactgaagaacaaaaatgtcacctttgaaggtacctatccaaaatgctatctgttatcaaacaagtgatagctgtaaatgttctcatttttattaccctgcccttcttataactcataaaactatatagatttttcattatatgtgctaggaaaactggaaaatgatgcccctagcatattgaagaataatagaagagaaatatgttacaaccttgtttaacagaactgacattggcacagaaaaatagtggaacatacatacatacatacgtaagtggccgtctatgaaagtatatctataacatgaacaaatttatgcaaaattaagattaaaatcatttgttggtttttttaaaatagatttttaaaacattttactttttcactgaaaaatgtatggagtatctctatgttcttggtactgccttttaagattttacattacatattttagtttagtctttatgtagttaataaataattatgcttagttatttctctatagctattaggctctaagaaacttaattcttgagtcatcataggatatattatattaactaacaaacattaatatttgcaatgagcttaaagtttacattgcagaaaaaaaaatctgggacaaaatggatcttaaactagtgtcggctgggcgcagtggctcacacctgtaatctcagcactctgggaggctgaggcgggcagatcatgaggtcaggagattgagaccatcctagctaacatggtgaaaccccgtctctactaaaaatacaaaaaattagccgggcatggtggcacgcacctgtagctccagctactcgggaggctgaggcaggagaatcacttgaatttgggaggcagaggttgcagtgagccaagatcgcaccactgcactccagcctgggcaacagagcgagactcagtctcaaaaaagtaaaaaaaaaaaaaaaaaaaaaaggaaactagtgtcatgatttttatttggagaggaaggaatgtggttatatttagcagaactggactatgaatcgtttgatgtgtgtattcctttttagtaagcttaattgtcttataatttaaaaatataaggtaattcctcagttgtgatggttgattgtagattacttggaagggaggatagctgcaaaggagattacagtggattagaatttgtatataacaaaggctttttgtaaaagtttgcccttcaccaaaaagcaaactacttctaaagacactttaatgctaaagacaaattttgaaattataagttgattttgatctaatttagatcctagaaagctgcccctaagataaaatatgatgcctacacaacaatgtgctggctcctctccttggttattttattagacacagccataggaacgttgacaataggtgtggattcaggcatttaggagaaaagataagtcttcttaaggttaggtctttatttctgtaacataagagagagttattgggggcgttactggaagtgtagtaaatcccatttttatatttttttaactatacactccacgacatggtttagttttataaacatcatagaatttctaattgtataagcataatatctaaaatgcccaaatacaaaattttacatagtatccaaataccaatattctatctttcatggatttataaaagtggcttgacttaagtaaagctttctgttgaagtcttgatttctctctttaattttttaacattgacaacttttatatagaaaaggaaaaaatcagaaatatagattttgtgttgaattaatgggaaatggaagttgtgataagaaaattcactaattaaatatctgtattactctttaggctttctcagcacttaaaaatggttatacatatgttttgatagcagcacaatgatccccaagattatatcaactaagtaaatacttaattagtatttaacttggaatatttattaagcatatatatacaaaaaaggctcatatgtaagtaaatgtagatacacatatacacatagtatatgtacatatgtatatgtatatacacatatacacatagtgtatgtacatatctatatgtatatacacatatacacatagtatatgtacatgtctatatgtatatatacatatttatcttttagtatgttttctcatatatgactatctgatgttgttacatgtgtatatatctagtcatatatatattaatccaatataatatattttatactcctagagacaaagaaatacattttttcaatcaataatgtaatttttggtagtttggtatattctaaacaaaaattgttgatttttaaaaattatatgtgtagaactcctcgcagtttatacactatgcccatgtacattttttcatatggtgcttacagtatatttgttagatagatatttttatacttttttttgcacaaaaggaaactaggaatgaagatacgtaagggactttccaaggtcacacacccacacagattcaaaagttgcaactgcctctttaaaccagataagccattatactcttgtatcccattccatcactcttgttttttaaaataagcaaagtgtgtctgaagaaaaccaagtgattacagacagttgtagatcacgttagaagcagaggtaatagaaccatcggcatttgaattatcagtttacttccaagccgctgctggatattgcttccctaggcacaatggcttccagtaaaacatagtctgcattgcttatatgtaaaagatataaaagtgaccataaacaattcctttttcttttcagtcatagcaaaacctctatattaatgtgaacatatagattaatgaaaaaaatgaacattagattcaacttataaatgaacatttcattctgtttttcctagaatctttactaagctcatctatcaagtttactctaaataatgtttatcatgataagtgctgaatttttactggtgaacaaaataatcagacccctgtcatctcagaattcatagactaatgaagaacatgagaaggtaaagaaatattcgaatagatgagaaagcatatctcttgagaaagaagggaacctcgctcggagtgcacagagcttgccatgacttcctcaaagagtagcattttagttgaagactaaagaatgcattatccacaccagatgaatggggttgtcaaggagaaagaaggaatactcaaatataaagacagagagaaaagcatatgtgaaggaaagaaagtgcatgataattctgcagaattaaaaactgtgccaagtgtttggattatggactggggagtggtgaaaagaagtaatcagcagttgtgtcagattgctgatttagtatggaatatctcgctttttcaaagcatattatatgacgtatgaatgtcctttaaaagcatgctatatgaacattaagtaatggtttgcattgtaagtattgtaagcaatgttggccttgggatgctaatagctgtgaggacaccacataccaccagcaaaggtggtacttctactattactgaatcacactatttcaaacatcatctgtaatttaggatttgagattatttttcagcagcacatgttcacacgggaaaatatcccctttggtttttcattcactcgtcagcagataattactctagaagcttttataaaagataagttggtgtttctcattactgaagaagttacattattgggaagaagttctgatcaccataaatgttaatatctctatgttccacatcttattttaaaaatgtttaaaagtattttagaaatggaaattaggaataacagaatgatatgatgtgaaacagagtacccagaagaactgtgatagaaatagatccatcattatagcatgaccaatatataaaactttgtttttattttttcttaagccactgagattatagtttgtcattgcaacataatttagcccattctggcaaatgtggatgttttcattgttttattcattaggaaacagttctcatttgtttagatttttcatagatagtatgaatgaaatttaaaattgtgtctacccatgactagatacatatttttagggcccaattcaacatgagaatttaagatgctattaaaatattatcaataatttcaatatggtgaaagcagaatattaaaacaagcgtgggatctaagcaggtgactctgtacaactgcacatgttgcacgcccatcagttccatcttgtgtctatgagatgtcagctctttgtctataagtggtgtgtgtttgtgtgtgtgtgtaggtgtgtgtgtttgtgtatatccttgggagtaataggagtgtaggagttggttggccaaaaaacttagaaaaggtacaaattctgtcctgattttacttcttttttacaagaaaagaaggacatttgaaggatgtttccccacttctccacaacctaaggtgatacatgttgaactttctttgaggtgctaatggaatttaggaattaaggaatacagaaaattacggagtcagtggggtatacaaaagtgaccttatactgaaaattcagtaattcagtcaagatcttcttattagaaatctattttacaaattgaatcttgggatatatttaaacatcagattataattatatatatatttaataaaatgtttgcactggagtttataaaattcacatggaaataaaatttatacagtttgggataaaataggaaaagtgtactagcctgctgatctcttaaatactgcgaacctatttaatacatctttaaaaaatgtgtgaattctatatttgtcctaattaataagacttttactcctgttgctgacagcacttgaattagcatgaccctagtcctctactagacaatcatgttcaaaaaagattaccagcaaaaatattcacctatgcagttcactaagcatattattttgcatgctacttgtattttctacatgaaaattgcataactcaacttctcccacaaataagtcatcaaaattattttaataaaatagattagtacagtacctgataattacattcaagaaagtatcaaatattttaataaaaactatattcatcaaagcctacaacaaatgttgaacaaagtagaaaagacatatgttacaccgaagatttcaataccacactgaattttattgtttatttgggtcattgcagtttataaattaacttatttcgataaaaatgtaataaacgtctattatacacacagggtctccaatagaaacttcataaattttaatggaaaaataaataagggattcttaatctcaagaaggttatgtcataatctgaaatacgctttttcctaggaaatcagcttatttgccataaatagaaaaggcaggacattaatcttataaatgattactctaattgaaagtataaaaacaaagatttattaaaacaaaaataattttaatacgagttttctattacagaatgaattaacaaggctagattgtgaatgcacacgtttcttttgttggcaccattattgactaaggtatttatagagataatgcatttgccactcgcctgaaagccttaaaatccatgaatgatattaagttttgaaggagatagttaaccaaattacatttaagtgcccttcagggatctaaacctagagttaatttcaatattgtaaaagcaatattgaagctacagcactgaatgctggcttattctatttttacactaagtaaaaaataaaagtaacttactaatgtttagcagatggtaatcactgaaattttgtctaacattgatttacatgtcaggtatgagaaacatcttctgactatgcattctttttactatccccctttttttaaaaaaaattatctccctttttaatttgaataggattgtactaaacgttacagtgaggtgagatttacaaatggcattatttcttcttttgtaaatgccaaagttcatgtcaaatctaaactttgcctcaatagtcatacgaaaggcaaccgtattaatggatagtttcccattcaggcaaaaacatgaattaactaaaatataatctacggtacttttaaaaatacatacacacaggatatagaagcatcatgccatcaaaattgtatctttttcagagtaacagttacaccttcaatgtgctcatactggtgatctgttacattatattccctctttgatgatggatacaggagttaacatctccacgcacttatcaccccttaatttatctaaattcttctcaaacctattttctatattataacttccattatttatatgagttgtcttgaaagcaggacctaagttaacatcttgagtgtgggaagtttattttacaggtaatgatggaacgcagtagtgaggaaagggggagaataaggcagaaaaaaaggaaaaggaataaagtactgtatgtgactaacttggttactactgttggcaactaagactcaatcctgataggaaccttctgaggaattatataaaatgcacctcagaattgcctatttgaaatctgtcagctgaagcatttctccattaactccggataccttggttggaggctgttatcagggatgtttacttacctgtaattccagtcatatttatgtccttgaaatgaaattttgccagtgaagttgagaattttctaccataactctagctgaaaccatgagtgagtcaaaggtatgtagcatggcacacaaatagcctctgctacaccatttctttgggggaaagaaaaaacccttaaaataaattcctaacttattacataaagagataaagaggtatttccctgtgtttctctaaaactaagtatcctcttgtaacactcacctaagaatactaagttttagtttttactttaattatatcctgagactcctaatgaatcccacagcacttggtgcatccctctcataagttacgcttatctattagtataatcattcatgtatttttaatgtttatgttagatttcatagtccttgtcagtagtgatttattttacttattgtttatctgtacaagggatgatactaattgaccttttgcactattactgaattgaattacatagagtatcttcatgatacctctatgaattttgatcaaatccatttcagcctttgtctttctagctctgcagtactgatttattttaatattactgtatgtggaagtgctctgctaaaattggatttactggcctttcaaaagtccctttatatcattcgagagatgtagtgtcataatagtggagaaactctcgtagtaagaaattgttaaatcatgaacctgacaaccttttggaaatgctcagaggtcttcttcttctccttttccttccttctctttctccttctcctcctcctcccccatcccatcccccttcttctttccttcctccttctccttttcttcttcttccttcttttttctttccttccttcctttttactctttcttccttctttattcctcattcttaaaaccatgttatagaagtatcatttttattcctaaaacatttaatgaaaaaaatactcgaattaaaggcatatccattaattatcttcttttttaaaaagtaaaataggcttgcatatagtagtaatcaatacatagccattcttgcttgatcggtaattagaactcaagtttgttcctcgtaaacattcatctgtcaagcatcttctgtgtgtatatatgtgcaagaccctatatgagaggttgtcataagtagcaatacagcttagtgagtatcaaacaatccgtgttatagactaaacatttgtatctccctgaaacgtatatgttaagtcttaatgcctagtgtgatgctattcggaggtgagaccattggaaggtgattggaccataaacgcaaaactcttacgaaggggattagtgcccttatagaagaggctcaagagagctcccttcccccttcttccatgtgaggttacactggaaaaggggtctttttaaccagaaagcagtccttcaccacatacagaatctgctgacacctttagattggacttctcagcctcccaaactgtgagaaataaatttctgttgtctataagccactcagtttgtggtatttttgttatagcaccctgaatgaagtaagaaagaccggggctaggttctggcttttcctgcaattagtcaactacttcatttttgacaaaatactttaattgaatttccatttcttcatttgtgaatgggcacaaaaataactatcttgtacatcttttagaaggaaaaattaaatgaaatgtaataacataatgcttataatatcttacatatagtatacatttttaaaatttagaggtaaaatataaattagaaatcagtgttgacatcaaggggcatgccattcttagaaaagataaaatactggccgggtgcggtggctcatgcctgtaatcctagcactttgtgaggctgaggttaggcggatcacctcaggagaggagtttgagaccagcctggccaacatggcaaaaccccatctctactaaaaatacaagaattagctgggtgtggtggcaggtgcctgtaatcccagctactcgggaggctgaggcaggagaatcacttgaacctggaaggcggaggttgcagtgagctgagatcacgccattgcactccagcctgggcaacaagagcgaaactccgtctcaaagggaacaacaacaacaaaaaagataaaataccagcacatgaataacagacctgcaaggtaaagagtgagaagcaaagaaaggaaggagacacagctagcactttcagaaaaagaagtgagtaaatataattattgaaaattaagggaagattttagaatgaaatgtcatttaaataggctcatttgtgaaagaagaggtttggtgaaaaaatatgtttctgaaaatgatctattttgagaacaatcaccctatgctgtattgattttgctaactttttcagacacatgatcaactttccctccagcagcatttgataatttttaccctagaatgaggttgcattcatttcttcacaatatagagaaaataatattacaaatgcctacacattttatttctatttacctttcttatattgctagagaaattgaaatttcttgtgtgtgaattgatcacttgcatttctttttagtgaatttatttgttgtggcattttccacaataatattttatatcgatttcccccaaaatttatctgcacacttaacactgtgaatagtagattaacagtgggagaaaatatctgatgttctctttaagttcaattctattatgtcctagtagtaacttttcattttggagatatctgcacttaaattattacttaaatcgtcttttttatgtgcttcgtggtatagctgacattgttttattttaaggcgtttggatgttgatttcctattctcaggttgcacgttacataataggcatgcaattgaccaacaaaataaatattctctctatatcatggagatcatagtatagtgggagagatggatgttttgaaaaacacaaaaatataaaaagatattgaatgagtttatagagtagagggacatgattcaatttatgatttaagagtattatctcatcaatgtataaaaataatatctgacttgagaaagtgggtagatggcaatgccatttattgaaaaggaaaaaagtggttggcgagttaggaaacagatgaatacatttagatagaagaatcagaactctcatttggatctgttgaattttaattgctcatagggcatccaagtaaatagagtaagctgctggatacataaatatggaatgcagtactggtatttgttctgggatgtaatttgagagtcaatagcataaagatgttccttacattcatagaaatgtgatatactatatggcagtcaaggtgaggcttaatgaaggaagaggacccaacaaaagataaatagtaaaagaggtgagaggaaaaccagtaaagaatggtattccagaagtatggagaagattttcaagaaggaagaattggttctaggcaaattatttttgagagtttgagtaaggtttgctgttggaggaaaaaaatggtgatgtttgcttctctccccaccaaattcaaatttgaactatttataaggtataggcaaatgcatgaatcacaaatatgcagtatgatgaattttcaaaaactgaactcacccatataatcagcacacagattaagaaacagagtattgccatcatctgagtggcctgctttgtacctctttctggtgactgtcctacccaaggatgaccacaatcctgattctaacacgaccagtttgcctttcctgtttttgaactttatataattttaattatatactacgtatttttgagtacaccttcttttgtgcaatattataatgtgaaatttgtccatggtgttacataaatagaatttgttcattatcattgttaaatacattttcactccctgaatattattgactgaatgtttatttccctccaaaattcataggtagaagccctaacacccaatgtattggtatttggaagtgggatctttgggagacaattagctttagatgacattcatgagggtagggctcccatgatgggagtagtgtccttctagaaagtgtgagagaggccacagctttctcttcttctgccatgtgagggcacagtgagaagacagccatcttctccagacttcttcctggtgaggaagagcaccctcttcaggaatcaaatctgatagcatcatggacctcccagtctccagaactgtgggaaataaatgttgtttaagccatccagtccatgctatttgttatagcagcccgagcggactaatacagtgaatatatcacaattttaggtatgttttctgaagagtaatttccaatgaggtactattctgcatactgctattatgaataactttgcatatttattttaggaaatatatatatacacaaacactattctgttagtatatacataggaatggaattgtgggtcatagagtagatatatgtttagcattagcaaatatttagaaacaatctaaatctatttgtaccaatttatatgcccaagtcaatatgtgagagtaccacacgttcaaatactagccaacccttggctagtcttttccattttgacattatagtgggtgtgtattggtatataattttaattttattatacattttgatgattactaataatgttgagatatcttttatctacttagtatttggatatatatatgggttgctgttttggtttcaatgttgctgactttaatactgttaatcagtacacattggagagtgaatcagcaatgtagatgactatttcacatactcagtgggtctttctggagttgtgcttccattggtttattcattgtattctaaggattcccttgaatttgtgcatacagtgtcaacattcatccgagaagtatggaaaatatatagaatataattttattgaaaaaaatgtattaaaacaattaacgaaaacaagaacctgagttaaaactctttaattgaagcttttgaaataatattttcctaaatatcatctaattacatctaacacatagaagtaaattatatttaaaaagaagtttgaagagttaagccccaaaaatcattcttaaaagtttgaatcactggcatgtaacctaaatttccaaaatgtcagaaaaatagatacagaataatttaggtataattatggtatacctaaataagtatgaaatatctaaatatatttaggtataccataattataccttaattatgctgtatttattataattatgttagataatattttaattatggtagataatattttggattgagtgaatatgcaggttatcactttctatatatcaatggaaattttttaaattacaacctatgaaggcctcacaatgaaaattttctagattaaatccattagttcaagtttttctaattgtactgtaaatgaaatatcttctccattatcaatctcgctttatttatttttaacacttattttaggttcagtggtacatgtgcagagtgttatataggtaaacccaagccatggggttttgttgtacagattattttgtcatccaggtattaagcctaatatctattagttatttttcctgattctctccatccttccaccctccaccttcaagtaggccacagtgtctgttctctctatgtccatgtcttctcatcatttggctcccacttataaaatgagaacatacggtttttggttttctgttgctgtgttagtttgccaaggataatggcctccagctccatctatgttccttcaaaggacatgatctcattcttgtttgtagctgcatagtattccatgatgtatatgtagattttctttattcagtataccatttatgggcattcagtttgattccatgtctttgctattgtatctagtgctgcaatgaacatacgcatacatgtgtctttatgatagaacaatttatattcatttcggtataaacgcagttatgggattgctagatcaaatagtagttctgtttttagatctttgaggaatcgccaccctgctttccacaatgggtgaactaatttacactcccaccaacaacatattagcattatttttctccacaaccccaccagcacctgctattttttgactttcaataatagccacagtgagatggtatctcattgtgtttttgatttgcatttttctaatgatcagtgatactgagtttttctttcgtatgttttggtcacatgtatgtcttcttttgaaaagtattcatgtattttgcctatttttggatggggttgtttgtttttattcttgtagctttgtttaagttctgtgtagatgctggacattagacctttgtcagatgcatagtttgaaaaaattttcttccattctttaggttgtctgtttattctgttgatagttcttttactgtgcagcagctctttagtttaattagatccaatttgtcaatttttgcttttgttgcaattgcttttggtgtgtttctcatgaaatctgggtgtgacagctgtcaccccacagatcaccagttgaccccactgatcaccgttgattcggctcatctggctagatgggtgtctccttccttcctcaccactccatgtgtgtccctactgaacctgcgtgtttggttgaagagaacagccatccttgatagaggaggaccagtcttcaataaaggatatacgagtggctgtgcttgcctgctacaacctccaaacatgctattagtcttgtgaataaagggatgagccatataactagacgctgagaaagaccagaacagtgctggtttagaaacggaggaccactgcattcttagttcatgtttggaaagtgctttcaaaaaatttcaagtacttggatgatctttagatgccattgctttgaaataatctttattttatagcacaaataaaatataacacccccattgaatatctatgtcccgttatctctgatagatttccataggtataaacctttaatctgaaggtcacacaaggcttgggaaaataccatcatcaagggtcaggtgagtatattgtatatttttaattgcatagttcgagtcacagatgcagatgtacaaaatttggtcagataattttctgaagattttctaaatcttgaattttctcaagattggacaggactttgggttaattaataatttatcagaatagcacattgcacataatttacccaggcttatatattctctaaaatatataaaattaattcaaaataaaatgttttagtcaaatacaactttactttccaccataattttacaatgaaatgttattatattttaacttaagagcttgggctcagcttcagtaggcctgttatggcattgtttaactcccccacagccttaaatactacaggaataagtaggaattttcaagggttttaactgttctttctttctttctttttttttttttttttgagatcgagtctcactctgttgcccaggctggagtgcagtggcaccatctgggctcactgcaacctccaccttctgggttcaagtgattctcctgcttcagccttccaagtagctgggattacaggcactcaccaccatgcccagctaatttttgtatttttagtagagctagggtttcaacaagttggctagactggtcgaactcctgacctaaggggacctgcccacctcagcctcccaaagtgctgggcttacaggcatgagccaccacacccaaccggttttagctattctttcattccctgtacaaaacaacacaaagacacatcctgccactgacatattctggcctgggccaaatgtaggattattgggttgtctgaacagtctcagcctcccagggcagtaaagttttcttaaaaaagagagcttgtagaatgggtttgcccacaactcactgcaaaatctcaggcgatttggcaactttttaaaggtaaaatatgttctgatccattttgttacttgctcgggggcagcaatgaaacaccagaggtggtatcctgttatgacccttctgcctacagtattttcaatattaatatctaatggtgggtatcttatttcatttgagacaccaagggtcagattcctctatttacttatggacatattaagcaacaataatgcaggcaagcataattttaaaataaagagtgattttataaaagtaattttgaatttctttttttctttttttcctagatgaccatattttttattttaaaaaatagaaataatacttttaaaatggtgaacaattcttttacatatatatatatttttattatactttaagttctagggtatgtatgtacaacatgcaggtttgttacacatgtatacatgtgccatgttggtgtgctgcacccattaactagtcatttacagtaggtatatctcctaatgctatccctccaacctccccccaactccactttttatgttcttttttcttcttgctatagatctaatttattttctgagaaggtccatacagagatttactatcccttgctttaggaacagttgtcatagtttattaaacccatttattttctaccaaaaggaagatatgtctaatggcatataaaaccattcaatgagtacttcataatatgagtgaaaggtgagaattctttgtattaataaacaatacatcttaggaaagcttaaaaatattaaaatagatgaaaataagtgatgtatagaaacatattttaggtcaataacaatctaaatactatatttatttattaattatgtaccagtatacccagtttcagaatggttgtaaagttaatttttttatatagcagcagcagcaacattattatttttttaacttttaggtttaggggtacatgtacaggattgttatataagtaaactacctgtcactggggtttagtatacagattatttagtcacgtaggtaataagcatagtacctgataggtttattattatttttttgatcctctcactcctcacgccctccacctacaactaggctgcaatgtcttttgttcccctctttgtgttctcattgtttagctcccacctataaatgagaacatacagtatatggttttctgttcctgtgttggttttctcaggataatggtctccagcttcatccatgttgctgcaaaggacatggtctctttctttctaatggctgtgtagtattacatggtgtatatgcatcatattttttaatgcagtctaccgttcatgggcattcaggttgattttttgtctttgctgtcttgaatagtgctgtaataaacatacatgtgcatgtgtcttcatgacagaacaagttatattcttttgggtatataccccaaaatgggattactgggttgaataaaagttctgttttaagttctttgagaaattgccacactgctttctacaatggctgaaataacttactttcccaccaccagtgtataataagtgttcctttttctctgcaacctcattagcatgttttttttttcactttttaataacggtcattctgactggtatgatataatatgtcattgtggttttgatttgcatttctctgatgactagtgatgttgaacatttttcatatgcttgatggccacatgtatgtcttcttttgaaagatgtctgttcatgtcatttgcccacttattaatgggtttgtttgttttttgcttgtacatttatttattatagattctgaatattagacctttgtcagatgcatagtttgcaaatattttctgccattctgtaggttttctgtttgttgatagtttcttttgctgtgcagaagctctttagtttaattaggtaataattgccaatttttctttttgttgcagttgcttttgacatcttcatcatgaaatttttgccaagttctatgcccagaatgttttttcctaggttatcttccagggtttttttttttttttatagttttaggttttacatttaagtctttaatttctcttgagttgatttttgtatatgacgtaaggaaggggtccaatttcaatcttctgcctatggctagccagttatcctagcacagtttattgaatagggagttctttctctattactagtttttgtcagctttttcaaagttcaggtggttgtaggtgtgtagcattatttctggactctgttctgatccattggtttatgtgtctacttttctaccagtaccatgctgttttgattaccatagccttgtagtatagtttgtgattcctctaccttggtccttttttcttagatttgtgttgcctatttggactcttttttggatccatatgaattgtatttattgtcctaattctgtgaagaatgtcactggtagtttaataggaagagcattacatttataaatggctttatgcaatatggccattttgatgatattgattcttcctgtctatgagcatggaatgtttttccactatttgtgtcatctttgatttctctgagcagtgttttaaaattctcattgtggagagctttccttttcctggttagctatattcctaggcattttattctttttgtggcaattgtgaatgggattattttccagatttggctctaaacttagatgttcttggtttataggagtggaactgacttttgcacgtcgattttgtatcccaaaactttgctaaagttgttggtaatttcagggagcttttctgcagagactatggggtttctgtgtgtagaatcataacatctacaaacagggatgtatatagcactaaacgcccacattaaaaagttagaaaggtctccaattaacaatttaacatcacatctagaggtaatagagaaataagggcaaaccaactctaaagctagcagaagacaagaaataaccaaaatcagagctaaactgaaggaaattgagatgagaagagctatacaaataatcaacaaatctaggagtttgttaattgaaaacattaataagatagagtgctagctagagtaataagggaaaaaaaagaggcatgttccaaataaacacaatcagaaatgacaaaggggatattaccaccgaccccaaataaatacaaaaatttctcagagactactataaacaagtttttgaacacaaactagaaaagctagaaaaaaatgaataaattcctggacacatacaacctcctaaactgaaccagaaagcaatcgaatgtcttaaccaaccagtaatgagttccaaaattgaatcaataaaacagcctactcaccaaagaaagccagcactagaggaattcacagcttaattctacctagagatgtataaaaaaaagctggtaccaatcctactgaaactattacaaaaaattgaggaggaaggactcctccataactcattctgtgtggccaacattatcctgataccaaaacctggcagagatgcaacataaaagaaaatttaagaccagtattcttgatgaattaaaaatcatcaacaaggtactataaaaccgaatccagcagcacattagaaagctaatgcatcatgatcaagtagacttcattcctgggacataaggttggttcaacatttgccaatcaataaatgtcattcatcacatcaacagaactaaaaaaaaaaccagattatttcagtaggtgcaagaatggcttttgataaaattttacatccctgcatgttaaaaaccctcaatatactaggcaataaagaaacttacttctaaataataagagccatctatgacaaacccacaaccaggatcatactgaatgggtaaaagctggaagcatttccctgaaaactggaagaggacaaggatgctctctctctcaccactcctattcaacatagtgttgtaagtcctggctagagaaattaggcaagagaaagaaattacaggcatccagctaggaagaaagaaagccaaactacattattttaaatcctatcaatttcaattttgaaatttttgctacaaaaatgttatcactagaccgtcattaaaataaaaaatttaccacttgcataaaaaatacattattttcacttttaatagtcttctatgtttaatatattctcttaaatgcaatttttgacttttaacatcacaaactcaaatgatccaaggtacaatgaaaatggtaataccattatatcattaagtaatctacaaaatgagaaataaaaatgaggctctaattcgtacaattccacttacatgttcagaaattgtattctgcttcaaattttgcccttcttatacaggttagaagatgataaaggattctaaattcttattatttattggctatgatctgcactgataatagtaatttaaccagggctgcgattttggggagcaatgttctatagggatattaaatctgtttttaattattggctttttattaggcaattttattaacagattcagtaaaaaatgtccaccgcagctcaataaccgaatgatcttctaattaatctattagtgccttttaagtattcttactgttcaggcgtatgtcatgttgaacagtaaaatagaacttgaaatgttaatattagcaggactagttctatccccaaatctctgctgccttcaaacttctgttgaaggagctctattgaaattagcaagctcctctgtgtcatactttcagtattttattaggagtgtgactaaagttgagaggcaagagatactgcagaaaatttgtgaagctctctgttcagccttctcctgaataggtagaggaactggtatgtacaaggtgtaatgtgtggtgtttctctctctttggtccaagcagtgactgctgaatgtccaaccaggtaagagcgtaatgataaaaatgaagttggggttggggaaaaagtcctgggtctattttagggtggcaagttgctactacatatcaaggcaaactgtagcacccaggatgcataagcaatgaaaactacaagtgttcatctctcagccagttgtatgaaaattctacattcctgtcggttattatcactttaacctttcaaaattcaaatttttctctctaatagatatgtagatttataggctctgcttctattcctctttgctgtattatcttccactggatgtcagttaaactttcacaattttagagttatatgatctgtctcctttctatacatcactttacaaaatgtcagagcccaggaggaatttgagtctgagactcctggtaggaagtggcactctcagggagccatgccattttctttatggctaccattactatctatgtattgatgactttttctttccttttctttactcccaattccaacttacctctacagcttcagaactcaatagttcatggtctgtttcatatttttatatgaagcacccccatatacttcaaattcacatgccccaaacagaacccattatagcctacttgctcttatatttattacttcgctcatgcttcttcctcacttacatccttaccattgaaaaagtaaatttaaaaatgtattgcatgattttcttcttttttctttttgtgtctgtcttcaatgtcataaatgttcatctacaatgtagattcagccacaaacctggatgtcatctgttactccatactatatattttcaactacaactatcagtctaatattatcttctcatccggactgcttgagacatgtagtatgcttctagtcttgcccttttgttagccagagtgagcccactgatctaacaacagaaaccccttctcttgctccccactgccactagggtcagtgctaactccattgcataagacagtcctcttcaagatctcacttcaccagttctctgcagtttctctctggtcggtgttctagcgcactgcaatcctgataagctgtatccacatcagattcctattccttcggctctttgcacttgcaaccttctcaacttgaatcactgccccacccttcactcacctctgcactatattaattgtccttcaagatatccattatatgccattccccttacaaagcattccttgacctttagggctgtgtgaggtattttgtccagtggtatcctccattaacgtctttatcacatatgacaactatgtgacatggagtaagattcaataatttcattcttatttatctagcttgcttttttagggctaactttcttcagggctctctactgggcttagaaggtgttaatagtttttatttataagattgaattaatgatgagcaatataataaataaatatgttgtaatataaatggttgataatcactttacagatgatcaacctcattccaataacattaaaagaaatataaacaggagaactgtccactgtcatggaaaagggactgaagccagagagccaaacatcctcactcagagggtcccacgcccacagaaccccacaagctgagacccactgggttgaaatccctgctggccagcacagcagcctggagtctgcctaagactaccgagttcatggtgggaggggtgaccgccactactgtggctctagtaggcagttctctccagctagtgctacggagactgggatgtttggactgggtggtactccccacagcgtagcacagcagctgtggcagatcacggccagactgcttctttaggtgggacccagattcatcccttctcactgggcagggcctcacacatgaattccagcaattccagccaggcctttacagacagaattgtcctctgccagggacagagcacgtggcaggaggagcggccaaggtgtcaagttcagtgggcttaatctttcccgtctgctggccgatctagaggagggggactcccccagcacagcacaacggctctgctaaaagatatacaaactacttccttaagtgggtccctcatcctgtgcctcctgactgggtgagacctcccaacaggggtcaccagacacctcatacaggagagttatggctggcatcaggtcggtgcccctctgggatgaagcttccagaggtaggagcaggcagcaatctttgatgttctacagcctccactggtgatatccaggtgaacaggatctggagtagacccccagcacactgcagcagacctgcagaggaggaccgtgactgttagaagaaaaacaaacagaaagcaacaacagcagcagcatcaacaaaaaccccatacaaaccctatccgaagattgacagcctccaagattaaagatagataaatccatgaaaataaggaaaaaccaagcaaaaatgctgaaaatttcaaaagccagaaatgcctcttcttctccaaacacttctccagcaaggccacagaacggggatgaagttgagatgggtgaactgacagaagtaggcttcggaaagtggataataataaacttcgctgaactaaaggattatgttctaacccaatgcaaagaaactaagaaccatgataaaagattacaggaatctgttaactagaataaccagtttagagaggaacataaatgacctgatggagctgaagaacatagcacgagaactctgtgatgcaaacacaggtatcaatagctgaattgaccaggcagaagagagactatcacagcttgaaggccatcttgctgaaataaggcaggaagaaaagattatagaaaaaataaagaaaaggaataataatagaaaacaaacctctgagaactatgggactatgtaaaaagaccaaacctgcaactcactgaagtacctgaaagagacagggagaatggaagcaagttggaaaagacacttaaggatactatccaggagaatttatttaacctagcaagacaggccaacattaaaattcagaaaatccagagaaacccagtaagatattccacgagaagatctactgcaagacacataaccttcacattctccaaggtcaaaatacaggaaaaaatgttaagggcagtcagagagaaaggccaggtaacctaaaaagggaaacccatcagactaacagtggacttctgagtggaaagcctacaagtcagaagagattgggagccaatattcaatatccttgaagaaaatagctcccaatccagaatttcatatccagccaaactaagcttcgtaagtgaaggacaaataaaatccttttcaggcaagcaaatgctgagggacttcatcaccaccaggcctgccatgcaagagcttctgaagaaagcactaagcatgaaaaggagaaagtgttaccagccactacagaaacacactgaagtacacagaccaacaacactatgaagcaattacattaacaagtctgaaaattaaccagccaacattatgatgacaggatcaaattcaaaggtaacaatattaactttaaatgtaaatgggctaaatgccccaattaaaatacaaagaacggcaagctggataaaaaggcgagacccatcagcatgttgtattcaagagacacatctcatgtgcagagatacatataggctcaaaataaaaagatggagggagatttaccaaacaaatagaaagaagaaaaaaacaggagttgcaatcctagtttctgacaaaatagactttaaaccaacaaagatcaaaaaaagacaaagaaagacattacataatggcgtaaggtttaattcaacaagaaaagctaactatcctaaatatatatgcacccaatacaggagcactcagattcataaaacaaatccttgaagacctacaaaaagatttagacccccacacgataatagtgggagaatgtaatgccctactgtcagtatgagatcattgaaacagaaaattaacaaagataatcaggactcgaactcagctctggaccaagtggacctaatagatatctacagaactctccaccccaaaacaacagaatatatatttttatgaactccacatagcacttactgtgaaattgatcacataattggaagtaaaacactcctcaccaaatgcaaaacaactgaaatcataagaaacagtccatcagaccacagcacaatcaaattaaaactcaatattaagaaaccaactcaaaaccacacaactacatagaaattgaacaacctgctcctgaatgactaccaggtaaataatgaaattaaggcagaaatcaaggagttatttgagaccaatgagaacaaagagacatggaccagaatctctgggaagcagctaaagcagtgttaagagggaaatttatggctgggtgcggtggctcacccctgtaatcccagcactttgggaggctgaggcaggcggatcacaaggtcaggagatcgagaccatcctggctaacatggtgaaaccccatctctactaaaaatacaaaaaattacaggcacctgtaatcccagctactcaggaggctgaggcaggagaatggtgtgaacctgggaggcggagcttgcagtgagctgagattgcaccactgcactccagcctgggtgacagagtgagactccatctcagaaaaaaaaaaaaaaagaaaaatttatagcactaaatgaccacatcaaaaagcctgaaagatctcagatcaaccaccttaatatcacaactaaaataactagagaaccaagagcaaagaaatcccacagctaggagaagacaagaaataaccaagctcagagtggaactgaaggagacagagactcaaaaaacccttcaaaaattaacaaataccggaactggttttttgaaaaaatcaataaaatagaccacaagtgagagtaataaagaagaaaagagagaagattcaaatatacgatgagaaacgataagggagataccaccaatgaccccacagaaacacaatcagccatcagagaatactataaacacctttatgcaaataaactgggaaacatagaagaaatggataaatttctggacacatataccctcccaagactgaagcacaaagaagttgaatccccaaatagaccaataacaagttctgaaattcaggtgctaataaagagcttgccaatcaaaaaaagcccaggcccagatggatttacagctgaattttacgagaggtacaaagaggagctggtaccatttcttctgaaactatttcaaacaattgaacaggagagactactccctaactcattttatgaggccagcatcatcttgacatcaaaacctagcagagatgcaacaaaaaaagataacttcaggccgacatccctgatgaacatttatgcaaaaatcctcaataaaataggacaaactgaatccagtagcacatcaaaaagcttatttagcacaatcaagtcagtgtcatccccagaatgcaaggctggttcaacatacgcaaatcagtaagcataattcctcacataaacagaactaaagacgaaaaccatatgaatatctcaatagacgcaggaaaggccttggataaaatttaacatcctttcatgttaaaaaaaaaaaactctcaataaactaggtattgaaagaacatacctcaaaacaagagccatttatgacaaatccagatccaatatcataatgaaagggcaacagctggaagcattccctttgaaaactggcacaagacaaggatgccctctctcaccactgttattcaacatagtattggaagttctggccggggcaatcaggcaagagaaagaaataaaggatatttaaataggaagagaggaagttaaattgtctttgtttgcagatgacatgatcctatatctagaaaaccccattgactcagcccaaaagcttctttagctgataagcaacttcagtaaagtctcaggatacacaatcaatgtgcagaaatcacaagcattcctatacaccaacaacaggcaagcagagagccaaatcatgaatgaactcccattcataattgccacaaaaagaataaaatacctgggaatacaactaacaagggaaatgaaggacctcttcaaagagaactgcaaactgctactcaaggaaatcagagaggacacaagtagatggagaaacattacatactcattcataggaagaatcagtatcatgaaaattgtcatattgcccaaagcaattaatagattaaatgctattcccattaaactacaattgacattcttcacagtattagaaaaaaactatttaaaaatttttatggaaccaaaaaagagctcataaagccaggacagtcctaagcaaaaagaacaaagctggaggcaccatgttacccgacttcaaaccgtactacaaggctgcagtaaccagaacagcatggtattggtacaaaaacagacacatagaccagtagaatggaatcgagaacccagaaataaggccacacacctacaacgatctgatctttgaaaaacctgacagaaacaaacagtgaggagaggattccctattcaataaatggtgctgggagaactgacaagccacatgcagaaaattgaaactgggtttcttccttataccttatacaaaaattaactcaacatggattaaagacttaaatgtaaaaccaaagccattaaaaccctagaagaaattttgggcaataccatttaagacataggcatgggcaaagattttatgatgaaattgccaaaagcaattgcaaaaaaaaggaaaaattggcaaatgggatctaattaaatgaaagagtttttgcatagcaaaagaaactatcatcagggcaaacagacaacctacagattgggagaaaattttttcaatctatctatctgacaaggtctaatatccagaatctacaaggaacttaagcaaatttacaagaaaaaaacaaataacattattaaaatgtgggcaaaggataggaacagacacttctcaagaaaaaaaaaagaccatacatgcagctaacatgaaaagaagctcaatatcactgatcattagagaaatgcaaatcaaaactacaatgagatatcatctcacaccagtcagaatggcgattattaaaaagtcaagaaacaacagatgctggtgaggtcgtggagaaataggaatgcttttccactgctggtggcaatgtaaaatagttcgaccattgtggaagacaatgtggtgattcctcaaatatttagaactggaaataccatttgacccagcaatcccattagtgggtatatacgcaaaggaatataaatcattctattacaaagatacatgcacatgtatgttcattgcagcactatttacaatagcaaagacatggaatcaaatgcctatcaatgatagactggataaagaaaatgtggtacatatacgtcatggaatactacgcagctatgaaaaggaatgaaatcatatcttttgcagggacatgaatgaagcttgaagccattatcctcagcaaactaactcagggacagaaaaccacacacctcatgttctcacttctaagtgggagctgaacaatgagaacaaatggacacaggcaggagaactacatacactggaacctgctgagggagggcaaggcagggagggcattagggaaaagagctaatgcatgctgggcataacacttaggtgatgggttgacaggtgcagcaaaccaccatggcacacgtttacctgtataaaaaacctgcacattctgcacttgcaccctggaacataaaaaaataagtataaacttgcaaattctttgataccattttgagatatcatttacaattagaatatattataaataaggctatttcagatgtcagtgaccatgagaaaatcaacatttttatgtcactggtataaacataggttgctttaattttctgggaggaaatttggcactgtggatcaagtacctaagcatcatcatgataagctcatgctagaattaactatgtatttctactactagaaattgattgtaataatttgatgagttataggtaaattatgtgtcaagatgccagtaaaattttattaaaatgaaaattatagcaaccatcaaacaaaacaaaataaattatgtatgaaaacgctatattgtggaacaatgcacagccaacataataataattaggatcagatttctaatgacatgtgaatgattatgcaatgtactaggtaacaaataaaatattcaactgtaactatgtgaagctgtgtgtccagcaaaaggaagtaaatgcagaaactctaaaagataataatctcctatcagtagtataatgaatgacttttgtcatctcttttttatgtcttctaaaatttctatgatgaacatttattccacttccacgtagaacactataatataagccttgcaatgttctgcgaatttctaagcttaaaaacctcttgtatgtcagttcatttattcattcattgatttatgcatcaaatgttggctaatcagcaagaagtaagacaaggtacatagtctcttcattctacagcagaaagacagaatatgaggaagtaagcaagtaaatacatataaaaataaagtcaagcaaacatataaataaataattgataattgtaatacatcctctgcagtaaatgagtaggccataaatagagggatatgatagaaagtaactcatggagaaaaatgataggtgataattgataattaaaagaagtcaaccatgtaaaaggctgagaaagggcattccagtcagaagaaatagcaagtacaaagacattacggtgaacataggcacagtatgctccagaaacagaaagaaagccagggcgactgaaatccagggggcagaggaagtgtggaaaggtaggatgtggaaaatcatctatgccatggtaaggaatttggattctaagtgcaatagaaagccctttaagatctaccttgcataatgccttctttgattgtcataaagtttcttttttcccaacatacaatttcatgtatttctcatacttctgctcaatgaaagtaattgcatttattgctgacattgtattttatcttctactaaatacttacatgtttatagtaaccattctaccaattatatgttgcatatttatataaatttaaattagtaccaagatctgtgtccgtgattaccaattattatttatttgctgcccatctctcctttctaaaacattagttctagaaaaatagattccttctgtttagcaccattatactcccagtgatttcactgtgcatttcacagaagatacaataaatatttgtttaatgcatgaatgtaattatgtttttcattagattgtaaaaagtttacagcatactgacagctgtatgtcactaaaataaacactttaagttcctattctaaccttccttttgccttcttcttgtcatttctcctttcttataatgtaaggccaggtattctaattatactcttacctggccattcttcttacttttcttttctctaaattaccatttgtgtccttctctctcacttgacaatcttgtgtatttccacaagtccaactgcgaaaaccctcctcaccctcacctctcattagggtagagacaagaatcccagattgtatttctatctagcatagatcaatcgacagaaacatagccagggtactactttgcttgagaaatctctacatgaatgttctcttcattgctcctaaagtatatatcccaaacctaattattttttgtcccttgatttggtatttctattaatagcaccaattccattaatcactaaaattcaaaactacaaatttacctttaatatgtctttgcttcttccctatgatcctatttcctctactcctgccatcttacccactcattgctcatgcacaaagcctcacctcacatgaaccaacatccattcttttaccaatcaaacatattttcatgtctgaaatatgcttttatgtacacacatctccttctcctgaagctgcagcttatcagctatcaaataagagataggaagaggaaatggccatatataatatagctgcaattgtcgcagactacacagatggacggaagaaggcataaaaggacatgggttgttttaatggatgggtgatatctgtgtttcatcccactgttgatgaattttggcagacaccaagatcatgtaacatattaaatttaatatttgttcagcattatatcatgactgaattagactcccatatggaaaacataatttatgtttaattttaatgagatacattactaagatgctgaaaaaatattcaaattttttatcacatattgaacaagcaatatatctacttatgaagaacacagctgacttacattcttgctgatgtttgtcaagaataaaaatgattatgctatataaccattgtatagaagccttctgttgccataaattcacttgacatttcactttactgagtgatgtgggaatgacccttagcaaggctatgcatactttgtgtgtttaaacttcatgcatacagaatatttgcagatacactaataatttaacatctcagtcggacattctactgtttaaatttaagcaaaggaaatagtctagttttaaacaaagcatcttctgaagcagttgcaaagggtatttctagaattacaaaattgtcagatccattagaactgtttctggtctctcaaatttgcgttggcccatgtacttaatactttctttcttgattgctctctctttcatttatgctcattatacgaggtagtttccatgtcacgaaggtaagaaaatatgtggagaattgttaaaattaggccagagtaaaagaatcaacctatgaagacccaacagcaatattgtaaaaggttatcatattttattaaagtgaatttttttgcctgttttaaaaattatctaaaggtataagtattcatagttgtaaggaaatacattgtattactccttagctttcacacatcatttccagaaatagtttcaccttaagacaccctcacctgacatttaaaagctcaaagtgctctggtgtctgccagattctataacactaattttgtctgtggtctttttttccccctagaaacttcataagtatacatcaatctgccagaaatggtgattatgtgagcagattaaagtaagggtatttctcccctgcaagtttaacattaacattctcactatagacatcctcttggcattgaaagagaaatgaaaaaggtgtgtgtgtaacattatctttgttctgtaacataaaactagcatttgtattttccattaatttaaaacacttgttcatacaatacattagagttaacaatttttcacttttgagctagcaaaagtttttagctgatttcttttgaaatataatttatttaggtcagatattttatttttacattttgtattatataaacacattctttcctttttattacctcaatatatctcaccaaaatattttaatcaatacttatacacataccacaatccaacatgataggtgttaggtgtttctatttattattagcatttttaaaatttaacagctttagatttttttccttttcttattgtacattctattgcaggtataaatcgtcctatatggatgaaatgttaagcagaggtaaaacactaaaaaatcctatttggcaactttgatgtacaagcatttggcagttatgttaagtgggagtgagtgatttttaaaaatggtatgtataaacccaggtgcattttttacatagacacaaattgtcactcccttatagttcttaaaccaagataattttatgctttatttttaaacaatgttgcgatgcattataggatgttatgacatttaaagaaatggttgcatcagctactgaatatttatcttaattaatcgattatgcatcagaagtaaaacttttgtataatgagattttgaaacttgttcaaagaaactatatctcttttacctacctcattagtttggttaaaataacgaattcccaaaacccacaaataacatgagaagtcagtgctaagacataaaaataaagcatctatttgctgaatacttatatatttcattagtatgaagatactgaaatgtaaacaaatatgggcctcagaaaacataaatgaagctagctctcagtcaaactttttatctcgagaagattttctttactttttctttctctgttctcagcaaaaatagatatggtagcaaagaaagtagcaaataaaactgcagctagctgggtgcagtagctcactcctgtaatcctagcacttttgtaggcaaaagcgggtagattgcttgagctcaggagttcaagaccaacctgggcaacatcttgggtagagatgggcgaaactccatctctaccccctccccaccccccccccccaaaaattagccaggcatagtgtccattcctgcggtcccagctactcaggaggctgaggtgggaggattgcttgagcctgggaggtggagattgcagtgagcttagagtgtaccactgcacttcacttcaccctgcatgacagaatgtgaccccatatcaaacgcaaaacaaaacaacaacaaaactgtagctttgctaaagaacagatgtggctttggcagagaaacttgcaaacacaggatgtgaatatgtggatagatctataaaagaggaaaaagcaggaatcattatatttgataaatttagtacagaaacattgcttgggatgtgtggtgacctaaataaaaaatgctaattgaagagaaaataatactttctaagcattttaaaaaatcagttagtagagacccgagccgttcattaaacattagttaaagagcatgttaatagcacttacagggttaaatggaactgttttgagacttctccaattataaaacatcttttcttatttcaatatgtatttaatgttactttcatttttaatttgtcttattaaatattccctcaagtaccttggagaagtttatgttcaaaataaaacaataaaaattcttatttggcagctttgatgtacaaatatttgacaattatgctaacagaatgaatgatcttttaaaattatgaaattgattttaaaaactttctgtcctttacagtttggacatttatatgttaaatatgcatccttctattaaatatgagaattgtgaaattgataatatttgtactattttgtttgtttttaaagccaaaaacctcagatcgatattaagtgtcttatgaaattataatagctctcatgatctccaagcttattctccgtttttgtcactttacttttctattttaatagttttcttaaacaacattaattttgaatataaaggcctaattaagtaaataaaacataatgatttcaaaattacattagtgatttgcacaaaattagcaaaaatacatatagaatttaatatgaaaaacttagaactgcacaagttcataataaaacattatttttagtgtaatatctttttaaaaaattccaaaattttaggtttggggttacacatggaggttagtaacatgggtaaattttgtatcttgggggtttggtgtacagattcatcactcaggtagtgagcatagtacatactaggtagattcaatcttcaccctcctcctaccctccatcctttggacagagactgtgtggttctctaggtacagaatcatatcatctgggaagagagatagtttgacctcctttcttcctatttggatgccttttattttattttattttatttttattttttcttacccgatagctcagactaggcctttcagtattatgttgaatgaatctggtacgaataggcatccttgcttgttccagttctcaaggggaatgcttccaggatgtgtccattcagtatgatattagctatggatttgtcatagatggcccttattattttgatgtaggttccttcaattcctagtttgtggagggtttttaacatgaagaaatgttaaattttatcaaaagcattttctatgtctgttgagatgattattttgtttttgtttttagttttgtttatgggatgaatcacatttattcatttacatatatcaaaccaaccttgaatcacagggctcaagcctacttgatcgtggtggattagctttttgatgtgctgcttgattctattttctagtattttttttttgaggatgtttgcagctatcttctttagggatattagcctgaagttttgtttttctgttgtgtctctgacagtgttggcatcagaatgatgctggcctcatagaatgaattagggaggagtccatccttctcaattttttggaataatttacttaggattagtactagctctttcttatacaactggtagattttggctgtgaatgtctggtccaggatgtttactggttggtagttttttttatgattaattcagttttggatcttgttatttgtccattcaaggtttcagtttttttattggttcaaccttgggaagttatgtattttcaggaatttacccatttcttcttggatttctagtttgtgtgcattgaaatgtttgtaatagtctgtgaggtttgatttttttttcatttatttctttgaggtcaatggtaatgtagtaatgataatctcttctttgtcatttctcattttgtttatttggatcttctttgtatttttattagtttagctagtggtctatcaatcttattcattcaaagaacgaactttggatttcattgatcttttgtatgttttcttatttcaccattttattcactcaagctctcattttggctatttcttgacttctgtctttggtggtttttttctctagttcctcttgggatgatgttagggtgttaatttgagatctttataaatttttaatgtgggtatttagcactatatacttctaacactgctttcctgtgtcgcagagtttctagtatgttgtatcttttttctcattagttttaaataatgtcttgatttcttccttaattggattgtttacccaatagtcatccaggagcagtttgtttatcttccatgtaattgaatggttttgagaaacccgcttggcattgatttccatttttattgtgctgtggtccaaatgtgtagttggtatgatttcgatttctttgaatttgttgagaattgctttacgtggccaattttagagtatttgccatgtacctatgagaagaatgtatattctttcgttgtttggtgcagtgttctatagatgtcctttatattcttcaatttcctggagtgtctgactgtgctataattgggttccgttgactggctttgcttctcgatgatttcaaggggtgaaggctcagttcagcactcctgggcagcacatgctaaccctggcaggctgggaccaggcccacacctttgttctctggcttcttgagggtaagcacctgttgcactaggggggcctaggtgttctcagtcccctggcaacaatactttgatggtgtgtgccagaaaagcacatcatcagggttgtggcagtggggttcatgatagcatgcagtggagttgagcttgtggtggcgaggtctgtgtgtgcttatgtgccagtaaaactgtcggtgcaggctgcaggtgagtgcatgccggcaaagcagcagggggaatctgcaggcaggtgcgcaccaatggagggaggcctgaccacataagctctctgatggtgaggaggggtctgctggtgtaggagctatggtagtagctgctggggagtgacccagttgggcatctgaggctgcattccaagtgagtgtgaccagaaagagcccctgggaaagactggcagaccagactggatggtgctcagaacacactgcccccatcccatggacaagacagccctgttctgtccaggtctatcagtcaacaaaggcaaaagcccctaaaggagcatgttgagccttgggggataagcatccctgggcatactctactgcagccattctgacaccaaacctctggcttctacacaggctagagtcctgtccctgctgactctccttgcagctctccctgacagcacaagtgttcgtgggactcgtagggcttcctgcagcttcgatttctgaggcacctaatgagactgagccattcatgtctatttaactcacctcttacttaggagcacctcagggccagggactagtcctggtgctcagcagccccatgttcccagcttctctatccttcaatcccttcagggtctgtgtccccactctgtccactctcaacgcctttcttcctaagatctgctggtaatgtgtcagtctactttatcttctgatctctcagtgagagttccttctggttgtgtctacttggccatattggctatttctgtaatcatatcttatccgatgacattaaggcagaaatctttaacaagcaaacaaaaaaacaaagaaacagagctatacagctgtaaaacactctacatagaaaacaatttaattcacttatgtatcttagaaatgtaatttaaaaatatataaatatattttaaaatatacatgtaaaatatatatattttaaaatatgtaatatatatgtatgtgtgtatatatgtaaatatattttataaaattacatatataaaatatactgtaaatattaaatatatcatatataaacataaatcattgaaataaaatggcagatcaacaaattgactgaaccaaaaatctttgcaatatagaagatattttttgtatatgacaatgggatcctagagacaaatgtttctttctctcctggctcccttccttctttcctttctccgtccattcctttgttccttaaaatatattgagcacttctgcatgtcaagaggcaagctgtacatggctatattaagttatgtgcactactgattttacctttttggtgaaaaccttaaatataacattttggggatttagtaaaacacctctaaaaatgtaggaaagttaatcccaaatgccattccaggcccttccattcagaacacattaccaatttgtttttcaaacataacacattttttttgtattgatagtttacaggataagacttttgaaaagacctgttttagagctaagaggagggtgggaattacaagcagtgttctttgaaagtgatatcctacaaactgttgttccatcttcaagtcaataaaagataataccttagagatgacattatagtgaccacatattttcttattcttattttttcccaaaccatcatatttcatgaaattatgaaatcataatgaatatacattttatacagctttatgtaacactaatttctggagatttaaattttacatatgaaatacattatttttgcagaattatgattggctaaattacaatttgtgtctgatctttttcatttcagggacttttaaaaactggccatcatttattcattgttttgcctaaccaaattgagaatttgaattaagaataaattctagtctcatctatagtctagggaaaaatagatatttggaatcattcaaggaaataacataagaagtgggactgttttactaaatatcttcaaatagtaattattctaaagcaaaggaaattcttggtgccatatttcataagagaagttatttgtccagaaaaaggatatttcaagaatgcagcatctcagatccatatcacataaggaaaattattggaactaagtaagacataaggaggttttccactactgtttcatcaaacaggttttctgtgccctttgccgtctcctctcctcctggaactcccagaattttcgtatttgttcagttggtggtgtcctatatgtcacataggctttcttaattcctttgattatttttttaatctgactacgttatttcaaaacacctgtcttcaagttcagaaattgtttcttctgattaatatactttattgttgaagcttattatattttctatttcattcattgaatttttaatttccagtatgtctttttttaatgatatctctttgttgaatttctcattcagatcatgattgtttaaaatttctttttatcgcctgtctgtattctcttgtatctttcttagtttctgtgaaatcgctattttgaattcctttccaggcattttatatattttattttccttggattttggcactggagaccttttattccttcagaggtgtcatgttttcttgcttttccatgtctcttttgtatttatgttggtatctgcacatccagcataacagttatttctttcaattttatggagtaaatttcataggaaataatttttattttttattgtttgagacagaggcttgctctttcacccaggctggagtgcagtggtgtgatctcagctcgctacaacctcagcctcctggattcaagcaattctcgtgcctcagcctcccaagtagctgagattacaagcatgagcaaccatgcctggctaatttttgtatttttaatagagatcaggtatcactatgttggccaggctggtctcgaactcctggactcaaatgattcacccacctcggcctcccaatgtgctgggattacaggtgtgagctaccacgcccaaccagaaacacttttttttttctgtagatgtgtctatagtgttagttagatagggtactttggtttcggttgtgggtgggtggtgtcatgtagtctacatataatttcttgtttattctatatttttgaagacgatttttcttcttataatcctatttgtcttcattaaaattaagattaaatgtcaatatcctccagtcaattctcagtaacaattcttcttactgtgagttgcatctagttttaaatatttagagtatcttattttattctatttatctctccaaaatagatcttgagctcctttttagtaggtaaaagacatgtcagctcaaacggcaagtattacttactcttccacaaatgatggtaataatattttatagaccatagagatagttcttcctcctcaactgattatctatgtgactttgagaaagttacttaaactttctgtttcagtctattcaacctacaagaaggacagtaatgtattatgtagctcaagaagtgtcatatagctcacatgaaataataaatgtgaaaaccctttacaaaacaagtgtaagtatgttgattttttttttagtggtggtagatttaggtaggccatttcttttctattctcacatatagtatttaaacagtttaggtacacagtgtaagtttattttacatataaacttaatagatccatgtgcatattaaatcttaactcatcattaccctgctcttatcaaccaagctaattaaaccagcaattattgtcaaaatgataaatggatttatgtaatctatatactatttgtattatatttagccagtattcccttctccaaaagaggattggagaagtatcacaaggaattctgggaaacgcaaaagtgggtaatattaaaattgtataaaggaaatatataggtatataattcgtttatccatttgcaaaatgctgtgaaaataaatggggataaattatgtattacacatatttggcctttgttcatattttcatttaaattattctgaatacaaaaattatgcataatccttaaaagtttgatctccaaattttaacctaccttgcaataaacaaaataccatatatatattaagtcaagcaagactaatttgctaaggaggagaaaataaaggctataatcacaataatattttatagcaattcagaagttagggttctaaacacaaatagtattaaatcaacacccaatccttgttgatgaacattttcaggggaaaaatgatctataaatactttattattttctgtattgcttaatctccatgaaatgtccatatttatttacaatgagagaactttaaagagaaagaatacactttttattttttttaagctggggtctcattctgtcacccagactagggtgcagtggcatgatcaagactcactgcagctttgacctcctggactcaattgatcctcccacctcagcctcccaagcagctgagactacaggcacgtgccaccacatctagctaatttttgtactttttgtagggatgggttttcaccatgtttcccatgctggtcctgaactcctgggctcaagcaatccatgtactttggacttccaagtgctgggattaaaggcatgagtcgatgcattaagcactatattgaggacaaaataaaaagaagcatgatattttgtcatatgtgagatactatgtaaatataatattttaaatataaattgacattgtgcttgctttccaaccctaagacttaaactgttttgttattaatgcatctttcagtatctttgaataggtcaggacacaattaaaaccaaaacagaaagtttctttttactttcatgtaagtatgatgattaaggtgacatataattagtgggctctttactgaaagagagattgtttataaaagcaaagacagctgaagcaacctttttctgctatatttacaattctaatgttaattataatggaatatccaaatataaaaagtggtgtcattaagagaaaagaaagatttcagaaaattagtctgaaaagaattccagaggcaaagctccatatattttagttttataattttatttctgaaatgtgcagctaaatttacttgttttctaaaagaaagaagctttcaggagcaatggcatgattttgtaatgaaggacagaccacatctatcacaagaaattatgaataatatgtttttgagagagcagcttacaacagattagaacttctgctgtccttttccctaccaggacaacaattttccatgctgagctgctgattgtgattatttattaaagggacattataatattttatttctcctctgatatttcctaacatagaaatatttgtggactaacactataatttacagaataaactgtattgattaaaaactacagagacctattgtgtcatttatttaatcacagaaagccatgttttcatccttaaataacatcatggtgaagcacttcattttatatattgtagaaattcaatgacagatgctaacgtatttatatgttaatttttaggaggaaatattttatggaatgatttatacaagataacacagaatggaataactttccagccattcatgccaataaaaacaatagtagggatttaatagtattaaacatcatgcttcatatttttgattgggtaatataaatatttttatattacatttaaaaagtatgtagtcttttatgcgccctttaaggattgtaaatatattcatatttgagcatgttctcttgtatcaaatacgtactaaaaagggccttttaaaataaatggttcatcagtgagataagtgactttattataaactgacttttgctaattttaaaggttttcatgttgtttttctttcatctttttggcaactgctttctcctcagtttttttacagctttgatattgataaaataaaaactttagttagcacagtttatttgagcaaaaaaaaaattcatgaattgggcagccctcagaaccagaagagactgagacaactctatctaatcagccaaggtgggcaggcaatatttatagacagaaaaagtaagtgaggtacagaaacagcttgattggttacagctcagtgtttgccttatttgggcatggtatggtaatgaatatgccttatgtgaaaatgatgtgatctgttggcagctaagcattgtctgaaactcagctgctatgattgactgaaactcagctatttgttacaagattatactcttaagttagcttgcagttttcataattaattatgttgtgggttgctatgtagggattcaaagtacagaagcagctttaagccaaatgtaatttaatataattatatctttatttgctatgtagccatctttttttatttctactcttctctccattcattctggaaaatgaatggagcacaagattattaaaataatgtaatgctatgtatatatgaccaaatttaatataaaattatgtttttttaaatattcacaactttctacttctcaaacccttctatcctcaattttaaagaacagtaaaatcatttgtatgagagagttttagaactagtaagttacacttgacttttgagactcagttcataatgagtaataaggaaaatggcagagaaatgctgatcagttagtttctcaataatcattagaggtattgtcaggattttatctatggtctaaatttccaaatgtttaacaaataaggatgaacattttagctactcttgagaccaacgaatgcattaactttagcctcattagatcccaagttcataccactgcagtgtgtggggttacaaatcttgtgtgtcatcaacaaggcctgaggatgtccacatgggcaggacaggaagagcagaaaaagacttctgaaaaaagaaggaaagaaggcaaatgagaaaaggggaagatgagagacttaaaaaatgcaaggggttccaaattttattgaataatatgaaagaaatgttttcaaagaaaagaatctttataaaaattgctagtttttagttgattgcatttcttttgtgaagaatagaggcttattattttagaatactagatgtataaaatcataattatgaaggttcacatataccacaactgtcatacgttacaacacaggaagattattttaaagaagcaaatcaacaaaactgttggcaacagcttagcaacttctaacaaagtgaattgctaattgtgacttcttgatctccttaaatttggttataattaaaagtatattcttattatttacaaaatcccacactgcttctatctatggatgtccctcctatagggtcacacatttctacaactggtcataaagtctcaatttttttttaagtaaatatttgatcacacacacaaaaaaatgtatgagaaagtgaggttgtcttttacataagtaatagtaaatattacctggtgtcttgcagaataaattaagataatttgggatacacaacctatatatctatctccctcaccttaataaaggaggccaggagtattgtatattgctattcacttagatctttagagcttattatgatacctggtaaataattagtgttcaataaaaatttaatgaacaaataaaaaaaagataatgactcacaggttaagtgaataattttgaatgtccatgttttaaatgtaaccttattaaaaactttgtttgaaatgtagttcttttcctttggtgacaatttacatgttaaattttaggaagtacaacaaagtttatacactaaatattattttaaatcacaaatgactgtaatttttattatatttatttgccagtgtttgggctaggttcacagctcatttgaaatcatatatttacattatttggtatgtcagtcttataaaatgcctgcttaggctttttaacatatcaaataacatatcatgtattttttatctaaggaacatgcaaatctttgttgaagattctcatagaagtaaaatatatcacaaatgttgacaactatatttttgcttagtagagcaataatagtaatccaagacttatgaactacaaataaatatattacatataaataattgtagttcattttgccttttccttaaaattgtgattgaagaaaataataattaattgcattattcaagaatttgtatcacatctttattttgaagaatggtgtaataaggtgaaatttcagaaagttgtaataaattctcatgttttattaatctaaaatatgaaaaagataaagatttagtaagaatatttttgttgtgaaaaaaatagcagtcgtattcaattctattttaaagttaaggatagtgctttaccttaaatttaagatgttagagaccaatttccttgtggtttgggattaacttttcttctcctatatccctaagcctagtcatgtagaagaaacattaaattcaggatacctcataagtagattgaaaggatattattgaaaaattggttttgaaaggtcttaagtaagaaattaatgttttctttcttactgaagtatgaaacaaagtaagtgtgagagagaaacagaaataaaaaatgaagcttatattacaagtattaaaaggatggatatttttccctcagaaaacgggatcagggttcaatgacaaaaatatttatacttatttagaagcaaaaatcattgctcttgaatttttatcaattaggtatttgataatggaaattccagaaggtgcctttagttgaatgttttatgaaaggattaaagcgcctgctttgtcaactttttttttaaggtctccttttttaagtatcctagaaagatagataggttaggcatgtcatgtgtgtgtacatgcatttgtgtgtgcatgcactcttgtgtgtgtgatagggatggagagaaaatgagaaagagttgagaggattattctttaaatcatgttatactcagacagctgtcttcatagaaatatgatactttaattaaaattagcattcccttcttgtcttcagtataccttgataacaaaaatccttttagatttttggttgagaaagatagacaatagtgtgaaatttgtagccatgagtatattttgaatattttccggtaatacagtgtatcttactgggcagaaatgactataaaaggaagaaaatgtatatcaagaaaaggaaatgacaaggtgttattattttgaattatagtgtgaaatatttgggaaccaacccaaatgcccatcaatgttagactggataaagaaaatgtggcacatatacaccatggaatactatgcagccataaaaaagaatgagttcatgtcctttgcagggacatggatgaagccggaaaccatcattctcagcaaactaacacagaaacagaaaaccaaacactgcatgttctcactcataagtgggagggggacatcacacaccggggcctgtcaggggatgggggcaaggggagggatagcattaggagaagacctaatgtagatgacgggttgatgggtgcagcaaacccccatggtacgtgtatacctatgtaacaaacctgcatgttctgtacttgtatcccagaacttaaagtataataataatacaaagtaatgaaaaagtagtaggaatattgatattggagaaataatgacagctcaactttaatgttcagttgattctaacactacctcttgtaattaaatgtatttcctttttctatttaatggtaaaaatctacagtcattatgataataaacttgcgcccacatcaacttttcattttacactttctataatatttgaacaatatgattcaccaattttctgtttatagtatagcaacttaagaacttttaaaaaatattcatgagacattttcaataagattcatttatagcttcatttagacctgtgtctcatcatatctttgttgtctccatttaaatttataatattccattaccattatataacacccttctttgtcttttttgaccattgttgatttcaagcctgttttgtctgaaattggaatagcaacttctgcttttttctgttttccatttgcttgacagatttttctccatccctttactttgagcctatgggtgtcattgcatgtgagatggatctcttgaagacagcataccactgagttttactattttattcaacttgctattctgtgccttttaattgaagcgcttagcccgtttaccttcaaggtcaatagtgatatgtgcagatttgatcctgtcatcatattgtttagcttgttatcatgccagacttcattgtgtggttgctttataatgtcaatggtccatgtacttaaatgtgtttctgtggtgattggtaatggtctttttttccaaatttaggaccttttaagaacttcttttaaggcaggtctggtgctaatgaattcctttagcatttccttgtctgaaaaggtcatatttattttttgcttatgaagcttagtatggctggatatgaaattattggttgaaatctcttttctttataaatgctgaatctaggcctccagtctcttctggctagtagtgtttctgctgaaagttctgctgttagcctggtggggttccctttggaggtgacctgccccttctctctagctgcctttaacatttcttcttttgttttgacattggagaatctgatgactatgtgtcttggggatgggcttcttgtatagtatctcatagggattctctgcatttcctgagtttgaatattggcctctctagcaaggttggggaaattttcatgaatgatatcccgaaacatagtttccaagttggttgctttctttcttctttcagtgaattgtagatttggtctttatacattatcccatatttcttaaagggtttgttcattccttttattcattttttaaattttttgtcagatggagttattttagataactggtctttgaactctgagattctttcctcaacttagttgattctgctgttagtatttggtgattgtactataatatccttgaagtgagttttcagctctatcagatcaggtttttttttttttttcttaaaataaccattttgtctttcagctcctgtattgttttattgtattccatagattccttggattcggtttctactttctcctgaatcttgataatcttcatttctatctatatcacaaattgtatttctgtcatttcagccacttcaggcaagttaagaaccattgctatttctggggtatgagtgcagttgtttggaggtgagaagacactcaggatttttgagttgctagagttcttgcattggttcttactcctctatgtggcctgatgttcctccaatatttgaagttactcccctttgaatggctttttttttttttttttttgcttttctctcctttgatgctcttatttggtataaggtgatttcagctgactggctttatttctaggacatttaaggggataaggcttagctcagtactcctgggctgcatcctctaactctggggagttggtaatgtgctcttggctttgttttctggcccctagaggttaggaatctgttgcattggagggtctgaggtgttccccatctgctgacgaaaacactccgatggattgtgccagccaaagccttcaccagggtgctggcaggatgatctgtgcttgcttgcatgtgccagcaattgtgacactgtagtggggtacaagcacatttcctgtggtggggaagcagcaggagcagggtacagtgttcctgcacatgctcactccagcggcatggtatgggtgggttatggttgccagtgtccatgcttgcacttgcaccagtggcagccatggcacggttgagacacaggttatcacttgagacaccagttgttgcggggctgctggcctccatgcatgcatgcacattggcagcagtggcagcatggagagacagggctgatggcatctgtgtgcctgtttttgccagcagtggcagcctggctaggttcccgtgtttgagcatctgaggtgatgggtggcaaggagcactcacacatccatgctggcgggggagggaaggcaaggacgacctgtgcatgtgtgctgacaaagtggtgtggaggtggccatgaccaagtgcctaccaacaaagctgtgcaggggaggctgtggtagaaggaaggtgtgagtagacacacattggttggggccagtctgctggagctctctgatagccaggtgctgtctgctgtaataggtgctccgccgaggacctccaggaagcacccaggttggacatctgaggctacaagtgggcatggccaaggtggggccttgggagaggatagcagacagggatcactcagatcagactggctccatcacatgtgcagaaccaccctactctgtccaggcctggtggtcaccctcaggctaaagtctcctaaagaagcatgaaaacccttgggagactggagtccctggctgtgctccactacagacggtcctgctccacgtccagacagtagcagaatcaggctggagttctgattctgctacctatctaagcagctccctctgccaacccaagtgtctgtaggggttgtggggtctcctgctaccaggatccatgaggttcattgtgagagcatgccactcctcagctgttcagctctccgcttcccctggagttgcaggaggccaggaagagttcctggtgcttggtagccttgtgcaggatacccagctatttcccccttccgcccagcatctgtgtcctcgctccatttactttcaatgccttctctttgaagatttgctcaaagtgtgcatttaaaacatttttaaaaatctagtttcactttcagtcttatcacttttaatttctttgctgcacttttgctgctttactctcttgattaactattttgtaaagtgtcatatgagtgtattactggggaataaacagataacacaactacacgctttgctgtttgtatgtgaactaacagatgtgcagtgaccaaacactggcagattctgaaagaagtgatgcgattggtcattgatcatgatgttcctattatttgcattataatttgtggaatggagtgttagcagcaaagtttatgctttgttcaattttttatagttgatatactgtggtaactgaaatttaaattttattgttgctaggctggcatcatttaacttaaaaaaaaaaactagtaagtgaagcccatccatattggtagcaggcaataaaaagactacttgccctacaaagtcacaatgatgacaataacattcaagaataaagaaatatgtcaactgaacagagtcaagacagtgacacatatgtatataaatcaaaattaagctacaaatgaagtgacactttaaatcagtgggcagacataacctggtcatcaaataatattaggaaatctgtaccaaagaggaagaacgactatattatactcttctagggaataatttacacaataattaataatacaagcgaggataaaacctagaataatttgaaagaaaatgtagacaaatatttttatgatctttgcaataaaaagttctcaataaccaaaaaacaaccccaaaacaatgcctagatacctgatcatgaaggaaagacagatttaactatataaaatgaatcatttctttattatatcagataagtgacagactatattacagaaaaagaaatgtcattaataataaaaagattgtataaaatacagtaagaaaaatcttataagttgattaagaatgtgcaagagaaacaaataagaaatttgcagaaaaagaaatatggatggctaatctttgaatagatttttaaactcattagtaaatcagaaaacatcaattaaaacaataattaaaacaataattggatttttttatcatcgaagtagccaaagtaaaagattaattatcactcattttaaagaaggtgcacagataactggcattcttatgctctgctagtgagagtattagtttataaataaagcctttttagaacattcatgacatcattaaaatttttagcttatatatattttgcctagaaattccacctttaggactttctctacaaaattaattgtgcttatacctaagacaaaagtatactgcagactacaaatacgaaaattagcatttcatcctataattttttttatatatctgttaacctttttctcaaactaggctttttcatcatcctggcctatctgaggataatatatgctttgtcaatattgttcttttcagtcaaacatcttctaattatatgtctacacatatagtttattcaagaaaaccatcaaaagtgatgtggatagtattacaatgtgcacagtgctcaaatataatgcaatattttttaaacaaatctcaggtgtataatactgtgtttcaataacagcatttaatggaactgtatacagagtataactgagagtgtttggaagggataattgttgccactaattaacaacggtaatggtgaaaagttattcttcactacttttattttctcatttctaaaacaaaaataataaaaccttgcatgcatgattttttaaagattgaataatatttataaagtggtaagttttggtgatgataagtagcaattgctattttttatcttaaaagtcattgggttacagtatatataaacagactttgcctatgtaaatgatcgtttctattataaattggtgcaccttcaagatagagaagtatttttaagggaaatgtaagaaaatatgtattttgatttttaatagccttgacaaaaatctcctcataaatcatttttattctagtaatttcttttaagaaactatcctgttatatagacttctgtgaaaaatcagtatatgcatttcctcatttatattttccagtaattgaattgcttttaaaaccctcacagcaatttttattagtgtaaatcactgcatttaactatttttatctttttgagctcatttttggtatacacatgtgcagcagagcaaaaaaattgatatcaagttgtatataaataccatatattagaacaagtgcaaatatatatcctagtagatttttaaaaacaatgttttggtaaaaatatacctatactggaaattgggataagaggacattaaggtttgacactcctttaaaataattaaagcaaaaacttccatgtctctatgttaactttatatatcttaagctacatttctcagtatgattagcttgagaaatatttcatttcagcttgacagactactactcactacctattacctgttctaaacatagaagataaaaaagaaaacaaaagaaaaacaaattcctggtttcagaattcttgcagtagcaaggcagatggataaataaataattaagaaactgagtggcatatgctgaaactgaggtttgtacagggcacagtgttgggaaaagggagtggtaatcaactatacatggagaagttagggaaagctttctatgtatttaattcactacctttgtgttatgctaaataatcatctcacactccttgattaaagtcaaatagacataatgtatctagacagtgactaggcacggaattgaaccaatattaaagaaaattaatttgtgggcatgaattttagagtcatgtactcacctgtccacctcacctctctctccaattttgtgtcttgtttggtatgtaaatttcacatgttcaaaaccgagctcttgacattccgctcctgaacttactgctttgtattcctctgacttccaaaatgatctttctgtatgtcaggcaaagaaccatagggtctttgcaagtatgcttcatgtgcatgaaatgttcgtgtcttggatattcacagctctctccctctctcgtatagttattcttgttttgcttacctctgttttctgggctacgttttatttttatgttgttatcatttattttattccttattatttctactttagaaaatgcctttgagatatctgttttattaattggcatacattttgcttttcctgaattttttgactgtttaatttttttgcatataacaaaggaaaccccagtattaaaaacacgattaaaattcccaaatgaaatgaacgcgaggtacctaagaaaacattgttctaatgaacacatcattgggcaataggagaacaaatttcctaggaatatgattttataaaataaaataaagtttacagacaacgtaattctctttagaactattagaagtgttatcaaatacatctgtaacagtatatcttgtgtaattctgttttctattaataattatatcaaagaagcaacatatttggataatcaacttatataaaaataataaaagtaaatacaaggcttcagggttatataaaccttcagtaaattataaacatattgaatattaaaacattaaaaactaaatattactttcaataattcattcttattacaccaatttcacttggataattatagatgtagaattaatggaatttaagaatctgttatgcaagattactgcctgtccacttactgaaactgaaaagttatgtgacttaggtctcagatttctcacataaagcatggaaataataacataatgactttatgaggactacattggataatgcttgtaagattctctgtttctttagtgctgggttaagttttaacaaatgtatatttcctgaagagcttagattcaagttagacatatttttaaaaatatatatctaatttttggtagagttacattatagtttattacacattttatcaatttcaaaaggggcaggcaacatatctaatacaatatttaaagtatagtaatctgccgggtgcagtggctcacgcctgtagtcccagcactttgggaggctgaggcggaaggatcacgaggtcaggagatcgagaccatcctggctaacgcggtgaagccccgcctctactaaaaatacaaaaaagtagccgggcatagtggcgggcgcctgtagtcccagctactcaggaggctgaggcaggagaatggcgtgaacccgggaggtggaggttgcagtgagccgagattgcaccactgcactccagcctgggcaacagagcgagactctgtctcaaaagataaataaataaacaaataaagtatagtaatctaaaaaactcaagggaagcaatatcttgaaagacaattcttaaaaagattgttccattaatttttaaaaattcaatggcataagggataataaattcagctctactggtaaattatcacattaataactagaggaaaatataggagaagtacgtattttacctcataaattttggttgctagttatttgaagttgtttaatgattaatgtcctgttctgtaatataataatctcaacacaagaattgctttaattgtcagaaaatctcattttaaaggcacttgatatttaatatttatcaacctcccactgtacacctggttatgtcttagacacagggagcacaggtgaacaaaacaagagtagtctctgtgttcatgagatttaaactatattaaaagaatttacacaattaaatataatattaaaactgtaatataggaacgtctcttggttattctgacgttgagactaaaatatttccagccactgtttcatagaggactttgtagtacttgggctagcttaagaaataaaaatgatataagccagtagtgttactttcaaacaccagtcttagactgttgataatttgggaaatatatagttagctcattgcttatgttatgacaacatttggggaaagatttcctgaagtatgtgcaatattttgttttgtttagtttagcatatacattgatggcaagtattctgcaaaggacataagctatatgtggggtgaaatcataaaagtacctctttccatcatcctaataagtctgtgaattgctttctacttggccatgtttgcactagtctccaatttttacactgtacctcacctaaacatatcactaggattgtcttaaatgatatatattttactttttgctgtaccgaactactaatcaccatttataccaactaattacaccccaaggcacaaaggggagtaaacttaattagtctgaaaccccaacagtgcagacttgccatctagtgatgacagaaggtaactatagattacaaaaactgtctacacatatttatggaacacttactttgaagcactggcaaagatacaaagatgagtaagacacagaatttgacccaaggagttcaaaatacagtgagagggagaagacacaagcagttacgtttaaggcaaaaacattgttaaatggcagaaagagatacatattacatgccaagagaagggcagaaagatgatgaatgaactctgattgaatagatcacgtaatttcctataatacacatatggtattaatgactaggatactgggaaacaagtttaccaggtacaaatctatatattgcaattaaaaacttgtgaatttggggaaagtttgtgacagaaactgagtgtagaaaaagtggaccacggagggaacaccattagagaagaaaccacatcatattcctctcatttcactagaatctagaatagtccctgattgatatctacattaatttagttaatatttgtttgcatgttaattactgcaaatgtgagtaggaagcatgattataaaaaatcttgaaatatatagataggaatacttaaaaactgtttgtatacagtattgaatattaatatttttgagactctatgacagatacttctaactgcatacccaatactttttatttccttaataacagaatcttatgtattttcagagcagcacatttaaggaaataaacttctccactttttttttaattctaggatagtaaaatgacacagttctggccaaggagataaaagcagaagtcactgaggggtgtttataggaggccctttaaaagtctcggatggggatgtctttgagctcccaaaaccaattgcgagcatggagagttgcattgctctttaagaatggtagagcagaaagctgaaatgagaccagcttcctgatgacattatggaaccatcatagcagccttggactgccagattccaaaattcttatttaagtgagaaaaatataaccttaatttttctaaagccattttccccaggcttctatcattggcagccaaacagaattctgaaattatacagacactgactaaaaagtcagaaaccattgtaggtagcaaagcatagattgaattctgaggatgtttagaacaagaaacttgctaatatcatattgccactgagactatatttaatcacacttttaccactgttgggactgctattctcctcatcactcttcaagtaaaacactatgcaaaatccatgtcaagcaccattgtttctatgatgccttacctaacatccatttagaattaatccctctttgtgcttatcttgctcagattactactataatacttataaaagtatagcaggcagtgtgtattgcttctacaaccctagactaccctggttaatagaacctcctttttttttcctagaaagaaaatgtatgtctgccctgggagcgtggcatggttgatctaaactaaaaagagctatcttgtcctgttttgatgatatttgttttctctggcttctgtgcataagacccagttctccccagtaaaacaccaggaagagaaagttggcttgagggttcctagacatgttttttttttcttttcattgataaaagaagagagcctttgtagaaaatgcactttgttctttcactgtcttgcttcgcttttagatgaactcctggtgcttgaagctacatcatcttgagaccatgaggcaataaacctaagcatgaaattaagcatgtcactgacgggaaaattctgggtcatgcttggtgaatcaaagactgaaaccatctatctctggatttcaatccttgcattaaaatatacctcttattgactaaaattactgaccaatacagaaagaaaatatttatgaaattttctcagtacaatattttcttcctataatacattatctgatattaacagacactattttacatacaaagaaagagaagctaagaacatcaaagtagcttgtctgaagttgcacagctatgaggtagatattacttgacttaggtatgactagtttcttccatttgattgaagatggctgtgaatactctctagccccactcatcaaataaatggattacaatttttaccttgatactgtataaataaatgatcagtgaatgtgaagacaggtaactcctttaatcatgattctacaagaaagattcaaggcaaccatttgtcaatttaaacgggtaagttttaccttttgtttttagaaacacagtgaatttggtcaggtgatagacttcttttaagtgttcttaatttgatatgcgacactctgcttttagtttctcttttcacaaccgaagttgccttttcagaagaaattacggaaataggagagtgaaaataggatttgctgcttttgacaaatcacctattgacctcgcaggttgttcaacagtttttatggctcttgggtaattggaaattcataaataactcaaaattattcatattaaaatgttttctgattattgattaggtcacattcctttaattttactgagatatgacttcttagaaggaaaataaatttacgttgttttctagagtacattttattttatttattttaaacaaaacaaaacaaaaagttttctaaggccttaacaaagctactccttttggttgaattagatactagtaaataagatttgttgttcactagaataatattatttgagttatgtatgctagttttctccaattattttaataagaaatatttaatatttaacaatttctcaattttctgtttttcaattaacactcaatgaaattagttaccaatattatcagatcattagattctccattttaacaaatttttaaataatgtcatactttgtttatatatttcttagtatacttctttacctaaagtttatttatttctaatttgatgaataaactgaaacttattttccctgttatgttataaagtttgtcataatatttagagaatcatggcagtttcagattttaataatccatataagaattactagacatgctatacattaaaactgtgtacagttcattagccggtttgaatgtcacatttaacctcagcctacctttgttcccatgcagagattttgagtgtaccactactatttgtgtaagcaagtaatttattgttatgacatctcttatttggaggtgaaaacaatgcagtgtggaactagttgtaagtggtttgtcttgttgcaaatttattgtatttttaggtcatacattaacatgactttaaaaagctcagctgacttatctgattaatatgattgatataaaattatgtcaaaaaaatgtgttgcaattgggcagggcgcagtggctcatgcctgtaatcccagcaatttgggtggccaaggcgggtggatcacgaggttaggagttcaagaccagcctggccaacatggtgaaaccctgtctctactaaaaatacaaaaattaacagggcatggtggcacctgtctgtaatcctagctaatcaggaagctgaggcagaattgtctgaacccaggaggcagaggttgtagtgagccgagatcgcgccactatactccagcctgggcaagagagcaacactccatctcaaaaaaaaaaaaaaaaaaaagagttgcaattgaaaaatggtcaggtgagaagtatctatatacttacctaaagagcaatacaatactttaaaaaactctataatagctaggttagaacaaaccaaaaattaaaaatttagaataaactgtaatatttatgaacattcaattaattggtgcttcatttttagaactccttcatgtatcatatagttacgtagtacaattctgctctgcagagtaacatacttactcttaatgtgcttaaattcagagtaaaattattttgagaaatgaaaattctagtataaatattaacatatacaaatatctataagctgtaagtacatgctattttccctgataattttataaataagaatgtaaaataatacatgaaaattggataattgtcattttttcagacactgattatttcattatgcagcacaagttgagtatgattatgtgtgtgcatgtgtgtgtgaaacatgcatatattgtatgtttggtacacatgttgtgtattcatatgtttataagttaacataagatgagaaagagctctcgctgtctctctacatagcgagatgtttgtgtgcatatgtgtgtgtatatatctaaacagaaatatgccatctttttacctttgaaaaactaatatgggcaatacaaccttgtccagttaatttcttcaatttttttttagttgttgggtaacactagcaaacattctttaaataatctggtttataccagtggtttaatgaatgcatttttggtactagaatgaaatttattgcaaatgagcgtttatctaccaatcagtagttaatgaggttgtaaatctgatagttgttgtgattgtttcacatgttgttaaaccattaataaggattcataaaacacagttgaaagttaagttttgtttatagaggctatcattctgaaaacgataaaagagtcattcactaaatttactaagtaagcaatatttcagacacaaattaggggagtctaattattaggtacaaccaagtaatattattatttaggaagatcaaatttggcatgtcaggccttttggtagcatactaattggcatagttacacttggttactaattaattggttttacactagccgtctgtaaatacagtgtttcccagaggggagaggagaggaaggacaccaactttatttttaaatgaacatttatttttgtgctaatgagggtgttcaggggtacaaatgacaagacccaactcaaagggtacattaattgcctcacatagtaatgcagagagaggacagatttgagagatgcttgacttctttgctcaattattttatagaatgcagggtttttgcattttcccactttgtttcagtgctttccatggttaatgttggtttccttctcaggtcaaaataagagatcgcatctagaaatgataatcctcctccagttgaggcagattttcttagaagcttcctagtataccaaccttcatatcacactgaccagctatcattagaaagaaataagcaatttccaagattgacttagacccgtcatctgaggtgggatgatggttgagaagtcaacattaatattcagcataatccacctttaaattttgtattatattagtactatatgatgaatgtttaatctttgggcagccagttctttcatctggatatttacaattttatttctgaatcaatctgaaaaatgaccgcctgaactatatttggttccctactagaagcacagtgtaaaaatgagtaattatgactgggcacgatggctcacgcctgtaatcccagcactttgggaggccaaagcgggtggatcacaaatcaggagatcgagactatcctggctaacacagtgaaattccatgtctactaaatatacaaaaaattagccgggcatggtggcacgcacctgtagtcccagctactctggaggctgaggcagaagaacctcttgaaccaggaggcggaggttgcagtgagccaagattgcgccattgcacccagcctgggccacagagcaagactctgtcaaaaaaaaaaaaaaaaaaaagagtagttatgttaagactccaaagggtttgagcatagtgtaaaaatgggtaattttccttaagcctctcaggaaaggagttccagtactaagccaaaacaaaaaaattgtgtactaaatgtatactagagggagtaaaagacaacctgaatgacatagaataatgcatgcaaggcatttatagactttctttgattttatatcctccattaattttgaaaatcatcaacttacactgtcataacatattaaaacttgaacaatagttatacagctgacacagtaatgttttgatatgcttgtcatatttacagtggtcacaatttcaatttttcctttttctttttttttttggtttttgttttttcatttcactgtggtcatggtgacccgtaagccccagatctgtttgaagaacatatttcgttgaattacatttgatttaatttcatgttttcattgaaaaaatccacacgaaacagccttaatgattttaaaatgttgcataatgttatttaaaacattatccactacatttttgtaaagcgcaagtgaatacttacctttagagttaattgcttgaaaagctttgctacttctgaggctgctgtgtactttttctgtattaattaagaagtatgtgacaggaatatggttctttttgttttggttgtctgaagttttacagccaaatttaagaatgaaccataatttttataaataaaattaaagcttgtaaaacattttatgttatttttatctcaatcttaacattcggatttgggttctctgtggttctgctgtttctaaaaatattttgttagacttgataaaattcctacaaactgactcataatttagtgttaaaagggaagaggtagatagacatagataagcagatatattttgcattatgtaaattatatagttaaattgatttttcctaggctggtatgtaaaaaagtaggaattatacaaatatttgctattattatcagtggctaatttgaccaacacttatactgaactagcctatgattatttttatttgtactgtaaatgcagctacagaatatatcattttattaaaattaaattttagttgctatgatacttgagagttaattacatttgtgatatgctctattgggaatgcaaaatctcatatgaggcaaaaccaaaattagaatttctgttactctcttcatagtgatccattatctaactaacactatcaaggatggggttttgtgagtgacaatggggtgtgaaagaacttatgaatttattcattctataattaatataaggtaaatgaacacatctttaatatatcaagatctaatatggctccagtataacttttaactaagtttcatcataatgtatcataatctattttgatataactataatgagatgaggcttgaatatcaacagctatatgtaatattcacaacataaaatttaaaaaattagatctgaccccaaagcctatttttaaaaatttattcttataatgattttttttttttggagatagcatgtcaatctgttccccaggctggagtgcagtgatgtgatctgggttcactgcctcttccacctcctgtactcaaaggattccccccactgcctgccaagcctcccaagtagctaggactacaagcacacaccaccatgcccggctattttttaatattttttgtagcgacagacttccaccatgttgcccaggcaggtttcgaactcctgggctcaagtgatctgcctgcctttgccttccaaagtgctggaattacaggagtgagtcaccacacctgaccatatgaatgtatttttgtacaggaaatgtacaagttgaggctgggtgtgatggctcacgcctgtaatgccagcactttgggaggccgaggccgggggggtggggggacggcaggtcacaaggtcaggagttcgagaccagcctggccaacatagtgaaaccccgtctgtactaaaaatacaaaaatattagccaggtatggaggcatgcacctgtagtcccagctacttgggaggttgaggcaggataatcgcttgaacccaggaggcagaggttgcagtaagctgagaccacaccattgcactccagcctgggtgacagactgagactccatctcaaaacaaaacaaaacaaaacaaaaggataggaaatgtacaagttatggctagaaattctgaatatatcgtaactacctttgataagacaaacagaaatggtgtattttttcactgaattatcacagacaacacagaacaatactggtaatcaaacaaacattaaggcaaaattgaataaaatatattaaaatgtggcaactattaatgcttacagaaaagcaagcacatatggaagaagaagaaatagaggatatctttgaaagatttttcttgggaacatagcactgaattctaaatgagcagatctgactttgatttgaacatttgtgcttatcagcttttaacctttgtggaagtagcagaggctctctgagcatgatgctcacctggaacatggtgttagtttctattctttcttcgcacaactgacatgaagaacaaatattaaagagctttatgaactgtacatgtaggacttagtcttttgttctttttgggttaattaaggagtgaaataaagactgggagtagcatctcaggcctcataaacaaaacatggccgttgatactagaacacagatacatgtactttgcccttattttagaaaactttttctgtttgagaaaaattactcatgacttaatagttatggcaggcttccagagtgatccctgaatattcatatactagtagttgtaaataatctagaggtcctggaattcctgtgctattttatagtcatgacttggagagatgatataaataagcatgtagatatgcaataagctatatgtgtgtgtgtgtgtgtgtgtatttagtatagataattttccacatatgcccataatacgtacatatgtgtgtatatatgattttgtgagataacactttaagaaatatgaagaagaaatgaaagaggaaaagaaagaaagtaggttgatgaaacctatgagccattaataagaagaataatgatccttacaagtatttgatccactgaggaaagagaagaagctgttggattaccactgtcttttgcatcggctccttaatagaagtgatggcccaagacgagacagtagtaaggggtaaagagaaagaaaatttcaaaaagaggaagataaagggtttacatgcaaatgattaaactcatagttttatataaatcactttagtcggtgaaaaacattatctccctaatgttatacataatcctcacctcagagataacataatgtataaaactagggataaaataacatgcaaagactgaaagtttatctaggtatagaaatcatacagataactgagtaaacatcctgtaaatatttcagttaaataattacataatttttcaataaagaaaagctgtataatgtataacgaaaattaatagtcaatgggaatttggggaaagacaaagattacttcttgttttccagatggtaatcactaatattgtgtatcagtttttttgtgctacatgttatgaatattttatattttatttgtttattttgcatgttatttaatttatcaatatattataggttactaatattttgtgtatatatggcttacgtttatatagcagataatatatatggaaccaagcactgctctaagtgtttcagtaactcacttcattctgtcagcaatcctatgaggtagattcagatcaagaaaatgaggctcagagagcttaagtatctttcccaaggacgcacaggttaatatacacaaaggtcgcagtcagatgtgtaccaaggaaggttgaaaaccagcagcaggctcttatgacaggtgggtctaatcttggctttgtaatttgcaagatgtctaacctaggacaaatcactttatctctaaggggcttatttttctaaggtctaaataagtaaattgcattaaatgatctgtaagattgcttctagttctgttacgcctatgtcttggaatcaacggattcccaatagtaaaaaggatataatgaatatcttaattgagatagggtgagccagagagggaaaaataacatttaaaacagcatatgtttctaggttgcaaagtagaacagaagcatttttttgttttctattacaagtgatttgtaagtgattaagtaaggctgaggaaatgcatattcaattttattttacttcttaatccaaagcagactgcaggctccaggcagctgccacattagcattttgcaggcacacatataagttcaattccttataatcctgttttctcagtgctaaatagtcagtgatcatgaagtcatggtgttaccacaaagctaagaaagtaatgtcatgtcaatttacaacctttagaaacacatttctaaattaaatggaaagaatatgctaatgcaatattaaggctgcaactttaaaaatagaaagtcaagacctacagaagttatggttttcattatcatcattaacatgactgcatcacatacactgaatatattagtttttttttcttacctaacttgtaatccaaagtattgcacgtatctaacttaatattatttgggagaattcttgcctgcatttcatgagttttgtactttatacttgaatgcttaactttatttaaaaatgtatttcatagatacatatgccatcaattattaatgtactaataaaaaacaagcaacattatatactactagaccacacacaaaatttgcatagagagtgatgtcaaaatttgtatgtacacaaggatgtttttctccaatacaaaagttttaactgcctaattttgcttcgcagattgcttatattcttctaaatcttttctgtctttcgtactgtctcatctgatcattcagttcctcctccttattccttggttacccagccaattcctcattgtcatgtaacacgtactccagtttttttgctttttaaccactgttccccataaaaatttacctgctctatgtcctgtttccttgtagtttgttagatgatgaatttctgagtcagctgaagtagaaacaagacaatcaagtcacctgaagtgcttcgaaagaattactaatgcctactgaatcagaacttttaaaaatgattttcagaatatgcatttaagaaaaaaactcttcgtgttatgccagtgttttctcttgttaagaaccattttgctcagtgtttccatgacacttttattattactctttctgttattatcattaaagtattaataatcaataattacaatatattggcacttttcagttacagtagcattttcagaatactttgaggattttagtcccagagaatgaataatacgcgaatttcattcaggagcaacggaaagttacttccgagcacagggactcaaattgatgttcatgtggccaagtactaatgaaattcctcaaagtgagcaatttcattttgaagccagaaacataaccattatataaattcatgtcagcaaatacaaaaggacatttagaaacagatctttacatgctttatatgcagaaggcagatatagtgagaagcagcgtgtcagaaactttggataaccgttgcagttctgcctctgtggcatagtgatattgcttaaatcatttaaaatcactaagacccagtttctttttatacaaaaataagataattacactaatctctgagtaactgcaaaaatgactgatggatactgtgtgaaaatgtttggtaaacataaatgcaatttatttataagaatatcattggtatacatttaaatgtaaagaattgcgtatccaagatttccattttgtttaataagttcgtttaattaaattaatcttttcctcttcatcaaaaaaatgtattgcaccttttgatgagaaaattgtgcctaatattttttattgagacatctgtggaataatgaaatgagcaccaaacttgagtcagaaaattttcattgatacattaacatctctgaagctcagtttttgtatcttaaaaatgttgcaatattttctcacctaagttaattgcaagatttgaaataggtaagttttgtgaagtaaccaagtagagaataaaatattaattaaataagcacaacaatgaatctatagttatgaacaggcaaatattccgaatgaaagaagttgacttctagaaggacacttaacagagaaatctgtcctagttggggaattagaagtgacacttgagccaagatctgaaaaactgtacaccagtgagaatttgtttccatcatgagccaaggagatttccaaaatagtaacttatttgagatttaagtataattcttgtattagtctgttttcacactgcttataaagatatacccgagattgggaaatttacaaaagaaagagatttattggacttacagttccacgtggcagaaggcaaggaggcgcaagtcacatcttatgtggatggcagcaggcaaagagagagcttatgcagggcaactcccatttttaaaaccatcagatcttgtgagacccactcactgtcatgagaacagcatgggaaagagccatccctataatttaatcgtctcacacctgggttcctcccacaatatgtgggaattatgggagtcacaagatgagatttgggtggggacacacagccaaaccatatcaattttccctcaaataagaggactttttaagtggatagtctatggctcatttggtagtaatgctaaggtattctgggacttctaaaagcctcaggttgaggctgtcacccacatggtccaaaatgctagctagaaccaagccatcccaagtacattcagccagtaatggaaaaagagaaagaagacataatgttttactttaaggagacttctctatatgttccacaatatttcttactagatattattggtcagattttattgttagaaggacagctgataaatatcaaattcatactgagaaacgtaatggttataaggcaggtttctgttcattggggcagactgggactaaatacatagttatctgtcatatttgtcaaaatgatcacagaacaattttctgaacaattatgtggattattacatagaaaaggtgagaagaaggattgagagcaggctagagaagacattagggtatgtcataagtgactgttttagactcaacaatcggaatcagagggaacatagtcaaattcctactttaaaaagactacttcgctatttgaataaaatatttaatggagccatcaaagcctgaatatcagttattaggctattatggcagcccagacaagagagatggtagcctaagcaaggatggtggctctataattttttgatacacttaagagctatttaggaggttaaatctatagaactcagtattttaactatattaaatataaggaaagaagaagcgtcaaaaatgccttttgtgtgtgtgtgtgtgatggagcctcattctgtcacgcaggctggagtgcagtggccgtgttcttggctcactgcaatcaccgcctcccaggttcaaatgatcttcctgcctcagcctcccgagtagcttggattgcaggtgcctgccaccacgcctgactaattcttgtattttctgtagagacggggtttcaccatgttggccaggctggtcccaaacttctgacctcaagtgatctgcttgccttggcctcccaaagtgctgggattacaggcatgaggactacgcccagcgagaatgacttctaagacactgtttcctctgtctctgtctctctctctttctctccaattagacttggttatatcattagcaagataaagactattataagataatgcatttttaacttagtgagctcaacatggtacccgtgatttccaaatgaggataattcatttcttcctagcctttcagagtaattcattaactggtcaagctatccgaatttcaaattctgtctagtgttaaaaactctttatcataccccatagactacatggaggacagtacaaagtccattttttctcatattggcaacagtgtagaagtccagaatcaggctctactaattgaaagtccatttgatatagtgaagccatttcataattgctatgtcactatgcaaatgttaggcactattatgcccataatttattatttaaatactatccattctagttattaaattggtaatttaaattatatattatacataaaatatatttttcattaattaacttattaatgcggtaatcacagaattttccaactattatacttgttatgtgataaaattgtatctgtggctatgtaaaaattataatttctatctttaaattcatatatagttattagctctaatgtattcaaaatcttagggtttaaggccaggcatggtggctcatgcctgtaattccagtgctttgtgaagctgaagttgaagattgcttgagggcaagagtttgaaaccagccttggcaacaaagtaagactctagtctctgcaagatatgaaaaaagaagccaggtatggtggcatgcacctgtagtcctagttacttgggaagctgaggcagaaggattgcttgagcccaggagctcaaggctgtagtaagccgagatcatgccactgcactccagcctgggcaacagaatgagactctgtcctcccaaaacagaaaataaaaaaataaaaaataaatagggtttattactcatgaatgttcatggtcttgtaccaaactgtcatgtggaagaaaggacaacatagctctgtgaaaatgaagagagaagaaaagaggaagacagagaaaaggtcagataatcacaattgaaggcacagtgggagcaggaaaaatccagactgttctagcaacctttagagcttactagaaggaaaggaaacaggagtttgttttagaagtgatgaagagatagttttgtttgattaaaaatggaatcctattcaggaaaactcacatgagaagagacaagatatgatgtgggaccagaccccagataatgaagcaggagttcatatcccaactcattaggaacactaaatgaaaaatgtcttcttctttctgccagagatcttggaaaccccagaaaaactttccctattgatggacctcgcatctaccattagataaactgcaaaaattatagaggggtcagatgtaattttggcatgattatttaagggctctttctcaacaattttaaatcttctaagttaaagagataacctaggagaactgcagctactagatggttggaaattatgaatttggatgaataaacatgatgggtatattacatacaaaattggtatgaattatttgaagatttaaaagtttcagctggtttggtttcagtgatactacaccacaactcaagacactattatctcaagtccatggttctagcaattattttctttcttctccacaaaacaatgcttaccttgtttctggacggtttatttgctcttgcaaggttcccacttaattacatctgctaaacccaatggcaaatacttagtcctcatgttcttagaagaatgatttgtgatactgttttccattcattttttgttgttttaggaaatcactttgtcgtgtttcttttttcctacaacatgagccattctttttttttcttcctttagatggctctgtcccagaccgagaggttaagagacattgaagactttcagtgcttagtcattagattattcctgttctctgtgctacctcacttccttgacatagaataccatcatggatgacttctacatttattgctccagacctttccttaaactccagatttgtgtattcaattgtctgcataacctcactacttgaatgtataatagacatctcaaaatggatacttccaaaatcaaactcaaaatcaaagtcaaataattttccttccagatttttatctcctcctgttagacttccccatttctgtaaatggcaactccacatgtccagttgagagttgtgcaagccaaaagccttggagtcattattagcttctctttttcttacacatcatttccagtgtgtcagcaaattgttatgattctacattcaaaatattttagattctaatcatttcccaccacctccaccactacaacccttggttagatgccatcacttctctgtatctttgcaataaaattctaattggtccctgagcttccacctttgacctgcctgccaccactcagtatgtttccatcacagtaatcccaaatcagattctgtcactcctctgcttaaattcttcagtgacttccattttttttcagagtctaaactctcacaatttacagaatttgacctgatcttggcccttgtttttaccttgaccacatcttatacttttattctactatctagctatgtttggtcaactctgaccttcccactgtaaatcaatccaggtcttgaacaggtcaaggaccaggtttgtttcccaccttagggcatttgcaactcccagtcccactgtctggaacatcttaccatggattcttcatggaaataaaccttattccaagctttttttctggtgccaccttctcagtgagagcttaagatcctgtttaaaagcggtatcttcactactcaatacttctggtcccttccttgcttaattttccttaacacatcaccacctgactctctaaatatgctatttatttatttgtttatttttgtccctctccactatataatgtctatatagtgtcagaagatggaatagtgtctcgcacatggttgacacccagtaaatatttgttgaatgagtgaataaatgaatgagttaaccaatgagacatttaacgaaatagggctattgctatcacatctgaagcagataaggtggaaaagccagaaagcaggatctgtttgttttcatgaaaatcacttttatgtgtttctcttcaagtaagggttttgttctcacacaaaatcttggtgttatgcatgtctatggttcatcgaaagatttggaacaggctgtgtgggattagtcagtcaatcagactgaagaggagctctggtaagtacatagttacgtgtctggaatgtgtagcctatacagagagaaggaaaaaaatgtatatatgaaaagtgaaggaactttctacagtggccaagttgtcacagtccagaggcctgggggctgtttttcatgaaaagaccaaaacaaagtgcaggatgctacacaaataaagaaaatgaattcagcaaagtcatataatacatgtacatgaaacaaaagcacaaagtcaaagaaattctatagagttcagagactaagattaacatcaaaagcagcagcagcagtcaactttgtagagaactatatgaaaacaggacaagatcttaaactggaatggctgatcttggggagaaaaatcagagaatcttgaagtccctgctatgttgtaatatattaaaacactatcgattatgtaaccgtacatgaagtgaacaggaaaggaaagtaaaaagacagaaacaagacctacaactaagaaatggtatagactcaactagcaactaaaacaaacaaacaaacaaacaaacaaaaaactagcaactctaggctgggcaccatagctcatacctgtgatcctagcacatttggaggccaaggcaggaggatcacttcagcccaggatttcaagaccagtctcagtaacagagtgagacctcatctccacacacacacacacacacacacacacacacacacacacacacacacacacacaaaattagccaggtgtggggctgtgcacctgtagtcctagctattcaggagcctaatgtgggaggattgcttgaacccaggaaattatagctgcagtgagctgtcatcacaccactgtactccagcctgggtgacagagtgagaccttgtcttaaaaaaaagagaacgaaacctagcatctttagagacaggagaaataagtgtcattaatgcaaatggtgtttatatctataattaattggaaaaatgtatacagatttactttacagtaaattttagttagaataatgtcttcacaaccaaataatttaaatcatattaaaaataagtactgtgtgacatttagcaaatttacctttttgtgactaatttcattcatctataaaatgggtattatgagctttaataatcttttcaattctaatattatataattatttaatgtaaataaagattattagctgtctgaaatatgtactttggagtagaaaataatccattaatatgcatttaaatacccaaattgtgccagaaactgaaagtataagttgaagtaaaatatgatgttatttaaatagaaacaactatggggacagggttataaacataaatacacacagagatatacacacataatatatacaaatgtatttacattcctgtaaaacatggaaatgcatatatctgtgcctttatatattaagcattatataccttcatataataaacagtaattgtattcattacacttactgaaatataaattgaaatttaatggctgggctgctggttggccaggtgcagtgactcacgcctgtaatcccaacacttcggggggccaagggaggtagatcacttgaggtcaggactttcagaccagcctggccaacatggtgaaaccccatctctactaaaaatacaaaaattagccgggcaaaggggtgcacacctgcaatctcagctacttgagagtttgaggcaggagaattgctcgaacctgggaggcagaggttacagtgagccaagatcgtgccactgcactccagcctgagcgataaagcgagactccctctcaaaagtaaaaaataaataaataaaaaataaacaaaaacaaacataaaaaacaacaaaaaaagaaatttaactagttttacctagttcatatagatatttctaaagagttaatgtaattttatggttacatttaccccactcctacaactcaggatgatgccatatgatccatatgcccaaaggctgtatcaaaggataaaataggattatttctaatttaatttagacagtcacatcacaataatttccacacttgcctcagtttgggtgctgttcatattgtgtttaatttcatgttgctacattctctttgagacataagtgttacagatatcttctgtagtaatgtagccaaataagattttgtggtgatggtagtttgtgtgtgttcctgtgtatgtgtgtgttgggtgtaagtgactttagatagaactcatatccttcaaacattgaaaagtcaaccactatttttattcagtttgcgtttttgtattatgttttagttactgtattcaaaatattatattctctctatatctccctgaacagcatattttattataggtatccttacctttaagtagtaataaatgttttcgacctagtaagttcctgttctgtgtgggaaacacgggagggagaagaaaagacacacacacactaccttaaagggtaaaaaacctttatcccatgtaaatggcaatgcagatgtaatgagcaaatgatataataagcagattgatataataagcaaatgatataataataagcagatgatacagtaagcagattgatatgataagcaaattgcaatgggaaagggagaagggaaaagatatttacactcaccagactatggaggattcaccaccagactgggaagcaacagtctcggctccagagttggccactcatgtctgtgcacaggcgaggagaggtctcatgaagtttcggcgcagtctgggaccctaactctttttgtaatgagttgtttcgcataaggtccagtcaagagggctctttgtgactgggctcaaggaacacaaaaaggtcaacttgtttttgtgattgtctattgttttccgataactaacatataggaatagattgaaatagagatttctctgaaacagtgctggatgaatgcctcaaggagctcacacaacctgtttcgggacttggtgactgttgtttgtgtccatgttcaattgagttcaaatttaatatttaactttcccttcacagtcggcctccatctgatactcaattgtaggaaaatacccttacagatacatagggaaggcatagtcgatatagattacagatacggggtaagcacaggagaattagaagcacaattaataaaataccacacccaccatggctttgcaaggagagtcatattgtgagaattgccagtgatatacacataagattcaatatgcagtaaatcacaaacccctccttgggctgcggtacgcatatctaatgccattcgattttgcaacataacagtacgcagctgagcaaattcatcttataacaacgtaagtccagtgctactatcattaagagctttttgtacgtgtaagctcaatattttaatttgttgctgaagcaggattgtaccggtggcaggggagaatactgtgatggggtaccaccaccagggggtctggtgcattcataatcagtgatgtttgtaagcatctagattactggggaggggactattatcctggatgttgaatgtaattaatggccaccctgaagtgcatctccccgtccaagtgggggcaggtattgccacccgtaggatccacgtgcccagagggcgcccagggaacaggaagagttctactataattgtattgctgtcatgtgtaatttaagtaacaaaggtgctgtgtctcatttgggtttgggcaaaatagactgtttggttaaaagaagtccaggttggattacaagtgttattatcccacccccattggtattggcatatccatccagaaatgttagcagggatgattctccaaggtagcccattcctgggggcctcccgcggcaactccacacatagccagtaccgactgcagttggcttgcgttgcaacggtggctacccagttgatgaactcattctcagcctaagacatgatgacccaggtactgattactagcagacaggttattctctgtaataacaaaaatggaggggaggatgcattatttttcttcgttaggaaatagtactatgccttcattttctgcccctatagctacaaggtcacaagccttaggggcaggatctgatggacactgtacccatattttggctccaagatttaagttgccccctttggtggacctgaattctccggttctgtatgttatttctattggggcagaaatttccttgggggttaattgttgacaaggtaccactaacaattgagcaacccgcatctgaggttatatagcaaaagaatctggagtggtattatataaaatgacctttaactctccctggtaatcactatcaattatatcaccatacattatgatgcctctcattgcaagacttaaacttattgtaatccactcatccacattcaagtttgcagttatggtgggaattttgccctgttgatctgcccgctgattaaatagtctgtcaagagaaagccgaagatgcatgagcatcaacatggaaaacagtgacaatggcagtgtgaggatattgctttttcccattaatttttcatattttaatactattagtttgaaaatgagcatttgatatggcaaagtatacgtagagtgtcaaattgaagtaaatgctgctttcattattttatcacaaagctactcgacaataaagaggaatgaagcactattgaatgttgtacctcacagtcatgctctgtaggaatgctttgttcattaaagtaatagttccagtaaagattcctctggggattagctggcagagtggctttatacacaggcatttttttttcataacaattcactaataaattatggataaaaatacagctacccaaagtgggtaacatcttagaggagctctgcaatgctgtgacatggtgagtgtatcaagaacattctcttgtttttttctattgccagatgtctagagtccctccatcctctgggcatcatccaagaagtctgggccaaagaaaaagaaaaattagaaatcaaagataaaatgtttactctctaataagttccagtttttaacgtactcgggctcctttatttagtcgtcaagccagtatataccaataacattgtaacagtttgcttcagtaataaaaatctattacagcatacagtggtaacatgtgttctaacatgtaattcctgacgttgagcttcactgtgtaatgaaatattaacataatttaaaatataatatgcaatcaagaagatgctaaaaggatagtagatagcattaaaataaactaatcattaatagtttattagtagataatggggtagattatgtgatatatataaataaacatctgtcataggacctgtcacatagaagccactcaaatattttgttgaatcaatgactgcttagactcctagctgaccatttttcttatttagtcatggtgattacattcaattttggttactatattcaaaaggttttaatctcaccaatattatctactggaaactaacctttcactaaagatgtccttaggcttctagaagcaacaccataacattttctcatcttcctgcttatcaggcagtgatgaaatttcctctgatactgtctattgaagagaaattttaaaagaatacatgaaacttaattcagaatttcaaggactccaaaccattctgtagaaattatttcagaaaccagatagaagttattcctctaagtgacattccactgaagtgatttttgcagagatcattataactattgttgctgctgagtcagatgactcttttcagtctgtaggcaactcaaacccatggtacattggtcaccattaatcatccactcctctcctcttaaaattatctcctttcttagtttcatggtatttgtttctctggtgtttctcttatgtctgggtatttctttttaccttcctggcaaaattgtcttctcttaatgacccctaaagtgctggtattctccaaagctctatcctcggttttcttctcttccttgacataccatttgctcaggtaatctcatttactcctttggtttaatggcccaccaatatatagatagctctgaaactggctagtccaacctaactgcgtaaactccacacccatgtagctaacttcttactagatatttatttgctggtttcatttaaaattccatgtctaaagtttaactcaatatcttaaccttaaaatttgtttctgtattttaatagtttaattacccattctgttgcccgtgtcagttaaacaatgttatcctgttccttattcacatatctaatagatgaatgaagacttacaaattttacttatctgatatttcttgaacctgtccatgcagcattgtattcattctcattgcctccactctggctgtcattatggtttgcttggtctgttaaaatatacactgttttcctaatctcaattttttaacttctaattcattctacttccaccatagtgaagtttttaaaagtatttgtcacccccttagaaaaattcaagataaaattttacttcttcattatggatgtgaatactcttctttgcttatctgtgctcttggcatctcccccacataccttttgctcattatactatgtctctacttaactactgacagtacttgagtgtgccatgttctcttacaattttatgaactcacagctgctactccctctgctcagaaagcctcctgctctcaccacttaacttggcaaatttctcaatcctcttgaaaatttaagtcagatgtaactgctatgggaaatcttctccaatcctgccagctttcttcctccaggcagccatccttcatacccatataaaatcttttctcttattgcaacattttatatagtgagtgttttaacatatttgccctctagcttattatctagcacttgaaatagtcaatagccattatggaatcttacttaataagtgtcatatcatataattccatgattatcaagaagtgcaaagaaaatgatttaaaatggcacactgccatacagcttgaagtgtattactttgcttagaaacaatgaacatctgatttttttgtgtgtgtaatgatggaaaataaagtagctggttggaaaataatatcccagccctatacctaaaaatagcagtggctagaataaatgaaatttaacactgtaaattttaaaagtgatatttttagaaaactcattgataaaagactagtcattggttttgaaattcttcttgatcgtgtataacgtttaaataatcaaacctattaaataaatcaattccagatgataaagaaacttgaactgaagttagacataaattagatgcttaaatacatacacctaagaaaatacaaaagaagaaaaagaaaaaaataatatgaatggagaaaccaagttgccccatcttttattttggagaacacagaaaaaaagccaaaaattcaagaaagaaaatatcaacaagaacagaaaaaaaggaaaagactttctttttcaggtaatatttggaaggatattgtgtagagagggtgagcataggaagagatgaggtgccatgagacttatatgaataggctgattagggtgaatcgataactaaagattttttttattcattcacttaacaaatatttattgagtatctatagtgggagtggatcacaaaaacacctaaaattaaacttgtaaatgataggttaagaagtaatctcgattgggtgaatcaatgatagttaagaaaatgattactaaaatagactaattccttaaaaaataaaatatcttgatttctttgaactcagagttaatggcctattcttttttagaagataattgcctttaggtacaaaacaatatacagtgaaatcctcaaaagttttttttccctatgaccttaattaagatctgcattgaacttttttttaccctttgtctactatatttttaaggaaataaatgcactaaatctgaactaaaaagtttcaataactagacaatgtgagctaatgatttaaattttgtacttagttggagctgaaagtgtatatttttctctttggtgaaaaaaggaggggaaataaaataaagagaaatgttatcacaattttaaaataacccatcaaaataacccatcaaaataacggagaggaaataaaataaagagaaatgttatcacaatttaaaaataacccatcaaaattaaggagaggaaataaaataaagagaaatgttatcacaatttaaaaataacccatcaaaattaaggagaggaaataaaataaagagaaatgttatcacaatttaaaaataacccatcaaaataaaggtttatgaatatatcaaaaatagcttctgcagatggagaaccatgttacatattcttttaaagcaacagatgggagaaaatagaaatttttcttagagataattatataaaaataaaatctagtttgcaacataaatttctacctatgtgtcctatgaagcaaaatttattgtagatttttctctgattttattccattatgaaccacagaaggaggaagagttccattactcaaggtttctaaaaacacaatagagagaaatacttttctactttaaaccctcattcacattatagcactcataccttgtagagttagattgcagtaatgttcactgacattctaaagtttttatatcagctctgcttttattgggcacagtattttctgtttattggtaatttgtggttgcattttaaaaatactgttctgttgataagctttcatgatttcttaatgtaaaattgaactgggtttttgtatactttgcctgcagcatctagatttctctaagaaagttttttattttaattcaaattgagtttttgccaatctcatataccactgtaagagaatggttaatgtgactttttctactatgatggcattatcttcaagaacacaaagttaaagaaaaaaatgcttttcagtacccacattctctaaggagataacattgacaatgggacagattcttttcttagaaaagtgaccactttctcaatctgtaaaataagaccagagggaaggcaagagatcaagtgacagggatacctaaaagtattacttattaaaagaggggatggctgaaaggagaagcctggaatcttaattcctgcaagagtagctgattgcccttgttgatcttccttgaggctgagaatggaaaaagagaatagtagagagagggcaaagtagatagagaaatgagggttgagcagccagttctcaaacatttcctgtgagtcaaatggacaatgagagctatcttgcctgatctaagagggttgagtgttaatggaggaattcccagaggcaactgaacaggaagtacctggaggtactgagatgttcaggagcatctcaccaggctttctctccaaaattctacgtgtatccagtgataaatccagcattttgattcattctatagagaggcactggtcagtaagaaacaaagaagcagcagacaaccaggagagagaaaattacaatcaaagatggtgaagtaatgaaaaatgtaccttcttctcttataaccccaggcagcacttaacataaagagaagtctgcgaaataaaggaaagcagtggcaccctagatgtataaccctgcccatctactggggttttggagtcggatacatgttattttaatacaaattacaatttacaaattaatacaaattacaatttgttatattaatacaaattacaatttgtattaaaataacatgtctccttccatgtatcttaacatgaattaaaataacaaattgagatatgttattttaatacaaatttaatatcaatgttttaactacttcaattttatgtattcttatgatgaatatcttgagttttactttttaattttatgttctaccaaaaatggtttcaaatgaacttatccaatattactacaaactatatgtatgaagatctgattaaatacacaacttttgtcattatgaaaatactgtgctttcaatcacttaaagcaatttttgtgtgatatcactatgctaatatttaaattggtgagttgtttatagttttttgggactttttaccttaattttatttataattatgtaaaacattattaaatacaaaacatctgagagtcagaaaccacatagcattatacatttaagaaagtcttaatccatccttgaacacttcttttttgatcactttttgacttttccttccagtggttactattataaatataaacaaatgcatgagcaaatgaaaatatacatattcatattttcttctcttgtacaaaacttggcatatagtaacaccattctgcactttttattttcattttaacacatatatattctgaagatgactttatttttgtattaaaaattattctttttataggtgattagttatatatcatacaggcatatgacagtatgtccaactagtcctttgatggtataaggttgggttaattctttatttttattattgcaaataatggtggaataaataaacatgtatatatgtcacttcctattttggcagtctaactttcatatggattcctagaagtaacattgttgattcaaaggtgactgaatatgtaattttgctagtggtgtccaagtccctttccaatttcaatctcaccatctgtgtacgagaatgtccctttcatcacagtcttgccaacagaacatgttgtcagaacttttatgttttgccaatctgataggtgagaaatgagctctcagtgtatagaaacagagaaattctccaagagtgagattgagcaactttcatgtttacaatctgcaattattcaaaacatgattttaatgtttcttatatcccactatatgaaaggaacacgatttatttaatatttttatttctttttatttataaccattaagaattttaaaggagcatgtattatttggtctgatattaaatacgttctcatgcttatgctcgttagtatttttactaatttctttatgtttaattgacaaaaaaaatttattggataaaacatattgtcttgaaatatgtatacattgtggtatgtcttaattgagttaattagcatatgcattaacagacatacttctatttctacattcttagcagttttctactctcttaggaattttcaagaatataatacatttttattaactatcatcatcatgttgtacaatagatctcttgaaattattccccctttttaattgaaactttcgaactttgaacatttccccaaccacttccctccctcaacccttgattctactctctccttctgtgatttttgacttttgtaggttccacacataagtgaaatcaagtggtattcatctttctgtgcttagcttatttaacttaaaacaatgtcctcccagttcaaccatgttacacaaataacaggatttctttcttaggctttggagtggagtgaataatattccatagtgtgtgtgtgtatacataaatatacatttatacatatatatacacgtacatatatatttatactacatttctgtgtttatttatcgtttgatagattcttaggctctttccatatcttgactattgtgactaatgttgcaatgagcatgggagtgaagatatgtcttcaacataatgatttatctcttttaaaaatgagtgggattgcttggtcatatggcacttctatttttaatgtatttgaagaacctctgtgtagtattttatattgactgttctaatttaaattcctaccaacactatgcaaaggtttccatttctccatatccgtgtcaacacttattatctttcttctttttaataattgccattctgttgagtgttaagtgacgtggtggtgttgatttacatttcactgatgattagttacatttctatgatgattagttattagtttacatttctctgatgattgaacattttttcatatacaggttgaatgtcttcttttgaaaaatatgtattctagtccacattttaattaggctattcattttttgctgttgagttttttgagtttttaatatattttaggtgttaaccccttatcatatgtatggtttgcacatattttctctcattttataggttgtccctttactctattgattgttcctttggctgtgcaaaagatttttagtttgatgtaatcccatttttctatttttacttttgttgtctctgcttttttattcctatccaaaaaaatattgtctagaccaatgtcatgaaacttttccctgtatttttctagtagttttatagtttcaagtcttacatttgaattttaacttatttgagttgatttttgtatgtagtattagatactgatctaattgtattgttatgatatccagctgtcccaacatcatttattgaagagactgtcctgttccattttgcactgttggcacctttgtcaaaaatcaattgcccataaacacatggatttatttctggggtttctattctgttctattgttctatgattgtgtttatatggcagtaccaggctgttttggttactatagccttgtagtatattttgacatcaggaggtgtgatgcctctagcttatttatttatttatttttcaagattgctttgtctatttagggtcttttgtagttctatacaaactgtaagatttttttctatttctgcaaataatgttattagcattttgaaagagattacattgaatttgtagatatctttgggtagtatgaacattttcatattattaattattgcaattcatgaacacagaatgtatttccatttatttgtttcttcttctatttttgttcaccaatgttttgtagttttttttagtgtagaggtcttaaattcatgcctgagtatttgatttttttggttagtattgtaaatgggattgttttcttgatttctttttcagagagttcaatgttagtggatagaaatgatactgatttttatattttcgttttatatcctgcaactttactgaatttgttacttttatttttttggtttttggtggagtctttagggatttctatatattatatcatgtaatctgtattttttttctcttgcctaactcctcaagctagaacatctaggattatgttgaatagaagtagtgagaatgggcatccttgtcttgtttctggtcttagagggatagctttcaccttttcactgttcagaaggatgttagctgtgtttaccatatatattgtctttattgtgttgaggtacattccttctaaatctaatgtttaagggtgtttatcataaaaggatgttgattttgtcaaatgcctttccttcatctattgagataaacatatctttttgtttcttcattctgttgatgtgtgtaccatatttatagatttgcctgtgtttaacgatccttgcttaccggaaataaatttcacttgatcatggtgaataatcttttaaatgtactgttaaattcagtgagatagtattttgttgaggtttttttcacctgtgttcatcaggaatattggcctataatttttttgtagttttgtctggctttggaatcagggtaatgatgacctggtaaaatgagtttggaaatattatctttccttcaatttcttggaagagtttgagagagagtggtattaggagtaggaaagattaagtgaaaggaaacatctgacttaaactacactttagaccaagtggaattagcagacatacacagggcataccatacaacccctggagaatcttcttaagtgcgcacagaacattctccaagataaatagtattttaggccatgcaataaaatgttacaattttatgaagattgaaattatatcaagtatctttcctgatgacaatatgaaactagaaatcaataatagaaggaatttgagaaaattcacaaatacatcacaattaaacaacatgtttctgaaaaaccaatgagtcgataaagaattaagagataaatttaaaaatatcctgagacaataaaaaatggacacacaatataccacaacttaaagaatagagcaaaagcagctttaagagagaagtttatagcaataaatgtccacattaaaaaagaagatctcaaacaacttaacattttcctcaagtcactagaagcagcaagaataagttaagcccaaagttagatgaaggaaaaaataataaagattagagcagaaataaatgaaacagaaactataaaaataatacaaaagatcaactaacttgagttgtatttttttaaaaagataaaattgaaataccagaatgaagaataaaaaccacatgatcatctcaatagatgaagaaacgtcatttgtaaaagtcagcatgctttaatgttaatggatggactagttatgactaacaaaagaaagaagacaaataaaatctgaattgaaaaaaaaattacaatggaaaccacagaaatacaaataattgtaagagactactgtgaatagttatatgccaacaaattggataacctagaaaaactggataaaatgcctagacacaggcaacctaccaagacttaatcacattgaaatatttaatattcagattgtttaactataaggtaaacagccaatcatgtaggctacttttctttatttttttcttttttcctatgtttttcttcaagttgattaatggaaaagtcaattgcaaaattagaaaaacaatatataagtaagtagtagatagtagatatgtcaccatacttaaatgtataaaaatatatttgaataacattagatactagaattataatttgtaattatcttacaatttccttttgaaaatttcaaaaaattaaatatctgtcattcagacttaaagaattagtatctacaccatgaatttaatatactgaacatgctacaaacaaaaccaactttctgaagcttagctaaaacatgcttatttaaatctactgtatggaaatattatatttaaaaagaacattccctagttgtatgaacactgaaaacagaaatgacagatttttacttactgttatatttgtttttctcgggactttagttaaaagtaatattaagttgcatctgctgtcaacagatgcccatataacagcaccaaaatgctaactccaacataaatgaccatctccatatgttgctggcatttttttggcatttgtgtattgtacataatcacaggctatgagtaacacttgagaaaaacaaagtgataatctcattatgaaggttcaagatctattcaaagctaagtagagcttcttgtttctcttaaatgtatttattagtacataagcataaacttaaatcatgaaatgatcatttttcaaaatgtttgctacagatttactgtaaatggagatttttatcaaattcacgtttcttatcactatgacaggggataatatacaaagctctatcttcactataaaaatgaaattttggataatatacaattgttaatacatagcaaatttgaaaaataagaaagaaaaagccacagcaaccaaaaataaagtgagaatgtaaaacaagaatggagagtcgaagttgaaactgaatgacctacatgagcatgggaattgtgcactgtgtgctgtctaggactcatgatccaaaattatgtggggatagtaatcaaggaccctggccttatgtgcagcagataggcacagttgtcttgttgataaatccaagaattgagaaaggatgacccatctccatataggattagaaacattcttcttcctagattgggaatgcagtatggtaacatgtccttcacttgagctgttcacctgggctttcaatgataaaagagccataatttaaaagtggaaacccttatactatacacaggtattgggacttttcgcactcatttacaatgctcaaatcctgagatgaaaaaacaacccatgggcaacccaggagaccgtttcacaggcagatataaatacaaatttaaatgcaaagccatttcaggggaattacattagaatctatggcatcaaactaccctttggaaacaacttctgtagaaggtaagctcatcattcaaaaatttttgtaatcagacaccttgaggaaaagtcagaagacacaaacaaaagcattcatattcataagaggtaaagaaaacagatcattctcaagaaaatgttttaaatgactgtgttttaaaatgaatagagaacatggtaagaacagaatcaataacgtaataaaaagaaaatctggcaaaggaacaagctagtttttagaaaatgtaattttaaaataagatacttctttagcattggatagaaatgctgaatactagtctatttagagctgaatttacagagaattcataaatgaaaaatagatttgaggaaatcctccaaagcatagataaattttttcagaatataaaattaaaattaggaaacaagaacaattaaatgaaggtttataattaatgtttaataggagttctgaagaggtgatttcaaagagataaaagtagcacatttttaggaataaagagagacattagaccacaaagatgagataaaaaccttaaaactgtgagaatgaaaatgcaaattacctgtaataggttgcaataagatacacagcacatattttcatgtaacaaaaaagaaaacaatgaaatattatcccaaaaagctgaatgtaaatattatccccaaaagctgaagttctctaatataataatttgattatgagaacctagatctggaaagtaagctttggaaattgagcaaaaaagattacttagaagtcttcaacaatttttcatcaagtcctattgaattatttttttttcttttagagatgcagtcttgctctgttgcccaggctggagtgcagtggcccgatctcggctcactgcaacctccagctcctgggttcaagcagttctcctgcctcagcctccccagtagctgggactacaggtgcatgccgccatgcccagctaatatttgtattttagtagagatggggtttcatcgtgttgcccaggctggtcttgaactcctgagctcaggcaatccacccgccttgtcctcctaaaatgctaggattacaggtgtgagccaccaaggctggcccctgttgaattgttttagattagctaaatgtgcttcaacattgtgaaatacaacagtttcacgaacacgaagtcaagtgacagaatttacagcccccaatgattcaaagattgaatttactgaaaggtgcaatttgctgagaaagaaaacaaaaccttaaaaacaactggattaaaaggaaatggtaaataagtcctcaatgtattaaaaaaacttttaaaaagtaatctgaaggattatattttatttatttatttgcattttgattatttttaacttattccttatattttagcaggtaaaaatatatctcattcctcctgaatggtgactagtacatttacccatgcccctattactagacattcacttcattttcattttggagtaactaaacaaacaactaactttgtactaacatttacctattttttcttaatagtacagatgcccagaactgtgatttctgggtgaaatgctatacatggtttaaatgagaggatatggcgtcctctttatttttcaaaatttattaatatcagcaatcctaatcagcaatacattaaagcgctcctttatactgaattcctgacaagagtaagcacccttcattattttggggagagtgtattttataatcaattgtgttttcctgatatctagtaagggttgaaattctgtttttacacatatgccactggaatttccttttctaggaattacctattaatattatttgttttaatttgtttttggactttggtcatatatttttgtatttaaaacatttacaaattcataattaatttacaaatggactaaaatatggcgtacttatccaccagtttataagtggaccaaaatttgtgggtgtttgcagtattctatatttatatctagaagatatgttagtaagtatgtctatttttaaaactaattaagttttacaatttatttatattttactttaacttaaaaagcctcaaagaaatactttattctgtctacagaattccaaaggccacttaaatgccaacattaatggctttcactttttaagttagttatttaaagaaattctgcattactaatgcttgtggtgtcacagaggatgatattgtaaagaaaaccatgaataccagggaattcaattcaaaaaatgatccagaagagacaaatttttaaggtaaagaaaggttaaaagtgtctatacaatgcttttgcttatttataaacagtgagtgacttacagtaaaaaaaaaaatagtgtgttttagctaaaacaataattaaacaacaatctgttaactataaatttcaaataaagaaatatatatgaaccttatatttgccacatgcatggcacatatttttacaatttattttttgtcatttgattttgtttaatatatagtttgcattataaaaacaattgtaaatatttgtataactaaatccttttctttagagattttgggttttatatccaacattggtgtgtttacatgtgtctgtgcatgtatgcatttttctcctcacatttttgttttatgtttagatatttaatatatttgaaattttgtcaaaatcatttttctgtaggtaagctgtgagttatgtggtactttattttctttcagttgtacaagcaaaatttgctaacttctatttttccactacattgaagtaattgaagtataattttttgatatattacatttccatatatgcagtgtttttttcctgaactttcctttgtgcctcacatatctatgttttgatgtctgcatcaatattgtattgttaaaaagtgagtatattgtttattttaatatatcatgatgcaagttgtctcccaacatcctttaaaaagaaaaacaaaattttaaaacttgtttaacttaatatgaagattaaattataaacatagcctataaaagattaggaggagtatgtccttggaatatagtatggatggagggagtgaataaaatattaatacaatggaagtcaggaaaagagaaaataagaagcatagaaaagtcacagaacacagtaaatacacaaaccagatgctaaaacatcatgggaatcatgagggacattgacttagagaataaatctgacaaattgattatgcaagtaataagtttagcagagaaaaatgaccctgttttcagaaagtcaagaatacataatattcaaatttctaagcacatttggaatattttacaaattggacacatacaacaccacaaagttcttaacacatcccaaagaatgattaatatgttagatacaacatattctttgaccacaaaattatacaattaaaattataaattttataattccttctcaaaacttaagagtacataataataagatacttaaatagatgttgaagccatagatacctacctaaaaatgtatatatttttatgaattattaattacacacccaactcttaggatctgttttctattgaagtaacattgattcctttaagcttgtaattctccaaagtaagttaactgagaaagaaagtccacattatagaaattcaacttacatatatttttatgtatctactcaataatacatgaaataaagcaaatcaaaatctgatctattttcccactccttttcttcaggcaattttacatttccaacataaagagaccattaaaaaagatgcagatccctcaataacatcacagttttacagcttcacagcaagaatgtcaccctgacttccttgccttttcttatacatgcttgtgtttcctatacctttgcttgctcttgagcctgctattctcagtgcttagaatggaaagagcatcggattgaagtttatcccaattctaccatttaactattggataatattaggtacaaggattaacttgtttgatttattattttctaatagtagagataatttctaacagtagagataattataaaactgtgactgttttcagaaataaatgacataatttggtggtaaacattaggtacttaagaaattccagttgtgtccagacagacttctctgattggcaaattatttatttttaaaatccaaaatccatgttactgcttttgatgagaattcgctggtatcttctatagctctttctattcccagctcaatgtagaaatgaggatttcttcccatgtctatcccactgtctttgtgtattcatttgctctacaaaaaacaaatgctcaccctgttttttgcttaaatttcttttctgtcttcccctacaatggtgaaatctgcaagtataagctctatactctggccagtgtttgatataggattgcaagaaacaactgtcatatgggaagcttttacaaagaggggaagcaaccttgttgggttaagtactaaagaattttgagaaccacgatgaagttgatctcagcataatttttaaaaacagattacataatgtttgcagtactgtgaccctaagagtacaataaactaagagcgttgttgcaggcaagttagatggggccaaagttccaaatgagaagattagaattatgtatgctctgcttttagttatcatggttatgggtgctctaaccacgttcattgatatttaaagggaaaacaaataaagacattgaaaaagtcataactgtttaacaacaaaaaaagaaaagctataaatttcaacttttaatcacaaagcttataatgatttaaatgtttaagtggaatattttgtgtattatatataaaatattgcagttgtcccaacaaggtaaaaaataggttgggtactggcacttttgtaactaattttaccctagaaaataacaacactttctggttgagaagggagactttttgttttgtttgtttgttttttgtgttactaattttgttttttgagactgtcactaacagatttgatcccaacatgatagaaactttaagagtaatctgattgttaccttgaagacagcctcagtcatattctagcatgtatcttcaatgccatcgatagtatttgtgcgtaataaatgtttaatagatgcccatgaaagtataaattaatgcactaaagaaagggggaaggaggaataaagaaggaataaatattactgatgatgatgccattgatgttggtaatgattgtatggaaagacaggctacagaaaatagcatctaagggccaagttttctaatataacaatttgattaggagaacctaggtctagaaagtcagctttggagattgggcagaaaagattacatcaaagtcttcaaaaatttttcaagtcccattggtaaataaatgaagaaacaaaagacaaatgcgactcaggattccagtgtgggagctaggattaagttggtgtcactgattaaagcaagtaagaaaaaacatgaagtgaaccttgcagaccaagtggccatttagttttgaaattgtttcattcaaagatgaaataatgatagaaaaattatgagaaatagcttatatatcagttactgttgcaataacacaatatgacattctacaaatcaaagtgctttaaaacaacaacccgacattctcatgctcaccgtcctgtgggttagctggaacagagctgatacaggctgatctcatctgggcatggctccaagccatggactgtgttcagctctgcttcacacagtctcctattcctctaggaccagcagaccacctggggcagaatttctcatggatacgacaaaatccaaaaatggcaaaagaaacacacaatgtttgttaaggctcataactcacacagtatcctttcctccaatattgcattagccaaacaattggttagctgaattcaacacaatggggtggagaaatacactctaattagagaaactgcaaagtcacacagcaaaggatgtggattcggggagaggtgaagaattacagtcttccacattctactttaaataaatgactgaaattcagttaaaagtgaagcctaaactagcagggttattaatgcaagaaatactttgcgaacaccaatatatatccatcaacatcatcatcatcatcatcatcatcatcagtgatagataatataggtctttgttctgtttcctactgtattgcttcccaatactatacagattacctaaatttgtttagtctgctgtggttatactttcagattttccttgagagttgatcatttttttctataattccagctagctgtgggcaaagattttttctataaaagatctctcaccaccaccatattaccattagctatctgattttgagtattatggcagccaagccatgctctctaaaatggattggattttctatgaataataatactgttatgaattagttttccattaattcatatagctctcttagatattttctactattttctaatatgtaatatctctgcactttgtcattcacatgatcttttcgtataaatcagaccaagacaaccatcagtacccaaagtacgattcagaattttcagctttaattgcatctttcccaacacgttttgcttcatagaccagttcatttttgtacataactttggcaaataatgacaaggagatgtaggcccattttaattattactgtggctgcacgcatatgcagcctgttggcaacttgcccactgtatagctttctgctgcaatgtttctcttccaatatggaataaagtacttaaaggaacctgcttagccatcatgatataagtgcaaaagggaaagcacaagtggttagcaccctcaaggacaggagctggtgcataaggactgcactgtttcatcctttggacaaacacttctattatgcattctacacagtccaatcaaggatcccaaacagaattgaaccccagaggcccacagaggtgattagctagataatatacccttggattggcttgccttcctcacctgcctcatgtttctcaatccctaaatcaccttctttgggaacagttcccaaaatgactattcaaatgcaaaccctcgtgtttaacaacagcaacaaaaaagtctatttatagctttcttgcctgcccacctgccttccttccttccttccttcctttttttttttttttttttttttccagagtcttgacctgtcgcccaggctggagtgcagtggtagaatctcagctcagtgcaacctctgcctcccgggttccagcgattctcctgcgtcagcctcctgagtagctgggactacaggcctgcgccaccatgccaggctaactttttatatttttagtagagatggggtttcaccatattggccaggctggtctcaagctcctgaccccgtgatccacccgcctcagcctcccaaagtgctgggattacaggcgtgagccactgcgcctggccccttccttccttccttccttcctttcctttccttccttccttccttccttccttccttctttccttccttccttcccttctttcttcctttcttccttttttccttccttcctttcttcctttctctttcctttttttcttttctgttctttcttctattgtgataggcagaacccacatcttaatcctcagaacaagagaatatattaggttacctggaaaaaaagattgaaggttgtggatggatttggtgattgctaatcaggtgacattaagataaaaacaattatgctgaatcatttggatgggcacactggaattaggtgggtgcctaaaagtgaaaagaggatggcaaaagtttagtcagtcaaataaagatgtaactatggaggaaaggcacagaggattcaacactgctgactctgaagatggaagggggctatgaaataaggaatgttggtcacctctagaaggagcaaagggcaaggaaatggattctgcactagagcctttaaaagaaacatagccctgccaacacctggattttattctagtgagactttcaacctaaagaacagaaagatagtagacttgtcttgtttaagcttccaaattggtggtaaatttttacagcagcaacagggaactaatatatcaatgcatgcgtgttttgcacaaatatgtcattcgtatttagaaatgccacattaagatgaaatcagtttcatattgcattctaaatgatcctaatagaaaaattttacatgattttatgatcagttcattttttaattattttgaatccatagacttcttttgtatttcctttgacaaatagtttggggctttaaaaagttgctgagccaattactcatctaaaagtttttctgaagctcatggtttattcaagtcattcaattaacaatttaactcaattaacatttacttagtgcctagcatgctcatggcattacagaaaatggaaatggaaatgactttgaaacaatttattttgaccataaaaatatcaaagtcctttaacatgtaggtcatggattactgggcagtagtagctaagagttcacagataatggcaaacagataaaatactttcaaatatacagcagatttaactttcattttggattctttgctaccagaagtgcaggaaaaatactaaaagtaaaatcaaggacatcttaagatggctttaattaacattcttagtaatgtaacaaacagacctaagaaataacaaattagtgtcattaatttttttaattgtttaaactttggaattaaatatttcactactttagtttttgggttgtttttgttttttactatgcagtacttaagaaacaatatagaaacacagtccaaaaacaaaaacactgtatctcagtgactgtaaacattgtggtatgtttttaaatatatgtatataaataaatataaatatatattttaagtcataatttaatatagtaaatgccattgaatacttctaggtattaaaatatttgccttttctaactgcccatatgtttgaaaatattttcaatggttttaaattgttagctcagatgtaggacgcatccagaaaagagagacaataagtgagagagaaagaaaagaaagaagagagaaaagaatgaatgaaagaaagagagagaagaaaggaaggaaggaaagaaggcaggcagagagggagggaggaagagagggaggaagggagaaagggaagaaaggatcctaatgtctgtttaatcttgtgccagaaaatcttgctaggtagtttacctcttttaaatattcataataagaataactcttaccctaaatattatttttgcagtctttctggtaaggacactgaggctcacagagacccattggagagaccgtgcctgcttatgcaatcatgttggtatttatttggagcacttaaaagccattctacacagaatcatttgagcttcatggaagtttatattgctttatgtactatttaacagcaaatatcaaataactagtttcactttggggaagaaaatttaggtgtaatctactttatgaaggtgatacagttctgaaaatataaggatttttcacttgtattttacatttgtatcatataataagttataggcaaatttaccatctgaaaaacacttacagtaaatcctttgtatgtttaaagatctcattataaaggcaatattagctgtaattgcagattttcatgtaacatttcttttttttttgggtggggggtggtggtgggacagagtatcactctgtctccaaggttggagtgcaatggcgtgatctcggctcactgcaacctctgccttctggttcaagtgattctcctcctatcaagtgataggcctcccgagtagctgggattacaggcatgtgccagcacgtccggctaattttttgtatttttagtagagatgggttttgccatgttggccacactagtcttgaactcctgacctcaggtgatccacccgactcagcctcccaaaatgctgggattacaggcgtgagccaccaagcccggcctcatataacatttcttaaggcaagtgccattccatctatgtcatatctctactgttgcttttataaacttataaaatttctcatttgagccatgacttgaaaagattataaattaatccaaaataaatttgcttctgtagtactcttctatatagacatttttaattttaaaagttttatcacaacgctctatctcaatacaaatatacttcataacaatttattgacttaacattaaggaaaaatgtctgtgcaattgttcatgcaaaggtaatcgttaattctctcagattcttgaaagataaaacatcacaattcaaagatttcataaaatgctatttgttctcaatttctaaagcagtgtttttaaattcttgacagaatggagacagaaaaaccatacatatctaggtctgagaaataccccaaattaatatagtgtattgctctccacctgatactgttttttgcatacgtgtgactaaagaaaatgttaaggtttgagatcacttattcctttttttcccctctaacagttacaagtcttcatgttattgaacctaatattgacatacctcctccctattgcagaattattaaactagctctcaaaggaaatttaacattatagggaaaatgataactttcttttttcttttgccattttctcagaaaatcacgactagcttctggccatgacaaaagttatgtcagcatcattatgcaacacctgtgatcagtgtgcaatggaagagcttaagagccagaactgagtatataactgaaaagtttctatacaatgttaaatgtgctgctcaatcccctaaagttaagtaaatggccttcagtgaggtttgaagaaagctctgcaacagcatgaatatagtggcctgagagctggcgtggaggtattcagatatgaactctctttgcttctaaatattaagcctacagttccttgcacttttatttctgaggcattttaagcttattgtgctgaacagttgtgctttctaagcttgattgacattccagaaaatattgatccgagtgttgggtgagcttactttctattaaaaagtgctcatcacatggcattaggctcactcagtccaaaatgtcagagaattgcactttttaacaaaaatcttatatttattttaaaatcaaacttaccaataatttataatcagaatttgaagtgtagtatgaacactttgcttctttagaattgatttagaataaaaatctgacaaactcaataagcaaacaaacaaacaaaaaaaactccaagaaaccactgtaaagaaaaagtgttttcttggtcactgaatagtattaaaattccctggaaaaggagaatttcttttagcaaatcatatttctcatatgttcttttatacctgttctgatataggacagccatttccataaccctccccctctagatccatctctacctgctctagaagaggtttgctctcaagacccagagcttaccgagacttcccttagctccccaagattgtgtctgctgtagcaataccaggaagtaattcgtttcttcctcggttttctcttctgttttactggatcaccgtctcaaattacttccaaagaaaatgtttgttggacaaagggtacaaaggttcaaccatgcaggatgaataaattctggagatctaatgcacatcattatgactatagctattggcactgcattgtatacttgaaatttgcaaagaaattatacataaaatgttctcacacactctctttcccacgcaaaagggtaactatgtgaagtgattgatatgttaattagcttgactgtagtaaacatttgacaatgtatatctatatcaaaaaattatattgcatgccataaatatatacagtttttatttctcaattgtacatcaataaagctgaaaaaaaataaaaagaaaaggctcattggaggattacaggatttctgaatcttggcccttctgaaaacatctttagtctaccattttattgattgatagtttcgctggtgatagactatatgacttgaaattagtcttgatcctcacttctgacctgcttagtgctctgtgagggcaaagtggcttatttctttgctatgtgctcctctgtgaggtctcaaaactgtcatattctttacatgtcattaggaaattttacagccacctttggttttctcgagttttcctagaaatgtcctgtgttcctctccacttttaactaatatgaatatacctaatttgggtttcctttgggattgtgcaggtagatttatttccgaaagatttctttcttagtggaaagtgtgcctgggtaggaactttgtacaagtgggtggaatatgtactgtcaggctttgctttaggaggtataagaaaggaccctaaggataggctgtgaggcaacccccacaacttgagaattaggatgattcttcccataaaagaacttttcactttccccaggtcgtctcaatgtaaacaaacaaaaatcggctgctttattttgtgtgtcttttgtttttcactctggtgttaaaaactgggcagcctgtgctctacaagctgaagtgggagatcgaattcatcaataaatttacgttttttccaccatgatttttctcctactattagtgtgtttgtgtatgtgtatgtgactttttccgggttttgacaaaagttcttacccacttactactaccttagctggaactaagtataccttctgttgcaatttccagagctttggacttgtattctacctggtttgcatgttttctgtgacttgttgagtctctttcactgaaatatctttaagcaagttaagcaaggattttggataacaatttaaagtggttttgtcataatgtttttgtataattttagcaaaatagtagaattttatttaacttttcttttggccaaaagtttacttccgtatgtgacaaataaagtaaaccccaaaaagcaaacaaaaaccagcattctattctggtttattatttcatcaataatatcaaattactgccatctatgaaatggatgtagtaattgtaattctccatacctaaaataacattttattaaagtggataaaaataatttttatggctgctagtcttagtcacaagcagtattattacagctcttactgtattctaattatttttatttgctcttcgaaaatttataagtggtattaaaatataatgacttgtcaaaatctgaaatagggatacatgaaatcttttgatgaataaaattaatgtgaatttaataatgttaacaccaataaaactgtttgcaatactgtacaggacgcatctgaagcatgtaccacatacaataattatagtagcagctctctaaggactagagcactagaaactgtactgtgctaatctgaaatcaggtgaattaatcctcagaggagtcaggtaccacagtctcaagtaatcagtaataattgtatcatattgctgaagcacactccaagagctatgattttccctacctgctggattgcctgcaatgattgaaatttgttaagcagtggcagaaattcaggcccatgatcagtggaaatccaagagttccaaatacataggtaacatcactataacaaggtttttctattgtttttttcctttggttttaactttatgttttatagtagatggattttgccaataatacattgctatactttgataacgaatactctgaagtgtttaaagaattgaaaacatcaaaaaataattttgcttataacaaaatacaaacattaaatatttttgataagagaacttacttattagatttacactatttctctaactttaaaaagtagtctgcatttcaagtggtctaccatatggctgtctacatcttagcattttgcagaaagtatatataaaatgaaatgcatataaaagttgcctgcagtaagtaatactaaaggcctggattaatgaatttagctcggctttgagttatttcaaatatatctttgttaataattatgtacttcccaaagccatcgaataatgttaattaaatctcggcttagtttcacagttgtgtttaattagctcaatcactttttaaaatgtaacaggctattaaaagaaagatctattgacagaatgttgaatggcaaattgttagctgccagatttggtccctgaatggtcattgggtgcgtgaaaaagcaaaaagcatcaaaatcatagcatttataaacaggctttgtagcttaagagttaactgcatgcaattcaaatgattttcattctatattggaagggagtaatccaatgagtttaatggtgtatgtattatacagaagcttttcaataaaggcagaaattacatttacagtgccttttctgtggttatttgaaatatacttttatctaggcaaaccttaatttctggcaatataaaaagtgccctgaggtaaatatggactttactcctgcttatgagaaagttaaattaataccctaaggatatgtcctttgcaaagggtcatacttattaccaagccattataataatatacactttcttacaaatctgcaatcgatttacaagcaagatttcgattaaagttcacttcccaaaacattggaaagtaagctgtttgtattgcactgtttataaacacttacttgattcccaatttatctttattttaggaagagatagtaagtcagaattattttgtttattctaggaaactctcagttttcaaattttcaattaggaaatggtgagggaagtgggattcaaacacaaggacattataatgatgccaatcaaaaacaatttattaataactaagtaggcagcttttaaaatttttgactttcaaaataataaaaaaatgcaattccttattaaatgcaaggaggttactggaagaaatttggcataaaatgccttgtttattaaagattaagagaaacaactgtttatattatagaaattaaattactatttattgagcatatgcatctcaatttgcaagtcacagtgtagaatagaggcctatttaatatgtcattaaaatatattttaataatgttgcaaatataaaatctattttaataatgttgcaaatataaaatctattttaaaataatgatatttaaccttattttgctgtgaattgacgctacagtgtacattcagtgcacacaaaatatcaaaactttccatctaggatttaataagagagaaaaaaatctgtggaagaaactatgtacattgaagaaactcaaaggcaggagacatgtgttaggccattcttgccttgctctgaagtaatatctgtgaccgggtactttataaagaaaagaggtttaactgtctcacggttcttcaggctgtacaggaagcttgttgccagcatctgcttctggaggggcctcaggaagcttacgatcatggtggaaggcaaagggggagtagcttggggagtcacatggcgagaccaggagcaagagagagaggggaaaggtgccacactgttttaagcaagtagatcttgcatgaacagagaaagaactcactcatcatcaaggggatgacactaagtcattcatgagggatccgccgccatgatccagtaccttccactaggcctcacttccaacaatggggattacattgcaacaggagatttgaagagaacaaacatcaaaaccatatcaacatatttattcacttttcttggtattatctatattctacgattaatatcatgaatagacagtcatgaatgaatagtaatgaatagacagtaaatgaatagacagtaaattctagatcagaacgtaatttactaatttactgccaatgaacagacactaaattctagatcagaacctaacttcggacttagtgcttccaaagtacatctttgtcatagtaccatgcatctaaaaacccagaatttaaatattttacacgtagacagagaaatagactaaatcatagtgtgattttatgaaaacaacgaaaacaactacttctttagtaatgtaaaacctatcaaagttccatctgtgatttgtctaaaataagcctatagctccatagtcagaactccaaagctgacaacctcttcaatccttcagaaaagacaataatgtcttttagaaaggttttagatttgccatgttcaattatctatattattgagcctactaaccacctacttctaatgttgcaaccagatatcattctggaaataatctttctttaacaataaaattttccatattaatttatagcatgagaatccccattcccgtcttccattattctcatttgcactaccctaaccttccttctcaatttttgcaatgctttccctcatagtacatcatatcataacatttagaacatttatgtaatgtgagatatggaaactgattttagaggtcatttagttggggaaagaaaatgtatatcacttcatatgttccagtagcagctgcctcttggtctcggtagagaagaattcagagggagagctggctcagactcagcagaaaaaggtcctcatatgatggcttatctatgttagagattgggaagtaagaattgtttgtatgtttaggtatcttttagttcactttgtctccgatttcacatattatcttttgatttcccattccctggtccaaatacccttctcaaaaagactaaaaatataaaaatattttaacgtaatttttgtttaaatcaaatccagtgtataaattattatggctatgtaaatgttatgtttagctgttccacacccacatagtataatgtgattacatgttatttcttggacagcttttgttttgcttttttctggagttaataatagcctaacattttctccttgatcatatgctctagaagggcagatagcagtctttctttggttcactgatgtatcctaaagtgtctagtacaacatatgtttctagtagacacatattaaaaacccaataaatatttgtcaaattaaaatattaattttcaaagctctaatagaactataaaattcctgtctatataatcagtcatgccagctaattctttagtttcattttaattctttgagacaacatcactgtcacctaaagctctctaaagccctcctcccaattgggcaggttctttttcttaacccattaccaagatatgatcgtaaaatgtccctttttattatcttggtaatttttgtctcagttttctataaaatctctactttcctgattttcatggtattctctttctttgtttagtcacttgttttgttttggtgaaacatattctttgtaacctgctgtgaaaggacgcaaagatagattttttggggggtttgttttgctatactatgtgtctaaaactgtgtattaaaaagtggctagatattaaattctagtctagacaattttttaaatttttgacagttctcacttccagtagtactttttaaaactctgatgccatgtgagtcatatgtgacatattttgtgatatgaccttctgatctagagaacttgttatttgaaaatctctattgtacaattctaaaaattttttctcctcctttttttttctgaaatagcttttcttatttggaaatagtatcacttcatttaattatgcaagtttcttctctttttttaatctcttattttaggttcttattttttcatactttatcaaaaacttccttacccttttttccagcagatttgtttcatgtttttatgctatcgtattttcagttttgaagcttgaattctttaagtatctccttttaatgttttcatagcaccctgttcacttcatcatgaatactttatatgatcatattccaggaaagacacttatcctttttaaaaaagttatcttctgatctaagtctattcttttacttctttcatttgtttgggtttctttacttttgatttaaaagctttcagtgataatttgtttcatattttttaaatgatacatactttttaaatgtgttacaaaaaaatgctttttggaagtactgtgttttggaacaactttccggccagtgcagtttattactgtatgataagacaatgaaactttttgtttgatgggaaactcaaatttaataaggcatttgttttctcacagggtactttagtgtccagaaagaatcctccagttgcttgccagggctgggatataagttgggttgcacgtgttctgggaatcaagcgaggaagatagcagatcacatcaccattttacataaaaacttatacagagtgcctatgatttcaccgggatgcttcttctccatcctaagctataccaatctcccctgagtccagaatctttacagcttagtttttccttacactataaatctaatccccagcatgggttgtgggggaagttgcttaggatgatttctaaatatttcttataagtcttttgactatttccactatcgataatacctacactttccttgcacgtcgaaggtgcttctgagcatcatgcggttcttctgcttaaatgatttcacttcttattatattctacttcttttagcttcctgcccaacctttagaatttgttccatctttacaacttgtacataaacggacctcccatcttctaaattgtgctgacatcttatcactacccaccctttattgtatttattcttttctatataattttaaaaaatattttatgttatttaggggaattctgaaagatctgtgatcaatctatcataatttgctaaaagtcttaacacatttaaaaattttaaatatccatgagcagaatgatcatgctgcaaatgtgattagttaactaaaatattaaatattaacaatattcaaaaaccttataaatgaagccccaagtgttaactgatttatcagtaattacatataggctacataaaaatatatttcctgtctgggcgcaatggctcaggcctgtaatcccagcactttgggaggccgaggtgggtggatcacgaagtcaggagatggagaccatcctggctaacatggtgaaaccccatctctactaagaatacaaaaaattagctgggcgtggtggcacacacctgtagtctgagctacttgggaagttgaggcaggagaattgcttgaacccgggaggcggagcttgcagtgagctgagattgcaccactgcactccagccagggcgacagagtgagactccatctcaaaaaaaattatatatatatatgtgtgtgtatatatatatatttttttctatatgtatacatatatacatatatataaaatatatatacatataatatatataacatatataatatatacatatataaaatatataaatatatacatatataaaatattatatatgtgtatatatgtatatatgtatatacatatatacacgtgtatatatacacatatatgtatatacatatatacacgtgtatatatacacatatatgtatatacatatatacgtgtgtatatatacacacatatatatatatatacacatatatatttcctgagggttggctctttcctctgtagaattttgattttgttgagagtagacttgtagtcatggagaacttaaaaacaataaaaacagaatgtaataaattgctaaatttcattatttagtcaggaaagccatagtagtttaggaaagagcaaaattaaagtattacagaatgtctcaggtgacttcccttgccttggtgacatgtgtatctggtttgttacatacttctaagatagcctttggattatgctattgtctgcctaacagctggaatctattcaatcaaagattatttgctgaaatatgaggcagagatctatcttttacataatcctaaatattcttttgaatatttctaccatgctgagaataaacaagtacagtgttttattttgagaacaaatttgggaactcaagttgataaaaagatggataatgtatttaactaaaatttttgaatcatactatgtgtcattttctctacttgatattagcaattgcgagaataaaaaaatgcagttactgctattagagcagaggcatgggcaatgaaacaagctacacttacttaacagagtaagtatgacaacggataggagcacacctgaaagtgacaatgaaagaaaggcttcccaggggaagtacagatttatccaaactctaaaacttaactggaagtcagatgaagaaggggaaatggtagtttggacaaaggaaccagcttattcaaatgcacggagtcctgataaaacatggaattgagggaaaacacatttaagtgtgactagactttgggagttagatttaaaaaccagactagtctgtgcaaagcaatttcagaaaattaagataccaaaaaatatatatattatatatgtatataaataaatatatatatatataatgttctaaagcagtatagtataatggagtttttacctagactagttaccagaaaatgtaaccctattatctctgtgaactttgacaaatcctttaatatgtgtaataaatttattgtttaggaccttttattttcttcccagcttcaatttcattgttaagatgttaaccagaagaataaggcccaattgacagatctttttgaaatttcagacacttttgcacttccctagtaatttgatggctcttaaccaatctggtgaaaacttttttcctatccacactgtagaatgttttacacattactctcaatgtaaattcactcaatcttcagactgacaaaaaaatttaggtttcaataagtcatttaacaaggaattccagtgataccataaactttcatcatcatccaactcagctaccctcctgatgcttaaattctctccacaatatttctgccagtcatcatctttattatgcttgagtatttcaagtgatactcaagtagttattctcaagtaagtctatgattagactcctctgactgaaagattttcttgtatcattcttttggtcataggtctaattttcatatcatgaagtgcctttaaaaaagaaaaaaaaaatgaagataatgggtttctagtgcctaaccaagtatgtggctccttggcacccagaatataacagtgatcattgtcccatcaattacttgagaatggaaattaaactatacttccaattttaggcttatcttctcagtgtaaaacatctcacattcctgtgattatgtctcagctgagatggtttttaggtctactaaaattttagtttgttccagttagttttttaccactcttagaaggtggaaaagtcaccatagagcttcaaacatggaaacacagagagcaatgaggaggctgctgacataatccaggacaagatattagaggttttgcttggataacagctgaaatgatcaaagaaacaaatagatttcggagaatttgggtagtaaagttcataagacctcctaatggcttggagtatatttggaagaggctaaaaggactcgataaggactccatgatatttggtttgagcagctgaggggattgtggtgccatttattgagatgagaaagattctggggaataaattttgtttgggaattcagtttgaaatgtctcaaagatatccaacaggaaatcttaattaggatattcactgaagttggctaacagaaaacctatttccctttaaaatcatgatcagtacctcagaaaggcagctagtcatttggagaattgtactacattttctttatcagtttgctctactactctctcagactggtgcttttcaaaagtaatgtgaatggaaatcactgggagatcttgttcaaaggcaggttctgaaaatctggtgagatgcttaagcatctgcatttttttcacttttaattttgttattattaatcgtcagtgcataatggttgtatatattcatgcggtgcatgtgatgttctgatacaggaacacactgtgtaatgatcaaatcagtatccatcacctcaagcatttatcatgtatctgttacagaaacactgcaatatcattcttttagttattttaaaatgtacaataagttattgttaactatagtcactctatgatgctattgagttgtagatattcttcattctacctaactgttatttttgtaccccttcttccccactatccttcccagcccttagtaaccatcatcctactctctatcttcataagtccagtattttttagttcccacatataagtgagaacgtgtgatatttgtgtttctttgtctggcttattgtatttaacataaaggcctccaattctatctgtgttgttgcaaatgaccggatttcattcttttttagggtagaataacatttcattgtgttatacaggccatattttctttacccattcatccactgatggacacttaggttgattccatatcttgactattgtgaatagtgctacagtaagcctgggagtgccgatatctcttagatacattcgttgcttttcttttggatatatacccagctgtggaaatgctggatcatatgatctatcatatgctggataatataatccatcatacgctggataatatctttaactagctcctatttatttttgtctatgtataaaaattaatatggattaaatacttaaatctaagacctgagactatgaaactactggaagacaacattggggaaacactccaggacattggtctgggcaaatatttcctgaataagacttcaaaaaacacaagataccaaagcaaaaaaggacaaatgggatcagagaaagcttcagttcaggaaaggaaatagtcaacaaagtgaagaggcaacccacagagagggagaaaatatttacaaactacccatctgataggtgattaataattaaagtatacggccaggcgcggtgactcatgcctgtaatcccagcactttgggaggccgaggcaggcaaatcgtgaggtcaagaaatcgagaccatcctgaccaacatggtgaaactccgtctctactaaacatacaaaaattagccacgtgtggcatgtgcctgtagtcccagctactcgggaggctgaggcaggagaatcacttgaacctgggaggcagagtttccactgagccaagatcgcaccactgcactccagcctgggcaacaaagcaagactccatctcaaataaatacataaataatcaaagtatataaggaactcaatagctcaataggaaaaaaacaaataatatgagtaaaatatcggcaaaagatctgtcttaagacatttatcaaaagaagacacacagatggccaacagttatatgtaaaaactgtcaacattactaattatcagagaatgctgatcaaaacaataatgagatatcatctcacctcagttaagttgacttgtatccatatgataggcaagaatgaatacgagcaagggtgtggagaaagaggaatccttgtacactgttggtgaggatgtaaattggtatagccactatacagaacaatatggataatgcatttttctttatgctcgcaggtgacatcaatgctatagatcctcagatgcactttgagtagcaaggtctgagttagacaagtctttcccacttaaatttgcatgccctgatgttccttcctcactctcagctgagtgtgtcttactgtgacttatttcaggagaaaatagaagagaagaagagaattttcacatgcttgtaccattaaatctaccaacccactcatctagtaggttttctctcttttaaaaatgggcttttacataaggccaatccttctgcttatttgctagattgcatcccctctcactttctcaaaggcatcaatcccataattgctacctcctttccaagcatcatacatttttacattttactgaatcattctctttagcataattaacatgctaagataaacgttagcttaaaataaaaacaaagaagttttgatactccctatttctttgcttccttttagtgtaaaacttttcacaaaaagattacatttattttctccaattgctttttttctgttttatggtggtagttctagcagtagctactgttaagatcaatgatccttcctttgccaaatctaatggtggattatctgttctcatgtcacctcgtgtatgaaggttattttcgtagttctatttataatactatcttcccttggactctgtgacatcaacttccctttgattttcctttgacttaatgtgtttgtcttttctgcctttttgctggctcctcattctcttttgacctctaaattttaagttacttttgagccaagttccaggacctcttattttctacatctatataccaaccctctaggtcaactcatattatttcatgcctttaaatactacatgtgttcttgatttctagaaacacaccttcagccgaggtttttccactgacctaaagtcctgtatgttgactgggtaatttattgtccaaacgaggacactttagaatgtgaagatgggggattattattaattattctgagaaaacacatgtaaaccaggacaaccacttgtctaagcagttttatgcaatcaggggtatatccaattgcctactcaccattatgtatttgggttttgggataaagatagctagctgttcacaaatacctattttactcttctgtagtactagaaccctgaatttgcagctggttacaagacctgatagaataagaactgaatttccaaacctcttttgtattttatgtggcaatgtaactaattctggacaatacaatgtaaggttagttggtgtatggaacttctaggatttgccttaaatgtaggagatgtgcatttctttgaccgctttccctgttctgatgcttagattatgaaggtaggagccatttagaatctcttagtagaagccatacattgaggaaatcagtacaaaaagatagaagacgcttagattttgatactggtaagcccctggactgctttaatatgaaataaaaataacacccatcttattattgcctttgttaatttaccattcattgcaatgaaaccaaatcctcactaatagaggggcttaacatttatttatatattcaacaaatatttactaagtgactgatactattctaggcatttgggatacaataatgaacagataagtgggcccttcagagcttacagtttgcaaatattaacattctggaagtatattctaatgaaagatttacatactaaatattaaatagtatactatataaaggtaataaagccaaaagtaagagaaaaagtaaagattgctaaagaggcttagaaattctggccataggggtgatttcttaattgggatagacttctcaagcagataattgtgagcaaggaggtggataaggtgagtaattttgcctatgaatctatctggaggaaagccatcctaggcagagctgagaaccatacagaggccttaagttaggagtattcttattctacaaaacataaggaagctagtacagctggtattggtgtttatagaatgatatcagagatgaggtttagaggtgatggagagccacatacatctttcagcacttgtagaccatggcaaagacttttttgtcttactttgagtaagattaaaaaaaaaaaaaactattgcaggattttgagcagaaaactgacatggtctgtcttagattttaaagaatttcactagccataatgtgagaatgtactatgagggtagagggtatggggaaaggatagaagcaaggagaccagtttgtagattacggcaggaatcgagatgagagatgattataaaatcaaaaagtcttaaatatcatgcttaatttctcatctctgccttattgaaatagcttcttctgcaggcttctgtatttctgtaaatagaaactttgctcctcaaagagactgggtctaaaactttgggctcatttggaatcattcagagataggaacacagagaaaatggcaatacatagatcttcatgcaacttgttccagacactcattcctgtcctttccagttttgttggatcagccacgttgcaattatgcatgataatgcaacattctcccaataagttcttctccatttctaagctcgtttacactggatttctattattagaacacattttgttatgaaagtcttcacaattacatataattacaggtcactaacacttgctaacttgaaataaaacatgatttttattaactggccatttcctaagttcctgtgctttgccattgtaatacagatgttaaaaataaaaacactgacttttcttttctctctttagaaataaaaattaagtttatactacttttgattatttgcttacataaatattactgccacaaggaactatgaattacgatgtaggaaaacaattttatatttacaaatagccatggtctcttaaatgcatgatactccttgcctgaaatatactataccaataaattaaaaaccacaattaaataaatgcaagatcaaaaatcacgattttccatgaaatagaggaaagtcattacaaaagttatatttttaaaaatccattacttttacttgcatttttccagctgacaccaaaagagcacacttaagttcaaaaggaacttatataattttacttttggattttgaagtggcacaaatcaaaaggtctgactaggagggccagattaatgctttggagacactacacacagaaaatattgtgttgtgttctcttaacccatacaaatcaacctgacgcaatacaaaagtataaatgtaagccactcaaataattctaaattttcaccttatgaaaacaatgatttaaaaaaaaaatcagctttttagtctactaagtgggttgtccaatgcagaagcagaagaaaaccatttctggaattgccccacttgtcctgaaatttatacaatttacagatactgtaaaagattcagcaagtagaggaatgattcaatttgttggaaatgttcttctctgagtgagatagagagctattgcaggattcagaattaagatccagagggttaaacacaaaccaattaacaattaggagattttcattattaaactccctgtcactgtaagtctagaattcaaacaagtataactttgataatttttattcatttatgaatcactctatattttttaataattttaatttgactttgaaaggatttaatatatttctaattcatgtaattgacaatggagaattaatctgaggaaataattggattttctcaggctatctcagagacacaggtaacagatgaaaaattattttcctttaaagtcctatactttagcttactacagaatacctctgatattatgatttgtttcttgtttaaaaattggaaaagtaaaatagatttacacataatgttacagttatctgaacctggttttgggtctccagggtgacataaatgtcacatgaattcatacaagaacagattttcagtttattcccctgatggaaaaaaatgttaatagatatgccactttttaactgttgtattaaaattaataatcatagcctttttaactttctgtgtcccaggagtatggtttacgttggagtacattctataagttgaaaaacaaaataataataattacctataatgatctccaaatactcatgccttttgtattaatttactcagaggagtaattttgaactaacatatacaaacacttcgtaaacaattaaggaattctgggaaataaatttagtaaaagctctcattctatttgtggctataaaatacacatatatacagcacaagattcacatttttattatcaatatttctcttacttttactttcatctactggaatatatgaccaggaaacaattggacagcaattttaaaacactgctatgtaagcagatttatgtaagtgataaaaagatacacatactttttttgtcttcagtaacttgtcttttagactaattcatcctcatgtatttgcttactgatgtcacatgtatttagatttacaaaaatttagactaaagcaacaaaaaatacctattgcttggttttttatgttgcttgctaaaatatttgcattttataaatgtgtaatgaatgtatgtaattaatataaattaagtctaaaatttatagacatatagattatatccatcgatacaaacatgaaaattgtgcaataaaacataagaaaatgtttatacatatagataaatacaatataaaaggaaggaagtagggaaggaaggataaaggaaggaagaatgggggttggggggacaggaaaaatgtattaactcatgaattaacccaagagaaaaaaatgtaatagtgtcaaaaaactcactaaactttctttgatatggaaattgctcagatggtttatatatgtatggtcccaattttacatatgattaaaatagaattttcaaatcaaccttatgaacattttcaaaaggtaaataaaatgagatgttatttattacatttataagtcaaagcagcatagcatttttcatttataaaccattgcatttttcataccaattcaaagtgaaacatgtcagtactcagacaatttgtattaaatttatggcccacatttctggatttgttatttaaattataattaatttgaatcgtaatgcaggatataaagtttctgtggaaaaattacttctgtgtttcaagtcaattatttaaagtgtatttcaagtttatttgtattcttccttgtctagtcgccattcttaataactgttttgattgatttaagtgttctttaatactaggcaccaataagatctatttattagatgtataaccgtgaacacacaaaaatgattctattccctcttggtcaacgtacactttccctcaggagtatcaatagtgatcatggccctctaaatctctgctgcagcttccaatgccttcatcttttcttttccaaatgagagaggagtgggcttgaatctactagcaaatcagatgcagtgcctaccatggtacactttgcatgtaattagggaccagaccttgtcgatagcaaagccctctctgcccacacacttcatcctaccctatattatcctatcctattctgttctatcctgtcctacctatctgtgtacatcagagaaaaaacatggattcttcttcacagctattatgtcagtagcagaggataatgggtctaaataatcttaactcatccacattaagttatttaggtaaaacagttcaataaatgatgacgtagttcttactttgtgctaacatcaatataaaattatctttggattcattttgaaccaaaatatacttatttcttaaaatttgaaaaatagtagggttctaatcaattgtgttttctatttctttctctctctttttcctaaagtcagtagtaataaactgcgcttcaaattcacttatcttttgtaaaaagaaaagtacaaggagttttaagtagaatcacagaatcataggtgtgaaaagttaacgttatcttaagcaatgcttgagccctgtttgcatcattccaacaaaataatctgtcttatacttgagaggctctaattacatagaagtccccattattccaggaactcattccattgtctgaaaacagtaatcaccacaaagttctttctcacaggtgaaaatctaccctctaaagcttcctctcatttatagcttcatcacataaaaacaattatattcattctaaattctgctgccatgtgcaagctcctcaaatatttggaggacctctttatgtcctctctggatgttcagttctccaggtaaatatttccagttcccttaaccattcattataggacattgttgtccaagtatactcattccttgtggtccatataaatgtttcttctccgcatacactcttaattccaaatagagaaaaagaaggaaacttcagcattcctaacaaaaagctaactacagagaacacagttcaatgcacccatcacaattggaacaatactttaagataatgcaataaatgcccgatagaaggactgcagataatgtaatagaaatgtgaaatattttacattttattccataatttagctgagagagcttctgaaacactctttctagaagtcaaaaaacagaactatatttctatttttctttttacgtatttcgatgttataccagcattatgcaaatgacaagtgcatgcaatgtaagcaattattatcttagggagatttcagcattgccactactgtttgcatcctgtatttattatatggtagcacaagtaaacttccaagtagctacctatgaatagcaaaaataagatcagaacttcaacataataaccacttatttcagtggaaataactgaagtaacttaagtgacacttcacacaaaattttcagttgcttcaagatggtatctgtaatgaatgcattgaggtgtagcacgggcgtcattactttaaagatggaatcactcattgtgccagctggtgagaatgatcatgactaacagctagctatcttccagattaaagagtctcgtctcccaaggttgcattttttttttttttttttttgagacagtcttgctctgtcacccaagctggagttcagtgccgtgatctcggctgggtgcaacctccacctcccagattcaagtgcttctcctgtctcagcctcctgcattttcttttcaaggtaacccacatctgatgactgatcaatgcagaaacataacaacccatcccttgggtctgggatgattcccatgtatttattttgaaaaactggaaggtggactcacaactttcagcaacaggaatgactttaagacccagtttggacattttagaggattaattttggagggactagcagtagcttttccaaagagagacgtcttgaagttagaaggaaattaagtttggaattgagagaaggactagagttggacaatatatattttaaaagttttattagaaatgacatttacaaaaatgagactagatgacattttaaagagaacgagcacaaataaaaaatgaaagaggtgttacaaatgtatggattaaggagatgaagagtaatcggcagaagaacctgagttggaatagaaaggtaggcagaaaatgaggcaggatgagatcgtggccctccgtgtgacaatgtgaagcctatagcaacagggcgctataggcctgcgagagaagagtgaaagaaagcatggttaccgctggaaaggctattgcctttttgtgtttgtttctttattggcctttttctgtttgtttccttattggcctttttgtgtttgtttctttattttacaacataatttttcacgcagcagaaccaattccctactgattcagtagatgggctttgcttaataatcccttagataatcattacattctatcatgagaaatccgcctatctgttggataggcaccaaacattccaactaactgtgcttttgactgaccaggacttaaaatctttgggggcactccttaaattctcactaccaaatctgcataacaatgatcatacagtgttgatgtggtgttctgatgaagctatagttacttttgtcattaattaatgctctctaaatgcaatttaatgatatttttcttttatatacatggttgaaaatatagatgaaatatagcattgatatagacattttggtacattcttttgatgaaaacattttgttctgtttattttatttcataacacatatttcaaatgtccaaatggataaggatgcaaagtctttgttctacagttaaacatgtaatgtcataaattcatggaagagatttattttgactcataataaatgaggaagtatcaaaaaagaccacttagtgctagagttgataatcattttactaaggtacataaaatcatttgaagtcatcgtacaaataagtatattttagaatgacttacaaactattaagcaaatttaagagatcatgatatttgactggaaaaatcatgggtagaatgtcttaagtggttttaaaatatggctatatctcttaaaagggccttaggctctggcaaagtaactagaaatgaattacagttaatctatgaaagaattttagtcttaaatgtgaaatgtaagagggtgctagcaaactaagagacactaacgtgagggtctttaggatcccccttcacatattttcgtatacatttgtggactatagatgtggcaccaaatatttattaattcaacatagtttaaaaatacaggtcaaatctactttcctgtacaaacaggtgactttgaatgatattcaagtcagtgcacattcttaccaatcaactgtgcaattaccttgcgcttcgtatcttctggctctgtacctgacctcatttgtactgtctttcccttacatatctaggcagaaagcctccctaccaactgtacctcgataacaggccatattcatcatgaagtcttgttttgaaatcacaattaaactccactatgattccataaaacatatgtagtatcttcactatagaaaaatctaccttgtgactggtaggactatttcttctccctctaaataataagttcctaataggcaaagatcacctgtataaggtgtgttccaatctactcactttctgtttcttatattatttgatacatgctaagggtgctcaatagatttttttgttgaattcaattaaaattcgtacaaaacagagctccatgctaacataccttttctagctgtgtgatattattaggtgagctagtaactttcttgatcattagttacctcgtatacagataatgttaaaatatctacgtataaatcccataaggatttcacagtacgacaaatttaaaataattatcacagtatcattcacatagtagtggagaataattcaagagatgttagttctcttactgcaaaacagctcttaaaattatgataaggtggccacacgcagtggctcctgcctataatcccagcactttgggaggccgaggtgggtggatcacgaggtcaggagatcaaggccatcctgggtagcatggtgaaaccccgtctgtactaaaaatacaaaaaattagccaggtgtggtggcgcttgcctgtaatcccagctactcaggaggctgaagcaggagaatcacttgaacccaggaggcaaagattgcagttagctgagatggcaccactgcactccagcctgggggacagagcgagaatctgtctcaaaaaaaaaaaaagaaagaaaaattatgataagcctaataaaattgtttgcactatatggcctcaatttatcgtgtagaggaaattatgttagaaacaaagctaaaaactcttcaactcaaaagaattactagtgatttggtaatagaaattcatttacgtctaggtaagttaatcatttcaacatgctgataaaggaaaacaaaactatttctgaacaattttatatactctttgttttaaaaattctttaacatgaggaaaactcttttgtccttgtgcttcaatgcgttatcaataataaagaaggggcttaatataaaatgtatcgtttgaattcaagattatttgaattttaaaaaggtacttttcttccagctatataaattgcagaaaacttaggaaacacagaaaaatatacagcaagaggaacaatatataatttttcaattcagggatatgtgatactaatgttttattgtcttttttatttagcttatagatttatgatgtagttacacttaaatatacgtgagtatgtatctatattgatttatacgcactattgaaattttatctcagtatacaaagtggatattttcccacatcattaaacattttggtaatgtaacattaattcttatgtgacattttactatgtattgtaccatcgcttgatctgttgcccagttgttggatattttcactttttttttgaaactgtaaagagaattacgttatatattctgacacataaccataatctacatttctgattgttttactggttcccaagaaatggatttacctgtatgaatatgtgaacttttgagatattattttatatagatgtattaatataagttcctaatgtgaacttccttatccaaaagttgatttatgcaggtagagagtggatgcaggtagagagtagaatgatagtagaatgatagatactagaggctggcaagcgtctgtgtgagaggagtttagcacacaaagaaagattggttaacaggtacaaaaatacagttagaagaaataagttctaatgtttaatagcagagcagggtgatggttaatagcaatgtattgtatatttaaaaatagctggaagcaaggacttgaaatgttcgcagcatatagaaaggataaatactccagatgatagataccctaaataccttgaatcgatcattacacagtctgtgtgtgtaacaaaatgttacatgtacccctaaatgtataaatatcatgtgtcaattaaaaagttaaaaaatagcctttatgacaatacagtctttactaattttaaatattattctttttttatatttctttgaagttagagattttttcctaagttcatatgctatttaaattgttttgtttttaatactggtattttgattatcttatgagagctaatcatatatcactacttaattatatacattaactctttctcacatttatggcaaaaatatttcagactttttaatgatggcattttgtgctgtgcattcgttaatactgtatatatttcacagtactggttttatttctttatgattgttttgcctttatattttatccttgcttgtatattttacatacatttataaagtttctaatgataccatttggaaatcattttccaattttttctacacatatttctatggattgtatgtattttttgcattattagtattatactatacatgttaatttgtcgttcttccacgtatgaagtgagcaacttgtcctaccattacttatccaatttcacatgacattttaatgtgttatattgagtaaatgaactcataaaaatttttcataatttaacattgaattttttatccacatactgtactcagtgctaaattctaaataaaaaatacatagtattactaatgtgcattcaatgtggcttaaatcgctcttactggaacacatgttaaattaataaaatatggtctttaagtcacttttctaagctatacaggtgttttgtatataaatgattgctgtaaaatgctgaatagctttttttattgccttacttaattggtagtctctttacctcagtcgtgaagtttgaaataggaactaaaaatcattagttttaccacttgaatgataaaactaaatcacaattttagacaaaaaaaaaaaaaaggacacagcaggaggtcaataaaagggaaagaaagagtaaaacacagtttatttccaggaaagaagccgtaattgttactcagaacacataaggagagcgtgattttaaacatttagaggaaatcacaaaagcttgaagggccttcccccagaggcaccttgaaagaattcatgtttctaaaataggaaacatttaccaagactttgtataagaacagtttcaggctagtgtcagcttaactaaagcaaatgaactttctggccttaatagtcttaatggtcactgtgctacttctgtcaacatggtttgcttttctttaaaaaagagtatctgtctatctatctgtctagtatgcatataaatataatgtgcaatatatatattgcacattaatggaaaaataagaaaacttcctcataatattaagctccacaatttttagaaaaagaggtacattttttaatgcaaataaatgatatgcttccattggaattttccaagattctttttcttgtgtgattgatttctgtctggaataaaacttacatacaatgattcttctattgttaaaattcgatacttaaaagagattagaagccattttctcccaatgggaatggtcattttacaataaaatatattttttatataattagaaagactacatattgtttctctggcaggtccccagtcatgcttgctccaatgataacaagatataacaacaaaaatgacgaaagcattttttgggaaataaataaaagtgtgtatatatagatacagatttagatagcaatcatgaaatctgaccttttgatttttgaggggaattcaactgattttgggaaaaatgacaaatttacatattttccatgttttaaatggaaataaattatgttttttgggacttctgactaaccaagtttgcttatttgctgtgtttttatttgtttaacctttaatgaagagctttaggaagaagcagagcaacacctcagtgaccatacataaaaggttttgtcatatcaatttaaagcagatgaataattataaactttttgagactgcaatagcctatcagtgtgtaaacatattctctttctttttaatcttatacgattttattttaagttccggggtacaagtgcaggatgtgcaggtttgttacacagataaacgtgtgccatggtggtttactgcacctatcaaaccatcacataggtattaagccccagcatgcattagccattatttctgatcctctctctcccaccccctgacaagccccagtgtttgttctcctccctacgtccacgtgttctcattgtttagttcccacttataagtgaaaacgtgtggtgtttggttttgtgttcctgagttagtttgctgaggatagtggcttccagctccatccatgtcactacaacagataggattttgtttctttttatggctgcataatatatcatggtatatatgtgccatatttgtttatccagtctatcattgatgggcatttgggttgattccatgtcttttctgttttgaatagtactgcaataaatatatgcatgcatgtatctttataatagaacaatttatattcctttgggtatatacccagtaacggaattgcttagtcaaatggtatttctggttctaggtctttgaggaattgtcacactgtcttctacaatggttgaactaatttgcattcccatcaactgtgtaaaagtgttcctgtttctcctcagccaacatctgctgtttcttgactttttaataatcaccattctaactggcctgatatggtatctcattctgggtttgatttgcatttctctaatgatcagtgatgttgagcattttttaatatgtttgttgcctctataaacgtctatttttgagaaatgtctgtccgtgtcctttgcccactttttaacggggttatttgtttttttcttgtaaatttgttgaagtcccttgtagactcaggatattaaacctttgtccaatggatagattgcaaaaattttctcccattctgtaggttgtctgttcactctgatgatagtttaatttcctgtgcagaagctctttagttaaactagatcccatttgtcaacttttgttttgttgcaattgcttttaacatttttgtcatgaaatctttgcctgtgcctatgtcctgattagtattgcgtagattttcttctagggtttatataattttgggttttacatttaagtctttaatccatctttagctaatttttgtattaggtatgaggtaggggtccaatttgaattttctgcatatggctagtaagttctcccagcactatttattaaatagggaatcatttcctcattgcttgtttttgtcaggtttgtcgaagatcagctggttgtagttgtgtggtcttatttccgagttctctattttgttaaattggtctaggtgtctgactttgtaccactaccatactgctttagttactgtagccttgtagtatagtttgaggtcagaaagcatgatgtctccagctttgctctttttgcttaggattgtcttggctatacgggctctttgttggttccatatgaattttaaaatagtttttctctaatttggggaagaatgtcaatggtcgtttaatgggaatcgcactgaatctataaattattttgggctgtacagccattttcatgatattgattttttctacccatgagtgtggaatgttttttcatttgtttctttcctctcttatttccttgagcagtggtttgtagttcaccttgaagaggtcctatcacttcctttattagctgtattagtaggtattttattctctttgcagtaattgtgaattggaattcattcatgatttgcctctctgcttacctgttgttggtgtataggaatgcctgtcatttttccacattgattttgtatcctgagactttgctgaagttgcttgtcatcttaagaagcttttgggtttagttgaatggagttttctagatattgtatcatgtcttctgcaaacaaagacaatttgacttcctgtcttcctattcgaatgccctttatttctttctcttgcctgattgccctggatcttaaactattttaagttaatgagggatataaatattttataatttcaattagtaattggtaactgccaaaatgtcagagtgctaatctgggatgaactgaaattaacgtatacttatctctatgatctaataactttggcttgtctcttatatttctgttattccctacatgatttcccaattgaattcatcaaaaaccgagcttctactttgtgtcaatttttgtttctatgataagggaataaagaatatgttaaacatataaaatgaagacaatgtgaacctttaaagaaataggaactagcatattttatgggtgcacaaatgcagaatgctttgttcagccgaggagaggttagtagaaaaatagttcctgaagaatcatcttcaagtcaatgttttgttttgcttacctgtagcgggccttcaaggcttctttccctcaggctacatggctgcatttaatttcaaacagcataaacaaaagtcctttatagtgctttgtcacagctgaattgaattatcctagataagacttctcaaacccagataaatatgccattcacttggtgctaaggaataattattcagtgatttcatataaagttgctttttctcttaactttcttgtagccagtgaaaatcccataacaagggacttccaatttgaaacaacaacaacaactaataaatgaaaacattttcaaaagcatattatgtgtggaaatactggggtgttattgagtgatttaggaggcacacaggtacaaataacatactggtataaattgtagaatgatgtttcagatatcgtcaaataataatattctttgtttatatatggtgacgtttcttgattcttgtattctgtataatgtgcccagagttaatagacaaaatattgagttgggtcatgatcaattagtaaaatggtgttgtgaataaaatatacatttaaattttaatcgtatgtgtattaaataatttgttttaggccggatgcggtggctcacgcctgtaatcccagcactttgggaggccgaggtgggtggatcacgaggtcaggagatggagaccatcctggctgacccggtgaaacccatctctactaaaaatacaaaaaattagtcgggcatggtggcaggcacctgtggtcccagctacttgggaggctgaggcaggagaatggtgtgaacccggaaggcggagcttgcagtgagcggagatcgcaccactgcactccagattgagcagcagagctagactccatctcaaataaataaataaataaataaataataatttgttttaacatttgctatagaaatacagctcaaagagaggatgtgaaatgttcccaacacatagaaatggaaactataaagagaattgcattgcaaatcctgacacgtaaatttaatctacatttctgaatgttttcttggtttgcaagaaatggattaacctgaatgaatttgtgaactttgagatattctttttcatgtagatttacaaataaaaattgccaatatcatggaactagagagtgagaatgatagttatcagaggctgggaagagtgtgttggacggggacgggggatgaagacaatgggaagaaggaaggcaaagagattaagaaaagagagggaatatgtttaaaatacatgaagacagaaggagggccaaaataaaggattctgtcttcctcaacgctctattcgtagatcttagcattatgtgcacacataggagatgttcagtaaacaactgttaactatttacaggcactgcagaatttgttacttttattaagttctattatgtaatttcacccataatctgatatgtatacctctatcactgtacatatcataccattgaaataatttgttttgtgagtatatctcctccctcactcttgaattaccttagaaggcatgatccaagtcagttatttcatctccactacttatgtgcctaataaataatcagtttgagtcattatttattatgtatttctaatgtagatatttatttaaaaataaataataatgtaaattttaaataacaatgataattaataaataataaaagtaaataaataataaccttgtgcctaagaaacaatcacttggtaaatagactcaactgacacagatatcattatgtcaataagcatcatcatcaccaataaaaacagttgtgaaaaactattcagcttgctgtgtctactactgaggaaacaaagagatgcatggcatagtctctgatctagaggtatttacaaagtcaattgagaaaccaggatgaaatggctaatgactgtttgaggcaggcctttttataacacaaaggaggaaatgaaacctaccctttttctttttttggaaatcaagtggcttaaaattatattggtaattacacttaatttgtactcataagcagacattaacattcacctttggaagataatttgttcattcaatcaatcttgtatgttctttggggagtgggggagattaggaagctgaagatagcacataacaaattatattttactatatactaaaatggagatgaagaataaaaaataaaagcaagaaaaaataaggatatgtctttatttgcttttatatagcaatcacacttaaagctaaacattatactttatccttacatgtatactttgggacctattcatgagcttcaaatttaaatgcaattcatctaattgctgagatgaaagaaaaaatatgagatacatagtttagcatccctaagattaaaaacataaagaatcaccatgttcccaggaaaattagagctattcaagtatttttgaattattttacagatggctctgtaatcatagtgaaaagtgtcttagataatatccttacaataggtataactatgagttaaatagggctatttcttatagcagtcatcaatataatatagtctgagtaccttattttatccagatttggttagatctgagaatattttaaaatatttgaaaagttagttggatttcttttccttggaattatattcacttagtagattttgtttctactgaatttgcaaaatgtcctatgaggaatacttaactgacagtggcaattgtctggaatgccagcagaattttcttgaataaagtttggattcctgtgttttagcagaaaatcaaattaggattgggttttatcctttcatgaggaaggcaaggaacctggaagctggcttctgcagtgaaccaaaataggacttcacgtcatggacgtggtattcttaaaaataataataaaaaattgaaactactgagagttaaaatgggcagtagaaacttcacaggtatgcttcattgtcaatatacttctaatctaaaaacaataataatctaaacagaaaaagactttgaccttggccaaatatattctcagtaatcatggagtaccaagcattgtgcaataatatttcccggtataccactcataattgagataaaaatctccaaaatgattgagttaacttggtttagtaatttaaatatgggggatactggaacttttctttccactacagcttttcttccttccttatctccttgaatgttccctctctctaggaaggataagtaccaatgtatagataagttttatcagatgaaatgccaaaaacaatgaagatatgcagagctactagccttgtgttattttaaataatatttttcagcttaattttaataatattcacaaatcttagcaaacattctacacacactcacacacaaacacacacacacacacacacacacacacagagagagagagagtctgaattaaatggggctcaaaatctgcttcaactgtttactaaatttataatctaagaaaaagtatcttcctcaatgcttatacttctcattggtaaaatgcagatagttataatatttttctcatataatttttgtgaggattagaagagtggccaagtcataaggcagaatgttgttctgataagcatggagagaattattgcaaccacctttgcaaacaaattacatacgatcgaagtaactgctcactatttttataagtattttcttaacagttttatttgcatatttcatcagatgaaatttagagtcattgtcaagttttccttggtcttcattcagtttgctctcggagtctgcccagtgcatttgctttgtatacttattccaataatatcttatattcctacaatgtattttaattttctgcataatttatatgtttattgagtttgttcctgtgatttaaatttttcttttttttcttatgtattatcacaatatttctacttggttattagtgatatagaaaagttttgtttatttgtatgttctttattctaaatgatttcatgtttaattcagtgtaatttttaggagttttttaatttgttattttcaacaggcaatattactacacgcaaaacattgaaaaatatatatctactctttttttatattttcttttgttcattctttgttctgttggcatgattaaaattgccttcattttgtgtaataatcttcagtatgttaacactgtgtaagattgatgttattgcaagataggaatcctttatcttgcagaaaatagaagctctatctctaatttattagttttattatccattcacctatttacttagtcatttaataagtatttataggccaggcatggtggctcaggcctgtaatcccgacactgtgggaagccgaggtgggcgcatcacgaagtgaggagatctagaccatcccggccaacatagtggaaccctgtctctactaaaatatgaaaaattagcctggcatggtggcacacacctgtagtcccaggtactcaggaggctgaggcaggggaatcgtttgaacccgggaggcggaggttgcagtgagctgagatcgtgccaccgcaccccagcctgatgacaaaacaagactctgtctcaaaaagaaaaaaaaaaggcatttataaaatgcctagtatgtgccagatacttcaatcaaaaatttaaaaataaaaacaaaactatagagataattttatgttttaattctttgatttaataattatgggtccaatttttataagcaaaaataattgctcttactttactcttgcattttatctcattattggttactatctacaaaccaaaggccaggaaaaagtcaatgaaaatgattttattcactattttgtttactttttgtattgttcctggtgcatttttcctaaactgctatgctatataacagagcgctattgtaaaataatctaacaaagctgcaaattctttgtaacatatttttcctgtaagttgaatataatgtcctctaaagtaatttgtatacagaaatcatatagcaatatatattagggaaagaaagcactgcatctttttaaaaatgggataaatcatattacatatccatcaaagtagaataatgcacatggggttaataaaaaggaacaatttgttaaattttttccagaattgcatctagaagcaaaagtcaatttggcttaatgcctataatggagttaataagacactttagaaagtgattggtttatataaaaaacatggggcgtttgaccttgatttttaaattagagagaatcgattggcataaaatgcaatctgaacctacacaatttcaattaccagattcattcttaaatgatatcccagaatcatctatcattgctgggtcttacacaccacttcaggaactctcatatagttgtaatttaagaaattttttgaaacaacttagtttgagaaattcattatggcttcgttaagtaaaaatttcataataacatcatacagtttggaagcattatgattttggaacattgcctaacttggcaagaaaacagtttgtgaataagaaatctagctatcttgttagtatgctaaaatattttttgtcaaaattttcactaagttctcctccaagaatagcatgtttcttggaaatggtaaaattgatcataaatgtattctatctacatacaagtgcatgatctgcatctcagatgaactttatgcaattatcaaatagatggtttacaatgattaaaccagttgaaacaatactaagataaataaaaattcatagatgcaaaaatatattgataggaaaataatttatcataatcattgtgactgaagaaaatttggcaaatgtagaaaagttataagaaataaataaaaactacctgtaactaattcctagatataactttttgactctatgactttttttacaggtttatgtagtagtttatttctctgttttcctcctcatttggcttattttcaatttttcattcattgtaaacagtactgtaaaaattaattgtacaaaatgtttgatcacataactgatgaataagaataggtaattttttaaataaaatattttccaattgagatgtaagactataagtactcaaactaatggagctgaaaaagtataaagattagcttctgattatattctaagagtagaaattaaattgagatttagccaagtttaattatcaactgaaatagttttaaattattttctagtttccatgtctgagttttgagtgataatatgtgtatgcaagtatgttttcattatggatcaatggttttaaaagtttagtctcgaatctaagttaatggaacattttttgatagagtcataatgtctcccacatattaggcgacctctgtttttccatatgaattgcttttaaaattgttgaaggacggaaaattactaggggagggtgattctgtaaactaactgtagctttccaactgtgagtaggaaaacactcatatctttctgtagacctcctgtacagattcatcacttatgaaaaccaggatggaactagaagtctcaaaaagtcacataaggccgggcgcggtggctcacgcctgtaatcccagcactttgggaggccgaggcgggcggatcacgaggtcagcagatcgagaccatcctgggtaacacggtgaaaccccgtctctactaaaaatacaaaaaaatttagccgggcgtggtggcgggcgcctgtagtcccagctactcgggaggctgaggcaggagaatggcgggaacccgggaggcggagcttgcagtgagccgagatagcgccactgtgctccagcctgggcgacagagcgagactccgtctcaaaaaaaaaaaaaaaaaaaatttaaaaagcgagtagtcctcttttaatatttttatgtaattcctaattggaatattgtttaagtagcccttgttccagatgcacatcaatataagtgtggtaagttttcattttaggccacaaattaaagttgacatttaatgtaattgtctttatcattgtctattactatctcagattcctagtcttttacatggtgaaaacttggtattgaataattgggggaggttttcctcttttggcttttgcctggggttgcctttaaatttcataggattttgatcctaaaagtgtggggacgaaattaagaggaaataatgagaaaaaatctattcagtgtgtgcaagggagagtgaacagtaggaaaaagtagagaacgggcattatctgttcatgcaggataccggctatatctgtattctcctcactctatctacaaaatcaggtccatcagcttgttttgccacgtccaagctgctcttggccacagaagaaaacatttgtgttttttccacaacatatggaaagctttcagggctatctctggcctgactgcctacacagagggaactgaaacaagtcttttctgcctcttcctcctctctctccccttcatcttcctccgcctttaccagcttattatgaaaaaaatttctggggtcttgcaacttttggatccctaaacctttttagaagtttttatcatttttcttatgaattccaatgctgaaccctggataaaacataaaattaagaatgaaaattatgatattgatcctcagttctgtctaaaacaaatacaaacaaacaaactgataaaagaaaacaaaatccttgatcagtgtgacaaagggcaaagattctatttggatttagatttctttcatgatagcgtctgccccgtaaaaccaaacacacagactgtgttaatgtcagggttttaacatgcgtcactactgaaaaacaacctgtgcaatatagaataataaatgtaagatatacaagtcagaaatgttcttaagttagtaattactctaaatcttttctgggacatgtcagtgtataaatacacacaattcgagattcaatgaataatcttatagaaggtatttttattttgtaattataacctgtctgtagtagaattaatctttctttgtttcagcccagtcttttaatattactctccatctttacaatatgtctacttagagaatctccatgcatgcatccttagcaatttatttccttggatgtgtactccttccaatactgtccgtaaaatgccaggcaatatttgcagagttgctaacaaatgacttggcattttctattgtgacactccttcatttgattgttggtttttttttttttttttttttgattccattctttctagtgctttggtggtgagaactttgttgtgttctcttcggagatgtgactcactcaatgattaggaactgatctgaaaatatattctttcttaggtggaagtgtgagcaccaaaatcactaaatttcaactcaaagcagagagcaagtatttctaattaacactttactctcagtgaagtgtagaccattagttataaggttacatatacatatatgtgtgtgtaggtaggtagacagattgatagatttttttaaacattggctgtccgtttttaaaatcagttttcatttttccctgtgtccttaatcatatgttccttttattacgtctataaaaataatttgttgctgaataagttgacaggtaacacagcttatttgatcatctccttgaagatcacaattcacagttatgtatcaaaagctccaagaaagtctgtagtaaataaatagatttaaactttgcattctggtgttttcaagatactgcagttaaatttgctttgttgtttataatccttacatagtcctccaatatatgtgtctttgatgatggaggaatacagcacacacacatacatacacacacacacaatttatctttatcatttcaattagtgaacttttaaaaattatattgttagatgacaaagtggtaacactatagtaaaccacaaaaaatttaattatgatggtaaatgccattttattatggagatttaaatccattcaaaataaaatgtatataatatattttcacaaatggaaaacaaaacatggcagaaggatttgccaagaagttacttctagttattggtagcaaaaaaataaatcacctggagtgtgaaatatgctattgcttcaaagaaaaacattgggctcattaatttggtatcaattagtatttcaatatttgattggtagaataataggtctgtgggaggtgtgtgaggaagaaacatattgaagaaaaagaaattcttaaatctgttttttcattcaagagtctacttacaagtcatgttaaagtatttacattaagacaactattaaatattcttccctgttagtaatttattgtctgtctcctgccacaagaatgtaagctccattagggcaaactttttttttctttcaacttttattttatgttcggaggatacatattcaggtttgttacctaggtacactgcatgtcgctgaggtttgagatacaaaagattctgtcacacaggtactaagcatagtacacgatagtttttcagttcttgccctcctcttttcctcccaactctggtagtacctggtttctcttactgtcatctttatgtccataaatattgaatgtttagctccagcttctaagtgagaatatgaagtactttgttttctgtccctgcattaatttgcctaggataatggcctccagctccattcatgttgctgaaaaggacatgatcttgttctttttcatggctttatagtattccatggtgtatatgtaccatgttttctttatccaacttactataagtgggcatctaggttgattccaggtctttcctatggtggacagtgctgtgatgaacctgagagtacatgactttatggcagaatgatttttattcttttggatatacacccagtaatgggattcctggcttaaatggtagttctctttttagttctttgagaaatctccaaactgctttccatagtggctgaactaatttacgttctcacaacagtgtataagcattccttatttgcaggctcacaagcatttgttgttttttgactttttaataacagccattctgactggtgtgagaggcatctcattgtggttttgatttgcattgctctgataattagtgatatggaacattttttcttatatttgttgatcacttatatgacttcttttgtcttttgcccattttttaatgggattatttgggttttgtcagtttaattatgttacttataggttctggatattagaactatattggatgtggagtttgtgaatattttcttccattctgtaggtcatctatttactctattgattgtttcttttgctgtgcagaagaagctctttgttttaattaggccttacttgtcaattgtagtttttgttgcagttgctcttgggactgagccaaaaattgttttccaaggctgatgttcagaatggcatttcctaagattttcttctaggatatgtatagttttaggtcttacacttaaatatttaatctatcttgacttaatttttgtatatggtgaaaggcggggttccagttttattcttctgcatatagtttccagctatcccagtatcttttattcaataggaagtcctttccctattgcttattttttttttttttttttggagatcagtttgctgtgggtgccaggctttatttctgggttgtctatgctgttctattggtctgtatgcctttttttcttttgccagtaccaggctgctctaggtactgaagctttacagtattctttgaaattcggcaatgtgatgcctccagctgtattctttttgctaagggtcactttggatattcaggttcttttttgctttcacatgaatttaggaataatttttctagttctttgaaaaatgaaattggtagtttgataggaatatcattgaatctgtagattgctttaggcagtatggccattttaatgatattgattcttccaatccatgaacatagaatgttttttccatttgtttgtgtcacctattatttcttttagcagtgttttatagtactcgtcgtagagatctttcaccttggatagatatatccctagatatttcttgtggctattgtaaattggattgctttctcaatttgcctctaagcttgagtgtcattgatgtatagaaatgctgctgatttttgtacattgattttgtatcctgaaacattactgaagttgtttatcagttccaggagacttttgttggaatcttcatgtgggtaaactattttcctttattttattcattggtgtaaccccagagcctacctcattccttgtagaaaattggtttggaataaatacttcttgaaccaatgaattattattataaattaacaatgacctttttttacagtctctaaagcttatgacctctctgtaataactctttctattctttctttcacaagtttaatctgttgttgacttcgagttatactcagtgaactacaaacttaaggcagtccttcagaatgtaccttctgaaatcccctgcatgagatcaccagaaaggttttaaaatgcctgctactgagtcctactacatacatgcaaaatcagactttttggtgcttaggcatatgaatctgcaaaaagtactcttaagtgattcttaggcaaataccaatttgagaattttcaccacatggtgactcaataggtcttggaggaattccactcaagtacctctctcctattccttcctgtggactgggtttatttatactcaacacaggcttttagaagaatgaaaggatagtattgagttactacgttacattcagcaaatattgattgaattattaattgtgaatctgaaattaaactcccgtgaaacgttcattgaagttctgcttttaaccaaaatatacttgcaagattagttatcaaagtaatgtttttgtgataatttcagtacaatgaggcatatgcaaaaaattattcatatcactgtcaaactgcacacactctttattgcttcacatgtatgcttaaattcaaagtgcttaggtatatttttactgatggtcgttctttgaatgtgtctagcaacaattaattctggtacaaaagtaagtaatacctgtaaactggagatataactgcatttatgtccctttctatatttctatagttttgattttctttgcataaacttattattactattattttttcttgagacaaagtttcacttcttgttgcccaggttggagtgcaatggcaccatcttggctcactgcaacctctgcctcccaggttcaagcaattctcctgactccgcctcccaagtaacagggattacaagcactgcctccatgcccggctaattttttttgtatttttattagagacggggtttcaccatgttggccaggctgatcttgaactcctgacctcaagtaatccacctgcctcggcctcccaaagtgctgaaattacaggcgtgagccacagtgcctggctcattgcataaacatttatatatgctatggacagtagagaccagaaaacagctttacactactctgactatatcccacggaaggacattacttgaagtacatgtttctgtcatctaacgctggcattgtcactttcagcactattgacatttggggccagataaatctttgttgtaggggatgtacgggactgtcttgcgtatcacaatatgtttagcaatattccagacctctattaactagatgacagtagcgtccctcaagttgtgacaatcaaaaatgtcttcagatactgccaaatatttcctggaagacaaaatcatcaccattgagaacccactgatctaagggatctgaatgggactatgttgtttccttgagttatgttacaagcagtgacatgaacttatgacatcttatactcataaacttggttagttgagcccaaattaattgtgtgtgatgtttcaacaatttggttaaatattaatttactttattttacttattatgaaaaatgagatctgaaacatatcttcacatgtcacaaatttaactggagaggtagttgttatctaatgaacgcattttgcattgttagccaaatcaggtaacgctgtaagaactagagttattcatcatcattataaacattaaagtgatctgaattacactacccacacattatttcatctgattatataataactggcaaaggcagtgcaggcaatgactgtgagccagcagaccctggaaaattggcatactaactgtgtgatcaagttggcctcagtaccagaggtttacagattaatggtaggtacggatttatattgtcatgaggcaggagccatcgttaaatagaatttcagcgcaagttatacaggtcacaagttcctaggttgcagctatcataccaaaattgaagctatgattgtccatataaatacctccaaaggctatgtgcaggatgattatggcagtatattccagcagctgccaaatagtaaactcgagtgtgaaatcactgtatttcaaaatatctttatgaaatgaggcttagcatagaaatgctaagaaagacaaaccatccaaatctttttattttgcaaactgactgattcgtctctgaccataaacaaaattcagactgtgaaattaagtatcacaggaacaaaaacaatattgacaaagcaagaatcattactaatcataggctagtctctttatgcatatgatacaaaaaagatctataaagctacagcttaaaattagagccaaaggattaatcacaaaatattaatccatataatttttgatttgcaacctaactttggctgaaacctttaaaatgctactttcattaaggattaatattgacagaagtttatagctttactgaaaagtgaacgtcagaaagtcaaaatgacataacttaatagtataatcaaacatctatgtagaattttctgtgtgtctggccctgttttagaatacagaacatttgttcaaaacttcttgggataattttctggagttattagcattgactattacaatgaatgttaagagtaggaggaagatttaagtatagatttagaaattaagatacacatttttattctctctccatttaaagatataatttgttttaattttctgaactgaatttcttcgtatgtaaaactgatttttggaagaagtaaagagcatgattcatgtaaagactctactccaaagtctgatgtaccatatacacagactttatctaattgcttcccttccttcatttcagataaaatatacagcctttgtaagccctgctacatttcttttattattattattattattattatactttaagttttagggtacatgtgcacaacgtgcaggttagttacatatgtatacatgtgccatgttgttgtgttgcacccattaactcgtcatttaacattaggtatatctcctaatgctatccctccccctttcccccatcccacaacaggccctggtgtgtgatgttccccttcctgtgtccatgtgttctcatggttcaattcccacctatcagtgagaacatgtggtgtttggttttttgtccttgtgatagtttgctgagaatgatggtttccagcttcatccatgtccctacaaaggacatgaactcatcattttttatggctgcatggtattccatggtgtatatgtgccacattttcttaatccagtctatcattgttggacatttgggttggttccaagtctttgctattgtgaatagtgccgcaataaacatatgtgtgcaagtgtctttatagcagcatgatttataatcctttgggtatatacccagtaatgggatggctgggtcaaatggtatttccagttctagatccctgaggaatcgccacactgactaccacagtagctgaactaattcacagtcccaccaacagtgtaaaagtgttcctatttctccacatcttctccagcacctgttgtttcctgacgttttaatgatcaccattctaactggtgtgagatggtatctcattgtggttttgatttgcatttctctgatggccagtgatgatgagcattttttcatgtgtcttttgggtgcgtaaatgtcttcttttgagaagtgtctgttcatatcctttgcccactttttgatggggttgtttgtttttttcttgtaaatttgttggagttcattgtagattctggatattagccctttgtcagatgactagattgcaaaacttttctccctttctgtaggtggcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctaggatttttatggttttaggtctaacatttaagtttttaatccatcttgaattaatttttgtataagaaatgtaaggaagggatccagtttcagctttttacatatggctagccagttttcccagcaccatgtattaaatagggaatcctttccccatttcttgtttttgtcaggtttgtcaaagatcagatggttgtagatatgcggcattatttctgagggctcagttctgttccattggtctgtatctctgttttggtaccagtaccatgctgttttggttactatagccttgtagtatagtttgaagtcaggtagcgtgatgcctccagctttgttcttttgacttaggattgacttggcaatgtcggctcttttttggttccatatgaacttgaaagtagtttttttccaattctgcgaagaaagtcatttgtagcttgatggggatggcattgagtctataaattaccttgggcagtatggccattttcatgatattgattcttcctacccatgagcatggaatgttcttccatttgttcgcatcctcttttatttcgttgagcagtggtttgtagttctccttgaagaggtctttcatgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgaagccctgctacatttcaatgacctaaaaactgttgtggcaaggccttgatgacaggcataagtgcttagtactatacagacacagattagacatttaatagctgtgaccattgaacaaattaatgtattttggaaacaaagggaaaatatatcaaccagaagtgctcacagatttaactcatgtaataaatacagtagattattgagcacaaactatataccggacatattctaggtttttaaaaagggtatgttatttgaaatccaaatattccaatgtagagatttttatgattctctttttgcaaatgagaaattaagacaaaaacttatctaatatatataatatattgatacctgagatttaaacctcagtggaagaatttatacagtcttctagtatagtgaactttctccctattcaactttttaaataaatacaatttctttagtgttggtaaaataacattgcaagtatattgagtattaactgtagctccataaataataatccacaaatagaggccattctttattcactgtcactacatttagatagtttatagtagacaagacatcctgagaagagttgtttgagcttttttgttatataataaggaaaatattaatttctattctgctttagggaattttggggtgagagcacattgggatcattagttgcttctcagtgaaggcatagacacttcaataggttctcaataggcatcaaatcactattttgcatttttgtgataacataattgaatagacatgttggcattgtcttggtataatatagtaattaggtggtaaagctagaaccagtgatatctcctgtgttccaaaaatcaattaacttacttcagcactgcctgcatgacaagcctattgcacttaacagagatcactttagaacaaggttcttcctttaatgttggaatcatttagtcattacttgacattataaattcattgagtgttgattaatgtctaatgcccaatgtaataccaggaaatacatgaaggatattaaatcttaaaaatgctttggtgtaataaattgttaattcactgataaatttaaaatatcattgggaaagcctcttggtatgtttgacagtagtgtccactctaatgaaatcagctgtagcaatattaaaaatctaaggaaatgcaagatatttgcttttgtattttaaattcatgctgaattttttttccacttaaattctgatgtacttgtttaagatagattttgttccacagggattcacatttttcttgtagttgaaacagtcatctatggaaggcgatgtttccatagatgactgattatacttgttatagtggcaagtactatcatgtggtcagttatctttggttattatcatatcccagatactaaatagtgaacgatatcatttacaagtcacttattctctctggggtccaagttttgtattctgtagaacaattaatttcccttacatctcttaaatgtctaattttctaatgtgcacagtgtggtctgaagaaacagaatttgaggcactaaaatttgttcatatggttattttgagtgttatagatttccccagggtaaaacaattagacttgggaaaagaaactattgatagctactttctaaaattaacattttattaatatcagaaataatgataactttgccgatgccacaatatccatgaatcagatacatctctctagggacagagttatagattgccattcacctttgtgttgttcttcaaagctctgcatattggaaacaaaagtcatctaagcaattcaaagaaaacaggttatttatatgttttattttgctgtctcatcttcctccccatctgaatgatataaatgtttataaataatttactataagagaagagatgtgatctttactctgtctggttaattaagaaaatgatctaacataagataatgcctccaggtatacatgtgtgtggaaagtgtgtgttgagggagacaagataaatacatttaagtaaagttgttttaaatgtctagaagaaatggaggtatcaacaaactagccagtcagttatagaaatagtatcttccatatctttttttttaatgtgtaacccaatactcaatttacctagtaatttatacaataaatgtagatggcaacatttcaagtaaaatatttctagatttaaaaaatgaatttggctttctcacctacgtaagtatctctttggaaattgctgatttctagggctataactataacaattgtcaagcagagagaatcaatgccttctttattttatgtggacgtacaaatatgtagcctaataatccaatatgaaaacacagtaggaatggtaacatttttaaatttttttcatgtatggtagtaacatgtgttttccatacaacgcctaagtggtggttggaaagcttcctttatccatggctatatggagaagcttttgtgtcctgtcgtgaggaaaacagtgagagagataaatatgatagataaaggtttaatatggaattattttagaaaagcaaatcataactttttagatccaagtgactgaaaacttctatatgtaactttgatttacatttctttctctttcaaattgcatctttatcaggaccctcaattctcattttattcaaatagtcttccttgacttctgagacccatcattctcttgattctccctcctgattttctttatctctcttcacttcttacttttgttaccttgcacttattcttccactgataacttcatattgccttttgtttaggggccattcatgaatctctcatcttttcgtatacaccctttttatgcggattagatcattttcccagaccttaactatagcttatttgtcgaggccaggtatccttgagttctgctcctcaactgtcagttacttaatgagttgtttaaacaaacaaacacacaaacaaaaaacacacaaaaaaaccccaaaatcacatctccaaattaattttaaaagcattattccagaaattattttgaataatcatatttcatcaaccagtaacatttatcttatatataactaaattccaaacccaaatggcttaggaaaaaaaaaaaagaaaaaaacatctaatgtctcatataatttagtggcagaaatttacacttcaattaggagtgtataaacatccccctagacctatcatctcacaaacgcttgatattaaaacttttaaattacttttttcatttggtgagcataaaatattaacccattgtggcttaaagtttaattcgctagttactaatcaattaaattgtcctttctcaggattttgattctttatattttttgttctgtgaaaagccagttaaagtttttactgaattgatatttctttatatagtctatgctctaattcattggagacattgtgttgcaaataatttctcctgattacaatgaagttgaatatattttaatattcatcttttctttatggtttgtacattttgtgtcttcttcattaatattcttattatgatgctatagcaagttctcttaaatctcttttttttttttggctttcacatttaagtagagttctgtttatgggttcccttatatatatttcattaattcgtgatatggtttggctgtgtccccactcaaatctcaccttgaattgtaataatccccacgattcaagggcaaggctagctgtagataattgaatcatggcattagtttcccccatactgttctcataacagtggataagtagtgaataagtctcacgagatttgttggttttataaattggagttcccctgcaccagctctttgcctgctgccgtgtaagaatgacttcgccccttattcacctcccaccatgatgtgaggcctcctcagccatatgaaactgtgaatccattaaatctctttccttataaattacccagtctcagatatgtctttattagcagcatgggaacagactaatagcattcatttggccatatttacgtcaacaacgtatagccataatttccatatttttgtaataaatttgtataccttgttcttttttaagagtgtttgactcttaagagtttattttgttgcttgtacttctatgtgcattttaagattaacttgatacatttcacctaagatttttttatttaattttactaactacattggtcaatttgagttagttatttttagataattgactcttcccacccctgaatatgatcattctatttctttatttagattgtatgcactctgatagcattatccctcgttgctgtataatttttattatacatataatgggtatttttatattgttttcacactcgttcctcgtgtgcatatatgcagttgattgtatgtgtttactttgcacccagcaacttttataaaactcattaactataatagtttatctatggatccttccctgttgtctatatgaaaatgtattaacacaaatatacgtttatatatatatatatatatatatatatttggtagaacatatgcataggctctatgcattaatatatacatacacatgctcatcatatattgtgaaacaatgtttaaatagcaacctgttataaatccaaaataatatttataatttggcttttttcatttaaaagattgcagtaacacacagtggcattctaagtttcaaataatggttaccaatggtaatattaaattaatgctatattagatcatacaaagaaagaattatggtggactggggtggttgaacgttacttaatggaggaacttatgttgtagaggagagatgaacaggtatggatggataaagtattctagggaagaagaaacataaagacttagtttaaaaaaattatacttgcactgaataacatgaatattcagtgatgtattgctttcacgaaatagggtgaattctgtgaacttaaatattaagtactgccgaaatacatcatggaaactcagttgagaattatttgttatgagaaaagtagtcattttgtttttctccaatttggaaaattaaatcatgaggaaatagattttgcatcagtaaaatgtatctttacattaattgaagctattgctttggctaattttattttctgctacttacaaaggcagtgataaaagtagtaatatgaactatatttgtcccagattccttattactgaagttgaattgttgataccttgaatgttcctattttagtaattttagtttcatgataacaaaaatatctcagtcagagtatgatttatttcaatatatacatggaagtgtttaaatcaacagattttaataataatgtatgctatcatttaattaacttattgtggtcattgaatattattgacatcataaatttttctcatgttaccccaatattaacaaagagtaaaatgtgcttaataaaaggtgaaccctgaaaataattaaaaagcaggaggttgagttccaatatttctgtagggggaaaattaagcatttattttggccaaagaatctttttcctttgactagtatactattttgaacaagccgatgttttcttaatgaggtttagcaatgttaaattatgtggaaaaactaagatacttatccaacaagaacaaaatagaaaggggtaaggccaatatttgtcaagaaactatttctattatatatatattatacttagcaacatgtatagggtgagtcacctgtgcattacttgaatagaatagaacatcaaacatttgtttggtgaaaactgcagttaatattaatgccagaaaagagttaatgatttggggatgattatttttaaaatatatccagaaaatgaaacagttgatgaatagtaattaagcatatagttatttaactatatgtaacgaatagtatttaacatatagttactattttgggtgaacaacaataaaagttgaaggggataaattattgtgggtatttggaataaatatattttatgacatacaaagtgaagaaagcttttaccaacgtaaattctgtttaaagattttagaatgcctaataatattacactaatataattaataaattaattaaataaatactttagagtcacatatatgagatacaaatctaagattgctatcattttaccatatgaatttaaaaactgcaaatagatattcaggagattaacggaccacaaaaaaatttacatctatttgttagttaatgaaaaataaagagctagtttctaatttgaaagcttcatagtaagtatgaattaaaagaattgtgcattttttacaaaataaaaatatggtcattataattttgtaatatttatttatatattttatatatacacacatacatgcataaacacacacacgcacacacacacacacgcacacgcacacacatgcacacgcacacacacaccccacattgggtgctctttcgtttctccactctgataaagctttatacttgatatagttcagcaacagttctttttaaagataaggaatttaatagtgacaccctgaaattgtgattgtttaaatctataaagaatttgggagcaaaatcaaaaatgatcagtaggctagaaatatttctatcattaaatgacagatagtattttcttgttttacaatttctatgaagaacatttacaattagaaaacatattcaatatattctgagtttttgttacaaatcaaaaatagaaaataaaatgaagtgaaaaactattttatctggtgttttacccattttagaggttgaggacacattttctatagctttgatttgtttattatatatctggacatctagaccctttatagtgtatacaaatgtcaagcatttagatttttataaatagagactttctctggtcttactgtacaatttcttagagaaatgagtgttcctttgaattgaaagagccctgcagctgtgtttgatagaactgccaaaagccatctataaaactattaagagtgaagaactattacagttgaattcagcattttatatatatgttttgtttgaccacaaatagcaactggattgtaaagccttttagttatttataatgcatttatttcataaggcttggtggtgatattaataaaggatattatcaaaatagaatgctagataaaatactataaatatatagatatatttattaccaatggaaaatgattacataatttatcaaaaatatatttatgccaaagttttcctgtaagcaagggactcttttcagtggcttctattaaacttagggtacagcatataaaataaaattacaagaactacatagataatataaacagaacaaattaatgaaactgaattcacaaactatacaaaaaattattacgcaataccttctatgtgtttctgtggttttataacatctaccctacaatcacacatgaactctccttcaaaatgtttagaacatattaaaaaaaggacaagtaaatgtttgcacatattccaagatagatgcacaccttaaaaataaggtaatgacattatgatggtgctaaggaggatactaataaaaataatactgattaagctctttgcccaaatcattcagatgccaaatgacagagccagattcagattcgggtctgcatttttctcagggtctgttacatgtgttagagaaggtgcacatggttcagaagaaaggtaagaacagaacaaaatctgggagaattcaacaaatttatttccattctctattagatttaggaataaaaactctattgtttgcagagcatcttcacaaatatttactctggaaaaggtgccatgtgaataaaaccaggaaggaagggtaggtcaaattccatttcacatgtgaggaagtgaactgtcacaagctaagagcattgctcaacgttgcacaacctcactgtagactggtggagatgaagacatgtctacaaactgtttttattgctctttttactagtttgtcaaactatccatctttactagtttgtcaaactatccatacctatcttaaaaggagctataatttcatgatgagaacacttcatagtgattgttgcagccaatttaaagaacattgtggatattcattgatttttttaatgaaaaaaaggtgtaattttttattcatttatttttaatattgaaatggttacgctttggattctatcttagcaagttcagatttcaggaaagtagttgaataaatatactcatttctgaagccaaggcaagtttcatgaagactgtcttctaatgtgtatgtcttcatattatagtatacatacacaagcatcctgtaaagcatagctttaagagaaatgtaagaaagtggagaatttgggaaaaatataaacaaaagtatgagaggatcacaatcatacttttctgtattgttctaatgtttacaaagtaattatcaagtatgtcacctaattttttatcattaagcctctgaaagaagtatcattcctattttacgcttaagagacaagaggttgactcaccaaaggtcccacagggatagaagggaaatttagtgagatgaaattccttgttcttcatgctatatcacaatgcctttctccccctgaacacctaaaactgaaattctcgcggagttttgaaaccacatccatgtgaatgcaatctcaaatgtcccgtgtttatgagacttctcaaacaaaagagtgtattctttttttaactcctatttttggtttgggggtacatgtgcaggtttgttatataggtaaactcatatcacgggggtttgttgtacagattatttcatcacccaaatattaagcctagtacccattagttatttttcctgatcctcaccctcctcccaccttcaagtgggccccagtgtttgctgctcccttctctgtgaccatgtgttctcatcatttagctcccacttaaaagtgagaacatgctatatttggttttctgtccctgcacaaacaaaacaatatattcttaagagtttattattggacctagtcttacttattgtacctatgataacatatcataaatcacttatttattttttgatttacacgtgtcttttttacatactccatttacacaagttaaaaaattacaaaataaaaaatcattccctctccaagtatgcagagataataattaaaattcagcttcagagattttaaccacatgtaataaactcattcattataatggtaataatatttcaaatatgtcaaattatacgttgtatctaggttttttcttatttatgcatttttgctagttggggttacaaaaataaaaaagaaaattattaggggttgaatgtaaatttcactgtctatttagtcagtaggtaaaaagttgtgattaggaaaataggacagacactaagatataaaattattttataattacaaaaaacattctgtcaagcgtatttcagattttaaaattactcatatccaaaaggatactgatttgtgtttttttattaaagtttctatctttaggaattaaaaatttatagctagagagtaataggccaataagaaaaatttaaggcaaagtatagtattattttcgagttatgatataacactttgtttttaaagataagttaatgtaatatataatatgaatgaataacatacacacataatacatgcaaatagtattgtatatatgtatgcataaggtatcatgtttgccagtgcatttgctatgcacaaattatgtatccatttattttctgaatttaaacaaatacgatcacatattcttgctttttttgtatactccccctcttttccatgtaaataatctagtatttttcctctgcgcccttacttctaaaatcctatacccatatatgttagtatgtttacacataagtattaatattaatatattcacatgccatgttttgtaatgtcaccatttttttgcttaaaaagtgagatcatactaaatacaatttacttgtgtcttcattactcaatgacatttatctgcagtggtgagcaagtatagctccaattcactcctttaaattgttatatgctaatatatggcaaagaaaactcacaggtttttcaactgataggcatggtctttgttttgacatgttttcttcctgaactacagtaattttatttggatgggatatattctgaggacaagaactgttgagtcttggtttaaaggaatgtgtgtgtgtgttagtgtgtgttttatgtgcctgtggaaattgaaaggaggtttacaaaattgcttttgaaaataatttcacatttctaggagtattgaataagagtaccttttgctctgcacttctgaaaacagtccatgttataattttgtttatttcttccagactcatgtggtataaaaacaatatctcgttatttgaaattttattttctaggctaatagaaaaatttagcaccatttcatatattttggtcactctgtaaactgtctattcataaccttttatcattttttcacttttttaattttccttgtcaatttgtaagtcctttctgtattatataaatattaatcttcatctgttacctgaagcgaaaatattgtccctatatattgttttcttatagaattcattgttcataatttttatcatgcaaaagttttaaatctgtatgtagtctaatgtggctatctttttgtaacatctgggattcctattattgcaaacatagattcatatttcttaactctattaatttattgtttacatgtaagcatttcattcatttggggatgtatgtaaactgccttaaatatatatattttaagattttgtattttaattcttctgtgtaattgttttttgatgctcaatcaaatgtggatagtgctctttacacatgtacaatgcctccctcattaaagatttagaactttctttaagaaaaaatggaattttaaaaatatttttgttcacaggtgcctactgctaaaatatagaaagggtaaagtcaatattatgataatttttaaacacaaaatatctcttggaagtttacaatcatcaaaaggagattcttttatctcttcctttaaatgtcactaaatataactatactttgtttcaaaatttggtccaaatcattatttctgaaaacaagaaaactacacacaactaaaaattagcatcaaaattcttacttcatattcacaatcctcttgtttttagagaggcagtgtgtagaaaaaatatggtattattggatggttatcaaggttttattcacatattcccaattactagctatgtgtccttgactaatttaagccaatttgattgtctgtaaaatgaagataaagctgatctcatggtattatgttagtatcagtgggacttgtgagggcacttaggaatcctacaaatgctatgtatgtataacatcactgatgggaaattccaaactcttcggaagcaagatgtgggcatttgtttactcttagttgaatggtattgcatagctacttggagctacttgtgatgaatcagtatttatagataaacttaaagagattatagaatgatcccctttttcaattgtcaaaacttctatttatctaaaaatctaccatgccattatattcaaccagtaaaaaaaatgcagtcctaaaatacatgcatattataaaagatctgtaatatttaatagctaaccagtaatgtaaaactaatgaacacatacaatgtcacataccataagtcccatgaatattggttaaaataataagtaataagaaaattgaatcgtagagttaattgtgacatgtaattgagattttaaaattaaaatgtgtaattcttcttagacaatatcttcataagggcaacaaaatagaaatacctactcaatagcccctgtttattgggtttaatgtagtaaaacattgattgtttaaaatgtttgcttttgaagctattgtatctcctatatacataagagcaggtttattctgaatgtgttttgtttatctatatttaactgaaaactgtcagtaacctccaaaataacacaatagaaaataaaacaatttaacactattatctttgggctaaaataaatgctaatgccaaaatgctgaatccatttcatgtaaacaggggcgttgacacttgaagtgatattcccttggggttgagcagtgaggctcagatgcatacacatttgtcagttttgtggtgtaattttcataactaacatcatcataattaccctctttgaagataggtaaggtgataggtgtatttgaatttgatatcattctcttatacatctagagtgacttacacaaagcatgtacttttattacgacacatttgtggcataactttcagtacaatctgattgacatggggtctaaatccctgtaaattctcatactgtagagccttcctaagccaaatcatgagaaagcaaagctgatgttcagcacccctcgggcattccatctaccaaaggagtctctaaggatattccttagcctaaaatctcctaattgagcttctgaaattaaggtttatttctaatgtgaaccatatgcttaaaccatactggtgatcatgtagtccctgagattcatgacatttcctcctctcaatatttcctttaagcagggattaaactgtgacatttgaaagccatggcctttggagatagagtactgagatatgactttcacctctaacagtttttaactctgtggccctaggaaagaggcttaagctgcaagcctattttccctttttaaaaacagaccttactcagagagaattcatgatgaatgaataaaacaatctatttgacacccttaaaacagtacttgaaattaactttggaaatactttgtttttattattttgataatggaatttcatgatgataattattatgatagtaatcataatgatagctactattattgattgagcatcttctacgggaacttcttcccattatttattctctaagtttcacttattaatcaggaggacagcttttattttgtctactctataatacctctttcaaaatgttggcataattaacctccttgtcttctgagccaaaaaacatgtattgcttatcatagacttctttgtttctttttttttttctctctcttttttttgcttcattatattttacatacacatatggatgaataccaagtgaagtttatttatattaatgtttaaaattatgttatgtaaaaacttgttttattctgctttgtttttaagggcccctcttaattaaaaacgttaaattgaattcttttatttaaaatatttatgcatttcttcatatttatgagttagataaaggtaatggtaatggcttacaatttattctttctcctgcaacacctagcacagagctactttactgttgattcttaagaacacttcttaaggtgaaagataataagaaaggatgaaggctggatgggtttgaatattataactctcttttctttccctatgtcaaaatgaattttattggatgccatgctttccattacatagaatacatcagccatatgatccctaagtgtaaagaattaagtcagcaaaaagtcctattgtcttaagaagtcctctgaaaaccaataatttggttttctgaaatttgggaggtaattttgagcacaggcagatatatcagatggtttttatgtgtcttctacgctccttttcatgtaaggtgtttcctgtgtgatgccaacagtaatcagcacaattgctgacactaccctgatcttagttccttacttttatcccggagaaaaaactatccttttgaaaagttccattatgttcagtgatcaatgattgtgcatgtcaattgagctttatcgtcttcaaatcttatgaatatcaaaaacaaagttttaagaatctgacactaatatgcctaaaattgtacaaaagtctattacatgtgaaaaacctcaatatcttatgaaaaattggttttatttaatgatttttcaaggaaatttattctgattatgagacacatacattatagtatgaacatctaagaaaatttgtataaagataaagttggttcaaaattcttgctttgggggaaaaagggagaaaggaaaaattattttatttgatttttatttcttgaggcaggttcttgccctgtcacccagatgggagggcagtggtgtgatcatggctcactgcagccttgacctctggggttcaagtggttctcccacttcagccccacaagtagctgggacaacacaacaggtgtgtgccaccatgcccagctattaatttttttttttgtagagacaggttcttaccatattaccctgattaaagattatttcattttacttatcttctgaaaagtcaaattagctaaatactactctagttgttacccgaagcaaaatcctgtgcatatttgaggttaatagtctcttaactcagttaatcaataagtatttatcatttactttatatgctgtttacagttctggctgtatttttctggtacatttacatagacccttgcgattgagaatgcaggcattataaagaaaaaatatcagttacacacttcaataaaaatacagatattctataattttcagttacaaaatagcataactcatgctcacaggatacctatttctacaactatgaacaatgaagagcaatgattattttaaattttatacaagaagatattatttaatattatttaataatattatttaattattcttgattgtacctttcttagaatttataggctaaattacttacacaaaatttgtttggatattgttaccccttttttgcacttaattataattttattttgttgaaattaattaaatgtaattttaggataaaaacatctatcatatataaacctacaaacatagattttatgggaggcattgagttaaagtcttaccatcctcggattgtgagatgctatatttggggatctataatatgaattcactgggtacctggagcaggggaaatgctacatataaaagcagaggtaaaggaagacacacttggcttactccacagtgatgcaacatgaagatgatagattttattcaatcatgcaacatagtttgagaaaaccttcctttagaatttgttcaatcgtttggaattttcaagcaatgtatgcctaaagttagatctgttaaaaatcctctctcatcattaattttacaaagttcataaacttgatcataaactaagaagttatttttgtgtgtattagtataagatattgtccaagaacaatttctgcagtaaactaaaatttaccatttttccaagaaaatgcatattaatttatcttcatttttttatgttaaacttcaacatgacaggataggtaatattgctacttgaaaagtttgttatcagctaattttatgtttttataattctttgaatgtactgaagatccttagatacttttattgcaaagattgttaatgttagctacaaaaaacaagcacaatctccctgttaaatgtatttaagagtttaagtgaattaaagtaaacaattaaaacttaggtgtgctccatgtattattagaatgatacactaactttgctctttccaaaagaattaaaaaaaaatagtaacttgaaaaggacctagaagagtaaggcatatagagaaaaatttggaatgagaataatattgcagaaaaaatgtttttttcttcatgtagcactataaaaacaggaaatagtcacacatattgtagaattgtgtgcaaatacttttactgaatcatttattttaataggtatttagtaagaaagagtatagatttatcattgttatcattgcttttgccactggcaaaagggtgataatattgcaagttagtttggaactgtggccctattatttggtgctctaattaattggtttagtgcataatgaagctgaaagacaataaaacagggaaagacaacatatttgaaaattggcatgattgaagctctaggcaaaatgattagaggtgttgtagcttgcataacaaaggtagaaatatttgatgtcttgctgagggttttccctttctaatgttgaaaataaattgctgcttgatttttaagttgtaattttcagtaatttatgtgaaattcttatccagccccttcccacccaactcatatttatatttatatattttatcttagaaaacaaatcatccattacaacagtattacttattgcttactgctccccaccgatcaccataatccattttactatttattgaatgaaataggctttaaaataataaaatctcattcactcggtaagtagctgtgtctattatatactatattaagctctaagtttggcataaggtatagaatgataaatagaaggttaacattgaattactgaatttgaatttcaatgatagaaacagatacataaacagattgtgacaatatagcataatttattctatgatacaaatgtacaagatataggaagaacagaggataagtgattaagtttgtcagaggaagatggaagcaggggaagtataaaaataagttcagaaaggaaatggtgtttgatctgtttctggataaatcaataatatagcccactgtattcatgaattcaattgaccaacaattgacgatatttgaacaaaataaataaataaataagtacataatatcaatacaacattttaaaaatgcattataacatctgtttacttagcatatacattgtattagatattatcactaatctagagatgatttcaagtatagaggacaggccagttacagtggcttacacaggtaatcccagtgctttggaaagcataggtgggaggatcgcttgaggccaagaattcaagaccaacctagaaaacttggtgggactccatctctacaaaagattttttaaaagttatccaggcatggtggcatgcgcctgtatttctagctactttggaggctgaggctggaggattgcttgatcctaggagtttgaggctgtagtgagtaatcattgcaccacggcacttcagcctgggcaacagagcaagatcttgtcttaaaaaataataataaatgaataaagcatatgggaggaagcacattaaactatgaaaacattttgccaacatagcataatgtattactgtgacgtatattgcataatggttataagcaaagcctatgccattttttataagggacttgagcatctgcaaattttagtatggggggaggtgccctgaacaaataatgaggaacaagtgtactttgccagaaaggatgatgggagaagccattttcagcagagacagataagtatgcgcaacctcaaataacaaaaataagagctgcagtgtttttatggaattgcagttagtccaagtgctctggcatcttggactatggacagaaggaagatttaaaagttttgaatttaatcctaaggaaaattgaactgcattctgtaagtactggagaataagagaaggctttaaaaaaaaaggttgggagtatggataagacgtgaattctaaaacttcttaaatggtaataacatggagaagaatgaagatgaatgacactgataccacgaagccagctagacaaggatagaaataatactctgaagacttgactgagaccttaataagtcattgtctattgacaatagaattcccaatgctagggttgttcatagaaaatgcaaacttccaactagttctaacaatgaaataaccacgtgagtttgttagtttttttaagatgacaaaggtaaatggtggaaatattcttagaaatatggaaaatggaatgatgaagaaaatatctttttttcagttggtgtctttaatgtaaatttcaatctttctaacgcttatatttttggtatctatgttacagtctatgtgcaattcaaaaatgtaacacttatctttttctctcattatgaaagtgagagaaagaaatttaattaaaccccttcgttcatgtgatagtaggagccttgttagtttaattgatacttggtcaaggcaatattgatttgataaaagcaaatctatttctaaccccaacaattaaaacatttaaattggctccatcttctttttgatgaaagggcatacaaccattataagcttcccataaaatcaatgaaaaacattaataagtgaataagcatccatttcattgaattccatttgcttcatattctaatgcactaacacattgcagtgtatggattcatctgtgagttccagatattcatggtatccttgtatttctcttctatcacttatgccaaacttagagatctctcttattccctccttgtgctctctctctctttctctatcaagtaaacacacacacacacgcacacacacacacacacacacacacacacacacacacattatacaaaggatcaagtcttgtttgggtgcaagttgaaccaagagcatggtgtccacatgacagaggtatttcttatttagttaaggtatgtggcagtcctcattttaaatcatcactctgctgtttgctagctatttggttttaggcaagttacttaatctttctgagctccattatctcaaccaagagctattttgagattaaaaaatataaaacatataatgtgtttaagacagttcaataaacccagaataaaaagtagctattaaagaaaggtgcctagaagccaatggcttggactggaaagtagaaccaatgagttggagaatttataaaaacaaagccagaaacaagcatatcaacactggccaaaatgatttaaccatttccaaaggttaaattcagtttaatgagattatttttaataaaattgaaaattatgagtaaattagtaaagtaataattataatattagatcatatataaaataaaatataatggaaaattataaaagcattattgaaaaaatactgcaaaaaggtcattattagtccctacattgtttatcatgaaaacaaggaccctgaaaggtgtttattcattgcgttttaggtaaagaagtgagaagtcatagtatctttaatgtgcaagccaaaatgtctggtatggtagtatacataatcagtgaggaataattggatcaacacacatcacatcaaatatatttttgaacaaatatgtgctcaaatgtgtttatttgtccttacaaaaaatatggatatgaaataaaggcttagagtgtagttacataattccttttagagcattcgtctaatgattgtctaattccttttaaaggatgtgtttagaaaggccatggtatttagatgtacctacatttaacccaggtagaatttaaagagaaagccctgctgtgaaaggatagtaatctccaatgaccctaaaatcagagtagagtcttcttccgcaaaatcaatctcttgatgtaagcatttgacctgttttatgctgaagagctggatcacagcaattacaggcttgtatttcctggcagagagacaagcaaggatagatttcctctgttttatgtttgtgttaatttaacctgtcaaagttaatcatcctgtcgaagtgccaaagcaccatgatgttgggtgtggtagagctgcctggtgccttagtcttatttccatctctgctagagactcgttaagtgccctttgttaaatccttttctgtctctcattttctttgtttttaaaatagaaggattaattattatctcctgtgttatatttatgttacattttattactttaggtaatagtttaatgatatatacatgacatatttttatttgttccctgatttttttttttaaatcgtgggggagataaacaaactaataatataaagattgtttaaaaaataatgtactcaaaagagctgacctgtttgtttgttgcttggcatttaacactgaactgcatatagaacataccagtttttattctaaacaggtacgtgattgtaaacaagaaatgatcttgtactatgcgtgtggcaaggcaagtattttttaaacctgttttgtccttactcagagtcaatgtaaggtcttccttcatgtccagagatatcttatattaacaaaagtgttgaccaaacttccactggacacattttttcaatctaggagtctacacaacttgaaatataaatgtactataagataattgaaaatatttcagataagtcatctataatattataaacttacttctagggtaggattattttcataagcattgtgtctcttagaggaaaacaatcccacaagaattagatataaattgcagaatttgattttcataagtgactgttttatattataattgatactatgttattcaatttggtagttgttatgcttttcttctgaaatagcaaacactctacttgggaaaaaatgcagaagaaaaacgtagacttggtaaacatttacatgctatggactagccttacataaaacttgttaggattggtgtgtgtgcccttcttaatctctttatttacttaccagtcgtgtacgtttgtatcctgtgctcattttaaccctactccaccaagcccttaaaaacactgttccatatttttgtgttttatttcatttttaactgacacatagtaattgtacatagttatgagataaaatgttatgctttgaaatgtgtttattgagtaatacatgtattaagtaattttcaaaaccacaatagagtggatatttaaaatagtttttcattagggtatgcattttttatttttccaaattaatctacaccatcttcagtccttctaaataagcaaaacatccctgtcgttatgctataattctaaaaattcatgaataataatttttccagcaccttcttaaccttcttacctctcatcagtggagacctaaccccaaaaccttcgggaacagtatttttggtctataacactactcctttcttccatcagaattgggaatataactttgaatatattatgaatgagtcttttttctcgaatgtttcctaaaatagtctacatatgacctctaccagctctactaaggttcatcttcatttttggagcacaaaatgtttttctattaataaaattttgtgagttaaagtgaaattaataataggcatttagaacagaaactctctgccagccttcctaatattataccgacatgctgtcattcatgtatttgagaagaaataatactaattccaaatccactttgaaacatggtgccaatacagccatggtggctctgttctgtcctacataataattacatctgtgaaacagggactctgcatagaatgcatgtttgtattcaacgtaatggcatgatttggtaaaagtttcctgtgtgttatttagatgaaaatcagggttgttaccaacatactctcctagactaaaagctccatgaagcaaaagaatcatgtctgtcttcatacattacaccttcagagtgtagagctgtgtttggaacatgataaatatttgctagataaatgaatgaatgagtgtacaaactggcataatttacctagttttatagtctccatttgttgtgtaacaaaaataatcttatgttgatataaaattaatttgcacctcaggacataaaaaagttaatttaatcagacttatgaattctgaagtgggagcaattaagtgtgatgtgtaacattaatggaaaatgcatttttttatttaactacttcttttgatgaaaaacacgcacggtaattaaaatagtatattttaatgcatattttattaatgctcatcctggaaactgttagttctacttttcagttgttgtaaaacatctgaaactattttatttatgggatggggaaatacactttgacaaaatttattcatttttagaataaaattatcagtgcaatttagactcaaatcataataacacttgtattatttattgctacataacaaattactccaaaattcatagcctaaagcatcatatatttaccatctcacattttctgtgggttaagagtctgtgaaggactaagtagggtatttctggcaagaggttttccatgcggatgtgatccaggtgttggctggggctgtagtgatccaaaggcttaactagagctgcagaattcacttccaagagaactcacaaaactgtcagcaggtgggctcaggtccttactgactattgataaaagcccttagtcgcttgccacatggatgtttctttagcctagcttgagtgtcctcagtgcttagtagctgccttgcccagactgactgatccaagaaaaaagatagaagcctcaatgtgttttacgacctaccttcggaagtcacactcaagcattttcacgatgttcagcctgttagaagttactaagaaatgcaccacaatcaaatgtaggggaattagtctccactggtaggtgttatattttaaaactatcacaaaatgtattactatctttcagtcaaccctacaaggtttatacataaaaacttattcaattcttactgcaactttatgatataagggttttaattagtcgatttgttcacaagaaaactgagcacagagcacctaagtatctttcccaatgtcacaaaactaactggctgcgtcacattttgtgctcaagcaggttggtccaagaatgtatgcttttaaatattgtcttgtgctgtacctgtacttgtgtttttatattcaatggagatctatttgagtaagcagtcttttttttttttaactgcaaatcataattcactgatgggtcaacatagagttttgctgttaagagcttatagaaagataacaaatgcaaactttttaatctaagaaaaaatagtatttttacaaaattattttagccacagggtcttgctgtgttactcatgccagcctcaaactcctcgaacaatcctcccatcatagtcccctgagtgactgagactacaagtgcacaccaccatgcccagcaaaaataattatttttacttaattatattttacctaaattaagtataattttaattattttcttttctcacatttagatatatcctgttacataacatgggaactatggtgaaatgcacacaatttaaaaattaatctgtaccatgatacttacattaaacaaagtgttaattgtattcaaataaaacacaaacatacaccattccagtgtgaccacaggaagaaacagttcttttggtttccacatacacatttagttttcaatgtattaaaattcaaattaatattagcagaagcataaatataaactagtttatctataccagtccctatattgactttaaaaaacttataacatttaaagaaaatactccttataaaattttgtattcaaatcgaattaagaactttacattgagagagtgaagtataagttacatttctaacagagacactgaaagcctgtctaaacaatttttaatttatacaatacaaataacaatgattgtgtcatggggatgtccttggctttacagcttagagtgtcacggaaagaaaaatgagtaaggaaaaccactaattagatacgtaaatcctagagttatgaggcgagcggtctaaatgggaaaaagccaaaaacagaagggacatatgcaccaattcttgtttggagctcgggaagcctatattgcccatgtgattttactctctaatctcattcatgtacattaacgtcaacagaaaagaggaaacaaacttaattttatttaacatcttctagactattctcaacacaaaatgtcagttcacttaaacaaaatgttaaatgtcgttcaatactaggtccgcttctctagtgtatcccaacgggaggagtcagctttatttgtacagaaccatttttcttaggaaatgaaaagtactgatttatccttcttcctggtgtttgtctctctcttgcttctactttagtgaaagccgatcggaatgagaaaagaaattttgccctttcctagctaagatgtcacacgttcatgctgtaaaaatatattgttcccaaatctctgtatctcggctggtttgaaaatatattttgataccttttttcttgaagaaatttgggataattgagaaatttctgatttgttttgtatattatgtcattcgttgtaatttatggacatgattgaatttaataactaacataaagatcttaataaaaattagattccataaaaatctgattatacttatgattttttttttgaatagtcaaatcatcttcaaagcctacaagatataaaaatattttctgttttttatcagttttgtcattgactactaaaaaaatacattgcttcttaggaacttttagggaagaaaaagatattacctttcagaactgatcctctacacctgtgttgaccactagccacaagtagcctttcacatttacatttaaactaattaaaattaaataaaattagagatgtagtttcttagtaacactaaccatacttcaagtgctcagtagccacacgtagctagtggctaacatattagactgtgcagatatgtcaaacatttccatcatcacagaatgttccattttgcagtgctatttcatcaatttatacctggggcttaatagtttaggagcagtaagcttattatatttgctttgtgctattactttctcttgtttaagatccctaatttgaatctatgatatcgtggtgacagaagctaatctcaaacaggctaaatttttttgacttgtctgaaatatgtgttaacattctaaaatatttaattactctttttgtttttaacagagcattgtaccagtgttcagagatactaaaaatctggcttgctttaaaattttttgagaagctgttttttaagtacaacaaacctcaggctgatatcattcagtacattgtaaatgtgtacaatatagtgtttgatatataattagtatcttttgtattaattcaaatgttatggaaatataattaactgtgatttactttttatgctttcataacagtgaggtagcaatcctcatcttgagattagtatatcaataaaaactactatatatatatgaatacctctactatatatatatatgaatgcttcttatagtttgtgtgtgtttgtgtgttctaattccagctctgacacttcgtagctttgagacctaaaaaaagttaatctttctaaacctcattttccacattagtaaatggagaaaatactgcctcccagatgctgtaagaaaatgtctttcaaaaactgattacaatgctgccagtgctcagtaaatgctgtgtatagtaattaatattattaattaccagtagttgtagtatcacaataacttaaaaataaattacaacacatcaaaatagtattgatagtttataatttgaaagtacaaaataatgcaagtatccagggttttatatatttctgtatttaagacataacttggacatgaatatatatctataaatgtgtgtatatgccatagttaattataaaatatttacttatatataatgaataaaaaagtttttaagacccctagcctcatgaaatgctgcctcctctattgacttcattgacaagccaagttcattgatatataaaaaaaaactcaatcaacaaacacatcttttttcatcttagtgcttgctatcctttttgtccttgtctcctttctttaaatatatttccactccctaaagtagtcttttctgtgtggttaaaacacagaaaaatgtaagtaaaattatgattttgcttaccttttatactataattaaattatatatgttcatattttatctttctacctatgcagtgcttagaataatgctctgctgataaaacatgcctaataaatgctttttgaatggataaacctaccaatgaagtgattatacttgttaggtctttctccaacaaaacatctcaaaactcattaacttaaaataataaccatttattattgttaatgacttcacaggtcagcgggattcctcatgaatctgtgagcagttttgtgagtagggtgtatatatttgctcgtcttggcagagctctctcacatgacttgggctttgactggggaaactaagtgtattcaactgtgaccatatagtctgtcatcactcagcaggttagaatgtggttggatttatggcaaatgagcaaggaactaagatataaagtgcaagtgtgcaaagccccttgaggtttagtctcagactggcatgatatcatgctgcattacatttgaccaaaaaagttacaaggcctatccttttgatgggagatgctgcaaaaccacattgaaagaacatggatacagaaagagaaataattgaagccatatttgaacaaaaaaaaaatctaccacaggcagatcttctctatactcttctctgccccactcttttcctagaaagcccaacttataaattccagtgagggaatcctttgatcccctggggagttacaaaaaaactgctctcacaagttcttcaatattcccctgatttaacttttctcaattatctcattgggtgtgctgtctctttgattctgaaactctgagtgatacaggtataagatggatcttgcttcaaagttaaaacatttgtcgcattcagttgaaatgtctttactttagaaattaacattttgtcaaaaagcaaaacatgcccagatttttaaatatttattttgattccccaagtcatgaacgcagaaaaacaggtaacaaaacatatttatgttctgaaataataaaacatttaataattaaataatcaatgaatacttaaaactacacctcactaatttgaatttcgaatagcatctgtatctttcctgtaattttttaaaatttaatttattgagttcagatcccagcttcactcttgctttgtgatcactgggcaaactacttttctcatctataaagtggaaataataaaacaatttaccttataaagttatgagaaatatattaaatataaattgttaagaagaatgtcttagaaattttaactgcttaataaataatatctattagtgtaccaatagaaacaggaattgtagtagtggtaaaaaaagtaccttctgaaaatttttatttgagtgtatttttttatacaaactatatatatgtatacaaatatatacacacttttcacaaatattatttaagggctactatttctatcaagttttatgtcataatttagtcattctatcactgtgaaatattttaagtatttctaattttctcctataaagaagtagttctaaaatcaagatatttgcacataatacttttataattaggattattgcaaaagaagagtcaaaaggctgcaattattaggatatgtgatataaactttaaaaaacaactctactcatttatttctattacttccatttgcctgtttaaaccgttattactaaagtaagaagggcctcattttctaaagcaacatacatatcattttgaaaatctttgctaatcatatacatagaagaatatgctttgtgttgtgctaggtgctgagggagttgatttgaattagaagcaatacaggtacccaggagaagtttcattttttaaaattttaagccagacattcttccatatatttattaaccagttggtttttctctagtctgtcatcactgtttacatcattagcctctttatgtactgctccccagcagttgaatactaataatctagcttcatatcatttctcagtttgatgtctttatatagtcatttcctagacttccatgtgactctacccttggcaactcatgcactcacaccattgagactcactgaacctgaaatggcccttttagaagccttgctctctttgtcattaccagactgctatgtaaagaccagtgacagcttgttgttttatttcttgaattgtgctgacaacattgtttttttctgggacattgtgtttgtagttcatggcaagaagagacgtgtttctttttttatcctctcatttcaaatatgtaccatttttgctatttgcagtactgaactatatttataactcctctagtcaaagaggaaatcctgttgtataactcaaagaaagtttggcttctttgatttgtattttaaatataggttcctgaaaaacaacatgtattatagtgacttagtgtattttaaaaaatggagccattttaagaactacgatagataaaaagcgaaaagttgactagtgtcttctacagaagtatttgtaaaaccaagacagggtttacaaaattccctggatcacgacacaacaatgcagaactgggtaaatctaacattgatttacaaagagaggaagttctgattattgaggtcaatttttcatagacaggtatagactggagcacgggtttcaaatacaaaataattcacgtaagttgtttttacacaaagaaagcaaagcctgtttccgactcaggaatctagttgacttcattattaacaaactgatattcaggagccttttttcctcacacagtgtcagtgtttcctttagcaaaacgagaatctgttgtaacatggaaatgcttggaaggtctggggtgtacttgaatataatatttattatgtgcttactatgtgctaacagtgggctaggctttcacttgctgtattttattcacaagaaccctgtgaataactggtaagtttaacagatgtagtcatgaggatggagatgagtaaatatcactctaaaatcattgaatataaaattcaagtttgtcctttttcagaattcaagttttttctcactgaagcacatttcctaaaaaataagataatttagaaaaatttaatagattttcataaaaaaccatttcaaaattttttgtacttgagattaagtttggtataaaataatagagatgctgattatgatgatgatagtgattatgaggatgatgataaggagctaaaatattgaatgcctgatctttcataggcactttaatatatgctttatgtatgtttattttggaagagtcatatcacaaaagcattgctatccgcactttaccaagctgaggcaacaagagcttatatacctcatccaaggtcatctaactagtaaatatctcagatgaaattaagaagtaggacatcttcactcatgaccattaattagtataattttatgtagtaatctgtattaaatatacattattcaaatgtatctgaaaagcacatcccacagcacaaagcactttcactagttctacaacattcttggtagtagatcaatgagtcctgtcaatatagtggaccgttccattgtgacctggattccattcctaaacttgcctcagacctttcaaagaaaaatcagggccttaggtataatgtcaagtgaaaatattgacatattataatgaagaatccaggggattaaacaccactataaaaacatatactttgcgaagtactctatccttgccactctaacagtcaaccatttggtgttttgttatttcaatatttccactgaatacatttcggttatatttaatctttctgtcaaacctattggactcactgcctcctccttcgtattcttcaactaggtgtttctattgttactgaactctgaagtggaagctacaccaaaatacatatgtgtctcaactagtgaacctcagtttgctggttggctaagacactttcttttcattagaaacttaggttgctagaaatatttcactcttatccaccagagaaaaaacagttgaaacttgctatgctgcactgaattctaagacagactaatcaatctaattccatctaaacctatttaccctgtccaggagatctgctaatgaggaatgccagtaactcctagttcctgacactgctttccaaaagtgagttaatgaaccagtttaaagggacatgcttgacatttgcaaattagtttaactggcttgttggggcagctttgaactgcattggactgatatggttgtcattaaaccattccatcatgtagtatttttatacttcagtaaactttaaaagataccttaataattgaataagtccgtgttatctagtattttttacattgcttgattatgatgctgaagttcagaattttaaaaatgctttttcttcaatctccacgataatattgtgcaattttgtgaggatgccaatcaaaagtaacgcagcttttgcacaaaagtgtgtattatcagtaattacaggtggctcggtgctttcacctgaaagcacagagggtgggtttggtgttttaaatgtctgcgtcatggggaaagagggggagacacaatctgaggtttctaggcaacaaagcataatatatctgttctttacaatcgactcagaaaaagaaaaaaaatcaggatatttttaaaggtaatatagttttctttaattataagagaaatagtttaatttggaaatagggtatatttacaaaggaattgattcatccatttatgaaatgtatttatatacctactttattttaggttctgagctgaacactgacaatataaatacaaaagaaaaaatactatatattttttctcatggggcttaaattgggatgaagaagatgtaccctccaaaacaaaggaataaatggaattttgcaaaatttaacacatatgaaataaatcaaaagcaattgatgaaagctatgagaaataaatgagggctttttctatctaaattagaatggtgttttaatatcatcaaaatcgtttagacaaaggatcacaggtgacatgattttgagcctacctaaggtggaatgccaaaaccaaacctcaaataaagttatgaaactgaaaaaggtacacattcaatgaaaggtttgactagaaaaaaattcaattgccagcaagaaaaacaatatggaaacatatctgtttacctgggttctaggttaaaaaaaaaaatgaacaaaccaaaatctccaccctgaaattttatagctatagacccaatctctgatggctttgaggatctctgttttatacagtatacagtattatttatgctctctggaggaatgtattctcaatccaagccccaaagacttttcatatatatgaaccagtaataagccagttgcaagtacataatctaaagttaataataatcttttgaaagtaccaggacttaatggactattcatgaagtcagcagaaataacatatgaatgaattatgtcaccaagttattaataattattagttaatagttaatagttaattatattgaatatatttacagttatatataacaacatcaaggaatcaaggaaataaaaagagacttgcagattaaaaaaaatcacataaaatttctagtaaatcacaaaaatttaaaaatcagtgcatggattgatcaatagattaacaaccaaggattacaattactaaacctgaagataaatttgaagatattaatcagaataagcatagataacaagaaaatgtcaaagacaggttactgaatagaattaaaagatctgattaaggattcagacaggacaaagagaaagcaaagagaggggaatagaatgatcagagtttttatttaatatgtttgtggctagaaattatccacaaagataaaaggaattttcagattcagaaagcagaaaccccaagccagaataacaaaaagaaatcctcatataaataccatgaaacaaaactgccagatctagagtgaggcaagtgagatattcaagggctcaaaatgtaaaaaggcaatttctgtaacactgatgtaagtgcaaaatcagctaagagtgagtgcttcctcacctatgtccagagcatcttatccatagctcaggtggttctcactcacaggtttctgcctgaccctgcttgtgcaacacctgggaataagtgcatccttaaatatttctccctgggtcctgactgactcacctgctttcatttatgaaactcacggtctttataacttctatgtcatcattagctttattgcatctttaccagtagtttccctcttcttttgctgggttgtttactttatttcaatatataatcatattttattaagatattgaattttcttctgagtacagtttatatgttttgttgactaatatttttattagaactattttgaagtgttttattattaaaatgtttttacttcacttattcataaaatgtttagagtgtttccaggaaatgattaaagattgaaggattttcttgcactggtcatttaaagtaggacgttggagcctctgggcttggatttccagtttataatcagaattttcggaagtagaagcttctacttttatcaagctataagtagtctatctgtgctccaccaaatgttttgtttgtttttttgttttgttttactgtgtatgaaactacacaagaatgattctgagaaaaacaggtccccgttggtattgtctgctctggtgtttataaccggaaaattttattcacgatctgaaaaaaatgtgcataaactcagtacaatttttcctacaataagagagattgtctcgccttaagtgttgaaaacaaacaagaacataaacatccactaagcaagttaatatgtgtataatacaaatatggacaataagctattatgacagagaaaaagaaatagataatagcattgtggggccatgctgagtactacggtaaggttcactcagaagacaagatgatatctgagttgagacgtaaaaattcacaagaacaaccaaaaagggaataacatttttccatgtatgatgagggaaatgtgagctgctaggtatggattgatattccaagtaaaggaaatcttgagcaaaagagtagaggtgagagagcgtgcactggttagagagaagtaaagaaatgaagattatggtaaaattcaaggataatgggaaatgcacattcatattatgtctaacaatttttaaagtgacattcttatctgttgaaagccaacattaaatcctcgaataaatctggggcggtcttttggaaagcaaacacagaaaagttaccactgactgttgtgtggctaatgatttcagctgctagtaaagtaaactctaagtaacagtaacttaaacaggaaagcgttacttttccctcaacaaaggaaacccctacttagattcctgctggtattccttcagctcacagtaatgtcagacctgggagtcagcatctgtggaattatcaggggcctttccccaatggccattagatggctatagtcttgggcatgacatccccaatcaaatggaagaaaggctcatttttttttcctaaaatgtaggagctaaaataaagcctcctacaattcaacagacgtatcatatctcatttgccagaaagatgtcatgtggctaattcaaattcaagatatcctggggaaagagggcaagaagagcatgttggaaatagtccattggtcctttgattagtcaacgtaaaatgtttgccagaaccaccttctctgagttctcatgctgtgaccactacctctgggaagaatgactcttactctctcagtcctttctttaaagtatttacaaatggtttaatcaattattgtatcaatatattacctttgaaaagaaaagaaaggtttacacttctgaaaaattttagctaaaaatttagcactttttcgctaaaaattttagctaaaaatctatggtactcttcgtcagtgttgtttctctctgtctcacacacacatgcacatgtgcacacacacatgcacacacatgtgcttttgttttccccatctacgtatctagtttttgttaagagttgtaggaaaaagatctgaatagttttagaaagaaaacagaaaaaaagagaatcattcagtccacttttattttgtcaagcctaaattaaatgcctcaaggaatatatgacatagtgatacttgatgataaaaattctatttggtgcatagcattgtattacaaagaccagttgtttgctagtttgtaacgagcactgtgctaagcagggaaactattacacacttggaattgctgtaggaaacaaaatgtgatcatataaaaaaaagagtagctttgctttttagaaatgtccaattgccataggagaaaaatgagtgaatttagattcaactgtattggaatgaagggaataggaaaggatattaaactttggaagtgattactaagaaatcttataaaagggttaactgataccattgtctagaatggtttaaagaagcatgcctcatacgagcagtacattaaccttgcaagactgctttggacatatgtattaaaaacatatgcatctgatcttcaaagtaaactttagcgtggtaacaaggttgctgaagtcacataactagtgtaaatcaatgtatctatgtactagcaattgactctatacacattccaagatttaaagtgaattatggttctcttatcaaataatctcctaggctttgtcagtggagtgcttaacaccaggctagtctcatactagaggtgtaattgtttttggaatttattggaaattgagttcctttaaaattctagaacaatagtctctacaaacaaacataatggaatttaaacacacacacgtacacacatgcacacaaatgcacacatgacatgttatgggatatattttaacagttttagagttctgtcttgagaaatgtttattttaaattatatatcaagaaattattcaacactttttctgttatgctaattaaatctatagtaccaggtctgtggctccaacggtgacttgttttcttatttaccttgtaaattttcttatttaccttacctgtgacatattttcttatttaccttgtttaccagtggtctatttaggaccttaggaactcagctttcctttgataattatttcttggaagaactgtttaccccagagatgagtggtgtgtgtgtgtgtgtgtgtgtgtgtgtgtgtgtgtgtgtgtgtgtgtgtgtgtgtgtgtggtgtgtgtatgatattatgactaaggatattggcctagtaagttatagttagttgtttaaatgctagtcttccctaaaagactgagctgatgtcagctcttcataaaacatggataatggctacatttccagctacttttattttactttgaacccatgctgctggatagtagataaataggtggataaagatatagatatcatataggaaagaatgagcatttcttggaattgaagatgaccttctacttgccttgcttttggttaattgtttttcataaattcatcgttaaaaatatatcggacactttttgcttggattgctatatatgaatttctgtttattttatttttaaaattttttataaaatgtaaaatttttgtagttactttggaaaatctagatagtgataataaggaaaatacaaatgtgaatgtgtggtttcccctgtcacccctagccttccaggtaggcacctagtgagttctcagatttctactctggactcagatgtggcagataaatgagtttattttctttaactaacataatttgttattgcacgtctactgtactaagggaaagatctattggaattaaaacctgccaattaatttattttacttcctttagtgttaaaaatctccatttagaagcaattttattgagtaaataatgatactcctagggtttttctttttctgactccactccttccatcagccacgggtatctggatacagcaggaatcctgtgagatttcatgaggagggaacattgattcatatttgaatgtgtgcccttgttttgatgtctactaaagtagggtgctgttttttaaaatggaagattcagtaaagaagtccttgctcattaaacaagatttaaataagcagaggatacaaggaggagaagaacattcaagttaaagaaaaaaaaaaaaagaaatgaagattcctttgtattgtgctctagtagagaactagaatgtaaacaatagcagtagtcagcaaggatgatatgccacagaaggaagctgtcgatacacagaggagttcatagtaatgaaaaatgcatatgaaaagcagagaaaggccaggcacggtggctcatgcctgtaatcccagcactttgggaggccaatgcaggcagatcacctgagttcaggacttcgagaccagcctggccaacatggtgaaatctcgtttctactaaaaatacaaaaattagccaggtgtggtggtgggcacctgtaatccgagctatttgagaggctgagacaggagaatcccttgaacccaggaggcagaggttgtagcgaggtgagattgcgccactgcactccagcctgagcgacagagcaagactccatctggagaaaaaaaaaaaaaaaaaaagcagagaaaattgggtaacagagtcttcatatttttccatttactttcaatattatttctatttctttctgctttctattgttactatctgaaagaagcagatttggcaaaaatcttctgttgttatacaaaaagatgggagaggtacccgctctgtttcagttatcatcccctaaatatgtgttacacacacaactttgtcctgcactcaacctactacttggccctattattcagattgctgttatcccgtttccaactcatctaacatcctgagctgctaaggaagtaaaacctacagaaatagaaatgctgggagtgaggtaaaacctgcttcagcatgattttgaacttgacaaacagctgttcacatcagagttgtcttatattccaagatggataaggagaacgtgaagaacatattagttatggacttagtaggagacttaatgttaaaaatggtatttaaataagtctagttatttaagaaatcatttaaactcattaacacataggccatcaatgatgtctaaatccttaaaattttaggtcagtagatatcaaatataataacaaaagaagcctaatgtttacaaacctttgctacaagaatactttcttgtttcctggagctaaatggaataatccataaaaataaaaattgtttcacagtacatctggatttatagattcaagcaaacaaaataagcctttttagcataaaatacaaaaagaaactttataatgtaagaaaaggtttaaactaaattctctgaagtaaaaatatgttactactcttgaacaatttaaaaatataccacattttaaaaacttgcaaatcctaactaagctatattattttaacagttttctaaaacctgtactaaggttgttatcctctgaatttggaatatgtcaaacataactctttcaacaatacctttaaaattctgaagaaattgtgtatgcattgcctggaaagtgaagttttggggaaacatgataactgcctttcaatatttaaaaggctgtcatgtggaaaagacagcaaggtgacaagtgctctttcattggaaacatttaaagcagaagctatgtaaaaactcagaatactgtaagtagagcacttaggtggttgaacttgttgacattcatatttcatttcattttatcctttcaattaggaaatacattttatttaatgaagctgaaatagtattattatgtgttttcctggacattgaccagaagaggtgaagatgcctccttgagattttaaaagcatgttttaggaagttagaaaaattaatgtagctttatctggaaaaaaatagtgcctttcagattaatttctacttataagactgtctcctattattcaaacatccttctctctcattattcacaaagaccaacagcttacaggcagggaagttaagaaattgccatccttaaagctattgcttatccaaattatactgtcccaataatcttttcctactacaagtggattatatgagaatatagaggatcaaaacattataatatgattcagtttctatgaattactatgaggaatttagtagttgacactcatcatagtgaatagataatattgtcgtgtgtttctctgttatgcatacgattaggagccaatgaaaatgtaactctacaatagtatataaggacattaatactttttcaaaaaaaagtattctaatatgactaactcatgtctctctaacatctaaagtaaaataattataagttagaaggaggaggaaaagaagggggaggatgtggaggaataaaggagaagaggaaagaagataaatgaaaaaagaaggaaaaagaggaataggagtaggaggattgttgttccaattgcgacaatcaaatgctcttctcgtttaattccacattctcaaggacccttatcctcctcttcactttggtatgttcagtgtttttgtcagcactgtgctgcagatgtctatgcttacatggaaaaatgaacaagaaaaaatctgttttctttgtatttttccttgctgacatccatgcataagcaaaaatgtgtataagcaaatgagccaaatgattatgggtaattagcttgtggaatatatgaaagcaaattgtttgctatatataagcagggttttttttttacaagattatattatcattaaagcatatctggagttagccaattaggacactcactgaaatttagccaattagaagtcaactctgtgagcatgtctgcaagaagttttctagaatgttccaatggttctctggttttgaaaatgatgtaattttattgggatgttagtctactgatattaaaagaatgtagtaatttaatctcttgtaaatgatcatctttagattatgctctcatcacagtatttgatatcatcttgagctgtccaatgatgtaattgatcttagtgttattgtgtgtcaatttcaagatacataatttgcttcagtgtcatttatcacactttttaatcaccatggatgatgactacagctttaatgtagttctgtttttgattagtgtaatgtcatttctgagtttcattctctacaaaggaatagaagaattgtgtctctatgcctgtcaagtctcacacttaacatgaaaactaaattcacttcaaaggctctatgaaaacaaatttcattacagcacccttgcttaaataaaatgaactattattttgaaaaattacttataataaatatccttaagtgggtaatttaaaaagctaatacatctgggtcagtgtttcactagtttgtgagtatactcatccttatctataatctctgcagtatagaagcatctttactgggacttgggacttggctgtgtatttggttcctagatcctcacagagctatcataaaagagtagcatgtgaacaatcagatctagatttccttcccagttccactgtttactacagttttttcttaaagatttattttccgattctcaattccttgtctctataatatagataataaacacttagagttagtttttcagagttactatgatgtgataatacataagaaagcacctaacatattgtctggactaataaagattcattatgctattatcttccttcctctgcaactgtaccagatatttctttgtcgttacttatggttcattaatttttgtatctttattttttattgaagccatttaaatagtcacaaaacatattaattaggagggactaggcatagactgtttggctagaaaataagtagtctcttatattttaatattctcaggtcatctcaaatggaagatcacattactgggagatcagagtgtatacattgctattaatagttacctacttaatatcctttctctctcttcactggcaaattttattcacttagatgggcaccaatacactcaactaaaatatgtgatttttcctttcttattgtctctgatgtttgaaatattcttgtcaccttttatgtattcaatctactccaaattatgaccattctactttgatcatcatccctgtagagcttctacctccttttccagagcagcttttaatctttcagacccattttttatctcctgacatatgcttctcaaatgttcaaggacatttctcgacaagtgttgatcattgtaaaatatttatttttatattttacctggctatgaatgatttcatggaactagactttgaaatgaatgtgttttctcatcattaaatttggtaacacttagcaagactatgaatgggatagctctttttctacagtcatcttggcttaacatctaatgtgtttgcatatgcatgattatagtctcctcgtgaacttacattactaagtacttttaaaatacaaatgcttctctaataatcatattgataatattcctttttttaaattgtataaagacattctgctacatctgaagttattaaaaatgaactctgaatatttttaatacctccagaacactgtccttcttatttaaaattataacccccccaaaataaaataaacttaggacccttatatactgaatgcttattgagcgcttgccactttatttagttcatgtaaccctcacaaaattgaagaagaaattggtgttgtccttgtttaaaagtagaagatatggaagcttgcatagagacattttgtaaatagcagaaattgaatgcaaatacttgtgcttgtaattttaaaggagctgattatgattattctgtttgattactatttatattcatatatgaccagaaaaaaagccacacacctccaggaattcttaaaggtcccacaaaattgagtaaacacaagtactcaccaaagtgatttaaggctactagaaattttctgtgggcagcctcatcagagttctctgcaggtaacatagacagaggtggtgtttcatttttcattctacatttactacagaaagaggtatttacattattcctttgttagagctgaagatcaggtagggaagaagtgcattacttttctagcaactggcaatttattttatgtaagatataatgagactacatttccaaaatgattaccaagtatattcccaatcaatggaattgaaaggtacatcatcagtaagctttcagagtccatcttttgtatactacgaagattcttgttatatttcatatttaatttccatgtttaactgcttcttccagtaatcactgatgaaatgtcggtttggtgaaagtttctaacttttgctggtttcattaaagttatgctttaacttactttgataattatatatcatgtttatatgacactattgttatagcataactgtactgtacttgatattctatctaatatactctatgatgtgttagaatacattaataggcccctgcctaacaacaggtatgtgctgctaaacacagtgctgtgtccaaatgtaaaactaattcatgactaaggaacattgtaaaaataacaggcatgaaaaataatgggattctctaatttatttaacaagtgtaataatcatactataaaaatgtgagagactattttgttaaaatgaaaacattttctagtgaggccatatttggataaatacactgcacagattaatgtttctgtttctcactttcttcatttgtcttaataaaggatttaagaaagaagttttcaaaggcaacttcttacttaatattttatcaaggatggtatttttgcaaaaatagggtcactcatatctttattacactggaataacaacactggtagataaacataatattaaatggccaataaattgtttaaaacagcatttgctatgctgtgtcttataggagttgtcttttctaactacctttggcccagttattttacgttttagttagaaataaatttctgattttatttctaaaaaatgtgctttctacagacatgaatctacaaaaaacatgaaaaatatgatttgttaaaataaatgtgacattaaaataaaagtgtacgattatataacttatagctatacatcgtataatgtgtggttatctcagaaaagtgaatactttgttctttagttaataagaaaaagaatttagctgttctaccagaaagttcctacaacagaaaagatctgttttgaatgtaataaatgagcctgtagctaagaaatgcatgttgactgagcttagtggattcacactgagtctaacaacgccttttattgataatcttccaccatctgctctgaagatatattcatacaaagaaaaaaaagcaggtgagaagaaagaatgcaaataagtggcaatacttaaaatttgaatcatgctgtgattttgcaaactggattgatgctactgttgcttttaaaaacattacaatatttgatgtaacaaagttgatggttaacttccactttcggtccatttgcttacatgagcaggaaagtgctcccagaaatgtccgattcataaatttaaatgattggtagaaacagtactaatgtaatttacattttgtatagggatagcactttcattctggcaaaaataaaagaataatgtatatattgatggtcctctcaatagaattgaaaaggcctttgactaggtataaatagaaaatatatatatataaaagcttacaaagttaaaaaaaaaacacataaaaaacttccacattaatagtcccttgaaaggtagggaatcactgaaaggtaaaaatatggtaggtcaaagtaatactaaatctggggatgtaaaaagaaagactttccagtgaaatcaaaggaaagaccacttatgtgtaagaaaatagaggaaaggacgatttgctgttttcagttccaatttgaaaatttctttctcttgtcgaattgctctggctaggacttccagtactatgctgaataaatgtggtgaaagtgggcatccttgtcttgttccaaatcttagaggaaagggtccagtccttccttcccacctactttcctgctcacttaatccccactgagtgtgtgtctggagagtcaagcaaaactctttttaaattttatttttttattttttaaagagaggacagacatttgaaacattttctccaagtttccataaaaagcactttatgaaacaatctaggcttaccagccttgacattccccagctctctggacttaatcacaaagggagatgaggccaagccttgggaggtagagtagaagaaagtataggactcctttgatgccatctacacacattaaatggaccagccacttctctacattgggcctttatcttttaactattaaagcataaggttattcatgtataaggctggctgcaaaatccttcacaaatgaaagtataccctgtaagtgcacttaataggcccccctttaatttctattgttcatagtggcataaacaagggttttcaccattcaataagaagttaactgtgggtttgtcatatatgacctgtattgagatatgtgccttatatacccagttggttaagactttttttattatgaagagatgttgaatgttattgaatgcctttggggcatctgtggaaatgatcatacgatttttatccttgattctgttaatgtgatgtttcacattatctcacaatgtatgtatgtaaaacctatcttgcatccctgggatgaatcccagttggtcatggtgaatgatctttttaacatgttgctgaattcacttttatagtattttgttgagaatttttgcatctatcttcgtcagggatattggcctgcagttttctttttttgttgtgcctttgtctggttctggtagcagggtaccttgtagaatgagtttggaagtattcctcttcaattgtattggaacagtttgagtatacgtggtattagttctactttaaatgtttggtagaatttagcaatacagccactgggtcctaggcttttctttgatgggagaacttttattactacttgtatctcattgttcattatagtctgttcaagttttctattttgtcatggtttaatatttgaaggttgtatatgttcacaaatttaaccatttattctaggctttccatttttttggtgtacggttgttcataatagtctctaatgactttttgtgtttttctggtaccaggtgtaatgtcttatttttaactctgattttatttatttgggtcttcttcctttttgtcttagtctagctaaaggtttgtaaattttccttatctttaaaaaaccaactttttattcattgatcttttgtaatttttaagttttctgttttacttatttctgttcttacctttctcatttctttccttctactaattttgaatttggcatgttattgctttttttttagttttttgatgagcattgttaggctgtttatttgaagtctttttttatactgtaagcatttactgctataaactttcttcatagtactgcttttgttgtatcccatagatttgggaatgttgtgttttcattttttccaagactctttaaaatgttattcctaattttttaaattaattcattggttgtacaggagcatgttgtttaattttcatatatttagtggttccaaagtttctcttgtttgtgcccttgtttgcaaacgtgaccttctacttacaaaatctaaagacaccaccaaataattgttagaaccaataaataaaattagtgaaggtgcagtatactaactcagtgtaaatagctcattagcatttctatgtgccagcagcaaacaatttgaaaaagaaattaggaaagcaatcccatttacaatgagtatgaaaaatacattacctaggaataaattaaaccaaagtaatggaagatctctataataaaaccagtaatatactgatcacagaattttaaaaagaacacacaaaataatggaaagatatcccatgttcatggattggatgaagtaatattgttataaatttcatattaccttaaaaaaatctacagatccagtgcaatccctgtggatgttactgtttacaaaactgtaaacatggctatatttctccattatctgcaatgctgcgattttggttactctgccaatgagaacagatggaggtggaatgaggatactccttatttagagcatcacagacaccactgtcgacgacgttcagtagtttctcttgggcagttttcagctatttttgtggctttaactgattggcagaattctgaagttgcttttttcccctcacatgtccactcttttatggaaataataaatacactgagttggccaggttttcacttacatgagattgtgaccgtaacttagggccttagcaccactctcagttaccatcattttgggtttccagtctcagaatgtcattcatagtttacggtgtcctcatggtcacacatttctttcagctgctgtcattccagttgaagagagaccatttgactttctagagatggctgcacgcaaacatttaaaacctttgagagaatacagtgcaccagggaaatgaccaagagtttagagtatgctccttatccaggattcccataaaccgaaccaccaaaaaacaaataggttaaagaatgagctagctgaagtgtctactcacttgactaagtagtattttcattaatcccctacaactgaaatattgtaatctacatttgatgtatttctctataagccacaagtatcaatagctgcacaggtacttttctgtttagccaattctattatttagcataacttttacaagagaatttaaagtctgttgtgtaatgatagcctttaaagtagaatttgctgtagaacctattatgagtgagacatttctgaatattgccacttttattctaaaccatggaaaaagagcctaacaaatgatgtccttctagaagactgaaggcctcctggcaatgttctctttaatccaggatgtgggttaagagttttgactgattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccaggaagcagagcttgcagtgagccgagattgcgccactgcagtccgcagtctggcctgggcgacagagcgagactccgtctcaaaaaaaaaaaaaaaaaaaaaaagagttttgactgattatgaggcaacgtacgtactactaaagtttctcacctacattgggcctttatcttttatctattaaagcataaggttattcatttataaggctggctgcaaaattcttcacaaatgaaagtataccctataagtgcacttaataggcccccttttaatttctattgttcatagtggcataaacaaggaaaaaatattcaaagataagagtctcgtgagagtagaagccttgatctgtgatcttgggaaaagttgttcacatcaaggatgtcatctttttctggggagaagctttcctggttagttttaccttaagggttccgatgggtgtacagttccaggagtatggaggcacccttctcagctgtgagattataaacccaaggttcaaagctaacaaattttgctgtagtgtgaatggcagagatagtctttctctgatgttctcagaagatccaatcttcaggttctagattgtgaagagattatcctcagtaagccataaaaaagctttctttacctggtgaaaatacactgtagcataataatctacttttataataccagctctcttgcatggaaaagctgttatacaaccaaaaagcatgcactgcaaatgacaattgaataaaatctctttataaatatttaaatggctcatcaggtagccaaatgtacctgaagctttgattgtcttcccaggaatatggaaccaaacattggttttagggtggagcccttggaaaaacagggccaggaaagtggtttctggtgcctcctgtttttcccagggagtccaggctattagagcttgaatatccacttttaattaagctggtttttaaccatagtactctttaatgaagtccttttaaaatttcttattacccgattttagccaggccaaaaagccaatatttctggcttttgaattttaccaaaggtaacctcccaggtgcccagagaaaggaaaatttaagatagtgaatggaggagagactagacaaggttatgcagatattaaaccaagaagggcttacttcctaggtggggaattgaaccatcagtgtgaaaggccaaagtcttagctactgagctatagcacagggcagtctctattgtccttcccagaaggagtctagagtagttaaatttgaacttgcaaacgcttttaactactcaagataatttttagagctaactatgacataaaccctaacatttctgttccctggcaggtgaagactaatagaaaatactgccacatggttacaaggtcaagctcccaaggacataaaacaagagggaggaaggcaaaatgatcagggaagccagagaaagacccatccattgaagcgacactgaaaagttcaggtagctgcttctcagtagcaaaggggtctttcccagcagtcccatcatctctcaagtttccccttttagggaggaaaaggctccccatggtcagcgatcctgtacatccctaatcctgtcacccacagccatcagcacagagtgcaaggcagattaatccaaagagaagagcagatgacatgctgtagtgccaaacccattcttggccaagagggacttttaccaagagccctcatttttaaaatgtacttcaatggattgttgttcacttggaacattccactgtaagttatcattagtaagtttttgccatttctgtaagacttcactgccttccgggcctaatgaataaaccagaaggaactcagttttctagaaactaaggatcccatttttacctaaaatactggcttcgatctcaggttctcttgattaacctggccaatgatttttcatacctcagcatgcaagaaaaatgaaacaaaggggtaaaacacaaaaatccctgggaattttcaaaagacaaattttataacccctgcaatattagcgcttactaccagtttctttctctcccagtcagatgtaagaggtctctaactggatccaagccagttcattcctgtatcaaatccattcctggacccagtgcagtttctgttgcgactccaaacccagtttggatcagaaatttgctcaaagaaactcggagaactcaaaacacaaatccgtggagctcagaaatctgagagggagcttatccatgatctccagctgctctgagagattaaaggacccaagtgggccctgtaggtaccttgcgtgttcactcagtgctcctaggggtcgctagaagctccacttctggtaccatctgataaaagaaaaacttcagaattaatttaaaggagtttaattgagcaatgaatgattcgcgaattgggcagcccccagaatcacagcagattcacagagactccaggggtgcctcgtggtcagaacaaatttatagacaaaaaaggtaaaatgacatacaggaataggaagtgaggtacagaaatagcgagactgattacagcttggcttttgccttatttgaacgcagtttaaacattctgcagtctgtgagtggttgaagtatggccactgggattggtcgacactcagccactgttaacaggtgcatactattaagataggttttcgcatttgtctggctattaagctaggttacagtttaaccacaaggactcaaatatagaaatacggaatctttttaggccatatttagtttgttttaacagatggaagaatctgataccaaagttgttataatatattatctaaaatgtccagttttctggcagagcaggaacatcaccatctcagataggcactgccattttaagttccccttgattaaaaactgcctaaatccagcccaaaaaacatcaccctaatggctaatgtcagcataatcataaacctcaaaagacacctctgaccagaaacattccaaccctgagataaacccccctccaaccagagacatgccagcccctaggtaacttcccctccaaccagagacattccaaccctgcaataaaactctcctccacacaaaaacattttcagcctgtgaaaagctctcttcctaaacccttaaatacccttaatctgtaagagagaatgctcctgaccaaaatcagccagaagcccctcttgggtttattctccaaaataaacctgtctttgaattgttgatctgcttttcgtgtttcttttttctatcttcaacttcacattttcgataacaacataaacaaaatacaagacataccaaaaaataaaggaaaatataccacatatacagaaagaaaagtacagccaacggaaaacataccttagagggtacagatattggtcttactagacaaaagactttaaatcagctgtactaattatgttcaaagaactaaaagaaattatgtattatgaataaaaataatacatgataacagtgtctcaacaaatagagaataatagtaaaggaacagaagttataaaaaggaaccaaataaaaattataaagttggcaagtatattaacaaaaaaaattactggaagggctcaaaacagatttgaactggcaaaaggaagaattgaagaattgtgaacttagaggtaaaccaatagtggttatccagtctaagaaacaaaccaaaaaaaggaagtaaagaaaaataaacagagtctcaaagacatgtggaatggtctccaatgtcacttattgcccattgtatacccatatatgtccattgtttagcttccacatataagtgagaaaatgtggtatttgattttctgtttctgagttatttcactaggagtgatggtccccaactcaatccatgttgccgcaaaagacatgatttcatactttttatggctgcatagtattccatagtgtgcgcatgtgtgtgtgtttcacatttttttaatccaatcacctgtttagggacatatcatgtgactgctatttgaaatagtgctgtgagaaacatacaagtgtaggtgtcttttttatataatgttttctttcccttcagatagatatacagtaatgggattacttgatctagtgatagttctatttttagttctttgagaaatctccatactgtctccatagaagttgtactaatttacatttctaccaacagtgtataagcattgccttttctctgcatccttgccaacatttgttattttttgactttttaataatagttattctgacaggttgacgccttttatttctttttcttgcctgattgttgtggccaggacttccaattctatgttgaataggagtggtgaaaatggcgtccttgccttgttccacttcttagggggaatgttttcagctcttcccccattgactatgatgttgtcagtaggtttgtcatatatgatttttattattttgaaatacgtttcttctcatgccttgtttgttgataatttttatcatgagagatgctgtattttatctaatgctttttttaatctatcgaggtgaccatatgattttcatttttattctgttcatgtggtgaattacatttattgttttgtatatgttgaaccatccttgcatacctggaataaacccatttgatcatggtgtattatttgtttgatatcctgttgaatttagtttgcttgtattttgttgaggatatttgtatctatgttcatcaggatatttgcctgtagtttcttttcaatgtgttaaaagaaagactatcgatcaaaaattttgtattcagccatgctctcttttaaaaataagagaggaattatgatatctctgggtttaaaacaaactactgaaagaattaatcaccagcagatctgccctacaaaaatagtaaagagaatctttcaggctgacatgaaacagcagtagatggtaacagaagtacatatgaagaaacaaaaagggcaggtaaaagtaacaataaagagatcataaaagacagtgtaaacttgtaaaacatgatgctttcatcttcctgtctattcaaaaagacaatttcataaaataataattgtaacattattgtgtagaaggggttataatatataaaaatataatttttatggccctaatagtaaaagtggggagcagtacctaaggtatattggagtgattatttggtatactattgatattaagttggtattaatccaaattggattgcactgagatgttaattataactcctagcacagacactattaaactaactcaaaaaatacagtaaaatattaaaagagaaacactggaagtatatatttgacacaaaagtaggcaagaatctaagaacagaaataataatacacatagaaaacaagtagcaaaatggcagattcaaatcctacgttatgaattataacattaaatgtaaaaatgagttaaataccccaaagagcagagattgactgaactgaaaaaaaaagattaaaaaaaggtccaagatttacaagagagatacactttagattcaaagacacaaatagatcaactgtaaaatcatagtagatatgcccatttaagatataatcaagagaactggaatggctatacgaagatcagactgaattaattataagacaaatattgttactggagacaagaggggcattgtattataaaaatagtatcaattcatcaggaagatatgatcattataagtatttatgcatctgacaacagggtctcaaaatacctgaagcaaaaactggaagaattgaaagaaaacatagacaatgaaaaaatagctggagaacataaccccatttttaataatgtatagaacctctaggcagaagagaaacaagaaagtagaagacatgtacaattctataaaccaattagtctacacatttatagaacattctacccaataacagaaaaaatgtgcactcttcttaatgtacatgaaacttctagatagaccgtaagttaggccacgtgacaatcgtaaataagtttaaaatgattggtagcatgtaaagtatggactcaaaacacaatgtaattaaattaaatatgaaaaagagaagagagttttaaaaattgaatatttgaaaataaaaaacacactactaaaaaaacccgtgggccaaagacaaaaagcttcagtaggagttataaaatactttgaaatgagggaaaagaaaaacacaatatgtcaaaacttgtcggatacatttgtagcagtttgtagagagaaattcatagttataaatttctatattaaaaaagatgaaagatctcaaataaataatcttccaacttaaaagaaaaagaagagcaagctaagttaaaagcaagcaaaaggaaaaaaagaataaatattaaagctgaaaagtaagaaacaggaaatataaaaacaatagtgaaaagtcaatgaaaccaaaagttggtttgatgaaaagatcaacaagatgggcaaatatttagctaaaatgaccaagataaaaataaagaaaacacaatttaatgaaatcattaatgaaagaaagtcatcatttctgaccttatagaaataaaaagataagaaaatactatttacaattgtatactaaaaattagataacttagaggaagaaatggaaagtgactactaaatggtatgctgtttatatttttattgatacataatacatatgcatattttcaggatacatgtgataatttaataccttcatatcatttgtgagggtccaatcagtgtaaatggtacatccaccacttaaataattgtcttttctgtatgctagaaacattaaaaattttctaaatttagtttgtggtaactttgcaagccttaatacattgaaaatgagggaactgcatgctttaaatgggtgaatattatggtggtatgtgaaatatatctcaatgaagatttagaaaacaacaactattaatcctatacttgagaattctatcaaaaatgagaaatattgaaaaggttatctttggtgtttagaagtttctcaaaatggaatggaacactagacttcactaatattatttaatattaagtaaatattaatatttaatatagcttatacatatattagttatacttgaagaaacaggtatacaacattgcatgtacatatacctgcaatctataaatatttttcaggagatttcatagctcttaggagataaaacacacaaaattatataaataactagtcattattcatgtttttgcagtgacatgaaccataaagttttatgcatccagtgcatgtgtatttatatatatttattcactagaatccaattgaccttgtattacagcccatatgcattaagatgcttatcgattttagaagacagttaatttctaaatgttaggaaaatgttattatactatatgcatatgttgaaatatctggtatgctcataatttttgtaagcgcttaactcactatttaaaaaatgttctgaacagatagtgttacaatataaaatactaaacttagaacacatgattttaaatagtagatgactgtacaattattaattagtattacagatttgagacacatttatcttcaaaccaatttaatgcaaattagagcaaatgattacatggcagcataattatatctagcttgtgacctaccaaagataggaaatggcacacgagattaaaactggaggaaagaaatagaaaatcttgacccaaactaatatctctgtagttcaattacatgctactaaacactggctgtaccctctgctttctttagctgaaaacaccagtgctgtgttccctccagtgatctgtattcaagtacttgagaatttctcatcagtactagtgattctcactctgggggtgagccacattttcacattttctttggtgattgcataagaatgcctatggttgatatttaaagttctaaaaagttaacagggctgtcagtacttatgttgaggacatcacctcattcccacctgcataatttcttctttgaagattatattaatcctttagtaacaccatagtgtctaataagcaacatatttgtggaggcctaaaaaatggtttgaataatctcctcagcatggccttcatctgggggtggtccttcagaagtttcttccatgttaatgtctgtctcaacaccaagtcctttgtcttcatgtaccttgttgttgggaagtcacgacacctaaaatgatttcaagctaaatgacagtttttcttgatctgggagaataaatgacgagagcaaagctaagcctgagaaatttgtgaaatatattatgtttgtctttgaagtgccctaacgttcttcacacaggacctctctcattgttcctgcctggtaatctaatgcccccaccaaacactataaatggactgatctttccaaacctactttaccttaaacagtctcatattacagagttacttctcatctcctatagatccttccatcaaaaaaatatatatttccttagtacactttgtgtaaggaaaataatctgattaaaatcattcacatataaatcaatttgtcttagtactccatttgacgggacaaagaagttgacatttctttaagtgaatgaatcaggtctaataccaaactccttgcaaaaatgttctccctcctctgtattctggagagaatctaagagttattctggtaataattcaaattttcaaggtattgtttacaaatctggatgcagttcactcacaataaaatttttaaactcacactcactaccttgggtttgaaaatggcttaaccaccatcatcacagaaatgctttgaaatacgtttcagtgttgtgcttttagatggtaaattccttgatgtccagtgagattaaacaaattgtttgccgcaattcttactgtgaaacaatcaataacttcactcctgaagtatggtcatctctattgtgaggttcacaaggcctttgcccacagaaagaattgagaaatcaattttgactccctacgagttgtgactgtgtctctacttgactaaataaataagtagatcaagtggaaaagaaagaggatgtcatgctcagcaaaggttactaatagatatatctgttagcccacagatctggggtaatgatattttagatattacttgactttcccatgcctatccagtaacccttaagaataccctctttacagaacaatgtcaaagtggttgatttagaagaaatttccaaccataagcattccagaatgagggaagtacatcactctaggagcaagcaaactgtgttaccctcagacaaaagcaaaataaaacacagcaattagaacactgccttaataagggctttgtctctctgaatgaattatgagataaaaaagaatacatgaataaatcactcagtaaagtgtaaagtgtcatgggaaaaataggtactctattcctagtatattctaacagaagagatgcttgttaacatctgtttgagtttcacaaacagcaaaagctggcaatctgtaaagttttaattaaataaagcaaaaagaatttgtcacttggtaaagtttctgggaaattgatgcttaaaatgtatcaaaataaggaatgaaatttctaggtcagttttttctttgatgtgatatattaaaaatgtcctacctttaggctttttatatacggtctttcagataactgcaaaaaaacaatttttctctgtaaaataaatgggcaatttaacaatccacagcaatgttagtgctagtcagaattgccattttagcatttatataataagaagaaaagtgtgcagctctgttttttgtttgagagttttatcttggccaggtgtggtggctcacacctgtaatcccaacactttgggaggctgaggcaggtggatcacctgaggtcgggagttcgggaccagcctgacaaacaaggtgaaaccccatctctactaaaaatacaaaaattagctgggcatgttgggaggcacctgtagtcccagctactcgggaggctgagacaggagaattgcttgagcccaggaggtggaggttgcagggagccgagatctcgtctctgcactctagcctgggtgacacagtgaaactccgcctcaaaaaaaaaagaaaaaaaatagttttatcttgaaagatgtctagaagaactatgagaaagatacattgaagaactaaaatttcatacaatttcttgaaatgttgaaattttatccaaagctaccaaatttttcaggaaactatgtaacttaagtaatatagtggagagctgtcctttaggactttaagataagcaaaatgatattaagctttgtaacacagtagaagaactggatccaagtgtcagacaattggtttaaaatccaaggtgtgacatttattatctctggacattggggaatttacttatcaaataggagcttcatttttctcatttgtagaataatacttatcttttagggttattgtgcattcacacaaaaaaatgagatagtggacaaaaaaagttgtaattatgtaaggcgtatagacaaggtaaataaaaggtaaatatgagatatgtaaatgaggtaaagaaaataaaatacctaccatagtgcccaataacttcaattagctcacactgtagatatttccaatatagattatatattgtttcagagtttgaattgttaatatgaatttctctaacttttagatataaattaaacaaaaatccttaatctcttttttaactaaaaaaattcaggaggctgaggcaggagaatggcgtgaacccgggaggtggagcttgcagtgagccaagatcgtgccactgcactccagcctgggcgacagagcaagactccgtctcaaaaataatgatgataataataataataataataataataataataataatttattgtgataatatacacataacataaaattaaccatgttaatcatttttaagtattctgttcaatagtgctaagtacaacatattaaacttctaaaagtattaagaagtcataaactctcttttctgattgttgtaaatttatttgtattaaggcaaaacatcttcctgagaacaacttcagtttcccattctccactggtgtgacctatcattcctacattctattagcattcaaattagaagtgaaaatgagataataagtatacagattcgttttgatccctaatgaaatatgaaaagaattaacatgaattgttgtatggtctttccctgagtcttagaatagtatttaaatattttcctagtgcctcatatggcatacaagaaaatcaaggctaatgttcagtgatcactgtaacaaataattatccagcactagaactaaggattaattcgttcaagttaaatattctttctaaaacttcaagttgtctcacagtatttttttttcttttcatggtgcttttctttctattcgttggtaacaatgagatgactttctagtgtttttgttcttgttgtgttttgttttgtttttagtaagacaagatgacacttgttatttagttcacctggtgaacagtctaaagaaatctattcaaaaaatgcatattttctcctgaaaacattcagctttatctaactataatatcttggataattatattatacttctgtcgtttatcacagattcatctgcctatactgaaattaatgtaacagtcttctgtttgttgaatcagagctctaatatcatgattcaatctgtgagctgctccccatttgaatcaataaaaggctgagaggtcttgacaagctatattttttctaatattgatcttgatgaccaagctggtgcccttgagtctaaccattgattttaaatgggaggcctgtcaagttggaggccaattttttgctattaaacagatcgggtcttgtaattaaagaaaatgtcaggctgtcatattttacaagagggccatgggaatattttcacgcagttttcaagcaaattagaaagtatgcagacctgctggagccaaacacatacacccaaaccagcataggcttacacagaaactaaatcaatgttcaaatagtatgtgattcattggctttctattttcccaagactcaatgatttaaggaataatttatgattcctggctctaataacatgcactgctgcatcaacttaaaatgcatcaaactcttctgaaagaaagtaacattcaaatgaaaagctaatttactgtcaggataatggagaacatccaatccagtctctgcagcttttgcttcctgtttctttctagtactactggaaaccataacttcttactcctctttttatgatacatttcctttattcttccatcagttcaagaaatatttacagaaaagcaacaaataaagagctgttgaaagatcacattagtgtagaagaaacagaccagtaagcaaaacaacattatatttgttgtaatataggtatagtacaagtgccttcaaaagctaagaagtgaagggctaactttgctatggatgtagtaccatattgagcagagcttgggactactgtatgagaaattgagagcctgaaatttttatattggaatgtgataaggactcacataagtttgagaattgacttctgaggctagggatactataaaattgaacataaaatatagaactttcagaactggaaaagaaaatattaaaataccaagagaaaacatactaagaacacaaattaataattctcccaaaaggaaatatgaattactataagctttcaggaaaatattcaaccgttatttctccaaatattgattttgtccaataaatattgtcctaacattgtttcaataatgtcccagtcaatatctcttttattattctgtaatttctgttacacttatgttagtacttctgcccatgtgacatgatctaacttatgctctgttcctctcattcttattttttcctcccagcttcagtttgcatatttttattgacttgtcttcaaatgtattgatatcatctttgactgtgttgaatctgcttttaagcccatccaatgacttactaattcctaatactgtattttattccttatacaaaatatacatttgattttgtatatattgtattctctgtaaaaatatttcatcatctacatattttctatagtttttctgtttctttaatatgctagtcatagttattttgaaattattttctgctaactacaacatcaggagtttttataggcctgcatgttaataatcttatcactttttattaatatcagtcactttttctttttaaatatctagagtgttgggtggttttgtttttgctatttcttttttttttttttgtattctggaggttacaagtgatacttataaactattgaaattctgaatcatggatccttccttaaaaaaatgtttcactttgttctggtaggcaccttgatgctgaagagtcccactgttagctttgttaagatagtcctgtattagtttggaaagcacagcgtatccgctaaaatctttccattctggatgaaccagaaaaatgatttccctcccaacaacaaaagactcttgattcttcacttgctttctgcctcccagcagctgctgccttgtgaacttccatagtctttctctgtgcttttgcagtccagaaattgtccaaggatctaagaaatattttcaacaaatagatgggatgcttatccacattccgtctttgatagcagctccaacttccacttatcaataccactattccatgtttgctatctaaatacctacagtgaagcccagaataatatcccaagactcattttatgcatctcaactccaaaattccctacgatggttgcccaatgacagccgtcagttgttttatatgataatattaatcaaacaattgttttattaagttttttttaaaaatttaactattaatatacattaatctcaaagttattgtactgcgtgaaaggcaaacaaaagagattatagaatatagctcgattgtataaaatgatggaaaataaaaaggagtccatagtgcagaacacagatcagcagctaaaattttcatttatattatatgactttatatggtgataactttggagggaaagattccaaagagatatgaggacactttttacagtgttgactgagatgattgtttcatggtgtacaggtataattaaatgcaaaattatacaattcaaatatgtgcaatttagtgtatgccaattttgcctcaaaagttgtgaatacgcacgcataagtatctgcacatatttatatctacagaaagacacatacaatgctgattaataatttataaggaaataatatagtaattttaaagaaatttggaaatatgcatcaaatagtgaaaatttttcaacttctatgaaatccaactccaaggaaatgttatgaactataaacaaatatgttttcagaaagacatttataatagtattatttaaaatcttgaaaaacttgatgcgtgataaattatcaataaaacactcttaaatattgacatagtcacatagtgaattatggtttaattattacgttggtaaaatgtttataatacaatttacctttttgcccttctttacccttttatttgtttttaggcacattattacattgaaacacatctatatacacatttcaatgagttttgaaaaataaatacgcctataagccactatcccaatcaaaacatagaatatttctgtcaattgagaagtatttttgtgatacttttattcaatacacactataaacatgtagccatttcctgatttatagcaacaatgatgggtttggcatgtttcttaaattaatataaatgaaataatagactatatactattatgaattgcctatttatatgaaaatatcacaattcatatttggtgactctctattggttgaattatggcaaatatttttctgtgtctattaagatgagcatatacctttttcctcctttattatcttactgtaatgaattaggttgattatttattatttttttttttgagacggagtctcgctttgtcacccatgccggaatgcggtggtgctgtcttggctcactgcaacctctgcctcccaagttcaagcaattctcctgcctcagcctgagcagctgggactacaggtgcacgataccacgcccggataatttttgtatttttagtagagactgggtttcaccatattggccaggctggtgtcgatctcctgaccttgtgatccgcccgcctcggcctctcaaagtgctgagattacaggcatgagccaccgcacccagcctgattagtttttaagtaggaacaccatctggtattctttcccactgggtcatgatgtatttttacctacattatctgatttgatttgctaaatttctgtcaaatactttaatgtccatatataaggggttattgttctacaatttgcttttttttaagaataccattgtcatatttgggcttcagagttgtgttgaccttatcaaatgagttgaggagtgacaatttaggacaatttccagagatttcatttttgtttaatatttttcaccagttgtggttctttcactagggaaggggttctgaaacctcatcacaatgctctcctaaaatttgtccctagagtcaaagagtgctccagtgttattaaaccaaatgctcttactttgacctttgccaaaggtataaataatacttaatgtcaaatttattttcaagtggttcttgaaataagcctttttaaaaagtcgaactctttaaatcaatagtgttagtattttaagaaaattgtatcttttattttatgctagtttgttgtagtattaaaactgaccatattattaattgtgtatataatattctagcacctatagctctttgtcctcaaagccccagaagatgattaagaaatattttctttcagttgtttctctttccctaaaaattacttttaggcctgtttactatctacaggtataacttgccaaattctttgcagacttttatacctcctaagctactacctctgaagaaatcaccttggttggctgttttgttgactgctactgctggttagccaggagataaatttcaagtggccacaaattcattctttgattgtgactgggttgcatcacgtgatatgaaatatcagaaatgtagtacagaaaatgtgttctgataaaacatgaatatatattttgcatcaatccaacaacaaagcaaaacaaaaaataaattaaataatacataaacaattttatccatatcatttgcctcctcaaatattgcagtggagtggcagtgtttgagagggaaatacatataatatgaaacaccggggttaaagacaacatatgttcctctaaaaaattatcttgtcacttacttgctttttgaatagaggcaaattatatatcctgtatgagccttcgattctttatgtgttaaaaaaataatgctgacttctttatgggattgttgtaaatattcaataatagtgttttacacaatgcatgacctgcaagaaatacaattttttctccgaatggtagttaattgtttctgctataatatccttccttttcattcagcagaatgcattataatatagtcagacagttaagaaaattggttctattcagtctctctatgccaaattgtatggtattgacaaattatgtagcctttctatatctctgttctgcataggattgctgtaagacaattcagatagtgtgtgtgaaatgcttagaacattctgcaacattttagtaagtattcaataaatattacccattgttattatattccaaaaaatcctacatgataaatgagaagaaaaaaggatttaagagaaattaagtgattttttttttttccccaggagcctcagcaaataaatggcctaaacaattggaagcctagggatgtaattgctggtcttctattaaaaagtgaaggagacaagattttaatgaaggtactcattctattcataggctggacaaaaatagtggttttaatagaacgagctaataagtaagagataaaagtagaaaacccagagctacctggaattacactacactcaattatactcgatcgtatatagacagattagccttcctctcaggtgacatctcacgcaatccaagatttgaagttttttttttttttctatcactgctattttctctaggataatatattcaatgaatagaaatcaaatagaaatcaaatcggctttaacagttatgatgtaagattactccagtaaaataacttcacagatgtacgtcatgattcaggagtaaaaacaaattatcttgaaatatgtaaatcattgtgacccattttcagcttgaattatttgtgctttcacacagattttcacttcttttgcttataaaagtaatgttattaatacatttttatttgaatttttaattttaagaacaaatgcccatccactaacttattctagacttaagactttttttacagacagctgaaaatttgctaagaacatactaacattgaaacagcagggaaattctcacatagggaaagagaggagaaaattatttacttatggtttatggggatcctatctgctccagtgaatttaatttaccacaggaaagatgctctgtatacgaaataaaatatacttctttatctcaaagtgtacatttcaaggaatattttgtctcctttacaagaaggattaattcacataaaattaatatttagtaataattatttcatgattaaaattctatttaacaaactccacttaaactgtgtctataataatcaaaacaactgaacagcaaatatttattctaatgatttgcagctgcaatagtatatattgtgcttgcaaaaactttgccatcagtttatattgcttcatccttagtcgtatcgtagactttcttgacccaataaggaatttactgataaatgacattctaggacaagcatatcctaggctacaaatgaaggagaatggtgaagactagctgcctctaaggtatctgggacataagtcagaaagttcaaacctgagatttaaactcaaattagcccaaagggggttggtaaaaggtgacatgtgaagctgtttagacgtgtataaacaaatttcaatatcccaatagtcaacaaatattaattaatataataatgacagttttgagggtatatatagcttctgggtggcataacataatatataaaaaattatgccatgtaaatttgctgaacaataattaatacattgctagcccaagtaggatgtgcatactggtgtgttataaaatattttaaggaactgaaatattttagctatccatatctcacaactatacagatgcagtttgatagaaaaagtatgttctattagtctactacatgaagcattctgaagtgccatttcatttattctatgggtgtgcttatgctgtaccatgtacacttggacatagagcatctcattccaaataactactttcacttgttcggtagtgactatgtaaaggctagttttattttcatcattaaatagtgagagattttactgtctagacaaaggagagagaaaaggcatctttctatggagcaggtgaaaccaccggattgaaaggaaaaatgcaagcagttgattgtcacacagccagaggaatgggttaatacaataactcctatccctactactgctattaagtaacagtgagtgagagaatagggtagggaaaggagaaagggagaggggaataaggaaaggaagagaggggaggagaaagaagaagaggatggggaggaggtgcacatgtgtaattaaaatatccataacactttaagatggatgctctagtaggatgtgaaaaagatatagtgggaagataaagaagaaagtagcttcagagaagagaatatttgttgtatataataaacagtgggatattgtaaaaattgcatattcttattcagtagctctgtgggtggggggacggggtgttgacattctgtgtttttaactaacaagctcctaggtaatgctgatgttgctgttcttcagaccaaactttaagtagcaattaaagtaattaagtaattaagtaattaagggtagagaagacattgatatttattctaggcagagtgatgaataccctctagtagtcatggaagaataaaagcatttggtctggctagtagttcactgagcataaatagttcactgagcataagtagttcactgaactatcagataatgatttagaaaaaaaaagtattacaaatgacctcaggctaaacattctgaacattattttgtgggcaaagggaagcctacaaatgcttctgttcctaagtgtgccactgtaggcttgttggtaaggaaaccataaacatgttatagtttaaagggcaagatggaattagagaaagaggaagaggaagaactgttagcagacttcagccattgccagagtgaggaaagcaccaggttgaactttggagatggaaaagaaaattccagatttggcacctacttctgagtcatcaacagaacatagtcaattattagatggaaatagttgggataaaaaaataagtaattgacaaggaacattactttatattttgtgttgttttatttcgctttagccaagaatgcataggaaaaaatagataatattaaaaaggtaaaaattatgggatggtatgaaagcatatagaaagtctatatgggtatattgaatagacaaagttttagaatgtaaatcgcggagtgggccatggatattgaaaattagaaggtgacagggattacacagggattgaatatatattgcaagccagtgattttttttcatagagtatttcttttaattagaaagccactggtaaccttagcaagagttgaatgatagaaagaagagacaatagaatgacacaaattatagagtcgatagaatgacgcaaattatagagaggtaaatggatttgtgtgcctcatgggtatatgtgtatgcaaatatggaaagtggctgtgggaagtaaagcccctggtagttgttctttaatttggatgataaaggtggcatactttttgtttctagaggaaccattcctgttttctgattatgaacgcgggtagcagatgtccttggaaagaatgtccactagatttgctccaaggccaagggcatcatcctgtagattctgataaaatagttagttaattatcgtatccaagatgaaagctgacaactacaaatcataaggcaattgatgatggcaggaagtttgtcaacattcaaatccctcgagtcccatccctcgaaaaagacatattcttcctactccttagcagtgatagcgttgtaccaatatcaaatcacagatttttagagggaaatgggtataataaaattgcctatacatttttatagtaaattctagaatttcttaaaatctgagaaattatttcaatgacaatttttttctacagtatatctaggtaatgatcgctgagactcatagagtgatgaaaataaacatttaggtgttgtatatctctcatatgttttaataagttttcaggtgtattttattttcagtagacgacccttcggtggaggattggggaacaaattttaattcaagccattttctcccagggcacacatgctaatgtattacagaaagctgaaccataatattctaagcacttcagttagtcttcacttttgaaattactcttttgaactgagtcaaaaaaaaaaaaagaaaaagaccctttcatttcattgaagtgaagcaaatctctctgctttaattaagagcaatcggaggaaatagtgataacagaagtccagctccgagccgtgtataaagaaatgatcgcgggctctggctgccagccaggctgccaggctgtttttcatgggtgttactcgactgacagtaccttcctgacatttgtacctcgacaccagaagtgctaacagctgcgatgccagtggtagaaaagcaaggaagatctttttcagctttagttgctctcagattctcagcaccctaagagaataaagtctgttaaaactgacttcagttggctatgtcctttgcgaagatttttgtgttggtgtctgaaaagcagttttattccatgacattgggcttaggggagattattttttcaagacagaagacacatgtggtaaatgcgtgacaaatggcagtaacaaagttgggctgggagttcatggttttatgaaatgaaatatttcagcaaccaattccgtgctctgttacttgctgcagacagcccttttgaccctacactgaggcagccaaaaaggactataggagaaaatttctagttatcttgaagttggatggtattcttaactaatagtgacagatgtagcaatatgacttctagtgcttgctgctaatggcagagcttcaagccatcaggaaatgagaaaggtcagaagacaagtgcacatatgtgagaaacgagttcagacgataaagggtgagatgtggtttttggaaaagctcattttgggaacctttccagtctgtcttggtggtttcaaggtgattcttggcacataagcgtatccctaacattttgacatactctagagaatcaaggtcctgaaaagaatataacactgcttaaatatcaaggagccacgatgcactgataacttgtttcgtacatttaatcttctttatgattttagcgttgctactgctttgatcttaaaaataggaaaaatgtttagcaaaacataataaattttctaaaatttaaaggatatttaagagcccttctacaataattaacttactgtaaaaaaaaagaaaacttctataaatagttcaattgctaatgctttatagcagatgagttttttacaaaagagtttgtatttttaattttataacaactgggttgtctccacatgcacttttctgtcacctccatatttcagacaaatctgggcagattctgggtggtgtggtcctagactgaaaactctgtttcaaaatccaagtataaaactttgtctttaatgacatttcaaacgtttcatatacacaatgaaaagatttttaaacagcataaaaacccataaatgtaagagaaatatcttcttacatgtacattataagtattcttattgagagaaataagtgttctattgataactttaagtaaataaagccaaaaggacagaagaaagtctataattaagcacaattcaatcattgtggccatttaattctgttgttttcatgtataatctgaagtccagagaagttaaggaaagcatgtgattttatgcagctaattaatgattagaattcagtatgccaactcccaatcctggggttctttctagaacaacatccctggacatgctcagaaagcaaaaatgtcagaatatttttctttcagcactaatgctatgattcatgtcaaaacaaaaacttcagctgaagaaataaagataaattgatttaatgtgatggcatcacatcatagtaatttcaaaaacttttgagaattattttttttttttgtaattaactctccaatcggcaatggcagagaggagcatcatccaaaacatctacagggaagtctgcatatttttttcatttcattgctaatgagccattttcacctggctcctgctcccactactcccccatgaagaaccagctgtcagtttccacagctgagcaggtttggtaccagacaggtggcagcagggtggggaagaaattgtgtcagtgggatgtagttaatctggaattatggtgatccacctggtatcattaaacattgactccatatcatgaatggttcactacaagacaatcaacacttaaattaaaagttaaagttttaaatatccttgaaaagacaaatatgaaggtttggtattaattgaaaatctgcagtcttatacacattagatcaactaagtccatttagagatgacagaattttatattctgtttatagaaaaggtgaattggactgtgctattccagattctaacattcactcactctgtaagctttttatgctataggctctgtgggggaaaaagcaaaacaaaacaaaaaactatcttgacatcagtagcactgggttgaagcttaaatgggttaatatattcggaaggattttgtaaactgatacttaatatgtgtgtaagtatggagtctactgttatcattggtatttacttcatgattatttttaactctcacaataacctagaaaacgtccttaatgtgtcaaatgatatggccaaccacatgactcaactgatctccctggtcacaatgatagtcgcccattggtgtttgattcagttcgtatttttcttcaggtggaagtcacctccccataaaagccttctctgaatgctcagtaatgggctggatgcccttcctgtgattctatagcacccgagctgacccctattagagaacttatcacacagcattggaattggctattcaccagtttcattctcccactggaccataatgtttatgctcagagaccttatgttgttcactttttgaatttccagtaactggtgttgtgtatatcacataatggagactcaataaaaattatatacattattgacatcaattagtttcatgtatacaaagtacaaagcacagtatgtaaattttttaaatttatataaatttaaaaaccatatctagacatttatttgatttgcaatttgaaccaccattctggcttcatcatgaagaaaactttgaagtaggccgacagtgaaatgcagggagaccaattcaatggtgaatgcagaaaagatgctcattcaaacaagagtgggagtggaaatggagaagaaacagacctgagatatatacagaggtcaaataaacatgatttgataaataaattcatgggtgaggaagaatgagatgtcagaaatggctttagcatgcctgtaatcccagcattatgggaggcagaggctggtggatcacttgacgtcaggagttcgagaccagcctggccaacatagtgaaacaccgtctctactgaaaatacaaaaattagccagccatggtggcaggcacctgtagtcccagctacccatggtggggctgaggtgggagaatcgcttgaacccagaggcagagtttgcagtgagctgagattacaccactgcactctagcctgggcaacagagcaagactccttctcaaataaacaaataaataaatggctttaggatatatggtttatacagctaggaagatgatgaaagtattgactgggattgagaacagtggaagacgagatgattattgttaccattgctgttggaagggacaatgaaaggaagcaggcatagttcctagtgtcagttttacacatgtaattttgttgtgactttgaggaatccaagggaaaaaagagacataaatttggaagttttttgtgtataggtggcatattgaagccatggattgcctaggaagtgtttaggaattaaagaaagccagaatcaaacacggaggaattcaacacttaagaaccttctaaggcacagaaaaagaaaagtgaaatattgagaatgaaaggtatataacaatgggaaaggaaaaagtatgatgtataaaaaggaggggagtaagtacagatatctttttttattcaatatagttgtactgtttaagaataaaatagggcaaatgttgaagggtgatgtaaggttaagacagtgtgatggctaattttatgtgtcaacttgcctgggccatgggctccccagacattgggtcaaacattattttgggtgtgtctgtgagtgtttcttgatgaggtgaaaatttcagtcagttaaccgtgtaaagtagatggctctccctagtgagagtgggccccatccaatcagttcaagtcctgaatagaacagaagggtgacccacctgtgagtaagagggaatgtcttctgcctgccagcttttgatctgagacattgcttgtttttttgtttttcttttcttccttcagactttgaaacgtcagcttttgctgtgttttgatgctgccagcctttggactggaagtacgtttttggctctcctaaaccttcagcttgccaattgcacatcttgggacttgtcagctcccataatcacataaactaattccaattgcatacacacacacacacacacacacgtgtgcacatacaacacacagacagacatacacacacatacatcctactggttctgtttctctggagaacactgactaatacagaaaggagattttatattatatacatatatttatatacattatatatatataacatatatatattcagatagagaggacttaaatgtattcaatactgtttttaacattttaatgtatttaaatactgttaaaaataatcccattcattaggcttctgggtaatgtggtatgtaattaaaccagtgtatcctgtgatcatatgtccactgatgtacctcctttgataataagtatggccatcagttctatgtaatgttatccaagttctgtgtcagtggatcaaagacttggttacttcttggagagtgctgctagctgaagagatgtgggcaagaaagggaaacccacacctaagatatgctttgattctactcaaaagctattccttccaccttgattgattgattgagtagaatcaataatatcatattggtgaagggtagtgggtgatctcagtgtagcgctcagttgctggaaggttgagatttctacagaggtagtaggtagatcagcttttgttgaacgaggattcatgttttgggcaccatgcataacctccatctctgccagcgtggccacattgttaatgtgtcagtgtgcttatactacaatgtgctcatactacaatggctgatgaaagagactggttttagtttgccaagccattctgtgcactggtttgtttagtgcctcttgcttaccaaattgtagagtgtccataaacttgtatgtctattccccagatctccttgtccccagttgtattagttttctagggcttccataaaacagaataccgcagactggttggcttaaatgacagaaaattttctcataattctggaggctagaagttcaatatgaaggttgcgccagacttggtctcttgtgaggcctttcccccagcttgcagtcggcggccttactcctgtcttcacttgatcaccacactgcttgcacatgtttctggtgtctacttgtgtacccaaatttcgtcttcttataagagcaccaatgatgtatcacttagtgttgggcaatacatttaataaggtaatttgtagcaagtttcagaagtagaaagaacacaaaaaattatcaggaaaacttttttaaaaatctcatatctaaaccaggattttaacatgaatagaagctcttcaggtggacaggggtggcaagcggtcatttgaagcatagggaacagtgctgaatactgtcttgaagttactatgttgttgataaaaattaattatcaatttaaggtttaattacaaggttttatttcatgttaagtttaaatatttgtttttctggtcaataacacattaagaatagaaaattacaggcagagtctattcaagacagccactctaggataagggacaaatttttgtatcccagcctaataaaagagagaaatgagataaactctaaaaagaagatacagatactgatgatgatttgaaatagagggagttatgattgtaaaaaagaaaataagaatatcaggtgattacatggcttttacaattttaggctatttttccatctgtaaagtaaaattcatgttagattaaaaaatcacagcaaaactatacaagataaatgtatgttgacctatggtgtgtgaagcaaggttgtgaaataataagacaacttaccttctttttcagtaagtcgcctacgattatttatttagatttggtctagctttcaaagaaatggagagaaaaatataggttggcaaaggtcattctttttcataaagtgtaacttgaggaataacaactaacatatgtaaaactttcagtttaggaataattttctcatctattatttcttaagatttttattataattccttgagcagacataggatctgacatcattacccccagaaatgctaaataagtgtttaagatctaagcataagtatatggtagaaacttaaagaagtctgactctgactgcaaatgaagtagtctcgtcatcacaacatactgtcttaaagacaagcatgagtttattccagagacaaaatggaaaagttttgcttctaagaagcaaacttgaaacttgaggaaggaattggaaaatgacaaccatcaccacaacaatacagttcattataatttttttcttttgctatgttagttcataatgaaatgtgaaaataattagtgatacttcttatttgctcaatatgtgctagacatgttggtaagctttttatgtgtattatctcatttaatgttctcagtatttccatatagtagggaaaaatgatgcactgtataattgctaagaagtaatggcagtaaaaagaacacaaaattctgacttccaaaaacattcatcttaatgacaatccaagatgaaaaaaacataacttgtcaaatcctaaaatgaagatgtgctgtttgcttaagtaactatcattccgcctaagtttgtaaacctcaacaaaattcctgccttttttagtttttaattttgtgcaagaaggcataaagcagaaatgtaaaattgttacaatattaagaaaagaatgaagggagaagaaaaaaggaagagggacaaaagcgaggaaaagagggaaggaggaagaaacagaggaagagacagagggaggaagcaaggaagacaaaaaggaatctatagttccttctgttcacaatttgtatactacaataatatctataatttagacttgatatcagaaatgcaagctgagattaaaggaaatcttaggtcgacatatttaaaattgctgatatttcactacttttgtttaacaaaaatgtcaatttcctgaagttccaaataatataaatagaagtcataaaggtcaataccctttggtagtgacaactacaagcaactgaaatactttttatcaatctgatcatgaaatatgtaccttaggtttccctggactcttggtagtattttaacatggaatcttacttgatggccttcaatcactctgaggttatcaatctcaagttctaaaacttatattccttaccttgattatgtcaataagcataaatgctctataaacattctggaaatattattaaagagaaaaacagtaaaatatttgtcctcactaaatttttagtttgatatgaggatggcaagttcatgaagatagtgtaaaattgctgaaaacaataagaaatatgttattagattcttatttgaaatatatgtatgggtagctacgctaggttttcaatcctaatacatcaataatctaccaaagattaaatttaatggaaatatgaatttcagtgtatagagaatttcattaaacaatgaacttcattagaaataaagagaatagaggtggccccattcatgcctatccttaatggagctcctaacacaactcacggttactgcaagctccacctcccgggttcacaccattctcctgcctcagcctcccaagtagctgggactacaggcgccctccaccacgcccagctacttttttgtatttttagtagagacggggtttcaccgtgttagccaggatggtctcgatctcctgacctcgtgatccgcctgcctcggcctcccaaagtgcctggattacaggtgtgagccactgcacccagctgtaaattcttaaataaaataaataataaatttaacattgcatatgctaggaatagcatagaattttcatattattgtcttataaatattaagaaaagcttggaatggtggtataagttagtgtgttaaatattctaagctattgtagcccatgtaagcttagagtgacattatgttatattattaaatataaattataaaggaaaaatacatctgaaaaagcaactacataaatatacctaattagaagctgtatgtgtttatatgggtaaaaagcatagtgattgtatgtataactaaatagaacattgatctaaaatatttaataagatgcatgggttttggtcaagcaaagttgaaaaaaaggatgatttttatcacaatagtatatattatttcttaacaggtgtctttaaaggattgccatttaatgccattcaagatctactaagcatcatttttgcatgactactgcaaaaggattactttacagataccagttcctttgtcaagagcatactttggaccctgttttcagaaagcaggtatggttcatctttattaaactgcctataaaattgaaagacatgttgaaaaaaaatataagattcatgcatatccttaatggagctcctaatacaactgctgaatatgctaaagcttaatatgttattttctcaaattaagtgatttgtctttgaattgaaaacaccttgattgtgtcagtaacataaatgctctataaatattctgcaaatattattaaaagtgaaacacagtaaaatatttgttcttactaattttttagtttgatatgaggatggcaagtaactgaatgtggtataaaatggctgaaaacagtaagaaaaacagtactcagatatagcctcctgttccatgatatctttctcaaccgacatataatgtgctagtggatggcttttgtgctttttgtatgtgctcgaattttaagacaatgcttaaagttaaataagcaggaagtcatgggtggagagaggtagtgtcatccccaccagggaacggggatcttctgaaggcagacgacttttatgcagtttgcacaacagctccgcattcttacatatttacgtaaccaacagaaattactaaagagtgattcacttattttgagtgaaactgggcattgtgtaataataatcctttaaaatgaatactctaaaatactttgaaatacatcaatggacatttattatttacgactaagtggcaccagtagacgatcttgaattaaatccattgtgtgctatttaactacaatacttctgatgtactttttagataatcaaccaagaaggtcaatacactatgaatatagaatgattatctttattttctgcttatttataaaatgttgacaatagtgtacccaatttcaaggctgtcacttgtttatcctttaacttgttaggttaatccaggttaattgattcaaaataggagaggagtttcctcatcctactctatgctttcagtaccttcaagcttgaaaattagcattaaagaagagaagttactaaatgtggatgtgagagcagttcttttggaagatgtaggagtctgaagttttaccacgatatgtgattttactttctactagccacactcaaattctagcagctcgttgcagaaaatgttactttccatgtgtcttttattcatttcattaaatcatgccagtctgtcattttgattgcaggccctaactgtaccaggtatctctaaattaatcttgtgaagaaaagcaaccacataaaagaaaaaaatttaaagacaaagtataaagaagggaaggggaagtatctaacagtgaaacctcaaatcatgggaaaaaattgagttccatataaattaatccattgctatattctaacattagacagattgtaagccaaattttgccatcaaagttctatttgttacaataagaatgatttaagaataggttacatacacaaaataataataataatctgtattctgtctataaacgtaaacatcttggaagctgttatttcctatatataaacattttgttcttaactcataatcatggacgcaccttaacaaatcaaactctatatttttttttacttctgagatatctgtgactactagagataaattaaatctaagcaccttaattgaatttagtaatgttagaaacaagttgtttatgatgcttgtgacattcaaagaaagacaaccgaaccactgaacacagcacagcagctgtatgtaagagggtttcagatctaatgctcacttccagatggatgatggataagcaatttgaatttatgctagacacatcagcagatggaaatagaatagagtaaatgtcttggacacctgtgaactggtgcattctatcaattaccaaccaaattgtattaaattcatgtaattcaacagaagtctaattaattttttagaagaggctctttgtcaatctattaataaattcaggtttcaagttgaggatgtagagtgtatttaactgtacagagaacctgtggaatcaggtttggcagagcaaagtgcactcttattatgccatttttgttgttgctccttccaactaattgaaaagcatattggtagaataggaagcaattgaagcaaatgagacaaactgagcactccaaaaagacataagtgaattagaattgatgattctgacaagagtggattcacagtgtcattttaaataaaacgccatttcattcatatacttgcacctaatctgtcactgtaacaactgaaaacattcagcggcaaaactgacagtttcatcttgacacaaccaactcagttcctgccataataagaggcaatatatattaaaagcggtcctgagttcagcctttgagaatgaaatgtttcactcaataacttatacaactcatccaggagacactggctcagctccaagtggaagagctttatttcattagagaagagtctgaatggctctaggtttatagatttttagcattgccaggattctcatcaattcatgaagggaaacctctaagtatcaatgtatgcatctcttagagagtattacagttgataagaatagagtagaatgtgctctgaatttcaaaaataggaaatctaatgttcatctttaaagctcttgacaattacacagaaatttgaagagaaaaaatttctcatatcgtttgcgacataagtattgtgtaaattaacagtgctactacttgctaaaatgtttacagtgtggccagaattgacaaaataatgaaggaaggtggacggagacagttttgaatgaatactcgaaagaatttcttagcaattagagtgtccacagcaatctttcaagggtcatgtgtccagatgaatgaaaagcgtaatttcttatcatcaggaagggagatggaacagttccacacaaaattgttattcaacaacaaaatcctgattaattttgaggtggttcttatagacatctgtgttttactacttgcaaaaattggttatttattttaactacacatatagttttttgtgttttagaaaatattgttttccagtattttataggaaaatttgttatatgaagtataaaaatgcctagtaaggttggacatggtagttcacacctgtaatcccagccctttggaaggccgagatgggtggatcacctgaggtcgggagtttgagaccagcttgaccaacatggagaaaccccgtctctactaaaaatacaaaattagccaagcatgatggtgcatgtgtgtaatcccagctactcaggaggctgaggcaggagaattgcttgaacccaggaggcggaggttgcagtgagccaagatcacaccattgcactccagcctgggcaacaagaacaaaactccatctcaaaaaaaaaaaaaaaaaagaaaaaaaacaggaaaaagaaaaaaaaacctagtaaggtgaaactaaatagaatggcttaagtaaatacatgtataagttggtgtgaaacattgtaatctgaggctgcatgaatttcttggacagcatttatctctatctgccagttatggtggtgggacggggtggttcaagttggatatcgatggattattttcattatcagcctatccataggaaatatgttggtgcattaatattttccaagttgaagttcctaaggagatgtaagaaaactgaatttgcccaaagcaagaggaagaaaaataaggaatatattttagtgtgataatgtaacagatcatataggctttctagtacataaatttttgctagtgtgacacaaggcatccacaggttgaaaacatgcaaacactttcattaatatgaatgtatgcaaaatatctcctatatgatacttgctcagcaaatgttaacatttatttaatatttccgttgtggaaataactcatggaaacagaggaaatatttattttctggagtaagttttgagtataagaaaatttccatccacctctgctcacaaacaagaaatggaactcttagtctgaaggctcagtcacctgaacacctcaaggctgtcctacaacataagaagggctctatctcttcattagatgggtctgaaattcagttcatctctctgcgctaagcttagtatacagagtgaatcccagacagacaaattcttaactagatacagacttctgcttagaaactgtcacatatgctgagtgtattgaggcaattctaacaaatggaaagattataggctttgaaataagttaaaactaggattgactctgtgctgtaatatttgctgactgaagatacttggctgtatctcaatttttataaacctcaactttcatttgactaaaaaagtgaatactatctcatttttgtaagggtgcaaaaagttcacacaaaatcgatcttatctatatctgtacatatacaagcagtgacacacacacacacacacacacacacacacacacacacacacaatcccttatatttaaagcttggtatctgaaaagtgtttagcagatggttattattgtcatagaataagtagcatacatttttaaccaccgagtggactgaaacttactgaaagtctcgtaagacttaaaaaaaaaaggaaaagaagtacatcaggaaagaagggaagaaaggaagaaagaaggaaacaagaaaagaaaggaaggaagggagggaggggagggaggagggaggcaaggaggaagggaggaaggaaagggagaaggaagggaaggaaggaggaagaaaggagggagggaaggagagagacagagtaagggggaagagcgggaaggagagagggaaaggaagggaagaaaatatagatttggcctttgggcattaatatttgcattctcgggctcttgtgggatataagactaacaaagaaaaatgatacattcctatctatctgtcataaatgattagaaaatggaataaaaagagatctcatacataatggaaataatgattgcgtagtattgtgctggattttgggttagtacacagcaccctttcctaattcttgtgctctccagaatgttagaaggccagggactctgataactgtgtttctcaaaacacctgttagcaggattcatgatgaggtgccactcaatgggagatgtacaagagatagggaaaatgtaagagaagcagccacagtggcctcagatgcattttttagtatcatatgcctcagtgctggaagctgtgctaattgctggtagttatctagagttctgcaatgacccactctttgaaaactctcagtcattttaagatttagcagtggtctttcctgtcatttgtttcttcagcttttctaacagtttaaaacaagttgatatctaaatttctttttaattaaaatacctaaaaatttatttttatttttctgacctaaacttgataaaggagatgcctaaaaataaacatacacacacacatgtgcacacacacacattcagacacacacacacatacacacacaaacacaaatatatatatgcaaaagcctactgagatgcataaaaatggagagatatattgtgtttgtagacaggaagactcgattttcaagagtgttaagcttccctcaattggttttattttggtttaacttcaaaaagttaatttagcaaaattaagacagtgtgttttggggacagggtagagccttgcagtaacctttggaagatactagaaagctcagagaacattttctgcctctatgaaaacttgatatacaagtgatgtgataccgaagaccagtggagaaagaatggactatgctataaattgtgctagtaaaatatattactcatcaaaaattaaaataagatctctcagaatgccatacaataaataaattaaaataactatagatagatgtaggacttaaaaggcagaactttaaattttagaaagaagaaattggtaataatttaattacctcaacatgcagaaagatattttagacccacaaaaagcagttaacaaaatgacagaggtgactatagtggaaaataaatgaaaaagaaaacacaattgtgacaaaacaccttggtgcctagacttttaataactttcttttacctgtaaaataataataaaagaaaatatttagcaatcattacttttacatatctgcagtagatcaactttccaagtttgcagtttaacattttagtaaattgcaatgttgtatttaattttttaactcttcctatctctgcacattcagtgtctgactttctagctcttctcagcaaaggaataaaatatacctacttgattcttgactttgggtttagccatgtgacctgctttgaacaattgaattaacaaaaggaatagtataccagctgtgaggtcaggccttaagacacaatgcatatttccatgagccatgttgctcttttttcaccatcaagagaataatgaataaaaagagagacgtggaatagagtcatcccagatgaaacatcccagccaaacccagccacaatcagctgaccttcagccactcaagatgagttaatgataataaattactgttgttttaaaacataaagttttggggtgatttgttatatagcaatagctaactgatagaactattattcacaaaataatttatattccactaatttttgacaactcattatccccaaatatgcattttactttccttcactaatttctctgtttatattttaaccctatctggcatgccctatgctccaaattattccacttttcatgttaaaattaagatcaaatcctactatttccacaatgtctcagtctcatcttatatgaaataaaagaaacatgctgcataataactgatagtatcaatatttgttcttctgcttttattttctatacaataattttaaagcttggtattgtatcttataccaatctgtgccccgataatgtcttccacatagtgcattttaaactaatatttgaagaataaattacataagtaacagttgatatggctgatagtcacggttacaaagacagttttttttatcatatacatacgcctgttttatttacaaattatttctccagattgaagtttttctcttactctattatggtgtacaacaattaagggaaagagagagttaaaatgtaaataaggagaattggcaaccacgcctctacaaatgttaggtcatcttcaagtgatgatctattatcatcagtgacaagatgtcaaaattaggaagcagaaaacccctgcagctaatgtatggtaaattaactaattagtctattagtatccaagatcacactgtaaatggtttccaagtgtcagtatttaccttactaaattttaagaggcgatagccagaggttcaaatattggaatgttatttcatgaatgatataattcacttagcgcaaccgtatttctttttcctttgtaaataaagttaaaatatccatactttcatgcatcgtaatttagaagccgctacctatatatgctttttagtgataatttcatgtgtgaaaaagcataataaattgtccaaaaaacttcccgggtagcttttaaattgcacattgtggcacaagatcagtgtttagtcaaatctattctattaccatgattgcaaatgtcatttgtaaaaagttttatgcttttattttaatgctacatttggcaagctggtatgtttactattcaaacaattttttcttacctaattttcttctgatatgttgaaaatgggaaaaaaagaaacacatttttggatcacctgtgatttaggtgacttttggggctacacttacacatacaataaaacagataggtttcagggaaattagcttaaaaattgtagttgcttatacttataaattctcatgcattctttttgctttatagaatggggaaaatctgcaagacttagcatgaccaccacttcatagacttaatctacaaacaatatccatattttattgaatatttcctactatcgctatgcttcccaaatagattgattacttaaaataataaaacattttataattactttctgaaaataacttttaataatgtattaataatgtatttgatactaagctagcatgtggaatagaaaatatatttcaaatctctgagattttatttggggttaaaaggaaggtgaaaattttctgttgtgtctatatgtcactataggaaatcatattctaagatttcaatgatgcatggcagtggaaataacagagatgaatacaatagactttcccatagactgagttttccaggtcatttaactctctctagtgtcttcaaaactctccaacagagttaatgataacggattgtcatattattgtcctcatggtgacctgcttgggtagaagataaaaaatgctatactctcaaagctatgggtaaaaatatagtgattatcaactcatcaactttctctctctctctctcacacacacacacacacacacacacagtgcattgtatccttttattaaaaatataaattatcaagaatgaaatcaagagctgaaaattaaacaaaaaccaaaactaaaaaggccagcacatacacgccttgagtgataaaaatcctgtcctttgctcttaaaacatctcagactctcactcacaaatacacaggcatctttgaaagcaattcaaacaaattttattgtctggcttcacaattcatgacagggtaaaaatagaatgtgagaagatagatgggcctctagaaatacacacaggactattcaatgaattgagaattgacagccccatagtagcagctaaggaaactgtaagcatattaaataattctacttgcaaagaaactttgaaatagttcataaagtagccaacaggtgggaggatgtggtgatggatgtgatacttatcttaatttgatcattatacaatacacaggtgtattgaaataatagttacccataaatacgtataattatgatgtgtcattttaaaacaaaataaaactttacatacacacacagacacacatacacacatacagtattggactgagccacttcctaagcaatattagtatattgttaattaagtttgtactatccaataaagatagctactagccacatgtggctattgaatccttgtaatggggctagtttgaattaaggtgtgttgtgaaaataaagtacaacacaagtttccaagacacagtatgaaaaaaatgtaaaatattttattaataattatcatttcatgtagaaattataatattttagatatattgggttaacaaaatatattttttaaaataattcttttttcttaattgttactattattttctttttaataaaacatgaaatatagttctaatacacattgtttctgtattgcctgatttgagtaggagttatttgactttctggccctcaacctaactatcagcaaagccaaatagacatgcttgaaacaataatggacattcagtgtattcctcagcaatacttcctctggaagtcgtattcactggcaccagagctgtttcaaccactgcttctaggccaaattggaaaacctataataacagcaatagcaaatattcagcatttgtttgtgaagtgtcagaagctgttctatgattgattctcacagcaacttactagttcaagcttattaatatctctaggaatttaaagcagtgagatcaagaagtaactagttgagggagtttcaaacctctgcaatcttgttctaaagtctctgttttttagccacatctctcttctgccatacagaagtcttcaatcttttaatcctgcttatgaaaacataagttctctggagtcatgttacctatatggtgcccatgctaaaaattctagacattttttataataaaattgccagactgtttttggaagttgctttagtctggatttcctttaggcatacaatgaaaatagtttaacaggaggtgacctgaggaagcaagcagaagtgagagggtagggaaaacaagaccgagaatggagaaaagtcgagaaaggacataataatgagcaggtccacacatgcaagtatatggagcttcatcttgctccagcttcttgtatatcttccctctgaggtttcatacaaaacatacctcagaattctcacaatgatagatggaaagctggggtaaatatgtccctaattaggctcatgggtgagggttgactttagggctgttaacactcagattcctttcaagctgccctgtacttggttgaacaagcctccgtggtgctagagaaaatcttgaggcagagaagcaggatgagactcggaccctcgagatgagacaatgagtacaggaacagtcctctatgcctgcaggtggactgattcaccattgtggactggggcattaacagcatctgctactgaagtgtaattaaaatatagtcagattccctggaaacacagagaatcctacaagattctgtttgagccttcttcagcctaaccttattcttggataaaaaaaaaaactttttgtttttagattgctgatttagcctttaatttatcggaggggtatgtttgtacacagtagtaaattcaataaatgtcaactacattattttaactagtccctctaacactaggaaagttcagtcaaaaatatcaatcaaattagctattaggtatgaaattgtcaaattggttaagagaatgtttcacttttttgtgtgatgagcttatagcttggataaacaacctaagggtataatttgtgcactctgagttgcttgaatggcatggcctcaaacgggtatgccacgcaggaaataatctgttgtggaattccttaaataacatttattttactatttgtcttatatttctaatactattactgtgaaatagtaattctgtgtaattcacagtaatagtattactgtaaaatagaaatattattgtgaaataaaagtgactttttttctatttattccacaattttcttaatgtcttataaactagacaagaataagaaataggcctggtgcagtggctcatgcctataatcctagcattttgggaggctgaggtggtcagattacctgaggtcaggagtttcagaccagcctggtcatcatggtgagactccgtctctactaaaagtacgacaattagctgggcatggtgctgggtgcctgtaatcccagctgaggcaggagaatcgcttgaacccaggaggcagaggttgcagtgagcctagaccacgccattgcactccagcctgggtgacagagtgagactctgtctcaaaaaaaaagaaaaaaaaagaataagagctaaaatgtttactaaacagtagatatagaaagaagatcactatgacagcatgacaattcacaatagtaaaagggaaacatgcttggtgtacagatttttttttacaaatgaccatgttctaaagaaatttaacaagaattttgaagtcacataaggacacatacagagtatttcttcatgccttttgaagctagaaggggaatcagtgtatttcttaataatttttctctatatcttgtcagagaagggacagtccgttcaattttttcctaatattaaggtgtatgtgaaatgaagataagcataatcttagaagagacttttgaaaaacatgttgtagctgtggaatttaagttaatttataaatattacagttaaatagtgcagagaccagctcggtcggggagaccctaacccagcagcgctagaggaattaaagacacacacacagaaagatagaggtgtgaagtggaaatcagggatctcacagccttcagagctgagagcccggaacagacatttacccacgtatttattaacagcaaaccagtcattagcattgtttctatagatactaaattaactaaaagtatcccttaagggaaacgaagggataggccgaattaattgcagcaggaacacgcccttaagacacagattgctcatacgtttgtttgcggcttaagaatgactttaggtggttttctgccctggacggaccaggtgttccttgccctcattcccgtaaacccacaaccttccagcttgggtgttatggcgattatggacatgttacattgctgcagagattttatttatggccagtcttggggccagtttatggctggattttggggggcttgctcccaacaaaatagtaagttacatatttttccgggactatctattattttccacttgaggctattcaaagaaaaaaatgtataagaagtctttttttggaatattgaaagtataatgtcagtagttatttctatgttctataaaagtttaaaaaaatcaaagcagaataaatctgtactaaatgttgttttctttactattgaaatgactactatcacattaaaattggaaaaattattcaactataggatatttcagagtattatatgccatattacatgctttagtttaaattcataaacttatttgtaaaaattaaattgctgtaaaatagaaaattaatttttctatatatgtcttttggaagtggttccttccatttacattagcattataagtaggtgttaattttatactgttatgaacacaaagcatctttaaatatgcaacacaatgaaatatctgctatttcattcaataatatctactcatttaaaaatgtttgacttacttatctttccacccagcctggtcaaacagctctatacttgagtctcattctttttctttcataaaactgcttttattgaattgcattttggtctttgctatttatttttattgaggggcataataagattcagtaatactcaaatcacaagaatgagtagggcatggtgtccaccatgtctgacagggttccattagggggttggaacagaatgaggggtggagaatgtctcttttttcttacggcagagaacagttgttcgttttggggataactttttttgttgctgtttaattttattttgttgctatttttaacattcagtgagaaccagggtgtgtatttattttaatctccctgattctgtaaaataatgtcatttatagtatttcattctgctttggctgatgtgaggcttaaaatcaaattaaagccaaaatgggagccaagaaactgtactaggttttatgatgtcttccattttcttttcttattggtattttctctatttgtatatgctcatttattttatttgcttattttgtttatatttatgtaaattgtgtcaactttagttataaaatgtgttaaataaataatctaggaaaatcattataacatcttttttctaattttctaagagttttgttggtgcttaatcaattttatgtattttgttcattcacagatatatatatatatatatatatatatatctgtgatatatatgtgtgtgtttgtgtgtgtgtgtatatatatatatagtgtccattatgagtgaactagaaatatagccatgaatcattttattagtccttatccctatagataaatgctgaggggatggataccccatctctatgatgtgcctatttcacattgcatgcctatattacaacatcttatgtactccataaatgtatacacctactatgtacctacaaaaattaaaaatgaaaacattaaaataaaaaaactttatccttttgaaattcactttctagtatgaaaataaaggtattaaattaatgaataaattaaaatgcaaaatatttttaagtgatgaatgtcttggcagaaataaatctcagttaaagggatagagaatgttatggttgggtggttttttgctttcgtttttctgggagattctggaagacctttttgctaagccaatgtttgctctgaggcataaagaatgtaagggtgccagtcatgtggattttttggtgacagaagggacatcaggtgaaaatgtcctgaagtggccaggctcagtggctcacacctgtaatcccagcactttgggaggccgagacgggtggatcacgaagtcaggagatcgagaccatcctggctaacacagtgaaaccccgtctctactaaaaaaatacaaaaaaattagccgggtgtggtggcaggcgcctgtagtcccatctactagagaggctgaggtaggagaatggcgtgaacccaggaggcggagcttgcagtgagctgagattgcgccaccgcactccagcctgcgctacagagtgagactccgactcaaaaaagaaaaaaaaaaaaaatgccctgaagcaagaatgtatttgattggactagagaagagtgagtgagatggagagtgaaaaaagtgagataagagagctggtaggataaaaccaaaatcattttttagaaaaaaaaaatacatcagtgtgagatattgtgtggactttggttttcaccctccgtaagggtatatatagcaagctggtggagagttttgaattgagcaatgtcgtgatttaatttacattttaagcaattattgatggattagatatgacatgtaagaaaagggaaagcataaaggacgatcccagtattttgttccttaggaactagagggtgggagttccctagacaactagaaacaagattcttcttgttgagattgggcaagtgtcagagaaagcagtttgggatgggaagattaaggagatcatttccagacaggtgtggggtgcgtatttgatatactagcaaagatgtaaaatagttagcaggacatataaatttggagtataaggaagctgagttgtctggagatataaaattgaaagtctgcactggtgtgtctggcaatactccaaaagaagacaggaaaagtaaggattatagggaccaaaacatagattacagagatgtggataattaggggggaaaaaaaagcctgagaaggagcagctacagaaattgaaagaacaagtgaagaatggtgatgtagattataaagacttaaggaggaaatgaaaagccatgacaaaagctgctattggttagataagaagttaggagtgactttttatttgttttggtgttactgttacttgctaagagcttttgcaatggcgtagaagttatggttgaactgaaagcctggtctgagtgcctttgagatcaaacggtaggagaaaaagcaaagaaagcaagtacagatagatttttctctaaagcaacaattactaatagaaacaatcataaaaataattctataaaataatttaatgaaagtaattaattgcaaaagctatggtattacaattacataaatctacattaaacatattcatgaccacaaaatataattccattgattttcttagaaattatattttcaggctgctaactgtcaatattttgggtaaacttttctgcttgattctgctgcttctctaatctcccccattttgaactgcctggttaaacagtaattcattaaaggtcatactttgggtgaccgaaatacttgatatcttataaagcatttgctggcaaattttattattatgtttgcatctcataccttttgtaaattagataaaagcctaacaagagatgaaacaagaattcaataccatcttgtaactggaagagaggcttctctatgaaagtatgtttattctaatgaataatcatagcaaactgaaataatttaacttctaatatcacaataaataaaacattgaatatttatttaaaatagatgtaaatatgtattacaaacaaaatacaagtttccctaaatgaaatatttggaatttgttttcagactaaccacatgtgaatacaaatagtttacatatataatctcattttatattatttcaataatttcatagtatgcctttttgaagcattaaaacttagaggtagtctgcaagtatgaaattatatggaatttgtcatcaggaagcacgagtttgaatcccaattctagtaattcaaactgcatgatttggagcaaaccttcattttctcaggttcttcacctgtaaaattggaataatcagaatatttaccaaactggatcactgtggaattcagtggaatgtgctatggtcagtaagtcacatgtcttgtactctttgtggaaggggaagtatgttatctacaaacaacaaaaagaggaaaagaaaagaaaaaggacaaacttaaagcttatatttaaccttacaagaacgttttttacttgaaggtcattaatcagtctctgttaagttattgaggagacaaaattccagtgatagaaaccttcatgaacaggccttgagtccagtttcttgaatttgcaattcaagaaaaattaaatgacaaaccacggctgaagaaaagtactgtgagagaacaaaaatagtaaagaaaacactgatgtaattagcatccaaggaggaatcactacaataatccagatttgaattctaataataaaagttatgatttaaacttgattcaagagcatcttggcctgcttaataaaataataagctatctaacatatctagtaataaatcagtgtttatttgtcatgctgatcttttccatatttaaaaatagtgttagtctcagaaagatatggaaaaaatagtcttaaatatcagaagcaaacattttacttgctatttgtaaataagattttacagactttaaaatattttaaaatttacaatctagtgtgtgtaatttgactcattgccacaaactatttctcataacttgattcagagacaactgtgtgaggagagggatatatatgggaaacctgaatcaatgctacaatgataaacgccaaggcttttacctataacataaaacaaagtaggacaatcattttaaaaattatttatttttttataaaatttgaaatggtgtcattttattatttaagaagcaggcaaacaggcgtagtgactcatgcccgtaatcccaacactttgggaggccgaggttggtggatcacttgagtccaggagttcaaaatcagccagggcaacatggcgaaaccccgttatctcaaaaaaaaaaaaaaaaaaaaaaaaaaaaaaagcagggcgtggtgacacgtgcctgtgatcccagctaagcagctaaggtgggcaggatcccaggagatggaggttgtggtgatagtaccactgcactccagcttgggcaacagagggaaagcttatctgaaaaaagaaagaaagaaagaaagaaagcagatggatattagtgcccaaattcaagtgttattatactgtttatttttaggactataaaaaaatctttggatacaattaattagaaccagacaaacttaaggtgttgttctagctgagatattagtaatattactgagtctgtgtagaaaataacttcaatgatggtcatttgtcatcagattaaaaaaaactgagatatacaaaacaaaaaacaaaacaaaacaaaacaaaagacaaaattttgtaaagtggaaagggagcattagattgctatcattcaatagttgtgaagcttggatccagaatagaggatgctgcagtgtcattgtgctcttttcttgtcaggcctcatctggaagagaggcaatagcaagctgcaggtggctggaaagagaggagggatgacgaatctttatcacctgggaaatgatgaaagaaattgaggatgtgtactctggaaagcagtagatttagacagacacaatatgtatgttctcagatgtttaaaagtactgtcatgtggaagatggattagaataggtatgtgttgctccaaagaatagcctgtggaccaagactagctgtcagaaaggtatttcagctcagcatgataaaaaggtttctgactctgaattacatagtgttagtgagtgcttcattataagacgtatcctgttctgaaaaagtagactaggtatgatatccaaggtcacttctgacactaagaaatctttgatttttgtgaattaaagtatattttaaatgtccattctcagttttagtaaaaagccctgtgcatagttttaagataatctgaaaaatttatattattgtgttatacgtcgatctctgtatctataccttctaatatgtatctatcttttaaattctgcttaaagcaagctgctttaaaatttttcaaggagcatttttgaaaaacttatattcttaaaatgaaaaactcataatgaccagtcattcatttaaaacatttgaccacatttcgacctacaaaaacagcagtttcatataaatcaatcagatactatgggtcaaataatgtgttagaggtgacaatgaaacagggcaagtaaatgtgtaattacatagagtgtgctaagtgaaacaaaaaaaaatttacagacgcttgtgaaagcctcatttacattcataaaatgtcatttcaagaaaatccaacatttgaaaatgataaacctaaaaaatacaatgtgactatttataaaatagccttctcatatagagataatacctgataaatttaattgccaaacttacgggaagacaattgttttgtgactaagcacacccagccccacatctcctcaacttcaaagtgcgtaagttttcggtagaaagtctatggcacgaggaagctttcccagttagtgctaagagctttataaggtaggattttgtccaccgatagatcgataacttgctgataagtaaaattaaggatctgtattttcaaaaaccttttaccagacatattttggaggaattacctttctcattgtttacctcaatccttagttaactgaaaagaataggaaaaaaattgatcctcactttctttcaggttttgattaaagctgtcaaaagagattcactcagaaaactcttgttactaatcacacattgtttcattttttaaaaatcctgatctgacagggtcttcatactaacgtttatctattatgttaaaaataacaatttttattacattaagatatccatcttttgaaaaatagatataaaattttttagttcaccacttttctgaaaaagaaagtgaagataaatacatctaatgtagcaaagcagatcatataaataagagcaaaataagtaaatagaatggctatagggtaatagaaaaatttaaatcaaatgtcatcagtgaagctcgtgatctctgctccgaaaagcatcaaaatgagcagcacactgcttggtgatctgcacagacaaggggtgaaatgactgactttggagacccagctaagggagcattcaaaaataagaaaagtatgtttaaagaagaaatgttacaatgagctgtaaggccccttaaaatctagttaattgcttgttctccaagaccatagtatattttaagtcactacccttacaagattagacatttctggacctcttattgggtagacaaaagaaaagttggaaatgtgtagctttctgcatctgaagggcctgtgatggaacagaaaacataatggacatagtcaagacccctggacgtggaacctttttctcaggccaatatttgaattactcccacttgtactgattccaagtgttaaattactcaaaagggaaatttaggactcctgtaaagcaagcatataagccatatgaatacatatatatggaagtatttcatatttaaaataaaacatacactcaggaatactatgaaaacataatatgggaataatattgctcatatattagcgctcagtattgtttttctaatgaattatacactgttgttgagggggatataatctttttagtgacgtaaactgaatctaatgacttattaggattatgtggtttactcagtcctttcctttcaactatcccattcctatcttcacctttgtacacaggcatcttaaaggcaacttaaaataaatatatccaaaccaaaacttatgccctcatccctgtggtggattgaaacatttttctcaattcttaaccttgaagcacccaatgaggaaggcgttatcactcaaattttacaaaaaaggaatatgaggttaaaagaagcaacatgtaccatgtcatataacaataatagctcaagatcaagatttgatccgatgtctaaagagcgttaatacctgtgttttccatctgagaagatatgttaagaatgatatgcttggaaaagactttcagtcttagttctattaaaatgtagattatatatatttgttgctatgcatatgtaaattattacttaattttcctcagaataactgtaaaatatgcctttcattttgtatactttctcctggcccctttgaaatagaattattaaaaattgattgtatttttcccaaaggtaagagtaagtagaaaacctcaagtatttcaatcaaaaatttcaaaacaaatcaaaagatacatgagagattaattacatacattaatgcatatttcataatattgaaggaacaaaataaagatgaaaaatagttagcccacattcacaccatgctaacataatactttttaaagcttgtgttttctttcagtttttgtccataggcgtaaattcctatcattattatagcacagatctaattctatatttgactttttcactccacattatgtcatattgtgtgaatactgcctctaaatattgacttccaatataaagtatatagaaagtcagtagaggtgctgagaggcaagcaataattctgcttaattgatgatgatcaacaatcgattgattatcaacaaagaattgaattaattttgaaaatgtaatgcaaaaattgtgaactaatgtattttcaaaagtgtctatatggtattgcaaacacctgcctttcttctctcatctccaccaatactcagcctgttttgtgtccagaaggccttgatctcctcaggcctggtggcccttgtgacagggattatgattacttcgccatccctggagagagaagcctaccgaggtctccactactgtggtggaggaggtgtcagctctcccacaaggtgtaccctgctggcaatagtcacagctccagtaaggagttgaacctcaccagagcagggtgcacttgtgactaagaaatagctgatatggactgaatgtttgcatttctccaaaattcttatgttaacgcccttattcccagtggtattatatttagagatgtgacctctgggaggtaaggtaggttagaataggtcataagtatgaggccctcatgatgagattaatgcccttatgaaaagaggaagagacacaagctcgctctctcctgtgtgaggacacagcaagaaggcagccatccacaaatcagaaaggaaaccgttaccagatactgaagctgctacacctttatcttggacttcccagcctctggaactgtaagaaataactatttgttatagaagctacccaccctatgatattttgttatagcagcccagactgacaaagacactagctaaatgtcattgactgatatgagacactatgttgttttgtatgcaaaatctcatttattcattgtatcagatctgagaggcagagagttttcatgttcttccagagtttttacatctttggcttaatatccctgattccttcaagtagtccttgtgtcccagagtttcaagttcaatcacaatcctggttattctctaggccatgtctttatgctactgaaatagtcctgtcacgtggatagttgtggattctaggaaaatctctgccttttgtgtttctatactagcacaaaaagattattattatcaaagggtaaaacaatgacacagggcgtgggaagtgttataaaacttccaaacaaagaaaataaaggattttatgaatctcaatgtttagcttctccactcactagaaacaaaagtaattaatataataacacataaactatatagagaaaaacataggctcaaataacataatagctatattaaaatttctttgttttcttatatctaataagagaaagcacatatcatatcacttttcttaggctgttaggcagttcagtcccacttttcatgagtctgacctgatttcaatttattttgcactttaattaatggaaaaataagaagggaggttaagaatatgtgtaacaagggtgcacagtgtgtttagtatgcgttatttgcatttttttggtaactaaatgacaattctaccatgatattagccccgatatttttcgttctgaggtgggtaggagttgtttctgtcagcagaactcctgctaaatgattcactgtcatttctccccaatataatgtgctattaataattttctttactaaaaaggcactactctgctattgaaaataagttttgtatattactttaaaaatacgatcaaggtgtaaagtttgttgtaggcaaaaatattctgcttcagtttttgaacaaatgcatttgaacagctgaatttgtttctttatatggttgaattatcattaataaataatgttatttatttaatgaaaataattcattagattactaacaaattaaatttaaataattgcacaaaagatcactgctactagcctatcttcttagcggatcacgaggtcaggagatcgagaccatcctggctaacatggtgaaaccgcatctctactaaaaatacaaaaaattagccaggcgtggtggcaggcgcctgtagttccagctacttgggaggctgaggcaggagaatggcgtgaacccaggaggcggagcttgcagtgagccaagattgtgccacttcaccccagcctgggcgacagagcgagactccgtcccccccaaaaaaatacactagaacagtcttctgaagtaattcaagtatgactggttgaaactttaaggcctagaacatattgataactcttctactaccatgtagttatgatatttttgattatattgaaataagtctgctgaggttaagttcggtaatctggatttaaggaaggttttatatctaagcctgccaactgcaaatggagaaactccaacctacagactgccttcggatatttttttaactccttagtttaatcacttcttctggatagatggcatggtcccaagatccttcagatccatctaccaccagttagacatggtctactttggttcagataatcttaagtttcttaattttccagttgacagtgtgtatgtgtgtgtattatatatcacatatattataatacatgtaagatctgtggttttaaatcattacttttagctttggaagactccttggtgtgcacagcactaatataaaactctcccctgcaatgtcacccagtggtgcctaagtgctccatgtgttcaatcattgatacgtgcattccacaaatacatactgagcactctgtgccaaaggttcactatagcaggttcagtatagccaaataatgaaacaagcaacaaagatccctacggtcacaaagcttttattctagtgggtgatttcaaccaacacacaaaatgagtaaataaattacatggttattagatggtggtaagtgctatagagaaacgtgaacaagaatgcagtgatctgggtatgagatgacaatcagaaacaccatctgaaaagctaatattagtctatggccagaccaccctgaatgtgcccgatcgtgtctgaaagggcaatattacagtcacaagctgaacaaggggaagctttcctggtggaatttaacatatgcttatgagaaacccaaatttttcaatactcctccatagtcatgctataaatttttttcctggccgtctgccagaaaatatctggcagagatatagatagattggccactcttctccccactacccttaagtgaactgctgttcagctccatggcatttatgacagatttttttcccctggttttggtccagtttcttggcaagctgaatttaatctgacttagtccttacgttcccattgccaaggtacacacaacatgtttgggcatatggtcttgtttttatgatcttttaacctttatttattataaatacaccatggtgtaatggatcatttgggggaattgaacacttggaatgacagcaggtccggttgaggccatctggagatgttagaagggagaagtttgcttccttgtgaactaaacttttaaagggagttaaataaaattaactggaaaacttgtgataaactcatttaagaacaggatatggtggcatgtaacatagatgagtgggttgaaggatggataagaatgtgataaaacaaggatacatctctattctggaaactaatattctagaataagccatcagtttcctaccactgatctctctgattttagaaagaagatattctaatgtgtgcaaaaatgttgtcattttcttttcattttagacgtggacatagtgttctcacagcctacctatatacataattagaatgaaggtgatagaaggttgaaaaaaataaatgtggaagaatatttttttcaagttatattgccaactaaagtcccttttaatgtttactttgtgtgttttgatggtgagctgtctcctagttataattaggagttttatttttaacactaaaacacctttaactacaatgtattttagcctaggtgactgatgtactttcccttccctagtatttttttcaccttttaataattgctatgtatatgaaaagtaagcaaattaacaacggaatgcctaaaatacaccacctgaatgcctaaaatttttttaaagaatgaaaacaccaaatcctggcaaagattttagatgttggaactcacattcattgttgtggagactataaaatggtctaaccactttagaaaaactttgtgcgtttacttataaatgtaaatatagatatgcactgtgaaccagcaatttcactcctaggtatttacccaagaattataaaacatatgttcacaaaaatatgtgtacgagaataaccaaagaaagtttattcataattacctaaaactaggaagagtcctgctgtctgttaaaggtgaatggataaacaaattgtgatatacacaaaagaatactactaagcggtaagaaggaacaaactactgatcatgtaacagtatgagtgatctcagaaacactgtgctgcatgaaggaaacctcagttaaaagagtacatacagtgtgattctatgtctatttagttcttgaacagaaaaatgtcatgtatgataaaaagaaaacaatcagaatagtggcaatctctgaggatttcggtaggggatgattgagaagatgtgtatgataattttctgtagtgggaactaaagtgctttgaaaatcccagcagaaatggattttactagcattttactttgaaatatgcaatatttattaagttagttcctaaaaccaagcagaaagaattccattttatgagagcaaatggacccagggaggggatcatcacacaccaaggcctgtgggggtgggggcctaggggagggataacattaagtgaaatacctaatgtaggtgacgggttgatgggtgcagcaaaccaccatggcacatgtatacctaggtaacaaaactgcatgttctacacatgtaacccagaacttaaagtataataataaaaaaaggtccatttaactccctgttatactagtaattattgaactctattgtgtactgatatagaggaagccaagtactatcctaaatattttgcctacattgctacacttaccactcccaataccgtgaggtgagaattattggccctgttttgtagatacagacactaatgcttacagagtctgaacaactttccctgccaagcttgtgcaggctctgtgggatggaactgctgtttaaattcaggcttgcctaactcagaagtaatagttgttgtggtatacaaattcctccttctatgcttacattttatgttcctttcattttaaaatccttcctctttcatctaatttatagtgtttaattataacatatataaaatacctaagcattagtattttcagaaataaatgatggtataaacgattaaaaacacaaacataagattcctaatttggtcccaatctacctatacagtatttctcttcatgatagatttcccaaattgattggaatatttaaggttctccagtgaactactatataaatcaaatttgaaaatatggagttcaatgttactgaggctgtcatctgagtaggaaatgccaaaagattacaaccatcttttttgttctcctgccaagtagactaggcatctgccaaggaacctcagatctccaatgaagcatagttgagtttgaaaacacagagttaaatacccactgtggctggaacctgattagaacgtaccaaagggttataagattttttattcttctgccaaatcaactttgctcctgcccaggaaattgaaatataaagcagatgacattgacaagacaaatgccattaatagaaagaggtatgtaccatgcatgtacaacacagattaagacagtaaatgcccagcattgaatgaaactagaaagtttcgaattcttcaaagtgtcagatttgtacatgatagctgtgtgaatatccaggaatatgaatagacctgagtgatttgtggaggagcctgttgttgttcccacaaagactgctttctaaaaacctgtggagtgacctcacagcattaaaaaggcagtctgcaactaaatgttatctatttaggatgcctattagagccaaggtattttattctgtaaattggctgtctcattcatagacaggtattttgagagtattaatgcagttgaaatggtttttatggttcctttccttccccatcatatatttatttttctgacttggctcttataatttacataatagcaaacataacttgtgtaggaagacagaaatttaatcatgatgagtcaaacataccaaaattttcttttcttttttttctataactgatctcatgttgtttggagcccctattcctaaagttgaaacaataaaaacaataagaaaattaaacttgccaagtaaaacccagtcttccttactttccacaatttctgtgtagatagatattcagttagctcacagaactccctagcaggcattatcttcccagccaagaggtatcatctttcattattcctttccaagattgtctgggacaaggtgggagcttatataaccttgtgttgaaaagggaagaggaaggctctggcctacgtgctgtccttggggtcaagggccttgtcgcacttgtcaacatcacttctagtcttagttgccaagtgtcaacacctggcacaaccctgagtgtgttttcctgactgtcaatgcatagagatggctgtctgcctcactgaccaggcaagccagctcaggctctcccttataccacagatcctttgagagccgggcggtgaatctcttgtcgttcctttcttctgtgccatcattagccacctgccacttgcccctgccacttgcccccatagctccagtaaacttaaggatttcctataagccctttcagacagggaaatagaaagacactatacaaggcccaatctagctatttctctccagcagtactattgctattttcaagttactcaataatatgaggaaaaggcacaaaggcatcttacctgccttgaccgcctataaatcccacgtttttataaagtattggtttctcattcaaactgatgtaagtgtacttcatttacatttatgttccaaaaattattagtagactacaaaattttttcaaaatagaatgacacagggaattctgggtgcttgagtcttgatccagttgagtgtatgcttgtccaaactagtatttgggaaagtaagagcggggaatggtaattttgtcctggcctatccatatgtttcactgtaccctgcatttacattgtatttgataattttgagactgatggagtgcaaacaatccagttgctactatctccagcatatatctagaaaagattgaatcatggtcagatttaactttgcatatgtatggctaagtcaaaagaggagggcctccttcacacaggcttaccatctataactcagttccactaatgaggatagccaggactaccaagacatttgcagatctgttgcctaagaatgaggttaatttctctgctgtgcatcctgattgtcctgacttttttcttttgcctttaaataaaccttgtttgattacccacatcatagctgtgtttgcactcaccatcattttgaatatattattgacatttgtccatacagtggtgttcttgtttataagtaactgctccaaagaaaaaaacgtttaccccacgtgaaggctgttcctcagttgcttggttgatttagggatatgtgtagtttggccagattggcatgatgatattttgtcaatccagtagatggtctaaattcatatgctatataattcatagcatttttagcaatcttagcgcatcctaagacatcaatcaaaaggaattaacgtgatacctcccttaactacaggtttcttaagaataattaatcataattggctttctctcactccacaattatgtattttcaatatagtaaatgctcatttagtataacatgaatgctacattatgctacatgaacccacataagcatgaccagataaatcacatgctatttaaagtatattaatacacctgtgaaatatagtgatatgctgccaatcatcatttgaccttagaataggggttgggcatgttttcagtgtagttggtcatcaattaagagttcccgggaccttgtttagatccagataagcctaaaattttttgaagaagttctttaagtccagctgaaactggagattgctataaggattttaacacattttatagatttatgaaagacaacactagtcagttgaaatgcggataatttttctatgatgttgtaactggaaataataaaaagcaaaggggagacatcagcgacccctctttttctcataccccgtaatcagtgctaagtgaattttaccagcataacctctaacatattccacattatggtggctgttcaccctctgcactatactccaaaccccatgatctctctcctgaaaaatcaccacctaactggcctccctacttccaccattgcctccctggtctagtcatcttgaagcagcaaaagtgattctttgaaaatacaaatctgagtataacagttccatgtttaaaaccctgccatagctgtacatcacacaaagtaacaagcaattcttatcatggcccagagaaaattcacaatctacagtttctggcgctctttccatcctttagccctacccctctctcctaaatactatggacagacaggcccccttgcagttccttaaatacacttatctcagggcccacaaaactgctgttatctctgtctggaaagaccttaatcactggtaattttgtggcttgctcccttattttatttaaatccgttttgaaatttcacctcctcagatcagactttcctactgtgttatcttaactagcacactttctactttccattgattgtaacatgtttcgtttttcttcccttgcacatatcaatgcatgtattatttgtctgtttactggatgccttgcctgatactacaaatgcttcataaagtcagtaattcttttttgtttcaatagcatattgttagcctatagaacatatgtcctcgaatactaaacaatgagtaaatatatattgaaataaatcattaattaaagcataataaaatggaccctgtgctctaagaaatctctctgggaccagtttcacatgagaccccaaaacaaggataactttaatccataagacccctcagtgcaagtagaattggattttgagccatagtgccctgaatttggaaaggttagagctgcagagtctttctctttgacacacaccacagggcgttctgtggatgatggtggtggaggggtggtgctgtcatctagaaaaagtagagtgtttttgtgctcatgcttgtgataaacattaccaaaattttgaaaagtggttttcttcaatgacttagtatcttaatcaggttttagctcccaggtacctaagtctcctatgttatgggtgacccaagtcctttttagacagcctataatatcggccttaactagtttattgtcctcatggtcacaaatgcatctgtcatggtttttttttgttttttttttttttgttttttttgagacggaatctcgctctttcgcccaggccggagtgcagtggcgctatctcggctcactgcaagctccgccacttgggttcatgccattcttctgcctcagcctcccaagtagctgggactacatgtggccaccaccacacccagctaattttttgtatttttagtagagacggggtttcaccatgttagccaggatggtctcaatctcctgacctcgtgatctacctgcctcagcctcccaaagtgctgggattacaggtgtgagccaccgcgcccggcctctgtcatgttttatataattccaatacggacattttttacactatatataatgccttaaccacccccccccaaccaagttttagtgtggcttgtggggtttctcaagttagaaacaattttaaacaagtacacttctagatctctacaaatcatatgtgaccatgtatcaaactaatcataagagtcactctttattgagcatttactatgtgattgacactcagcatttaaccaggcaggaggaaaagcataatttctgcttcacaggtaagaaagttggcatggaaaggcttatttatacagtatgtacaggattgctcagtcaatcttattagtccacactcatatatttacatacttttcagcagcatctttcatgtataaccctcctcaacatcatcaacaaacacttttgaacacctacgttgtgcagtgcaatgacttcgtttttcaaacacttaactggaagaagtctgtccattattctgtcaaccctcttagagtatatttacctttaataacaattccagaatgattaagagtcaataaatataattctgctttttaatgtataataaaacaaaatcacatttgatgaatgttcctaggaatacgaaaaagaaaatagaattatatttagtcaggcatattaatagaattattattaaagtcaatgggatttctaatttggcagggtttgattcaggaaataattaggttctgtatttggaattaaactgggcttctatttttaaagattatcttaccttaacaattggaagaataaagatctttacttaaatcagtgaaaaacatgtgtatataacaccaagtgtcatgattgtcaagtatagaaaaaggaaactaacaataattaagcaaccatttcatgctaagctcttaatttatttttctttagtataatgttatgcaatttaataacccagtaaggtacattttaatacttttattgataggtggcaaataaagagcctaaggaatttgatcagggatgcttcgctggtcaaggatggcagtggcgtttgaactcacagatatgcgcttttaaattctctcatattactaacaccttgttgcttcttaaaccttatttgcctctttttaaaattctcagacttcaatattcccctagtattcaatatagccaccagcgtatacctgagatccaatagttattagcaactgaaatagcaaaagggtgagttattcgcttagagattttcttcataactgaaattaaataacaatattatatacttgaaattacataacaatattatatacttgaaattacagaactcctttgcaagcttgaaaacacacacacgctcctccccacccccaccacacacacactctaaggtttattttcgacaaaataactaacacagcattgataatgataacagagagaagaataatcctctatggaatattaaaactcagaaatggctctatagcatatgcaaaataagataataaaatttcatcacagtgagttttggctcacttgtagaaatcagatgagatcatgtgaaaatggacaagtgttataataaatttaagttaacactgctattcttacctgagagtagagaacatttacaaattaggtatagaaaattaggttatttcacttccgctcctgcccccacctctcatctgttatttatatctatatgtgtccaatattaagactctactagtgtctcctttgaaacactttcaacctgtagtcccagctactccggaggccgaggcaggagaactgcatgaaccctggaggcggaggttgcagtaagccgaggtcgcgccactgcactccagcctgggcgagagagggagactctgtctcaaaaataataataataataaaataaataaataaaataaaattcatcataagaatgaaattgaataataaaataaccttcacatcaaatgctctaccttttcactagacagagtctcgctctgtcgcccaggctggagtgcagtggcgcgatctcggctcactgcaagctccgcctcccaggttcacgccattctcctgcctcagcctcccaagtagctgggactacaggcgcccgccaccacgccctgctgattttttttttttttttttttagtagagatggggtttcaccgtgttagccaggatgatctcaatctcctgacctcgtgatccgccagcctcggcctcccaaagtgctgggatagcagccgggcgcggtggccgaaaccctgtctctactacaaaaaattagccaggcgtggtgatgtgcacctgcagtcccagttaccagggagcctgaggcaggggaatctcttgaacctgggaggcggaggttgcagccagccaagatcgcgccactgcactccagcctggcgacagagcaagactccatctcaaaaacaaaataaaaataaaaataaattgtcattcttaatttactatgagtttcaggccaacattaacatgagacaccaataaacttaaaggacactgaaaatcagaaggcaaatattatttcaaaattaaatttaaaaaattcaggtgacaggacatacatttatttttaccaagtgctagattatatatggctacatagaacttcagacattcagtttactaatattacctgtcaacattgattatttgtgttattagaaaattagattacacctaggaaactcaaacccctcagaattatgtatgcaatgattgaaaatatttcttccactttataggaaaaaaaagtaaagcaaaattaaacaaaaacaaattggtctgtttattcatttaaaaagtagaaataagttctaagtggaaaattttgttttatatttcagtgttacatttcttgttgaacattttcattttatttgtagtttcatcacacaattcttcaattacccctaaaatgcagttgtaaagtgaaaagttatattgtattctctacatttaaaacttttcaaaatgtcaaaatttagattttagagccaattcaattgcagtcattttcattgaaataaacaaatattgattacacaatatttcccattcataaactttttaaaactgtaaacggcagtacaaccaactctatatgtccttataaccttctatggtggaatgggtgaaaaaagcataagcttccctcaaaccctttttctaaaggcactactcccattcatgagggcagagtcctcatgaccgaatcacctctcagagaccccacctcctaatactatcacctgagggttaggtttcaatatattaattttagggggacacaaacattcagaccatagaattccatccttggctctacaaaatgtatgttcttcttgtatgcaaaatatgtttattccaccctgttagctcccgaagtcttaccttgttccttatttatatatgtaaattaccttattatatatgaaaaaatatattatatatgaataaatatatttatttatataaatatatttattccaccctgttagctccacaagtctacagtccaaattctcatctgaatatcagctaaatcagatatgcatgagtctcaagatatgatttattttgaggcaaattgccttacagctgtgagcctctgaaatcgagcaagttacgtgcttctgaaatgcagtagtacgacaagcatacaacagacattctattccaaaaggaggaaatcagaaggaagaaaggggtaactgaaaccaagtatatatgaaaaaaacttaaaggcagaatgaacaacttggattaaaaatcaaagtacatgaggggatggattcctcatttgccctgatgtgattattatgccttgtatgcctgtgtcaaaatatctcatataccccataaatacatatacccactacatactcataaaaattaaaaatttaaaaaatagacaattaaaaagaaaacctacagggcaaacaacattaaaccgtaagacttgagaataatcttctttggttccatggcccaccttccagacacagtggggcaagagttggacccctgaaggttccagccagccttgccactttggctttgctggaggcagttcatgtagcagctctgacacattaaagtcacatgtctgtagcgctcctgggctaaaatttcatactgcatattagcttctctaatgttctggggtctcaggagcagttctccctcttgaagctccttaggggattgctctagtgggtctgtctgtagcagcccccaaacctgtgggagttctctgttcggctccatggctctccagtgagtcctttgaaatataggtggaggcagccatttcttataattcatatactctctgcaccagtggagatggcaccacacatacattaccaaggtttacctctggcagccctggtgaggtagacactggcctggagtgcaccttggcccaatggagtcatacttgagttttgcctttcgtcatagttttgttccccaggccttggcattctggtcctgggaagggagtggcagctccgatgctctccaaaatgctattgtggtccctcttctattgtcctgattagtagcatcaggcttccacacaagcatactaatctttttatcaaaaggttgcttggccacacccttggtgttctctcctgaacatgcttttattcttcacaatatagccaggttgagaatatttcagatctctaagttctaattcttttttgattacaaattttatcaattcatttctcttctttctcattttacgataagcagtcaagagaagacatgccccatcttcaacattttgcttagattttttttggccaaatatcctaatttatcactcaagaatttctgctttccataaagcagtaggatacaaacacaattccaccaagttctttgccacttcataaaaaggatcacctttcctccagtttccaataatatgttccttatttttatctgagacctcatcaaaatggcctttaccatccatatttctatcaacgtcctattcacgacctcttagaaaagctttaagaagactgaggttttctctatagctcttcttttcttctgtaccctcaccagaagcacctttaatgctccattcactttaaaattcgtccagcctctatccaatacccagtttaacacattttgttatagcaaccaaaatggactaagatgccccttaaagagcttttgtgtccattagacaagagttagacacctaacatagtatctgggactaatattgtatttaataaataattgaacctgtgatttgatcatatcagggatttgcaaatctcattttgtatgtgtgtggtaaaatatatttaacataaaatgtatcattttagccattttaattatgcaattgagttgcattagtttgctcataatgttgtgtatctatctccacatcttttcagactttttcatcattccaaacagaaaccgtgtccattaaacaatgacttcccaatttctttttcccccaacattttgtaccctctattttactttttgtctctgaatttaccttctaggttcctcatataagtggaatcatacacacactagcttttcttttgtgactgcttatttcacttagtgtaatgtctttaaagatcatccgtgtcatggcatgcatcagaattctattcctattaaaggctgaataatattccattgtatgtatataccacattttgttttttcattcatccaatgaaggacatttgtcttgtatcaacctttttgcctattatgaataacactgctgtgtccatcgtcatacaagcatctgtttgtgcttctgcttttaatgaattgctggataatatgattattttatagttaattttggggggaacttccaaactgtttcccatagtggctgtgcctctgtaacattttgtattcccactatcaactcacaagtgttctaatttctattcctaataacacatgttatattctattttattttatattattttttaataatagccaagcttatgggtataaagtgggatctcactgtggttttgatttgctgtcccttagtgactaaagatgctgagcagcttttcatatgctgctgattatttacatatactctctgaagaaatgtctgttcaagtcctttgcccattctttaattgggttgtttattttgttattgttgagttataggttctttatatattctagataaaaattccttatgagatacataattgacaaatattttctccaattctctgggttgtttttcactttcttaatggtatcctttgatgcacagaagtttttaattttgataaaaaacaatttatctattttttttagttgtctatgctttgggtatcatatctgaaaaataattgacaaacccaaggttatgaagatagctttatatgttttcttctaagagttttatagttttagctttttttttcttaagcatccttttggtgaaaaaatgttttagctcttatgcttaggtatttaatacatttttagttaatttttgcatacgatataaagtacaggtccaacttcattatcttcgatgtggatattcaatttttttcaaaaccatttattgaaaagactgtcctttctctgaatggtcttggctaacttatcagaaacaaattgtgcatatgtgtaaagtttatttctatgctgtctattgtatattctattctgtaggtctgtacttaggacagtgccacactgtttttattactgtagccgtgcactgttttaaaaccagaaagcatgagtcttccaactttatttttctttttcaagattgttttggctattcaaagccgcttgagattccatgtgaattttttgatgtattttccagtttgtgggaaaaaaaaatccgtaggattttgataaggattgtactcaatctatagattgctgtgaaaagcattatcttcttaacaatattttcttccaatccatgaacacagatgtcttccatttacttatgtcacctttaatttcttttagcaatattttataattttagaaaataaggctttcatctccttggtgaaactatccctacgtattttattctttttgattgactagctcttttacaagtcttttactgcttaagtaatttctcaaaagtttgttaaataaaatgtagaatctgacataaatttctaagttgacagaatatactattaatcaacttttactaggttatgctgcaagataagaaactaaatgttacaataccaagtttatttgatactcacatttacatcagatgtgtgttgctgcaggagtgctggggtctgtgagattttcaagctgttccctatttcttctttctctagcagtcatgatgaaggacaaaactgttgggaacatgatgttctctactatcagaggacagcaccaagaaggcaaacagaaacaagcacaatttttctaatccttttcctagggattagcctactaattgtaccaaagttgtccatatttcacgggtcaaacaaaataaatcccatggccatgctaaagatcagtagggtaggaaaacaggacagtgagaaaaaagcaaaccaataattgtgaacaaataataagtttcattgcagttataagtaagcaataatctttcatagttatgaaaattcgtttttccaagatttatcacttgctgtgttatcttgacgctatcactagtcctgttttctttccttgagaaacagagaacaaaaattctctttccctcacatgttcaaataattagagtgtaattataaaataattggagcaaaggtgaataaaagtctatcaattttcagctcattttactcactgaaaagaatcaagattttttgtgttttaaaataacaaatatccatctaaaaatgccacagaaattagacagaaaggaaacaaaataagctttgataaaatttatgactgatacaataaagagaaaaaggttttttataaattaagattttaattcatgtgataattgtgtttattttttaattagatggtgttagctaaattaaatcactcatttgaacagctcagaaatatcaatatgctatattaacttccttaagtatcacagttcactgcaataatacattcatattttcactcaaatactcaagtggttgtaggattagcataatatgctaatttttgtagcttatctaacatatatttagcatattttgctcactgaagtacacacagtgttgtttaaatgttttcatttaagcttacctccttgctaaaggtaactccaggctcttatctaaaatttggtcaggggaaatggattagataattgagtaaagagatatgagcaagaccttgcctttctctatcatccatttagttcacagaacaagcaaagattcaaaactatgttacattttaaccattaatactgttcataatatcaaagtataaaggttcgtgaaaaaattgattgaaaattttaaaaaactctccatttatttcataagaataagatactttcatttgtcggtacgattaaatcattgattatggtagtgaagttgctggaggagaaatggagaaggaagattggttgagcttcatgaccttggcaggagttaagtgagccatgtagaaggtgagtatttatactttgaggaatttctcctcctaaaagatccacaggtgctgttgaggggtttggggcagcagtggaatgtggtcagattcacgtcttaaatagatcactctggtacctgaataaggatggctttgaagggaaaagattggagatacagagacagtactatagaggctgttgcatctgcttaggtgcaatggaataaaaaacctaattaaggatctaaattagaccaacaggaaaaggccaagtgacatgaaagttaagagcatgcctgagtttggctgtcaaattgatctggcttcactttgctccctagctctgctacttagtgctttgatactgtacaatattcttaatcactctaaatctcaattccttttcccatctttaaaatgagtatgataacaatacatttctcatagagtggctatatggatttgttgaaaaagacatacgcatttagcatcatgcatagcatataataaatatgccacaaatgagttaacattgttcaaacagacaaaatagagtctttccaacttcatacttttagaaagtggtatagcacaagcctacatctaggcctccttattcaaattttgtggactttttactctaccatgctgtttcatagaacatgtggagagaagagaaaacaattttagagaggcttagagccactccagtattaaagctgggaatatgctgaatgatctggccaattcatttcatttcatttcatttcaaacagtgtaataaatgctctcttggtataagaaattggttattatctgaactgtaattctgatagtatgtttctatataaacaagatataatatgcagtaactttaacttcttaagaacacagattgtttctcattcattttggtatttccaatgcctagtttaggaactgaaacgtaacagtctcttagtaaacatttagtgaatggatatattatgctatttttgagacacagctcatcaaacatagtataattgatttgaaataaaaatggcagatcaatgaaaatagcaatgagattatgatcagggagtgcaagcaagttttctcctttacttttctggtgatgtgttatggatggttttccttagaaattattttctttcaggatcagcctaagggaaagagtattacagaaagttttagcaacagtgtcatgaacttaaagttgtcagaggaaagccctgaggctccagcatcccatccatcctcatcactaacagatcttccttgtaaaaccctttggaacctggcttcaatacaaagtggaattaccgaaagccttaatattgttgctggtttgctcactaatgattattttgtttctctgtttcataatgccttgcctggaaaatcttttgcaagtgagtggccggaattataattcttgtaaggaagtgatttccacatgtggttaacgattttgctactgctcttctcaaccttcacaccccttcattcctgcccaactcatttggttatggatattaatcacaatcacagaacaggaaatgctttattttaatgtttaataagtttacaactctcgaaattgattcttgtagtatgaatgttggtaatcattacactttaatgccataggcatttcagaaaagactggggaaggaaggtctccactgatatcaaagatgaaatagcaaatatttttgcaaaaagacaaaatgtcctttctttgactttaaagaagattaatagttataattaaaaatcacccatcagtgtgtatcgccaaagacccagctgagttcagtgaatactgctcacaggccaaattcaactctgcatcttggtaaatgcttctgtgacgtcgccacagggagttggcatctctctacattgacagaaatgaggcggtaattagaagtgagtgacaaggtgcttttcatctttgataaggaaagattttttgtgtcaaaatatctcgccagaggagtaattttctctgtgtgcattttttgtcctgaacgcattttgcatgataatagaaaaggggaaattgtttctgaatgttgcttagtgacaaatagcagattcggtgcctttgcagttaacaagtgtctgaatgctgtcatattgtgatatcgacagatagggctcatcgtaagctggggatatttatattggaaaaataatttgtttttgatagaatagaatcaaagatattaaaatgtttttatggtattatgcctctaaaggtttaaaatgatctgacaagatttaatcacccaattctaaaatacattttaaggatttaatcacctgaaatttttagcacagtgaggagacaaataaccaatataatgtagttgctgttttacagaacctgccttgtcactcaacataggggctgctgtcagttcagaacactttcaaacaattcataattatgctggaaagtgaaatccattgactgtactaaattggaaaatttaaaaacaactattcatgaaatttaaatggtttgaaacagttttttttttaaagaaacattaaaagaaacctctgtaattatagctttgcctggcattagattctatgaatgtgaaaggaaaattctgccttgaagttggaattgataatgttaagagaacacagtgctttctttcattatttatttttgtgtgtagggagagcattttatgggatgcaatttagcatacaggtcagatatgatagcaggtggaaagaatgacagtgcttatttgaaagaatgaatctgatactcattgttatctgagtaacattggcatggaaaatgtagtaagatcagtaatttctaaagaagcaataagtaacattatccagctagctataggagaaaacttcagagtgtacctgatcacaagagaaagagggaggtaggatgggtggagagagagagaagatttaatgaatattggaattaaaagaagaaattgaatgaattaagaacaccagtacctagctatgaatatcataggctgtgactcatttgaggtaattagaagaaatgtgaaggtttcaaagagttcattgccataatacttagataacaaataatggacttggctttttgttaagcactttattaaggctatcccaattcctgaaatttaattttctgaatacctctgttaaattaaagctaatgatattctctgatagcagcttgcaatagacatttggaccttatctttcatctttcaagatcctattctctaagagattttgatgagactacaatccttgaaaaaactggaatcataataatattgttgcccaaatcagatggccacaaaactaattaaatttgttttcttccccccattttactattaccatattcccctttatcaattcatttagaataattgtaaaaatttaatttttattaggttattctagagtacccttgagtatgctactcagaactctcagacagaagataaaataaatccacattagttttagatgtacacagttattttaactttgagattatttggagtcccggtgtggtggtgctcacctgtaataccagcactttgaaaggctgaggcaggaggatcacttgagcccgggagtttgagaccagcctggacaacatagtgcaactcttgtcttaaattaaaaaaaaaaaaattgaaaatataagctttatcttcagtcctaaacaatcactcaatagaagatcatatactgacaattatttcataagctttattaaataagttaataatcagtgtttataacatattgaacactgtgtaggttgaggactttacacatataattatcgtaagactacagcatacatacttcctgttgtattagtcagaaaataagtgcttagaaggaaaacaacttgttctagttcccatggttactaaatttcttacatgggatttgtgttgccaaagcaaatagtgcaccagacataattaaacaggcgacgaagaattattcaaggctattgcaataggggagagagagtgaactcacatcgctgtaacaaaacgtaagagtttctaagcagtagggtgagttagtgcaaaaacactggagaatgtcagggaagagggtggggaagggaatgtgttcagcatgttaaattaatccacaattggcaaaagtttttgtctaagattaggccatctgtattttggcacccatggaagttagacccttccctgccacagagtctgagaaaaaggaatgctatcctgcttgctgattatatttcaaagacatgattccaagtcctccacaaagacgttcactgggtcataaaactgacaagaggctgggagaagaattatatatatataatatatataatataacatataatatatattatatataatatatatatatgtatttcaaaggagcagataaataaagtgcaattgcaaattttctaaaatatatgctctaaagtagatatacagtcaagaaggaacctttgtaacatttagttaagctgaaagtaatgttaaggccatcttggtcacagtccatgtctgtcagacacctttgtagtcactcttaaccctggcattacactgaatcctaattataccagttttccaacagtaattgggaatattaattgcttgtccatagaatggcagtttatttgctgataatatgttcttccaaacttgatataattgtaagatactctcaatgaatatgtatttgcctaatatattataaatataaaaatagatttaaaaatttggataaattatctcaaaatacagttgaaacatttgaaatttgcttattaaaatacaccaaagtaatggtagaaaggaggtaaaaattatcccagaatcccatagtccttattatttttccattatccaaaataggtggaagttgattattttattcagcaaatatttattgaatacttatatctgccaggcagtatgctaggtggtagaaatatattagtaaacaagagaatcaatatttcttttggaatttacaatctagaaagaagcagatatttactagctaatttaaaaaaaaattacaccagtgagctatgcaatgaagaaaaaagttaaaacttctgtgaggacagataacaggccaaagttatgtcattacatagtgtagattttcctgaggattcatctgggacctaaatctaccaggtggagaaaaaatcttgacaaagcagttgaaaaggtgttgaagagtttgattaaccaaacagaggaatttcatatgtgaaacaagataaaaactatattttagattatttggaggaatcaaaagatgtagcaaaatgaagaaagcctgagagtcaggaaagcttagctctgtcataaactatttctgtggaattgagaaggcttggtatcaattttcctgtacacaataggttatctttggattaattttctgaaatgtcaccattgcactaaatgtttttgaaaatcatcttttggattgatggagaaacattcaaggatcgcaagtttttaggtcgcaaagaaaaattttgtagtcacatttcaattgactaaattgctgaaattattcacatactgtaattgctatgcttgactcttaagaagtattgaacacttcccaaattccaaagtattgaacacgtaccttcaaaagataaagatttgctgctgttgagcaattcaagtgttcgtgctatattatagaaatgtcataaaaagttacaatatctttgaagttctttgtctttgtttaaatgtaatcacatttactaattgtcacatctaattatcatttggatcagagagttggcataaaattacagaaatggaatagataccctctagagccaggcatgagtgagggtgaaggatattgttgctactctctgtcacaatttacacataataattggtggttatatttggtcaggtccagtttgtaaaagactctcgtggtaaagctgaaatgagtttctgaactttggagaagactagaatattatgaaatttagataatggcaaaagataataaaagagtagtgcctgtgggtctttgtttccctactcattctcctacagtgtttgggagaagaagcctccagggtattcgtggcacttgatttccagcagctgtcagagaggcagggcgctgctccagatcgggaatagcttgctctgctcagggtaattggctctgcagcctctgttgaagagaggcagtctgactcatcaagtttctatttttgctcatttgtttgtttttatgagaaaggagatgcatgttttttataccacatatagatccttacctagtgaagaaatctttgttgaaagaggtaagaaaagttaactaataaagattaaagatattttaaagtaggtatcattctatattcaaattatatccatttttaatgtaaaaattttaaagattatagcataattatatacacacaacttaaaaatatatacatatactatatatatgaaataattatacataagtccctgaaataattatacatatgtgtacttgtgtgtataaaacatagcctatattgattcctaagattcactgcaacaagtgtactttgagtaatgactcatagtaagttagatctgagggtttattatataaataaaatgttgttactgttcagtgatcttacatgacttcagtaatctggagtaaggactagatgggctaatttcttagtggagaactaaaatagaattaaacgtatttgatggagttacagattaactttgatatccaatattaaggagaaaaaaaaatattactctgcttacagagatcagtctgtcagtgtcagactttttccaaattttagtttcaccttgagtaatttttattttagatcacaagctatttttaactttctttccaaatggttttagtttacatacatttaatataaaacacacaccccataccaaaagaaaaatgtataaggcatgaagcataatttctacaaccttcgatactgtcattttccctttagacagctaagtttaaacaggcttctgcccattttcgatggtgtgtgtttgtgtctttgagtatacaaatttatgtacacatggttaattgtgaagtacaaaatgctgtaagtgaggatgagaccctacagaattattgacaatacaagtggagcgaaagagaatccacataaggtagactagagaaaaatacatttctatttattgttatggaaaatggctgaaacaagcacagccttccatgcttatgaaaaactaatcttacagcatagcagttcacatcactgtttcacaaacttatgatacatcctattggagaacatttaatcaaaaagcttattcagttttgatctttatgtatgtgagtttccattttactatattttacccatttaaaacggttctgttttttctactttgatcaccgttacatcattattactgtgatcaaagagagcacacgtaaagaaacaaaaaaaagtggtaccatttaagctgtagtgcaaagaaaatgaaactactgttttagagtgtaacacacatgtcactgaatcacaaagtgtaactgaagtgatgctaaacatcaagacacagagtgttaaaacaatctaaaggaaggtagtgaatatgccatgtacctggcacaacggacaacctcttggagaggggaaaatctgggataattccccatctgtgtgaaaactcaccagtgatggccagcaggcttgccatttaagaccatgttgaaaatgtgaaaaaaaaaagcttggctggaaatcagtgcctaatgaagctatagaataggacgcactttttttctttattatatatcttgtgatgttctgatttaaaatgtctaattcatattgtacacacgctatgcctagatttacctacaaaatcctcaatcaaacagtttatctaatgttataaagcaaaaaattgcttacggcataaagtttttattttgttttgttttgttaccaattacttaaaagggaaatcaatgtccagtgttatggcatctgagagataaaccagttgaaataaaaattgacaatgagggctgggcccagtggctcacgcctataatcccagcactttgggaggcccaggtgggtggatcacctgaggtcaggagtttgagcccagactggccaacttggtaaaaccctgtctctactaaaactacaaaaattagcggggcatggtggcacatggctgtaatcccagctactcaggagggtgaggcaggagaactgcttgaaccctggaggccgaggttgcagtgagccgagatcgcaccattgcactccagccagggtgacaagaacgaaactccatctcatatagttcaggttataatttgaggttcttgtcctgaaaagcctaacaaatagagtacaaaactggatggactattgaaagcagaagataagagaagaaaataatgaagggtcaatagagaataagagtaggtggcccaaagggacatcttggaggctgattaccccatatcctatgctccatctttcatgtttccccatttttattcatttgaaattaaaaggccgggcgtggtggctcatgcctgtaatcccagcactttgggaggccgaggtgggtggatgacctgaggtcaggagttaaagaccagcttgaccaatatggagaaaccctgtctctactaaaaatacaaaattagctgggcgtggtgatgcatgcctgtgatcccagctacttgggaggctgaggcaggagaatcgcttgaacctgggaggtggaggttgtagtgagctgagatagcgccactgcattccagcctgggaaacgaggaaaactccgtctcaaaaaaaaaaaaaaaaaaaaaaattaactgatatttttcatcattcttaatttcagaaactaagcataaaaacaaaataatatatacaattatttcattaatatgtccatattttgttaacataataaaatataaatttttacattatgattacagtttttaaaattcacaaatacagttttatctttacaagcctcaggaatttaaccatatgcttcctctgaaacatgcaaaatattacatatcaaatcaaataacattagtattactttctaaattcaattttaactatcagtcatataatccagaagcatgaaaaagtaatatttgaggaagttatcgaaacatttcactgtttttcagaaccctttagaaatcagatcagaaggtcatttgcaattcgctaactggttaatgacacaattgaatttaatagactctaattctttttctctaatgaccaatagtcagaggtccaatttcagagttgaaaaatgtctgctattttcagcacatctatttctaacttcacatttgttttctctgcaagataatattaaatttaaaaataaaataaagtaaatcattttgactaaatgaacagcacaaagcctttggcatcagatacatcggaaccttggctcaaacatttattttccttgaagctattcactacttaattaacttcccttggtctcagtttttcaatgtatataaaaatgtaagatttgggaggccaaggccggcggatcacgaggtcaggagatcaagaccatcctggctaacacggtaaaaccccgtctctacaaaaatacaaaaaaaattagccaggcatggtggcaggtgcctgtagtcccagctactccagaggctgaggcaggagaatggcgtgaacccaggaggcggagcttacagcgagtccagatcgcgtcactgcactccagcctgggcgacagagtgagactcagtctcaaaaaataaaaaaaataaaaagtaagataatatggaacttaatgtctggtcggtgaggtaaaaaggaaatgagtgtaaaagagatatcatttgtgacctccagacttagatcatcatgtaaatattggtgccaccaaatgcaatagaaaactctgaaagaatgaagaaggccaaatgaatgtgttgatacacggtgaaggttttgatgggcaaatggccatggaacatccacgatactagcaggaaaatggttctggtgctcaacttttgttttcaggctggaaaagtaaagaagaggaatcaaaaggaaactagatctgaagaaaatggagagctaggccgggcgtgatggttcacgcctgtaatcccagccctttgggatgccaaggcgggtggatcacttgaggtcaggaattctagaccagcctggccaacatggtgaaactctgtctctactaaaaacacaaaaagtagctgggtgtggtagtacgtgcctgtgatcccagctactcgggaggctgaggcacgagaattgcttgaatccaggaggcaaaggttgcaatgaatgtagatcacgccacagcactccagcctgggtgacagagtgggagtctgtctcaaaaaaaaaaaaaaaaaaaaaaaaggagaaataaagtgatgaaagtataatagaaaatggaagaattaacagttacagcaggaggagtgaaatatttgatgtgaaattatcagggatagaagagtctagataataacaagttagagagtatagtcaggagctagtattgaggaatgaagcttaatgagatggagtttattaaagaacaataaatcaaagttcttggatgatatttttgttaatctattgttttgcaacaaatatccctaaatatagtgacttaaaaatacaacagtgatttacaaaattacaaatttacaaaattacaaaaatataagagtgacttcccatgtatctggaattctggaatttggggttggcttttgtctgagaaaccctgttttctccctccagtagtctatactagcttccttacactgcagttttagggcaatgttccatgttggtgaagtcagaagctgcaagacttcttgaggtctcaatcctagaaagcacacatagtcacttccaccatattctgttggtcacagtcaaaaggccagtttaaattaaaaagctgaattacttaataaaaaatattttaaaaattataaccatatttaatctaccacaaatggaatatcgacttggatcataaaattacctggattgcaactggatttgagttggaaaaaaataacaatgacccatttaccaaagatataatgaatatatcaaaagcaccaaaaaacttgcggatgatgcaaggaaaaagagatagtttcagcgaggtaggatgactcacaaaggaacaaatattattgtacgattataaaagttataatttggatattgcatatgaagaatattgacctcatgttccagtctcagtgtaccttttgttccagggacccaatgtatcaatgaccttctgctgacagaatcaacaatcccaaaatataaggggcttaaaacaatagacatgtatttcttgtttatgttaactgaggaccacaattcactgaggttctgctccaaaacatgatgaaggtgagatctgttccatgcatcttcttcttctaagaccaggttgaagggacactcctgtcagtgacgtggtattctcttggtagtgggaggtaaaagtgtttaaaactgaacattgaagttcagttttataaaattatacaggccaattataaaattgtccttgtagtttacttttgaaagcaagttatctcagatgtctaacaatgacaaagtctagtcaaggtatccttgacccactttatcagggattatctgcccatgttgtggtcagaatcctgtacttatgccaaatggcaggaagtgatttccagcacagtaaatagactttaccccagtcgcttacccctaatgtgagtacaaaggaggaagtaacataggtactgaactgagattgatgcccttattcgatgaatgttataaaaatagcacctggaatatggtaattaattcctacatttccaaatcagaacagaggcttccaacagttaaaaatcctttctattctcatgatgcacaatgacagcttgttttacatgatttagctagtagtgaacagaattcgatttattaactttttgcaggaagagagacaatacaccattgtgatctgtgcgctgtcttactaagaaagagttgaaatgtacttaacatggtgtttgggcttttgctgagtgatataaggaagggcttaagaaaggttgggagggtctgttttggattaaattctgtcaggaagcgggtcaattatccttttgaatatttatacttcttaattggaaactttaaaatgtttttggtctaggaggtgtgaggaatgaaacagagctagaattgtccttggtaaaaaagaaaaaaaagcagtagtctctcatattttgggggagtggagattttctaatagtattatagtatctttatatttttcttatattcgtatatctttatagagtggtcttgtttttgcttagtgtcatcatgtcacagaatgttttgccttattattgttaaaagtctatgaaattgtttatgtctggtagagaatgctgctgctgttttgttatttcttttgtatttatctttctcaaaggctttagttttttttaaatattgtttgtattgtcctatagtcgttattcttaacaagtcctaattggctttcttaattgtaactttttctatgaattagaaggcctcactttctatgatagacttattaattggtttcatcatttagacttcctttaaaacaatcgctgatattgacatatcgtaacttcatcgctactctcacaacctccatttacaaatatgagactacttggcagtaataactgtagtgctacatattatttcctctttaaaaaagtgtctggaggtacatctttggttcttctgaaaggcactgtgagagcagagatgtacagattagttcctcacttagtcttagagaagaccttgcaattttgccttttctctggctagctaatgaaaactaagttcttcacccaagtcctttacaccctttatgcagcacaactttaacactttaattttaacaagtcccatttcctcatttggtctcttgaaaatatctatgagaaaggaaaccttgctttgttcacatcacagttcatattgcaagatagtgagttcctagatggtttaaagataattttagggtgtataatcaacctaattatattatcttttggatacaaatctaagaacaaacattacatataacatgtctttggttttggaaattacataattttgtttcttactttacccttaaaatttgtgggaacactactcttaacaatgctttggactcgtggtcttctgaaatcttttgtcccactctaggctctgtttccagctgaacttccttgttaactcatttctattttcgtaaagctgtttcatgttagcatttcttcttacttagacattcatttgctagtcatcctacccacttttatttttcatcagctatatttctctaataataagaaaaaactagtagtcataactgtcaaactctgcattaggctattttccagtcagtatcactgtatatgttcaagtactgtattcacatgcactgtcttggccaatctcttatacaggaaaggcaagcattgaagattgggttttactagatgacctttgaatctaagttcaatgttgagactctatgattcaaaacacagtgatagaaaaatcataattttgcacagacttcatatatatactttaccaccctatccaagagccctttcttgattttcttatactaatcagcacctctagaaaggataagtaaaattggtgaatgtactctgtagtatggatgactatatgcatatgtagaaaatcactaggctaggtttaaaaaaaagtgagaaaggaaataatatctataggttcactgcaattaaatcatcctattaaaatagtttacaagaacatatacaaacagtatgatatacactgaacatattataatagttgcttttagataagaatatggcaatgggagagtgaataaatggaataaatacattaatgaaacaagataagagcaagacatatcaatgagatagtttgacatgaattcataagtctttttttagtcttctgcacatgatattcaataaaatacatacataaaatagcactcatctctatgcctattgcctatttaattttctagtctgtatttatggtttctaataaaaagttaattaatttattctttattatttgcctctgctaaccttttctgaccagcaagttactttcctaagaggagataattttgtttctttttttttttttactgttgtatcaccagtaccaaaaataatacctgacatctactaaatatgaaaatattaattatattaattaattaattatacgaataactatgatgaagttgattttttttatattatctctaacttaaaatttaaaagtaagaatctgtaatgggcttaagttattcatggtagtgggaagatattttaataacgatcagtgggtgattgatttctggttcaatacctttctcaattgaaatgacaaatcaaattagagttttacctcaagtgccatttgaaaatgaataaaatataatcgatatgacatgaaaggagatattcattattgaaagttgtattctgacccagagaaaacactaactgctatacccgtattactaacttccagcatgagctatttttaaagttttaataaactgaagagaatcatcttgcctcaaaaacatgtggaaaggtagaaaaaaatatgtgtattgttatatatatacacacatgcatatatgtgtatttatgcattctataattcagctcatggcccctccagtggggcagagatcctaaagctttggtgggtgacagaatctcttgcaaagctgcttaaaagtgaacattttggccaggaacagttattcatgcctgtaattccagcactttgggaggctgaggcatatgtatgtgtgtgaatacatatgtgccatataaaggtttaaatacacatatatgtgtatatatgtgtatatacacttatgtgccatatatgaggttcatatatacacatataatgtgtatatatgcgtgtgtgtgaatatagttatgtgtcccataacaatgttttggtcaacaacaaatcccgtatacaatggtggtctcataatggtgtgtctgtgtgtgtgtgtgtgtgtgtgtgtatggtgtgtgtgtgttaaataaatgctactcttgaaaaacataataaagtcagtattcctgtggccaagtaaccatttgaagaaatatttgtcctttgtttggtgcaaaggaccaaatgatgtttatactttttttcagagaatactacacactttacacatctcagcatgaaattagtatcacaaaatctttctatttatttacagttttatttaactgcctgatttgtccaaaatattctcaaagaagtgagcaaatagaaatgatagtgtttgttgtctataaaacctttttgtaaatgagcaatgatcattacactgtttctactattaacttaaacaagaacatttgtcagatttgttcattcaaatattgtttgtagctggggatggtggctcacgcctgtaatcccagcacttcgggaggctgaggtaggtggatcatctgaggtcagaagttggagagcagcctggcccacatggtgagaccctgtctctattacaaataaaaaattagctgggcgttgtggtgtgctcctgtaatcccagctactcatgaggcaaggctggagaatcacttgaacccgggaggtggaggttgcagtgagccaagatcacaccattgcactccagcctgggcaacaagactgaaactctatctcaaaaaaaaaaaaaaaaaagaaaagaaaaaagaaaagaaaaagaaacccacaaatactgtttttgaataccacctgaggaggaccagacccatgtatagatactggggttacatcagtgagaaccctgattattttgagtttcttatctgatgcagtggatttcaaacctgtttaaatattggaaacgtccaacggatttaagaagtaccaaaatctgagtcccattccaggccaaaaaaatagaaatatctggggataggactccaacatttgagtagttttaaaggatctccagatgatatcagtatggtgcccaagtttacaactgcttgtccaaaaagtgacatataccagcaaataaaaaaatttcttcagctgagctaagcctagggaaaaaaaaaacaaaccaaatttctaatcactgcggtaagtgctacaatataaaattccctggagccaacagggacaagaggatcattaggtgagggaatggggggaagagacatagtttcaaaagtcttctcacaggaaatatcaattaaactaggatctgaagaataaaagaagttggtgaaagtcaatggagatgatttattcagatttttttaagtatatgtaaagtccaggagttaaaagatagcatggcttattttaggatgtaatagtattttaatgcaattggcattgaacttgaaaaggacaaagaaatggctgtatgcagaaggccttataagccatgttaagaaaaatgaactccatcttaagagcaatggagaagaagaacttcataattttcaagattagtcagaagttgtcttttgcctttctcacagtactttttatatatttagaatggtcttttctacttaattttaatgtatgtggcatagtgtccctattatcagcagaaatgcacagtcaagtttcttgaataaaaactttctaggactcctattattaatgaatctaacaattttaatggttttcttagagctcatatttttagctttagggcagtggttctcaagcttttttcaggtccaacatgttagaagtaatgactaattatagcaattattttcaagaaaaggggcagaagaagggactaaacagctcacctgggtaatggtggctgctgtagcttgaaagtgatccacccatcttcatctgatgctcctcgagggctgagagaaaaatcgtagtctccctttaaaaacaaacaaacaaacaaatcaacacaaaaaactgcaagctcttgaaattagaattaggggtttaaaaattgccttcaaaatttacaaatgcctcagggaaaaatcatatttacatccttggtatgagagtacaataatcagcgaaacttggttcaagtgtcctatgcttgacctaatgaccttaaagccaggaaagataatagcatccttccagaacgtgttgctaaggctgagaaagaagttgtaccctagaggaagcatagatacaaacactgagaggactgaatggcacgcagcacccccacattttggcttctacagaaaataattatgacctagaagtgaaatctgctggacagaaattggctagacccaaactcatggggaagcacggacagatgcagacgcagagagaaaagtgaaaatatcattaaagaggcctttgttgttaaataaagattaagaactgccactctaccgcacaatttgacagcctccaatttaaaatgtgatttacagtcacaatagttcctattttctttcttgcattttgtgaccaaagaaaacaaatacctgtgtgtgcttttacgagacttatttgttctttttctccacatccactcgccctctcttgtatgatattatgaataatccagtgccatgacttgaactcctgagacttatgacacaatcagagacaggtgatctggaaatatcctatttggtttcttcactgtcctttaatgttttcttatgggaggagaggttcttccatttttgacagaactcagtaacacgtgtttcattcgcacacaagtcagaggagccaggcaaagcacatctcactagtgtctctaaataacttttttttttttttttttttttttttttttagacagagtctcgctctgtctcccaggctggagtgcagtagcctgatctcggctcactgcaacctccgcctcccaggttcaaacaattctcctgcctcagcctcctgagtagctgggactacagccgtccaccacgacggccagctaatttttgtatttttagtagagacagggtttcaccatattggccagcctggtcttgaactcctgaccttgtgatccgcctgccttggcctcccaaagtgctgggataacaggcaggagccaccacgcctggcctctaaataacttttatttcactaaatatattgttatgaaaatgaagtggctatcatttttatcagtagtctcttttgtatgtgaatatttaaagctctcaaagaaataggaagaaaagaccaaaagaaatgatgagttactagctttgtttctctgacagactggtcccatatgtctatggttatgtgatgaacagaagaaaaaggaaagaaatacaaaatattttagaaattggtttgctaatgatagcatgtactacacagaaaatattgagacatagactgtccctaatctctagttaagttgttggttgttttcagattctgagtgatcctctatatgaacagtgatgccatagtggcaagcaagttattaaagggactcgatacctgctcgtggttgatactcatttagttttcatatatttaggttgagaagctgcttttttttttttcttttggcattaaactcacataactatagaaattatgtttgtattctgaggagtacctataatttatttaaaatatttttgtaatttcccatggctattataatttttaaagtatgctattaagaaatgcttgtcttaacagggcagaagctgctttaccctgggtttttccacatggaggattatctgatgataatgacacatttcccacagtggcagggaagctactagagacacagaaggcctgcacagatgtcaggactgctgggtacagcactgccatggttgatgcactcagagtttaaagtctctttaaatttctttcacataaaagaagaaatttgaagttcagcctccaagaaagagtattaaaaagaccaggagggttttatccaagttccacgggtgataaaacacatcagtctgaaacattactagtgcgttgctgattccctagtcattcttccatttgctgtagctgaacaatgatagcactgttccatcaagggaaaatgatccctcctcctttcaaaaagctttttacaaggcaaagctataaagtgctagatttattaacaatttccatttcaagagagacactgtttgtacggccgtaaagctgtgctttaatgcaagcctgttttcctaatgccttcacaactcctgtaaataatgcatcccttggtggcatccttcacttttaaacaatttgggcaaactggttcaagttgtaaaaatacaaatatactttctgtaatataataatagttttgcaaacactctggaatttgccaatttacttttctagatctgattgatatttgattgccaaaatgggaaaaaaatgtacttaggtgaatttcacccccaaccgagggactcaggacaccagaaaagtgaagacatattccaggaaattttgagcaatgataaaactggtccgtggtgtttgttgacaagagaaaaagtgcatccaagttctataaactgaaagtgtcacgagaaacttctttatctcagttccctatgttggatctgtcaattcaaccaggttttattgaactattctaattatcttaaagaaacctgattaaactttattctattcttgaatagtccttcccctttactatatgtttgcttttaaaaaaattaattgacaaataataattgtatatatggaatacaatgtgatgttttgatatgtctactctgtggaatgattaaatcaagctaattaccatatctatcacctcccatacttaatttttgtggtgagaaaattcaaagtctacccccctaacacttttatataaattattattaatatgtttgccttttaaaaaatactattaaatggcaatgtattgattaaaaaataaaaatcattcaattctcaaagtgtttactattgggcagataataaatgtttgtttgtttgtttttgtaaagcaccagaaaattattttatggtaagctatgtaaaaggaaagtaagagtcttgaaaaatgtctttcctctagtagttatcattttgtagtgaaaaccttttgcattcactctcttagcattttttcaagaatacaaatattgttaactttagtcactgtgttgtgcaagagatctcccaaacttatttctctatctaactgaaaccttgcatcttttgatcaacatcaacgtcttctcaacccctgaaacacccccgccccacccctcactgccagtctcaaaagtaatgtaatccagcttggatttggtgatttggacttgaactggattgaaatcaccaatccagcttggattagtgatttggacttgaactgaggggaaattataggtgttatattttattcataaaccagtaattttatagtaatgtgttaacaaaggagaaaaataaatggtccagtgaaaaattgagttatggttagattgcataggaatgtaatcaataaagtatgacatagtagagagagaaaatttgtaagaaaaaggtcataatgcagaactcttgtatttagttaagtatcatttgaggctctttttgttgaaaatggcagacaaaccagtatacaatagcttaggcaataaagatgacttattggctcatataactggaagatccagaataagaaggagttttagctcaaggatgtcgtcagagatcccattttcccatctttccacagtgcatcctgtatatatggaattccatatatggattgtatatatggaattgtacatcctacaagatctttagacagtcttcctcatgttgtcaaaatgactacataaatttgaaaccccattcatagctatgcatttcctgtataactatttggaaagacttagagaaatttatgacctggagtcctcagtatatttcccttgggtgaaagttacgtggctgtccctaaagaaatctctgaagacaaagatcaacggcatatactgatctactcaagcccgtttttctgaaccaaattccaaattccatggagaaggagttaggattgctcttattggacttcactagagcagggcccacctccaacctgggtaatgtcaggttcccctgaagcacatctgttacaggaaaggggtcctgatccagacccaagagagggttcttggatctcacacaagaaagaattcaggatgagtccacagtgcaaagcaaaaacaaatttattaagaaagtaaaggaataaagaatggctactccatggacagagcagcccgagggctgcgggttgcccatttttatagttatttcttgaacatatgctaaacaaggagtggattattcatggctcctctttttagaccatctagagtaacttcctgacattgccatggcatttgtaaactgtcgtgacaccggtgggagtgtagcagtgaggatggccagaagtcactctcatggccatcttggtttcggtgggttttagccggcttctttaatgcaacctgttttatcaacaaggtctttatgacctgtatcttgtgctgacctcctatctcatcctgtgacttagaatgccttaaccatctgggaatgcagcccagtgggtctcaacctcattttacccagctcctattcaagatggagttgctctggttcacacacctctgacacttcagtagtgtggaaaaaggaaaaataattgaacaaaaatctcagcacttaggagccagatatagggaaacagaggatgactaagcaatcaacaaataacctccattctaaggcatttctcctcaagtttatatagtttttgccatttaaacaaaaaaacttttatttaaaatttattggatttgatttggccaattgtttctttgcattcatgtttttctagtttctggtgaaaatttcatttatttaatacttgttggtcattttataaaatgttaattactagtaaaatttttccaattagatatatgttatctcccagtccatatattttctttctaaccgcatattctctcctcatctaagctctgaatagcagggaggttaattaatagaggttgattttatatacatctatttgccataggaaacaccaaactcataagaaatggtaacaattaatcaatgctgtagttgtcccataaaaattctatccccccaaaatttcattttcccccagttaagaccaatatgttgccacattatctgttttcagtacatacgtagtcacacacccacagatatttcattttagttttgcaaagggaaattttgataccatactgaaatggtaggaaatttagttccaaatcactggagttaaatagatgataattccacaaatctcttttcattattaaacaccatttctactagctgtattttaacttttaaatgatttcaaaccatttattataagtaacaatatataatcgcctatagaaagttcatactatccagctagaacttgttcagctatcaacctgacacctagtaatcatgaaatgtccatccactcagtagaaataccctttccctaaccaaaggaagtttctgtctcctcttttttctggactcctgctactcagttgctgagcttcccctgccacaaggaccctctgactccatcttccacccttcctgctctcctctctttgaccttatgctgggatatttgtaggtatatagacatgtcaagccctttcaatccttggcttttaccatgctgttgccactttttagagtagtgagttgtttttaaccttggctgcacattggaatcagttacagaggattttacatctcagtggccaaccagcattcaagacaaatgaaatgaaagtatctgggggtgaggtccatgtatcaaaatttttttaagcctccagttgattccagtgtgcagccagaattgagaaccctctctctattcttacaactcctgattctcctacatatatttgtctaaatattatagcactctgcagagaaacttttattccctctgcagactaggtttggttttttgaaagatgctttcatggctggacgcgggggctcaaatctgtaatcctagcactttgggaggccgaggcgggcagatcacctgaggtcaggagtttgacaccagcctggccaacatggtgaaaccccatctctactaaaaatacaaaattagccgagcatggtggcacacacctgtaatcccagctacttgggaggctgaggcaggaaaattgtttgaaccaaggaagcagaggttgtagtgagccgagatcacaccattgcacttcagcctgggtgacagagcaaaacccggtctcaaaaaaaaaaaaaaaaacatgttttcacagctcctgtatttctcttcatggcactttgtacgcttgtaaactacttgaaagcagatatagtgccatgcgtatctttggtttctagaatgatatgcaatcaataaatcaacaaatatgaactgatttgtcttgcttaccaggacaagcccattgaaatcagactgctatcttaatgaaaccagtgtggaatctactgccacattgtaaacatgtacttaaatttctatgtcagtgaaagaaagaacacgaaactttttacacctgctactatacatacagatttgttcatagtccttagggctaaatctgcagttagaatcatttataaccatacaaacttgcccagttttcaaccactttctatgataggaacagatttatctcctaatctgcttacacacagacacagacacacatacacagtgcataatacccattgaaatgctctgggtactgtggaacacagaccagattgcctaggactaaaacaaagaagaaatatctttaactcaatttaagacacctaattctccagtccttattttattttattttattttattttattttattttattttattttattttattttattttttgagatggagttttgctcttgttgcccaggctggagtgcaatggcacaatcttggctcactgcaacctctgcctcccaggttcaagcaattctcctcccccagcctcccaagtagctgggattacaggcatgtgccaccatgcctagctaattttgtatttttagtagagacaagtttcaccatgttgactaggctggtcacaaattcctgacctcaggtgatccacctgtctcagccctgcaaagtgctgggattgcagacgtgagccaccgtgcctggcctccagtccttattttctatcccaggttaaacaccttttaaatgggatatgcaatggaaataactaaatctttaagaaaaattctacttgtacctgtattgtgtataatcaggttcacataatagctcaaaaggagcctgttctagatttttgagtcttataactttaactttgcagataatgcgtagtgctgattaacataaatgaatactttttccctttatagataagaatcagcatagtgtagaccttactttcatataactctgtcctacccacacaaacatgcacacaggcactcccaaatgtgcaaataaaactgtattttaaatcaggtggaataacatttggtaaaaaagtagcagaatgactaacagaattataaaatgtcgaaatataggcagatgcaaataagaagctggaattttccccaagtggtaggaataaaatctgattagagatttaaattaatttggaaacttatggtgaagggtttcatttagttatttcttaatgatttcttaattaataaaaatcacattaaccagaattggcctttcctttaatcgaatgtgaaagtgtgattacttttggaatcaagttaaaatttaatatttaagctagtttatcattctcaactctttgtccagtcctcaatatgagaatctaaagcatgctttaaatatctaattagttctaatgcatagcacaatgcctgacatatagtaggtatatgacattggtgaatgatttaatacttaaacaaaacaaaattcttgttctcaaataaaaaataaaataagccttttttttttgtcagggtctctgttgcccaggttcgagaacagtggcacaatcatagcttactgtaaccttgaatttctgagctcaagcaatcctactgcctcaaactactgagtagccaggactatgggcatgtaccactaagcccagctcatctgtttttatttttcatagagatgggggttgccatattgcccacactggtcttgaacccatggctcaaactatcctccagtctcagcctcctgaagcactgggaaaaacctttctctttaaaagaaagacatacttgttattcataagaaaaaagaaagattttaaaacaaatatatctttaccttataataagttgatgacatatataaagtatcttactaaaatgttatagtttgacacaaaacttaaaatagttggacttcagattcacaccatattatgttgagctcagaatttttatccatttgcgtacaaactaatgaaatatgaataattaaagaatagtttgtacattgtactaaattcaatgtctctaaaattttcctgtgttattcgttcttaaataaactgaaataagccaataaacttcgaacattcctggctacattttcagatttctaagatgtttctgaagtcatctttcctgatataattatattgtaataaagtacccatcatatcataaattgttattttaatgatactaacataggcatttaattattaagtaatcctaaagctgacattaaaattactatgaaattgttagtttcaaaatagtaaataaaacaacttttatattttttaatgtttttattatagtttctttgtaccagtaattattgaaatattctaataactcaaaaatgattttaactaaataacttcacttttaaaagaaatctaacaacttaattcaaccaaagtaaataacaccttttgtattattactcctagatgttgtttaagtctttaaaacaatttctaaaactccaagtttatttaattttttctacaatgtgaaaggtaaagtctcttatctaaaacctgtaaaaaacaagtttaatattggttttttaaaagccttactctcaaatctggttcttgaactgttaatcgtaaaaatagcatgactatgtgaaaatactagattgttcttttaattataactctgaactatattgtaaatccatttgttagctttcttcttctttgtcatctaattccatttctagcacttagcatagtgtggagagagttttaggtcgttagtaaacaaaagaatgagcaaactaatagatgggcatgaaaagcactaaatttatgtcttgctgctgtcatatagtagctaagattctgatctcatcacatatgtggacacacaagctttcgctaagatatatacagcattgtttggtttacaatattcttttacctatagtattgaagttgatgctcagaggagctatgtggaaatggccggaaggaaaattattatccacaattcataatatagaaaggtgaaggtagggcattaagcctcagttttatgttgaattgagatgatattatttatagctgaactgtggaaaggagtcagtaagaatttagtataagggtatttggtccaaaattgctttcttctgatcacataaaaacatttttgtataaatttttgtttccctgggatacccttgtcatattaggtataagggcacaagagtcagaatatttatgttaatcatatgctgattacctgcatgactttcccacctgtatactgtccctcaaagaaaatctcaagaagtaaaacagaattctaaggataaaatgaaacagcacaagaaaatgtcatgtaaagtaaaatactcacaatgctgaaatcatttttattatttgttttgtaacaaaataatgtggttcaaattcttagttaattgtctgtgaggtgtgtagaacttggactaccctaaggctcagttttataaaatttaaaaagatatttgcgtgactatttaaaaagtatgaaataatatgtaatgcttttagatcccatggcagtatttgtactcaataaataataaaataataaaaataaaaataaaaataaaaaactcaactataatagttattatacttacatataagtactagagtttttattgttgttactgtgctgaatggaagaggacaatagcaaaaataggagggagaaaaataccctctcctgtctcctatttaggttgataaaagtgccacccctccttcataggatttagatgaaattgaaaatacaaaatattacaagattaacaattctggttttcctgctggagtatctccagtattgacagataaggctaacttttcatccagcccatctgatgatattgactttcactaccatctgcattgccagtgattatgctcacctaaatgaattactttagatataattatcaggtccccaagacatcgaataaaacctccactggtgacatttcaaatgatgacagtgtgttttctcataatatatcaatccagagaccacctaaaaattatctttgtctttgggttaatggtaaaaagcaaataaataaacaagaacaattatactaaaaggttgccatgaattgttcacatttttcattttaaagggtaaatagtaaagaaagaataaagacatatttttaatccaattaatcattccatatctaatgttgtagaccaaacaacaggacatgcctaaacatttcaaagtagaaatagcatagttatattcaattcactataaaatgacaaacattcattgaacattggctttgaatagcatgtggaaataatggtataaggatgagtaagattgtctattggagaagacacatgtacaaatagaatatgacatctaatttaagtggtttaaaaacattttgctatagaaacccagagatgaaatattaaaattcaacaaaagccccactaataagtaacatgaggctaaatgtcaaaagaagggcagaaattgtccagaaataaaatctccaactggaaggaaagtgtactcagtagttaaagaaatagaaacggcacaaactcaggttacaggaagacataagaaattgggtgttgcagcaatatactggaaaagctggagaaaaaggagtatgttcaaagataaaacaagcatggattggagacagaaccagtaggttggtggtaaattaaagagtgttcatttgatccagaggtagtttgcaaaggcaaccatgttccaggccctaggataaatgtgttatgtttaatattgtttattctcacaactgtatatggtaggtagtgttgtcacctctttttcagatggagaaatcaaggcaaagggagctaagtaagttagtcaaagtcacacagcttgtagatagtggagttgggattcaaacctcagttttctaagactttaggctttttaactgtgtcctgttgcttttctctactgattgtccttttctgtcacttaccattcatttgttagcctttttactggcttctcattccccatcttatttgttccttaaatattatggttgtccagaattccatttttgtaaaactgaaaagaaacatatgagttctatagtaactttctttgaaattatacaagctttgtacttagaaacaaaacaatgtgggaaaaaaatttgaataccttcagagcatcatgatttgattagtgggcacacactaaattgtaagataaaatgcagaaaagtaggtaaatagcctataggtacacatcaaactgtttaattagtgagagaataaaatgattaaaaattaaaattacttaagcaagttctcaggcaaattctcatttctatttctttcttaacgagtctttaattagctgaaattacattagggaagtttcatgccttctatatttttgccaatatgtgaagtaccctctttattcacaaatgatgggtgtaagtggataatgaaacgtattcctcaggagaaagggaaattgcagtcaatttagtattattgaatatcaacttgtgtatatttttggctgaacaaaattaaagtcaacagccagcaagggaaaatttggttagaaatattttatgttatgtttgttttccacaatttcttacaaaatactttggagggagaaatataaaatgattttattataaagatttaatgtatctttgtaacattacaacaaacaaaagaattacctcaaactcacattaaaattttcaccctccaaactgtaaaataaacactagcttaaaattatggaataaattcatctttcatttcagaatcaacttatatgctagctttttcatggtttatgagaaactattatataattttctttttttaaaattatgttttattgccctttttaaaacttttattttaagttcgggggtataagtgcaggtttgttacataggtaaacttttgttatggggttttttgtacagattatttcatcacccaggtattaagcctagcacccattggttattctttctgatcgtttcctttctctcacccttcatcctctgaaaggtttcactttgtatagttcccctccatgtgctcatgtattctcattatttagtcccagttataagtgataacatgtggtattcggttttctgttccagtgttagtttgccaagaataatggcctccagctccatccatgtccctacaaaggacatgatctttttcttttttattgcatagtattctatggtgtatatggaccacattgtctttatcaagtctaacatcgatgggcattcaggttgattcactgtctttgctattgtgaatggtgctgcagtgaatatgcacatgtgtgtgactttataatagaacgatttatattcctttgggtatataccccataatgggattgctgggtagaatggtatctctatctttaggtctttgaggaatcacctcactgtcttccataatggtcaaactaatttatactcccactaacagtgtataagcattcctttttctccccaacctcacaagcatcttttatttttgacattttaacaatagccattccgactggtgtgagatggtatctcattgtggttttgatttgcatttctctaatgatcggtggtgtcgagctttttttatatgattgttggtcatatgtatgtcttcttttgagaagtgcctgttcatgtcctttactcatttttgaatggtattgtttgttggttttcttgtaaatttctttaagttccttatagatgctggacgctagacttttgttagatgtataatttgcaaaaatattctcccattctgtaagttgtctgtttattctgttgatagtttcttttgctgtgcagaagctttttagtttcattagatcctattagtcaatttttacttttggtgccattgcttttggtgtctttgtcatgaaatctttgcccattcctatgtccaggatggtactctgtaggttgtcttccagggtttttatagcttggggttttacatttaagtctttaatccatctcgagttgattttttgtatatgatgtaaggaaggggtccagcttcaaccttctgcatatgactagtcagttatcccagcactatttattgaataggtagtcttttccccattgcttgtttttgtcagcattgtcaaagaacgtatggtcttagatgtttggccttatttctgggctatctattctgttccattggtctatgtgtctgtttttgtaccagtaccatgctgttttggttaatgtaggcctgcagtatagtttgaagtcaggtagtgtggtgcctccagctttgttctttttgcttaggattgcctggtatatctgggctcttttttggttatatatgaattttaaaatggctttctctagttctgtgaaatatcaatggtagtttaataggaatggcattcaatctataaattactttggcagtatggccattttttaatgatattgactctttctatccatgatcatggaatgtttttttcatttgtttgtgtcaatgagataattttcaaagtattaattattttgtgctcattattaaatacgagcataatagaataggtcaatcttttctaaaataaaacttaaggaggaaataaaaatacccaaagtgcttgcaattcttaaagtaacttttgtttctaaataaaatatagagaaactctgtggtctaggttatctcaatatttgtcatttttacaagcataataaaaaattatgttatttatagttgtggttgtgtaaaacaggacctgtttttataaaccccagtcagtatccttaaaattttatgggttaataaatatagtacttgccttttaaatttaagtgtaaaacacttgaagttatgagaaaaaaagttatcactactatcataagagactgatatatatgaaaccaaagagtaagtagtgaaagaactaaaattctgaaaatatttttattataagaaagctgcttttgtcataaattaaatttgtatttagcggtactatagaaaacagccaaacagttaggagataagacatctttcatgttttattttaatatggaaaaagaaaagataaagtaagagctaatgatcaggaatgtgatgtcagcctttaacactttcaaatggattaaattcctggttgaatattaagtgagaaggaataaaacaagtatctagtgcatacgacattcaacacatttggtatgcctttaatatgcattatcccatttagtatgaacactttggcttaagaagtattgtcattccaactttatagatgagaaaatggagcatctcaaaaagtttgacaaattgcctaaaatctaatagataggaagatacaaagtcaacatttaacctcagaactctgatgccaatggccagtcctctaggttgtgacggttcctccatcttttctagatgctgataactttgataatttgagaaaaatcagtaaggtgttttgcagaatatctctgagttgatatttgtctgatgtttttccatggtaagagtaagggttacagatttttgggaggaagaacatagaggtaaagtacaattctcatcatatcaaaaatacttattatcaacaggacttattacagtttttgctgattttcatcaactggcagagatttttctatgtaactactcttttattctcccattctgtagtatactcttaggaagaaagtcattatgcacttaaggagtgggcagtaattatccacctccttaacaacagcatatctacacataaattatttggaattcttttgtacagatttttttcctccatttattatctatctatctacctatctatctaatgatttatttgtattagttggatactcattttaagcttttgattataattcattatactttattttgttgcttaaatatatccactttcatcattaagagctctttcagataaattctgtgccctattgaaatactctcatgtttgttttgcttgtttgtttgtttgtagaccacttcctttttttctggtattacaagatgtttcaggctcattttacatatttccttcctcagtcctaaaatcaaccatttctccaaggatccctggctacttttatcagaaaatggtattagaaacctagatctgggcatgaagtttgctcatttctaaggaatattgttgcttttatggtctcttagttgagagatcaagggaatatatgagtgtatactactgtgtgtgtatatacacgcctacaaatattgctgtatttcacatctatatctatattaagctaaacatgagttcatactgatgtctcccagtctaatctattatcacattgatattctacaacctcccattccaacagtgagacacctggctccgactgtcagccatccattgactttattccttaacgccagttacacatggattgtgatttcagaattgttagcccacacccactttggacaaactttaacaattatattacagagtgtttttttgttttgttttgtgttttgcctttagccttacagactcctttctttcaaaagtgacttagggtcaaaccgttttttctcacctcttttcctgaatttattctatacatttgtaatatatttctgttcgtctgtcctattctgcattccaacctcctgaatgaattatttgatttgcatacattaagatttactcttcatgctttaaattctatgcattttagcaaatgcttaatattttgtattcatcattactgtatcatacaggacagtttcaccaaccaccaaaaatcctctgtgcttccaatgttccagcctgttctcaaaacccctgggaatcacttaccatccctattttttgtttactttttccagaatatcatataattggaattatatagtacgtagcttttcagaatggctgtatttcatataatacatcttagagattcatccatgtctgttcaacacttgataattcatttattttccattcaaacaatattccattgtatggatgtcagtctgtttatcaatttttttactttaaagaccatctttggttgccttcagtttttggcgattatgaataaagctactctaaacagctgtgggcagctatgtgctgacaactcatatcacctctctccctcctacaagaatttcctttgccttttttgctctccttttgaaaatcacaccgtatctgctacaacctgccaccttcaccccacttaacaaactcctgcacatcctttctgtctcatatactcttcatgtcctctccaaattcttccccaacttctccagatagtagaggtctcttacttctgttatggttacagaaaaaccatatcactctgatagaattattcatctgagacagcatttaacatttaattgtatacatttccctgacaaattatggggctacataagcatttgtggaataaaaaaaactaaaatattaatgaaagaaaatgatataatacatatacttattcatatagatattgtctatacatataattgaataaactatcaagagcattaaggatatgtgacagtagtcaatgcagttctaaacttattagatttcagaacaaatttgaaaaattctaaattatgagatccttgttattcgataaaagggatttttggttgatcaagaaagtaactaaattattgagtaataaagaaatttatatttaattcacataaaaggaacattgagctatataataaacattattattaaaattaatttttaaagttttacaaaacatgtagaaatattctttatgactacctcacacattatctaaagataagagccgattatgtaataacacattctaattctttgtagttatatatgcaatggtatataaggcaaagggcttttttttttattaagtgttggtggaacagtggtggaaatatttttctcttaaaataactttatatgtccaataaccagaaaatacaccaaagattattgcttatctaaatattttttgaagattacactttggtttttttagttgttcaattataaaaaactttgattctctcagatatttgttattgtaagctttgttttgtttatttttatttttaatttctttggctttttttctataattttttatttttaatttttgtgggtacatagaaggtggatacatttatggagtacatgagatatttgatacaggcatgcaatgtgtaataatcacatcatggaaaatggagtatctatcccctcaagtatttctctttcatgttacaaacaatacaattatacttttagtaattgtacaatggtacttttagtacttttaaaacatacaatttactgtagtcacatccttgtgctatcaaatactaggccttatacattcattttaactctacttttgtacccattaaccatccccactttccttttacccctctaccacccactacccttcttagcctctgcttaccaatcttctactctctatctccaagggttcaatagttttgatttttaaatcccacaaataagtgagaacatgtagtgtttgtctttctgtgcctgctatttcgcttaacataatgaactccagttcattatgaacggaatgaacaatagaatggactgaagggtgagttctatttacgttgttgcttatcaaatggtgagaatttcattctttttttatggccaaatagtacttcattgtgtaggagtaccacattttctttatccaatcatctgttgatggacacttaggcttaatccaatcatctgttgatggcgattgtgaacagagctgcaacaaacatgggagtgcagatatctcttccacgaactgatttctgttatgggggatatagtcccagtggtggaattgctgggtcatatggtagctctatttttagtcttttgaggaccctccaaacccttctccaaagtgggtgtactattcactctctcaccaatagcatacaagggttgccttttctccacatcctcaccagcatttgttactgcctgtcttttggatataagccattttaactggggtgagatgatatctgattgtagtttgatttgcatttctctaatgatcagtgacgtagagcaccttttcatgtgttgctttgccatttttatgtattcgtttgagaaatgtatattcaaatgttttgcccattttaaaattagattattagatttttttcctatagagttgtttgagctccttatatactctagttattaatcctttgtcagatgggtagtttgaaaatatttacttccaacctgtgggttgtctgtttactttgttggttgtttcctttaccttgcaggagctttttaacttgatatgatcccatttgtctatttttgctttggttgtctgtgttttgggggtattactcaaaaaatcttttccagacagttgacctagagagcttccctaatgttttcttgtagtagtttaatagtttgaggtcttaaatttaagtctttgatccattttgatttgaattttgtatatggtcagagatagggatctagtttcattgttctgcatattgatatccagttcacctagcaccatttactgaagacactgtcttttccctaaggtatgttcttggtacctttgtcagaaatgaattcactgtaggtatgtggatttgttcatgggttctctattctgttccattgatgtatgtgtctgttttatgccagtacaatatcatgttattttggttactatacctctgtagtataatttgaagtcaggtaatgtgcttcatccagttttgttctttttgcttaggatagctttggttgttctgtacttttgtggttccatataaattttagaatttcaaaatatttctgtgaataatgtcatgggtgttttggtaggtactgcattgaatctgtagattgctgtgggtagtatggacattttaacaatattgattcttccaatccgtgaacatgagctatatttccgttgtggggtgtcctcttcaattctttcatcagtgttttatagttttcattatggaggtttttttccttctttagttaacttaatgcctagatgtttaactttacttgttgctactgtaaatggcactacttttttttcagtttactgttagcatatagaaattctattgatttttgtatattgattttctatcctgcaactttactgaatttgtttatgagttctaatagatttttggtggagtctgtaggttttttcacgtttaagattgtattatgtgcaaacaaggataatctgatttctttctttcaaatttggacgcactttatatatttcttttgtctggttgctctaactagggtgtccagtactgtagggaataacagtgatcatagtgaggattgttgtcatgttccagatcttagaagaaaggcttttagtatttccccattcagtatgatactagctgtaaatctgtcctatgtggcttttattatgttgaggtgtgttccttctatccccagttttttaagcatttttaacatgaagcgatattgaattttatcaaatgctttttatagtaccaattaaaatgatcatatggtttttgtcctacattctgttgatctgatgtattacattgattaatttgcatatgttgaactatgtttgcatcccaggggtaaattctgcttgatcataatgaacagtatctttaatgtattgttgaatttggtttgctaatattttgttaagggtttttgcatcaatattaatcagggatattgacctatagttttgttgttgtttttaaatttgtttttgtctcattatgatatcaggataatactgacatcgtagaatacttttgaagcattccctcctcctctagtttctggaatagtttgagtaggattggtattagttctttaaatgtttggtagaattcagcagtgaagccactggattctgagcttttctttactgggagactttattacagctctgatcttgttaattcttgtgggtctgttcgggttttggatttctctgtagttcaatttggtaggttgtatgtgtcaaggaatttgtccatttcttctagatttttcaatttattggcatatagttactcatagtagccactaatgatcctttgaattcctgtggtatcaactgtcatgtctcctgtttcatcactgattttatttattctaatctttccttttttttttctgtcttagtctggctaaaagtttgtctattttgttaaacttcttttttttttttttttgagatggagtcttgctctgtcacccaggctggagtgcagtggcgggattccagctcactgcaagctccacctcccgggttcacgccattctcctgccttagcctcccaagtagctgggactacaggcgcctaccaccatgcctggctaattttttgtagtagagatggggtctcaccatgttagccaggatggtctcaatctcctgacctcgtgatctgcctgcctcaaccttccaaactgctgggattacaggcataagccaccacgcctggcttgtttaactttcgataagccaactttttgattcattgatcttttgtattattttcatttatttctgttctcattttatcattttttttcttctacaaattttgggtgggtttactcttccttatctaatactttaagatgcattgggagattgttatttgaagtttttctcctttttgatgtgagcacttacagcttttaaattacctcttattgctgcttttgctctgtcccataggttttgttatgtttggtttccattatcatttgtttcaaaaaatttttcaattttctccttaatttctttatggacccactagtcgttcaggagcatattgtttaatttccatatagtcctatagttttcaaaattcctcttgttattgatttctagttttattccatagtagttagagaagatccttaatattatttcaattttttgaatgttttaagacttgttttgtgacttaacatatgggctgtccttgatgatgatccatgtgctgaggagaataatgtgtattctgcagttcttggatgaaaagttttataagtatctattatgtccattttgtctatagtcaagattaagtctgatgtttctttgttgattttctgtctagaagatttgtccaatgctaaaagtggggtgtttaagtctccaactatcattgtattggagtctatctctgtatttagctctaaaaatattggctttatatacctgggtgctctagtatcgggtgcatatatatttaaaatttttatatcctcttgctgaattgatcccttaatcattatatagggaccttcttagtgtcttcttatataatttgtcttgaaatctattttgtgttgcattagtatagctgtttctgcttttttttggtttctattgtcatggaatttattttttcatccgtttattttcagactatgtgtgtatttataagttaagtttatttcttataggcaacagatcaatggtttttttttttctttattcagcttttgatagaaaaatttagtccatttacattcaatgttaattttgataggtaggtaaggacctactcctacaattttgttttttgttttctggttgttttgtggtcttctctttttttgttctttgttttctgtatttcttttagtgaaggtgattttctttggtgctatgacttagtttcttgctttttatttttttctgtatccattatatattttttggtttcaggttaccatgaggctttcaaacactatcttataacccattatttaagttaataacaacttaacactatttgcataaaggaacaagctaaaacaaggctagtaaagactgtatgccttaacttcatccttgtgctttttaactttttgttactatttacatcttattgtactgtctgtcttaaaacgttgtcatagtttttattttttattggtcaccacagttacaatgtcatagtgttctgtggttttttgagatacttactattaccagtgagttttgtaccttcagatgatttcttattgctcattaatgttcttctctctcttattgaagtactccctttagcatttcttataggacaggtctggtgttgatgaaatccttcagctcttgtttgtctaggaaagcctttatgtctctctcatgtttgaaggataatttcaccgaatatactattctaaggtaaaactttttttttcctttagaactttaaatatgtgatgccactctctcctagcctgtaaggtttccactgaaaagcctgctaccagatgtattggagctccattgtctgtcatttgtttcttttctcttgctgctttaaggatcatttctttattcttgacctttgggattttaattattaaatttcttgaggtaggcttctttgagttaaatctgcttggtgttttataaccttgcacttgactattggtatctctagatttaggaagttattatccctttgactaacattctatccctctttttctaccttctctttgaagacagtaactcttaggtttgcctttttgaggttattttctagatcctatagctgtgcttcattgttttagttatttattcttatctctcttctttgtgtattttcaagcaacctcttcaagctcactaattctttcttctgcttgatcgtttcttctattaaaggactctgatatattcttcagtatgccaattgcatttttcacctacaggatttctgcttgatttttaaaaattatttcaatctctttgttaaatttacctgatagaattctgaattcctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccggctactcgggaggctgaggcaggagaatggcgtgaacccgggaagcggagcttgcagtgagccgagattgcgccactgcagtccgcagtccggcctgggcaacagagcgagactccgtctcaaaaaaaaaaaaaaaaaaaaaaaaaaaaaaaaaaaaagaattctgaattcctttggtgtgttatctcgaatggcttggagtttcctcaacacagctattttgaattctcggtgtggaagctcacatatctctgtttctctaggattggtccctagtcctttatttagttcacttggtgaggttatgttttcctggcttgtcttgatacttctagatgtttacctgtttctacgcattggagagttagatatatattgtagtattcacaatctgggcttatttgcactcatccttcctgggaaggcctaccagatattcaaaaaggcttgggaattgtgatctaatctgtatctgcttgaaggggcaccccaagcccaataatgctgtggttcttatagactcatagaggtaccaccttgatggtcttggataagagccagaagaattctctggattaccaaacagacattcttgttcttttcccatactttgtcccaaacagagtctctctctctctctctctgttctgagccatctggagctaggggttgagtgacacaagctcccctgtggccactgctcctaggactgcactgggtcagatcttaagccagcacggtattgagtctcacccaaggcttgctgcaactactccctaactactgcctatgctcattcaaagccctggggctctacaatcagcgggtggccaagccagccagtcctatgtccttccctttaaaaggtgagttctcccaggacttggacaggtccagaggtgctatctgggagccagggactatagccaaaaaccttagaagtttacctggtgttctgttgtactgcagctgatctagcattcagatcataagacacagcttttttccgctcttctctcccattttcaaaggcagaggagcttcatactgtgaccactgccacatcagactcatcgggagtactgccagaatactgcagatattcccttatggcccaagggctctttattcagcttgaggtctgtctagcctgggactcacccttcagggaagtgggctcacctctggcccaaggtaggtccaaaaatgccatccaatagccatgtcctagaatcgggaaccccaagagcctgtttggtgttctatccccctgtggccaagcgagtacctaacatgaaagaaaaagtccactttacttttttccctctgattttctcgagcaatagtagttttgccccatagccaccacatctgggaatgtgctgattcccatctgaaaccggcaaatctcagagtctcatgaaaagccctaaacatagttatctgggtattactgctggttattcagggcccaagggctcttcagttagaaactgatgaatcctgacaggcctagtgcttctattcaaatcagcgggttcccttctggctcagggtgtgtctagaaatgtcatctgcgatctagggcctggaaaagggatgtcacagctctgactagtgccctgtcctgctgtggctgagctggtatccaagatgcaaggcaaagtccttccactcttctgtctcctctcctaaagtggaaggaaggggtctctttcggagccgtgagctgtgcagtttgaggttaggagaggggtgagacaagtactcccttagccatcccagctggtgtctcagtaggtcatgtccctctatcccccaactcaactggctcttggtccagttcagcactaggactcacctaggtgttacagttcttgtggcctaaactgcctttcaaggttatctggggccccagtggcctttagcttgtagtggcaaggcttgtgggaattcaagttctgactgttagaatctgtaactcccccctcactaggactcatttgagtgctctctttatgggcaggcatcaggggagtttggtctagttttgctttcttctataacaagggcagcactgagttcagtgcctcataatcactgactctccatctccatagggcacaaaaatactctctgcatcatgcttccactacccagggattggagaagtgtgacatcggtgattcggaactgttttttctacctgttcagtgcctctttcagtgatatgaagttaaaaccaggtattgtgagtgctcaccttatttttggttcttacaaaggtgcttttttctgtagatagtcattaaattagtgtccttggcagggcaggtggggagcaatatttgttggacccttctattccaccaccatcttgctgcagccctccttttaatttcactggcgtttttgcaggcttcttttttaaaaagtatcattgttattattattagatacaagagactgtgtattactctgttgcccaggctggagtgcagtggtgcgatcatagctcactgcagcctggaacttccacctcagccttctgagtggctaggactaccagcacatgccactacaccaggctaccaaaaaaaaaaaaaaaagaaagaaagaaagaaagaagagagagaaagaaaggaaggaaagaaaaagaaagaaagaaagaaagagaaagaaagaaagaaagaaagaaagaaagaaagaaagaaagaaagaaagaaagaaagttagttcatagaaattggagtctcaatatgttgcctgggctgacctcaaaatcctgaccgcaaggcatcctcctgcctcggcctcccaaagtgctgagattaatgcaggcttctttatatgtgtaaacatcccttttaaattataaatgtaaatatttagaaaacattatcttgccccataaattaataagtttatacactttttcagatttaacctccaaaaaaataaaaatctgtatcttaaatgaacttggccacccaattaaatttgagtcagagcctgcctactttaattaacaaagaaaaatatactgtgtagttttacataaaacaatggttgactgaataataataggtaatctttaactattttgggcatgaccatctgttgttaagatcattttaaatcatgtattcttataataatctgcaaaataaatcccaagtcaactttctctcttggtgaaacatcatttgtgattttcaacagtcagcctgttttgtgattctgtttattggaatttctgattctaatagtagtgaattagtttgttgtaagtaatctaattatgtggccattcttacttgttgaaataatgtagttgatatttctaataattttaattactttagttcaaaaaagagttattagtcactatctttaaaaggcactgccggccaggcacgatggctcaggcccgtaatcccagcactttgggaggccatggtgggtggatcacgaggtcaggagatcgagaccatccaagctaacacggtgaaaccgcatctctactaaaaatacaaaagaaaaattaaccaggcatggtggcaggcgcctgtggtcccagctactcaggaggatgagaaaggagaatggcgtgaacccgggagatggagcttgcagcaagcaaagcccgtgctactgcactccagcctgggcgacaacagagcgagattccgtctcaaaaataaaaaaataaataaataaaggcactgacaaaaatgtttttattctgatacaaaactttttgagaggttaaagatcatctgtaaacagataaaaataaatcatgaattaatacgttggtgatttttgttgagaagtggtgatgatgaagaaacaaaggctttgtgaaatatgcaagactgggtaaaacaaggagagaaaaatagtatagcaatagttattagaatgatggaaccgagtgaactcgttgaattgcttagaggtcattgcagccatcaagtgtgggttgcattttactagtatggcaaaatgacctaataattgaaccaaaaattgaagttaatttgtaagaattatgtgactacttagtagaagaaaaaggatgtgatattgggaaaggaaagcttaataataaattgtcattaagacacaaagtcaactatcatttattgttactatattccaatttctgtgctaggcacttacacttaccatcgcaagttgctctcaggttattcatttatccaacatgcaataagtttctgggagttataaggtgttttgccagggatatgataattaatatcataaccttgttggaggcttagtttgcaaaacatatttataagatgattatcaaaaaaagaatgattaatgacttgatagaagagtacaaatagtggtgaattataggaaaaagaaatacactccgtttagcttgtattttagtttcctagctagaaaatgaaagagctaaaatttaagttcaatacacaagctatgcagccttgttttctttatctcaatttataaaattataagaaggtcctttgcaatttgtagaagaactgacacggttaaggaaataggtgaaaacaaggacaagaattaacttacaggagaaaaatgcacatacctttccttgttttcataaaagactggcaagctagatccatattgccagagccatgaaagactgttctaaataacatgctagatgcctgatgtgagtccaaactgtggaacaaaaggtttctaaatgtattttttttgcaagtatttattcttgatgattaaagggacccaaaaccagagaagaagagagagagagagaaatagctaaacagctgtaaatttatccagaaagtactactcaaattctccttgattttccctgggcaacaatcagcaaacttttcattagaaggaactttaaaaggtttgctgatttgcaaaacatggcatgaataatgtgtacattacttgcataattggttttgtgcgtacatatggcacatgctattttggaaatgtaccccctctgtgttcattatagctgttgctcactctattccctgataatcatttatagttacttgtcacagtttattattagaaaattaatgaatcagcagttttgtgcactctcctttaacaacctaatcttagaagtttccaaaccacagtatacagtaatagaaagcaagtagatttcccaaatttatttgcgtatattgagctgcgcattttacagagattatctgaactttcataaataaaactttcattattctttatgaattgttctattacattcacagaaaacattttatgaaataaagttaatcaataaatctatattggtaacatgtttattttcacatattttctaatttttacatagcttaagtttttcccttgtctgttgaaatttccacaatatataattacaatttttcagttgaggaagccagaaatcagacagaaaagagggccaagagcagtagctcacacctgcaatcccagcactttgggaggccacagacagattgcttgagcccaggagaccagcctgggcaacatggtgaaaccccatatccacaaaaaaatatgaaaattatatgggtgtggtggtgcccacctgtagtcccagctatttgggagactgaggaaggaggatggcttaagcctgggaaatggaggttgcagcaagccaagatcatgctattgtattccagcctggatgacagaatgagaccttgtctcaaaaataaataaataaatacaaaaaatttttttaaaaaaattagaaagaagctctttttatcacagctcttagggttttatgtggcttggagatgagcccaaggagaacttccacccaggagactcttaatttgactgtttctacttcaaattactcctatttgtagcctagagcccaaggaaatagaatagcatttgcccttgccagcaaagatctggattatcagacaaggattttaagccatgcactatttgtttaaaaatttctaaacttagcactaaagtcactgtataaacccatggaactccagtttcatttcttacatatggttgattggtaaaacaacctgtagactccacatagactaacggaataaataacacatgcaatcctattttgaatgtttcataagacatttatctcccacatatagacccttaactatgggccagacaagatatattactttgaattactttgacaaactaagaagcataccagaataaaaataaagaaatggggaaatgaagcttttaaataatattattcaaaattatctcaaattatattgtattaagatgtatcatagatatgtaacatttccttgtatgatttttatatagaagaaatatattatttgaactttcttaagaaggcaaatgacaaagttttcagagtttatagaatattgtagtataattctaagtaagatactgtactgtacattggtgagggacagggaaaacaaaggtgaatagatagtttcttatcctcaaaatccattcaatattttttgaatatgttctttataccagccacaaatgtgccaattctagggaatatatataaagatcccaacttcaagttaatcaaaatctgtagtttccaagtcttcatactaatagctaattgggaaggctgttcaaacaatgaatactatttatcactgtatcaatttcaccatctcattgctatcctcacctccatcatcatcatcatcgtcatcattggacatgttatatttagtactatgcaccagctactctgttaataattgttgatatttattacacataatcttcacaataattctaggaaatagatgccactttaatcctgtttcacagagaaggaaacagccttgaagaaataatataaaattcccgaggtcgccatgccacactcattgtgaactcaattctagcttttcaccacaacgttatagtgcattctttatcacttgctctctttatggaagagtttgtattgtattattgtttcaacccataaatgaggctgtatttttgttgcccttttctgtagatgaattagtaagtttaaatttgaattagaagatcaccctgcatcaatcagagcagggtgaatataactaatttaattgttttattaccagagtacatcaccaagcagacatcaacaacaaattgcacatttgactttatgactttattataaactgcagcagcatgtggattctacgaccaatgacacagcttatctctttgcaccttgttaaccttttatttcactgttctttaaagtgagaactcagaagtcagagcagcatctgtctctgccatatctttgcaggcaaattaatctacatcaaagcaccctgaaaaaaatacttagagtcaagtattaacggggaaggtataatgttaaagagagcaaggaagaggaagattaactagaacaggcaataaacacaaaagcaagggacttagtctgaaatatcttgatatgtcaatgggcaactaacagtgtgacaagttatcattaaagaattcagcagggctgggcacaggggctcaggcctgtaatcccagcactttgggaggctgagatgggcagattacttgaggtcaggggtttgagaccagcctagcctacatggtgaaacactgtctctactaaaaatacaaaaattagccaggtgtggtggtgggcacctgtaattccagctacttgggaggctgacgcatgagaattgcttgaatccaggaggcagaggttgcagtgagctgagatcatgccacttcactccaacgtgggcaacagagaggaactccatctcaaaaaacaaaacaaaacaaaacaaaaacaaaaaaacaaaaacaaaaaagatttcaccagaaataacaaatcagtaatcttgtttcaaaattcgtttttttctcagaagtctttgttgtaatgacacttgaaactacatacaattcatgactctcttataggtgtttataaagttgggaaaagtaacacagtaagagacttcaccatctgcaagtgaaaaaaatccttttatttataatctcaactattctgccaaaaccagtgctttctgtctagaataaattgatttttgcttatgcataaattaaatgtcaacacatctttcacaaatctacttatggccagccaaaaaccaagctgttgagctagaaaacaaatttaatacagataactagatattctatttgttcaacaaatagatacaaaagaaaggagcttcagtgatcccaagttgtcagtgttaattagttgatatttgaagaaaattcctgcctcttcctcctaaaccactgtggatcaggaaacctgttatatattatatttctgtccaactatgtcttataacgcattagttccagctgaacaaacgctgagaaaataacaaaaatatacatttccatattgcaatattgatatcactgtgttaacacgtttaatttaaattctagaaagttttgagctgggtgtgttggtgatgctctttctctgccccatggaaaggggatgtatgtgtatagttgtgcacacatggatatttaataagtgcctgctgagtgccagaaactcttttaagcactatgacctggagatacagcagaaaattatatacatatgtgtgtatgtatgcagaatatatatagaatatatatgtataagaatatatatatacattcttaactttacaaagaagttcagcaatgaacaaatacatatacagtatgtcatgaggtcaggctaggcagaaaaatagagctatataatcagggcagatagtgataggggtatgggagggatgttttgagaagttctctctgttaaaatgacatctgagcaggacctgaattatgggagagactaagatgtgtggatatctgggggaaattatttcaagcacagagaagagtgcccaaaatcctgagactaaaataatcttgctattctggaagaatggcaagaaagtctttgtgtctgtcgtgagtgacagaggagagaatggcagacaatcaaacgggtggtcagagtaaggatactgaatatagtttaacaaggaaggaaagcattttgaggatagaattttctgtgctttttagttgcctttggcttcctgttataaatatctgaactattttattttttaagaaaactccagtaaaacaggcaactcaatattgtaattcttgaagtatttgttctcatggattatttcaacaaggcatgctaaaacacactctttggaattataggcgtgaaaatgtgtgatatcttttcttacccatcatccatcataagggtcgtggtgagcattcctataaacaaaaaggaggttaacaggagcaaagcacaacagatttatttaatcaaagttttacacaacacgttgaaccttcagattgaataacctaaaggtacatgggaagccatctgattttcttctgaggtttaatgaagcagggacagtgagtagaaatgtgactggataaaaaaaaaatgtgtgatctaatagtagtctaatagtgtgaggaagaaaacccagcaaggcttgtctgttcagcttcttcttggcctctctgtgaggcattctctccttccttctgggtatggggcagggcctctctggaatgtgggtcttataacctataccaggtaaatcagaaaatttatttatggccagctgttatgcagaaaagagggggaaagttaaagtaatactttcaggttttatggctgtctttgacgaaagggagttctggtttctatgactcacattgtgggtgggggattctagttgtttctatggctagcctctggagaaactgaggggagagcaggagagtgtcaaagataaactttgcttctgaggccttcactttgtgatatcattttctgggccccaataagacctagcaccaccaaaatgtgaactaattaacagatagtcgtgcaatcattcctttccattaacgtaacttgcatagctcttcaacactttagaatggtagagggggcatcaatattatgaagaaggaaattgagttccacagaagttgaatgatttaatccgaactcaaagagtcaattaattctgctcttgatttttccagtgtttatttatttcaaaaacctaagttaagttacacaaaaccgaacaatataagtagcctcaaaatagtgcactgtagtcagcttgtacctgattttccatttgtatgtgcatttcttcccaacttcaagttcagtggcagctcactggcagcttggagttagccttggtgggagtatttagaccatgaatattagcaaatgctatataattcagggttttatttacttatttattggtgtttcttggacagcctaattaccagcatactggaaattacaagtatgcagggtattttttcaacatatattatctaaacttttacataaaaaaggagcattctaatgcctttttttttgagacaaggttttgttctgtcacccaggctgactgagtacagtggctcaatgacagttcaggggagcctcaaactcctgggctcaagtaatcctcctgccatagcctccccagtagctaggactacaggcaagcatcaccatgcctggctaatttatttttattttcatgttggtgagatgggttctcagtatgttacccaggctggtctcaaattcctggcttcaagcaaacctcctgcttaatctcccaaactgctgagattacaagcataagccatcatgcccagtctctaatactactgtcacaggtgcaagtatctggggccggtgtcatgggtggtaaaggaatttaccaagacagttgtaggtaaagaaagatagattacagggaaagtacattgcaaggtagcaacgggcatcataacagagaaggggctgtctgcaaggaggcagaggctggagggaagttttatagggttgtgctggaaggggctatgtgcaaaacaaggtatttgggaaggggagattatgccagtgaattgtttgtaaatagctgtgtcttagaacaattgttctctcccacttgggagctcttccttgttgttacttactcatatcaggactccacaactacttctactttgcacttgtacattttactgaaagtatctgcttatgaggctttaaactccaagaggcagagactgacctatttttctgtgtatccaaactagaattgaacaacaaacgcaaattgactttaaaatcaatgaccttcacagataaagtgtcaatgaattattttttaaaattaatttttaaattactgttcaatcaagttaaaaaaacccaacttggtctaacttgtcaaatagcagcgtgaatacattttatatctttctattatttttcaataagttatttttatattaggtagtcttggtccaatattagtgtgataatatgtagattaaacacactcattggtttgacaggcaaagcttgatttgtcaaaaatacacggattattaaaacacatttttaattagacagtggttatctcagggaagaaattgctaagtataaaataatgacataagtgaatatgttaatctacacttagtatacaacaaaacactattcacaatgtaccgtcaacttggtgtgaatgttaagtttttgctagaaatgcacaaaagatgtttcattaagagtttgatttcactttatttgtaaatgtgtcttaatagactttattatagccattgtgttgagttgaagtgctcaattattcctactattttatgttaaattgtactattatctaggaaaataaaaggctgagttgaagaatctaatgcttattcaattgtaagtattgtcccatgaaagcagagactcttcatttccattcttttgtaaattcatggtgtcacaagtaggatttttatttattacttttaatcttcaataaacacaaattataaatcacattctttggatactaaaaccattactagctattgttagacttaatagactttattgtccccattttggtgagttgaagcattcagttgagtgcaatgagatgtattcaattgtggtaacattagaaaagtttcatgtttaaacggtgatctctgagaagttactcttgtaaatttaagttatgctgacttggacaactcttttcagatttatgaatatatagccttggtcacagaagtaatttaaactgctcaaggtttttaaagtatctaatgcacttctcttttatttctgctggttacaatactgctagaaaagtcagccttgctaaggttaatccaagattacacttgcaatttctgtgtaacttcaatcaaaatagtagagaagaatattgggataatttcatgactacattgctaaaaataaattacttctagtttttaaatggaaaaacaaaaaaatttaaagaaccaacatgaaaacaacaactttaaaaaaaaggtatgagttattcttactctatgtggaaaataaattatgtgaataatttttgcttgttttggcacatttctttaactagatccataggcaagaaaagacagtaaaactcaagttgacatcaagccattaaagacctggaaagaagagggtgttaaaagcgctcaagttcagataacatgtccaaagggataattgatgctgcaaatttttaattggatttaattggatccaagaacatttaattggattatttgatctttagctaaaattacttttctttttggaagttttcggtacagacaatgatttctgattattgagactaacctgatgcacttcattttggaaaccatttcaactgtcattaaaaagacttgtttggggtttctttcttcccatggctctaatgtaattgacaagtgccttttcagtaaattacactcattacctgttctacttactcttgctagttatttttcttaagtatctgtcgaatcatgtcgtgatcctgaattaaactcctcatgatgcctccaaataaagtccatgtcctactttatgtcatacaagccttttaatcattctaaagttacctgtgtgaattgtggaaaagttcaagctttggagacagatgaattgtatgggataacatatgctttgccacttagctagctatggcagtttgctatgccttctaatactcagtgtcctcaactataaaatgggaggattatgcatgataaggaatgtcaagtttctacataatacagtgcctgccactaagcaagtgccaaagtaaacaaacagcaaagtttatgaccacttccccatattctaattcttagaaaatgtcatcaactatgcagagggcagagatcttgccaccatcatcacctacctgagcacaacagcactgcacagcctcagggatggtattcaaactgcagtcaatgtgaattgcaccctctggagatgtaaatagaccagtcactgtatgtgatgactttactcattttctagagcttgggatatgcttgtcggtttgttgaatggataatgaaactaagtgaatttctaagaagttgagaggtttgttttatattaaaaaaaatttgtcttacaaattattgtaattatttatttctgggttaagtggttgcttctgttttaatcctctaacaagctgaatgaatgttgaaaccatgctgtgccaagaagggctaattggttgttttagcttattagggctggaagtgttaaaaacagagcctgacagcaatgaaattagtgacaatactaagccagagttatatggactgtagctaatgaagggcatgtatcattcccaatttttaaatagtatcttttacttacagtagattgagttgttcagtagggctggagtggggggaggggtgtggctggagaaagttatgtaaatttctgatgaaatacaaattggcagtggattggcaatatttgtttcacagtctttctattgtggtattttcttacaaattattgttattgttatatcccaattaatgacttctccctgtaactcaacagaggtcttttaattaatttcattaattcaaaaaatgttcagcaaacaccatgtatctagcatggtggtcttcaccaaatgtatgatagtgaaaaaaaggagtctccgtctgcaaggcattcagtttaaggaaggagacagaaaattaaataaagtaggagaagtgctatagtcaaggtaaatccaaggtgctggggaaacagacatgtctagtgttaaaaaattgttagaggtgatttagtgcagccctctatttacttataaattccccggatacaaggctgcagaaccgtgactccattgactggtacggtggtttggttcaaatgctctttttggtgaaacttgaacaattagtcatctggtctcctttgacagaaaggaaattacttcaaagaaaagtattttgaaaaaacgtaagtcaaaaaaaatctgggaaaaaggttatccccaaaatgatgtatcaactgcatgtcataatttagataaatattaattttcatgcagtgtgcatgcaagccctgggattttagaaattttagcttaaagtgaaaaacaagatatttcagtgttaatggtagcacataataagaattttcatacataatgtcacactcaaaaaattttttaaaaacctctagtgttgtcataaaaagagcaagcttctacagctcaaattctggccatttcagaacttgaacaacatgtagagccttcctaattgtcagaatcctagtctgaaaagggccatgataatgcttacataattgagttgtggaaaggattaaataagattacgatgaaaaagtaccttgttgaatgcctgataaattgaaagcagtcaatcaaaggcagctgaaaagaaatggctgcttcactggttaactgtcaggtcttgtggttacataagaaaatatgggcaagatagacattttctctcttgggttgaaataaaattttgatatatttcctatttcctacttgaattttactttcatgaggacagagaacctgggaattctcagtattcctgccctttgctgtccatgtgaaggcagcactgctcccaattgcactgttacagaatcacagcttctcggaagcatggatagcagggcccttctttcaggcatcttcttctcattctttcctagctctcttccttattgcctggaaattataattgtgtctttcatcagaaagagcatgcaaagctgaataagaagaacttttgtttacacttagggggagatccaagctctgtattattcattgaggttttttttttttttccgcctaataaatattcatagagtacctactgtgtgctagacactgctataagctcaggggatacatgggcggacaacatacctcagattcctttacagagtttatggtattgtggaagagaggtgaaacaaacaaatatatagaagataacttctactagtgaagaattttgacaataattcaatgaccagtgctctaatttcactctaaagaggctacccagagaactgggaagaagaatgggctctgtacatccttgttgtagaaggaagctataggaataagaacagaattcaggattaaaatcatttgctcttcgtcgctgttgcaagcagctttgttaaaaactccccaattgaaactaatttcatatcaagaaattatagcacctttggatttttaatgggctttatgtagcatgacattgacttatgacaatcttgatgtttgaaaacaatttgccattttatgacttttttgcatttctggatgacaccgcattgcatgtttcaaaatattatgagctttataaatatacatttaggggtaatttctgcaatattttcttagtccagttaagttagatcagagtgttgtttgctttgtaagtttaatttagaaatttgagtaaatgttttggtttctctgaatccaattcactgcctattaactttgcctttggaaatatggcttttactaggaaaaaaaaaatagctgtcttacaaatcttgcaaataaatcaaaaacaacttatcatagattttacatgcatcacaaattttcagagtcaaattttgtggtaatgtcaacctgaaaagaactgcagctgtctattcaggtgtgttcaatctctacttgataggaataattaccttctaccctcactaggtaattgccttttgattgaggtcatcagagcaatcaagtcagtgagaggcggaaatctagagtaggaaaggagacaaagggaagaatcatgaacagaactttgaaaggagaacaagaaagaagaggtttaatttgtttttaacatttaactgttcagtaataatttaaatagtggcagtcataaaatcatcataatatgcaacctgggttaattagcttgatatttttgttttttgaagtgaaaagcttgatatttttgttttttaagcatttgattagtatcattacacattcctatgaatgacaactcactctctaatttagtctccaaatagtctttgcatacacattatatcaggggaatcgtttaggtactgggacaggtagaggtgggaacaaaataaagaaaatgtatgtcctaacagggtttacatcctgattattgaaaaacaaaagcgattcatgttactttatatttttatatatatatatatatatatatatatatatatatatatatatctgtattttaattatactttaagttctagggtacatgtgcacaacgtgcaggtttgttacgtatgtaaaacaaagagagtgtagaagcaaagggaatagagagggttttttattaatgaaacagggaagaataaatatttgataaattgacagtcttcttaagtgagacatcctggggatgagtttgcaggaagacaaaacagtagtgtaaaatgtttggaatgttcaaagaacttaaaggaagccagtgtggctaagagtagtttgaacaaggggtaagtttgagatttttgcagactaataagtgcatcttctaaacttccaatttaagacttgcagatgttggggaaatataattaaaaacaaaatcttctcctaacccagaaatcctctctacaaagataatagaggaagaaaacattttcgttattgaataagcatgtaaatagaatgtgatgcaatcacaggaaatacactaagagactgcaggtacagcaaaatacggcagagagagaaatcccacctttacgtagagccaagcagatacatatcattacatatgtcttttcaagatgaacaataagtagtcctaaagaggacttgacaggactatttgtcacatatacttcattttaactttacctggtgattggagtgactatctgtgttagctatggtctttactcagaggaaaaagcagcttctatctttatgacaggagttagtcttgcagtttgcagcaaggtgcccactgaagtgaggcttccaccctcgagcagaaactgagagataggaaccttattttccatgatgtttacatttcaaagagatggctccttggtcgttgagaaagacattccttggtcataaagctgacaaaagctttatttagtttctaaaaatattcatatacatttcaaagaaacagaaaaagtacttacattttcaggtttctaaggtaaacttactaacaaaatgggaacggaggaaaatctatttcctattttcaacagtgagaattaagcctcttatttttaatctgtattttttctcattctagtaatacctacattagtgcttctcaaactttaatgtgcataggaattgcttggtgatccatttaaaatgcagattctgttttgatgactgtgaagtgagatctgaatctctgaattcacaacaggttccctggtgatgccaatgccatttgtccacagtacaggctttgagtgacaaggttagataaggagctgagagagaggcagcataagactagtgatttcgactagggtgggtatggggtgggggagcggtggtgtatgatcaagtattataaggccttgtagaccatttaaaggacgtttaggtttgaatgatattaaaaccttagagtataacagttcccttttatttgtgggtcataagttccaagaaccccattaggtgtctgaaactttggcaaatatctaacactgtggacacagtaagtactgtgttttttcctatacgtacatacatacatacatatgatacagcttaatttataaattaggcacagtaaaagatgtataacaataacctaataataaaatagaacaattttaacaatatggcaacatcaatactcttgtactttggtgccattattaagtataataaggattacctgaagacaagcactacaatctaaacagtgggtctgataaccaagacctctacaagtgactaatgggtgggtagcataagtggaaatgcaggacaaagtgtcgtgggatctgggggttgtcgctttcccagctggaaacctctgtggctggtggcacccagcatgctgcactcagctcatgctgccggcctcaacctcacgcctgcgaagggtgagccaggtgtggagcggcaaggggtgtgtaaatgatcactgggtctggccactgaacacagccaggcatgccagctaaggcaggcaggcagctcctggcactggcacagtcacgagctccatgtgaggctgcagctgggccagacgtaatgtaagtggcatgcactgtgagcactggggaacatggtggtgcccacaagcttggagatgccaggaatggcagagccccaaagagggtgtcacagccctggctcagggagctcctatgtctgggctgccagaaggactgcagctcttctcttattttcatcgcccacaacatggtaagcagggacatgtttcagccctgtttgtgttacagctctttcagtcgggccattcaatgggtcctgagttcttgttctatgtccaggaagaatgaggtacgtggacaactggagggtgagcaaggcagagagaagcgtcactgagacagaacagctcagaggaaactcaaagtgggttgctcctttccacaggcaggttgtcctgatgagtgtacaactcttagcagagaggaaacccatagtgggtagctcctttctatgggcaggttatcctgatgaatgtccagctgtccacatagaggagacctgtagcaggtagctccgtcccacagctggtaatcccaatgtctctgtgagtctggctgagtctggggtttttatgagctcctaagggaaaaattgtgtgctgattggtccatgggtggccataggcagacctggaaaaacaaccatctgattggccaaacagtcatcaatgaagtcctcactccaggccagggacttcacccagaactggcagcccggccctcaggcttcaggctgtttttgttttggaggtagggtttcactgaggaccctccgctttccttccaggaacctgtctgtctcctgccatcaacatgccatccatggcgccaaggttgttcgtgctgagagatgcctgcaggcccaggccaagacacccacaccaccccttgcctctctgctgtgctatgtggtgcccaaagtttgtagagggacaaggtggtggggtgggggtagggggctggcataacagcaccaccccaaatgtgtgcacactccctggtttgcaacagtgcacacgcccagccacaactttgctgtgcactggagcaggtgccaggagcagagaaagaggccagagagtgggagcagacacttaggagctttcaagggcaggggttgcttcctgagcctctgagaatgcagggatgccgaggtctgcagccatggctgggtggctgcaactgcaccctggagtgtggggctcctgccagctcagtaggggcatggtttccacctgttcctcacctctgccagatccatggggcacatagccctggctactcctcccccactgcagccagtgtcttcacagcgctgctccagaaaggtcactgctgccatcacaaccatggttagagatggaattgacaaggaaatttggttatttatgtggcaaacagcaatctaacataattataattactactgataacatatactaagaaataacagaatcacaggaacctcatacaattttgcaacacatattaatagcatatttataaaaatataatctaaaaagaattaaacaccatttcatatttgacaatgcttcctgtatgattttattataccaaaaatctgactatttctcttttggacttcagggggcctcatatcaaaaaaattgatgaagtcaaaaagactgaatttacaatttggtttttgccagtttgccaaataacagaggtttaaaacacttgatatcacaaaataggatcacaggtaactgtaaaataagtcattcatttatccaaagtggtaatacaaatatttccaaaaaaagggcaaaaactctgactcttttagaaaggagactcactttcataaacaatgagacctaataaagacatcatgaggccagctaaatatgtttctcaattcttataaacaaatctattaaattttaatcatcttgaccataagacagaattttcgtaagcctttttataatcttttacaatttttttaattaaagagtggttaaagctgccagaaaacttcgttaatctgacacactggcacaaatgctggtcttgtatcagtgcctttgatatgaatgtttaatttatcgaaaaatactgaactaattttctctgaaaattagcccttacagtctcctgcgtccacgtcttccatgttagtccttgggcctggaggatttgaatagttctaatttgtggccttgtatctcatgaatgcaaattattttgattgtcatattctaccaggtctgaagataaggctactgtaagtgtttatgatttagaaggagttggtgtcctttttagactcaggaatcatagccctgtaacttaacagtacagggactctaaaagcaatacagaaaattacatggatataataatcttgtatttttaaatctcagttttactaagcaaatcagaaacttaataacaatggcatagaaattatttcgataaaacataaaatctgtttcttaggccagttaccgaaaggcagaaaaacaaaaacaaaaaccttctgcagtgaggttgctttcctctgttaggggtccatttacataacctgcaagtcaaaactattgaaaagagtacatgaattatttaatcagacataggaaaagtgtgtcctgaatcgtaagtgaaggttttcagtttcatagaacaatttagatatattaagaaaagccaagagtacagaatgttacatcagaagaaaacattttctttagatcttgaagataaaatatttttagcattaggccacaacaacagttagaacctgaggggggaaataattacaaaaactgatgaaaaacttgaaggaaagagttattatctcaggccttctcaaaggggagagaaagccggaaacagcaagacataatagaagttaagcttttggattaaaagtgaaaatttcttgggcctggcgcggtggctcacgcctgttatcccagcactttgggaggccgaggcgggcggatcatgaggtcaggagattgagaccatcttggctaacacggtaaaaccctgtctctactaaaaatacaaaaaattagctgggcatggtggcacacacctgtagtcccaggtacttgggaggctgaggaaggagaatcacttgaacccgggaggcagaagttgcagtgagatgagatcctgtcactgcactccagcctgggtgacacagcaagactcagtctcaaaaaaaaaaaaaaaaaaaaaaaaaaagttaaaatttcttataattctattaagaacaaatgaatactttaaggaaattttggttttttaaacaattattttgtgtatcagtgtatttttaatatcaaacccaatctctagaaagactattattaataatttccttttaattttagccaacttaatcacgtaaaacttttccatacattttctttttacaaaccttattaagacttatagaaatttgtgagatgcttagacttcctcttttagcctaattattcctctttcttaaataaacagtcattttatttcaggccaataatttactgtacaaaatttgttctcatagaaaattattttccttttaacttaccaaaattacctctttataactttctttacaactgccttatttactacttccttttaccttgttttataaacaacctttgaattaaacaaaaattatttttcttttaataacttttttaagaaaaaaaaggctttacagctgaatacagtggctcacgtttttaatcccagcacttcggagggccaaggtgggtggatcacttgagctcaggagttgaagaccagcccgggcaatatggtgaaacctcatctctacaaaaacatacaaaaattagctgggcttcgtggcatgtccctgtagtcccacctatttgggaggttaaggtgagagatctcttgaacttgggaggaggaggctttggtgagccaagattgtgtcactcccctccagcctggacaagagagtgagaccctgtctcaaaaaaaaaaaaaaaaaaggaaaaaaaagatgtttctttaatatatgtatatatctttaattgaaaataacccagatatttaatgaatatctattatctaacataatataacttcaagattctaaattatatgtttatgtataagcatttattccattacatttccctaatttactatttttaatagtttatttagattacttagaaaaactgcagtattagacaaagctagtcatcatttaaagttattttcctgttaacaattgtttttagcctgtgaatgtctagttgtttatctaaacaagaactttaaggttcaataaatcagttttttgccaataacccaggatttagcaattttcattaaatcagtaatacaaaatgccttatttataaaaaaattacacaaagataattctgttttgagctgcatttatagcattaaaatcttcatgccaaattttgacagcttataatatctagcagatataattataaaacctctggaaaaataaatctaatgtataataatgtatgtgtataattctgaggacatttctaattttattttaccaataattctaaagccaccttatttattaaagatttgcttaagtcatgtgaacttgaaaaagcatttgggcttaaagttttttttctgatatagtatttaagtgcttttttatttaagccaattaattagagctcttttatatatttttgatagtgagacattatatatatgacacataaatacatacaggtatagacacatagacagaagtagatctgatagactcataagacttttattccacccctactttaaacttcacttttcttgataatctacttcattaccctaggcaattgtcagagagccctaaatttgcatactaaaggaacaattcttaggtgaaaatcagatagcaaaatacacatctcaaaggacagcaaaagggagagagagagagtctgagtgtgttagaggaaggttaaaaatggataccatgccaaacattaaattgtagaaatctaccgtaccataggattttttttaaggagtacaattttacttataaaggcagttttaaatttaggctctatcttttaactggacctctgagcacggggcagagtctacacttaatcctggttctccaaaaaggagagatcatgggaataggccatataatatttttacagtacactttgttactaaggcatttctctaagtgtttaaactgtaccctttcttattttaaacacactgagagtagcccccgcccccatagtaacaactatttactgtaagcagctgccatttagccatctctaaaagcatattacctagctgtcacacagaccatggtaaaaaaaaaagttatcatcatgcaaaataatatttgataccctcaaaagctaagaatatcaagtaactaaatgcaaggaagctgagctttagacctgagaagaattcaccaatgactcttgaaactccacagagaaagcagaagacctcaaaagaggggtgtgtggcacctttatgctgtgacttttaaggggtgtgagttattagactccttctcaagatgttttttcacttgataccaaagatggtaaaggggaaaggaggaatagggtagaagaaaagtaaattaaataatgatttttaagaaagaaatggaacagagaaattaagcacgtgttttcttttttgtttaaaaaaacgaaaggtttcagtaaactaaaaaaaattccgaaaagcaagatccgaaaagagaagtgtaaaatcatatatatatatatgtgtgcacgcatgtgtgtatatacatatacatatacacatatataaaggcattatatacataagaactttaaatatatttataaggcctttatatatatataagagatttatatatatttatatatttatagctctcttttctctctctatatatatatagcttgaataccaccttttaattaagctgattttaaccatgggcctcctaatgtatactatatatgtatatacagacacacacatatgtatatacacacatggagagagagcaagagagagggtagctatctatatagagagaaagagcttggatatcagcttttaattaagctgattttaaccataggcctccaaaacaaaaggttgggggggcggggagaaaaagacaaggaagaaagaaaaataaaagaaatcccttcaaatctcctactacataaatatcaaaccaaacccaggctgccttagtgaaaagggcagaatcttatctaccgaactacggtgtgaggtggctgtcattgctgtttctggaagaaaaactggaggtagcttggttagtaaaaggtggccttgctgtagatgaaacccatcaagtagccaaaaaaaaatttttggatcctttttcctggctgtttttttttttttttcctctcatttctttttgcaactgcagagtatttcagcaattttaaaaggccttgttaggcataactcggaactctcattcggatttgaccaagtcaggtagagttggtcaaatctgatgggagaaagactgaaacagcaacaacaacaatgaaaatacagttatttagagctctgatggtaaggagaaattaagaccagcttgttgtcagtctttacttttagtcattaaggaaaactttccaagacaaaactccaaattcatgtacttaatatagaaacggggcccagactgaagactgctttctaccaacatagaaggaggaaaaagctcatacttaccctccctgttgaaagccagctgaaactccggaaaggagctgctagccatccaccatcctggaagcaggaaaactcacttttttaatggaaatgagtaaaattctagaaaaggaattgtacatcaaaataaaccttagatctcaatgaaatttggggagatcaggaattccttggaggggggaaactcccagatctcagcaaattgtcatgttggtttgggcattgtagatagcccaggctagtactaagaaccaataggagttttgtcatgggtcagggtcatctccagtcagagtcccttccattggtcaccaattggtaaaaacaaaaagtatctgagacaggaggtcttaatcaatttgaagtttattttgccagcgttaatgacatgcctaaaaaaaggaacagcaatccacaggaacaatctgtgatccatgcctttttccaaagataattttgaggacttgagtatttaaagcagaaacgggctggagggtcaagagggagggcatggtcactttactcaatccacatgtgaggacttgagtatttaaagcagaaacaggggctggagggtcaagagggagggtatggtcacaatactcagtccacatgtttcaagacgaaaggagcaggtggggggatagtcaaatatgtattcctctccagtaagtccgcactttaggtgagagtagctgcctttggagatattctagctcttaatctgcaactatttgcttaggaataaaagggaaggcagttttttgcatgactcagctttcagcttaatatatcccttttgtgatactcaattgcgggcctaagattttattttcttttcacaaccaccatgttttgggtctcagaaactgaaaactacatgtgtcattcacttacatgagaaaaacagagggcaggggcaaatttggaggagacaattaagagatataaattgaggttataggatttgggatttctattttgtttccagataccgtcaactgcacagatacaaaaaaagtaactacgtagaagatttaaccagagttggggctctgtttctttcttttcttttccttttctttccttttcttttcttttcttttctttccttttcttttcttttcttttcttttcttttctttcttttctttctctctctctgtctttgtttcttttttaggggcgaatggggtagtatattgagaacatgtcaggaagtgtttatacaaacagtcataatatctctcttgggtgaggaaagagtgagagcagttcagggcaagtgagagcgaaaagctgctagggtctatatagtaaaagtctttgctggaatgaagatattagaatgagtgagccagaaaatagaagatgaaattggagagatgtgtctgtaaaattactgtaatgaaagggatgagattgtgggtgatgccatgatgctatatatatggagtggctggcggaagtatgatgggtggctgaattattagcgtgaaggctgttatggaactgagatgcaagagtactagaatgttcaccacattgaaactgataccaccaagaaagtacacactgtgagaggaaggaggcagtagctagatggtaaatactgaaagaatgagcgttgtgactccatgaatataaatgattaccaggaaaaaaaaaaaaaaaggtttagtggactgtgtagattgatggcctaaccttcaaagctggaacttttcagaggatggaaatctgaaattttgaaagcagcctgaggaacaaagaggacatttacctcacttcccagcccagtgctctgaattgtgctgtagagaaaacatgactgcttgagagtacagcagagaaagcaaggtcctctggggagaacccaatcttgtttagaagaagggaaggtttagaaaagatgttgaaaatataagtaattttgctactgactgactgatttcagagagaacagagaaaaaactgtaatcataattttccttgtagtttatctggtaaaaaaaaaatgtgtgtgtgtgtgtgtgtgtgtgtgtgtgtctttgtgtgtgtgtgtgtgtctatgttatagttaaacttttaggttttatttttatgataaacatatcagttactgtaaatcaaaatttgttcacatttctagtaaggtgcctagtattaaagatatttattattttcttttaattcatgaagggtatccttgtgtttatttctaatcttctctgataggtattcagttaaagtattgccgaatacatcaagctttgaccttcaatgaataccattatgaaacagagtgattcaataatattcaagacattgagaagacacttttctaacttgtacaattcttaagatcagaaaatagtgtgaagtcaattcaatcaatacaggatagttgatgaagctaaaagatgttatttattaaatgtaaatctcttgaaagttttttaaagagggaatcaaaatttaaacagtgattataaatccctctacgtttgatgacacagggatacagctgctttcctagtcacctaaggcaggtggtgctttactgtgttttacagagctaaaagaaatgaacatttttctttgagaaagcggaaaagcagatcagaaaaagacttgtcagaagatacagtgattattactactgtttcttatatattcagggacactgtgctcagtgccatacctacaatgaagatcacagttccaggccccaatataatcttcggctgaaaaacaggtggtctaatttgttttattatttaattatctcattaaagaaagaagcaagattaagactatgtgatgtattatttggcaccacagccttaatttcctcttcaatattgtggaaaaatatattttgatgcaatttccatgtcatgcagcatgtttctgaaaaaacagtagataatatacattcttttggaaatattttgccatttctaaaatgatgtatgaaaattagcaatattccatgcttgagttagcagagaaaattgactgacttgagattcggaggtttttgttttatgaaacaatgtacaacattatattatatattgtaggtaaagctaaatcatttaaataatttcctctagttccatgcaacagcaagtaagatgcatagcttttaattttctttgctatgcccagaagtctttaccataatccaattttctcacaacttttgaagtctgtgttaagcaataacatacggcaagtttattccaacgtaggacacagcttctcaaatcagagccgttttaataattattaccaataggaactttgaaatctactgatagtagctgaagagataaagtgatttgtctttaacagatgtgtttcttttaaattattcattttcagaagcatatttctgtataacaggtgcccaaaaattgctgtggaaatatgaatatatttagaagactcctatttatgctaggcatgttgttttgacaattcaagagaaatttctgaattaaaatgaacatcatacttctcaatttctcagaaaaggtagtaatcaagagtatttggtacgtatgatttaagatttaatcttgcatccaattttaggatcaaattttgttaatatatttctcagcaaagagtataatcatcaaccatttagtcaaaacacttgaggatgatgtgacttaagtctagataaatgtattgatatataattctcatatcagtcttttagtatcaatgccatttttaaagtgtgaaataatgctcctgaaatgtaatatcacaacatgatattgggaggacaaatatattcttcttttcattatataaagggcaatttgacaattctcctgtcaaattgtcatctttttgtagatgagaagtacatttttcaagacatcatacttatgccatcttaagaaacaatgtccatatcttagtcaatactttttaaaaacagtttatttcttgctcaagaatattctgcagctgtccaggtgacatatcagctgttgcccatgaggtgattcagggattaagtcttctggaattttttggccttgctatctcaacaggggttctacacactagcagtgacagggagagctcacactgaaactcacacctactccctctctgctgtagacagaaatgacatacgtcttcagttcataatactctaaccacatctggttacatgcatctacttaacagcaaatggggcttgaaatgtaggtgaaaataggaaatatttggtgagcattacttactctgccaaagagggatacactaagtcttaaatatgccaaataacttgtttatagggtacaactaaaaatatccagtacttgatattgggactagttctgtctataaccaaacctacactatttcttgcatagtgacctaccatcatttattggagaatcgtatacatagacaagcttcaattaggttgtcatttattctcatatttgtggcatggccatgtaggccatgaaattatatatgaggaagtatatggggaagatggtaacaaattgtagttctggtctgtaacagatatattcagaattacagtgcaaggttttataattattttaaaaaggtcgtattcaactttgaaatgactcataattttatcaaattttcatagacatttcaaggttgaaatgttctctaagttcatgcagtactactaatgcatgatctcatattacaacgctaccaaagatcttaaatgttctaaaggagtaaaagcagatcatgatcatttggagtgagagacacctgatttgaattccaattgactgtagtggtggcagtgatgtcaattactacatattgagtgctgtcttgggcactgtcattagcacgttacaaacgttattttaattactcctatggagaatcctatgagatagaatttcataggatgccaccataattctctccatttcacatatgaataaatggaggatcagagagattaaatcatttatgctcagatccacaatgagactactgtgcatcatgttatcgtctctaactctgctttattgtcctaaccactacatagcttccttacatctttcacagcatacgtttgaatcttactcactttatatttgtttaggatgttctgtttaaggtacagtttccccatcttgtatctattctttcaaagtaattggtgttcatctcaagatcgtgtttatgacggacagacatcatcttgttagatttagctcatctgataggtaaatccaaaaaactttactatcacctccagattacttctgacaatatgcccctttcatatctaatgaggacaataataatatgttacatttacaaaatactcaaaaattcaacattttattatctcctcacaataattctcatagcggttcctttgatgtccacactattttctttgccatttaactagtcattctttcttgatcataagatctccttcatacactcaacatcgagatatttgagtacctgaaagcttcatcctggttccctttcatctttatttataataacctctccctaaaaggttttctctaccttcatgatgttaattctgttgataagctgaacacttccaaatttgcatctttagcactggtcttttcagtgaactccaactgtctatgtccagcttcttactcagcctaataggcatctcacgtataaatgttcaaaagtgagccctgatttccacctccaaaggtttcaccaaatctcaaagtaaagaattgaaaatgaaatttgtaaaatgttatgtaggcccagagacctagtactttacgtggcaaagagcggtcgcttacaccatgccagatgtattgagatgatcttcaattataaaaatacctgatgttatgttaaagtcacacaactaggaatggctactggtatgagaattaaaagtggttttgccgctttatgtttctaagatgctcctttctttacgtaatcatctataatttgacttcatacattattattcttaataaatatatattttatgataaagttaattgtagagactaagaaagtctgattaaagtataattttaaggtcaatagcagaaaacacttaaacaatatttcccgttgtatacatctttttcgtttttaagctagtcataaaatatattaaaagtgattaatttgggctgggtgttgcggctcatgcctgtaatcccagcactttgggaggctgaggcgggtggatcacctgaggtcaggagtttgagaccagcctgaccaatatgatgaaaccccatcgctactaaaaatacaaaaattagccgggtggcatgcgcctgtaatcccagctactcaggaggctgagacaggagaatcgcctgaacctgagaggcagaggttgcagtgagctgagatcgcacacttgcaatccagcctgggcaaaaaagcgaaacaacatctcaaaacaaacaaacaaacaaaaaaagtaattaatttgaaagggtaaaaactccacagaaaataaaacttcccaaattttcaccaccatagggcaatcaccattacaatgctaatgtattttccatatattaaaaatgttttctagatgagattctgttccatgtacaatatggtattctgtttctgtcagttagttagtataagaatgtttatatatcattaaatgcttgtaaactatcattttagtgcaacatttaacacatgagtaaaggtttattcatgctagaagcttaataataaaataatgaattattctagattcccttaagatgtacttcaactttacaaattctgattgagtcaataaatacttaataaagcatgatgaaagtgccaaatcataatttatttacatgcatatttcaggaatctttttttaaaataaagatttttgaatagtaatttagaacatttattgatgagtctactataaggaactattcgtcttatctctattttaccagccaagatgttcaagtgatgactatatgtcacatatttcatgtcttacagccagtaattgttggacaagaattgaaacctggcagtcagacttcagaaactggtctcttacacaattttaggtcacctaaaaatatctttctgccttctttattttccttcatattcttattttctcctatctctttatctcttcatatctctctctctctcatacacacacaatatataactttttctaattcatatcatttatttaatttataaatatatttatgttagcaaaacataaaaattatctaaagaggacactgtatacagtgatgtgttttcctccaaagctctaatttttcactcattgaggatcccccactcatgtcacagttaactattcagtaatgtttgtgcatcaatccagagtttttttatacatatgtaagttcataaaaatacatatatacctctggcactgttttccagcaaatcaactttacacattaaatggcctgcttcaggaccaagttaactctcagcacttacacacaaagtcaaaatacagtgtgcaagtcttcgatgatgttgtgacgctatagaactggtgatatgtagtgaacaaaataagcaaaatcacacataagttaaataatttctgattttaatgaacactatgaaataaaaatagaagaaaatgggttataaagtaatatgtgccatttatcttttcgatagagtgacctaaatgatgaggattacacatataagcatttgtataaaaaatgcccatgggagagaaataagctcatattaaaaggccaaaggcaaaaacaaattctatgtaatcaaggaacttaatgtccagtacggctatagcacagactgttggaggagagcagagaaggaatcaggaggcatgttaatgagctagttcatttagatgtgtagatctctgtgtgtgtgtgtgcgtgtgtgtgtatatatatttaagattttagagaggaaatatgcactgtgaatctaaaaaaataacgttaaaaataaacttgtacacaaatgggctaaatacttagcatttagaaatacatagacaggcgcggtggctcacgcctgtaatcccaacactttgggaggctgaggtggccggatcacctgaggtcaggagttcaacaccagcctggccaacatggtgaaaccccgtctctactgaaaatacaaaaattagcctggcgtggtggtgtgcacctggaatcccagctattcaggaggctgaggcaggagaatcgcttgaacccggaaggcggaggttgcagtgagccaagattgcgccactgcaccccagcctgggtgacagagcaagactctgtctcaaaaaaaaaaaaaaaaaagaaaaagaaaaaaagaaatatcacaaatttgtatctaaatctagatatatatttataagtatttttagataagatacatgcatcttgccgctgtccaacaattaagattcacaaatcaatttatgcaatgaaatacattagtatttggtaatggagaggaaatagtatttaaaatatacataaaacatttagatcaatgcagatgtggttgtaataaaagacaaaatgtagaaaacaatatggatcattcgaataaatcagaaaaaatggtaaatgttaaagcattaagatgattgaataccataatgaatgcattagtatttctgtggttatactgaggatttaattcactctagaacagtttcttctgttaaaacagaaaacattccttcacatttttttctataactttcaataaatgaggataattacatttagaagtgatttatcttagtcagtactcttataaattataccagctaatttttagtgaattaagtttattgggatactgctgagttaaaagggatatattttgctgttgaaattttcttattaagttaatgacttcttgtacacctaaaatgacaactggaattattactaacatttaaaatctgaactgtttggtttgaacataaaatacaatttcttgtttatttgatttgacctcctataatttaaaaaattatatatataaaaatattattaagggaatatttgtataccattatacctaacacaaatagtcaacttaggttgtctaatccactgtgctttctgcaaagactttcagaattatttgtaggttacctgttcagatagataatcactagttgggcaagattgttaaaacctacacaagattgttggactttggttctctgatgactttgtccatagccttgtgtaacatttcttcttcattcttttccattcttacataacttttttttttctggatgcttaatatttggcaacatgaattgatgatcttaaaatgtcagcaaaaggggaagcattatgaaggagcaagttttgaagtgcatagatatgtccaggcttggaagtcatattctgttggtgaaaatgtaatcccgtgatcatcacactaaattgcaagggaagctgggatacgtaattagctgtgtgttcagtaagaagagcacactaattacggtgaactgattgcaatctcctacactctagatgatatcataacagagctggtaagacaatactttggtttttaaaatttttattattaacattatttagagatgagggtcttgctatgttgtccaggttggtctgaaacacatagcctcaaggagtcctgccactcctgcctcccaagtagctgggattacaggtatgagccaccccacctggaaatactttgtatttgatattttaaggttgaagttgtgtgagccttgcattttctctttagcaatcaattaacaaatcatgccttaactctctctaaagagcgtcaaaatattgagaataatttctgattagtataatatttagtctagttacctcatcttaacctcttttaaacaattacatatgggattcccttttgtattgcttttaatcttaactactttatacaaacaataaaataatcttgaacattcaaattctcctctgccctaatttttgtctagatctttcctagaactttctaacatatgttagaaacacccccacgttaatatactagcatctaaaactgtctcagccccttgcactgaacatgtgaataatgttctggcatagcctatatttcctccaatgtgaaactgcaaaattctcagctcttgtttgaggggcagcctcaaactagcatctccttcttccctttttcattgatgattggatttggttgcaccaaagtaacttatgagaggttgactcaaaataggaattgatgcattcagattgttttctcaaaaattaaaattgtaaaattaggagtgaattaagcatgtggatattaagagtcttggccatattagtaactctaaaacagtttggtaatcttacagcttggctcagaactctttttttttaaatgcattgttatgaaaaggctaaagtcttcaaagtcatttttaatatattttgagatgtgactccatgcgtttccatcagtgtccagcccatctggactattggattgagatctggggttctctgcctccgtactattgataagaatgagaagtgaattccaggaaaataccctgtgttatctctccattaaatcctgagttgtaatctcctccaggatgtttccctgatcatcctaagcagaattgctctgctaccttttttatggcattttcacatttgttgtagttatttgagtgcatgccttgctaactttgttccatggaaagtactggactcatttagctacccatagctatgagggctatatatattttttttttaagatggagtcttgctctcttgcccaggctggagtgctgcgtgaccttggctcaccgcaacctccacctcccgggttctagcgattctccctcctcagactcccgagtagctgggattacaggcatgtgccaccatgcccagctaatttttgtatttttagtagagaccgggtttcaccacattggccaggctggtcttgaactcctgaccttaggtgatccacccaccttggcctcccaaagtgctgggattacaggtgtgaggcactgcacctggctttgagggctgttgtttaagtatacctgtgttaatcaaagagacagagtttttgtggaaattatggggacagagctctagtgtttttctatcagcgtgttttattttaatcttgattatttggtgtgactctattcgtctatgtatgcttgtgaatacgcatgaatatgtctgtgactcctgcaataaaggctagaacaaagacatataaaaccagtttcttgaatttgtaaaatccatgctttagtttctttcccaaatcctgcactttaaacctctatggtaaaagaaaaaggaagcagagatgatattataaccagtaatgagaaatctgtggcctgttccaagtctgtgaacgaagtgatacaaaacatgactactgagaatagttggaaattgatgctgtgggaagggtaacattcctggtaggaagcggatccatgtggatggcactgtgattggccagacttatacatgtctccttgcctatattgatattaagactttccaaatttttcttactttatgatgtctagcactgtgttatttatttagtaagtattcaaaaatagttgaataaagtgataaaataattcacaaaagaattaatatttgagtgtgaaagtgctttgaaaatgaaaaaaataaacagacaaagatactggatagaagaaagaaaaacaaggattgaagtcactagcgacttgttgaataaaagactgtctggatctacctatcaaaatgctcagacaaatgaaaacatggaaatattttctttgatcctaaaacaggtggatctgaattacaagccatccaagaatggttagctcctgccctttttcctttttatctatgtgtaattgtgaattattcagaaggatgctgcatggtcccaaatgaattgttgttattgatgttttattatgtaaatatttaaatattgatttttcagaaatagtgggtagcctgtgtacattttcatggtgttttgacaaaacgttgcaataagtgtcatgagtcagtttttgctgacagtccaaaccagaacgccatgaaaaatgcaaactgatgtcacttctcatttgtaaaaggcttcaaaattatgaattcataaatatttaatagcaatggctcaaatagaaatttgctctgttagagtatacgactgcttgtgcatgcagcatatagagctatgctttcctgagacagtgctacctagattacaaattagaaataagatagtatcaggtggttttctaggaagtgggtcattggctggtgacctaaatattgtacttaaaatacttgtttatgggtcattaattttaccagtctgaaacagataggaatgccagtggtgttaaagcttttatgatttggaacacaaagaagcaggactatttttgaatcttttctattgagactttcagtaactttattgaaaatataggtgggtgccgtggctcacgcgtgtaatcccagcactttgggaggccaaggcagctgtatcatctgaggtcaggacttcgagaccagcctggccaacatggtgaaaccctgtcactactaaaaatacaaaaattagctgggtgtggtggtgggcgcctgtagtcccagctcttcgggagggttgaggtacgagaatcacttgaacccagggggtggaggttgcagtgagccgagatcgccccactgcactctccccttgctgacagagcaaaactctgtctcaaaaagaaagagagagagagagaaagagagagagagaaagaaaatatatcatttgttaattaactaccaataatttcctgaaaagtcatattaagtcagaggttatttgtcagaagatagtactgaaaatgaaggaaagaataaagaaacaaaatacacaggcttctgtgacattgtgatgtttaacaaacaagcaaatatcctagttaaaaatgatggcatatgtgtgtaaaatagtgaagagctaaaatgcccaatctcactatgtttacactttctgtgcacgttagtgagaaaaaaagtgtaataacacctaacatacatttcttcaatgattatctatcctttattcttgtataagcagatacaaaatctactgcttacttgccaacattacttcagagggacagaaacttcagtgtgcctatttaatcatatcaccttaatcttcttttatctgaataaatacttcaaaagtttgagtgtagtatagatatacttacatacatatatgtatacatatatatttggcctgtgtgtatatatgcatctatatatgcaaatatattgcctaactagctaatctttatatttttaagatcatttatatgtacacatagtcaaatctagtcccacctcttttcctacaggtatccataaataaagaatatcaccatgttgatactagagagttaatacagtttttgttttaaattttatgtatgtgcctgaatactcatatgatcaaaatttaatcgggaaacaattagttaatttgctttatagtttgtggttttccaccttatgggataatactatatttatgtgtgtgtatttatatatatttatatatacatttatatatttatatatacacaattatatttatatttgtatatttatatatgtatatttatatgcatgtgtataagtgtccctatttaatcatatatatagcttatatataaataatatatgggtgtggtgtgtgtatgtgtgtgagtgtggtgtgtttgcatacatatatgtatgtatatatcctccttttatttttattcttaagagttccatttcacctcagctaatgaggtagagtgttagtcacattggtggcaataagtaagtttataataaatactactttttatttcactagaaacttttcagagcatttatggtgcctgaatacacaatacttgtttaataacagttaatttccttcatttctcaatgaataaattctctgttcaaatggcgcctccagtttcttgattgtgtatcatattgtttgtagcaaacatttattcacacttacttagtgctgggcatgtatgtacatctttactaacattaatttatctttcccatatgtaaaagacaatttttcttgcattctttacattggatttactctctttttattctatcctcaaagagtcaggatgttgctggatggaagaataagagatgttaactaaggaaatggacagcgtcctctatcttccattcactcaaccattttcttttttatatttcagaggacgtaacattatttaatatgtggttcatagaagttcccctctcttttaaagtacttccttagggccgggcgcggtgactcacacctgtaatcccagcactttgggaggccgaggcaggcggatcacctgaggtcaggagttcgagactagcctgacaaacatggtgaaactctgtctctactaaaaatacaaaaattagccaggcgtggtggcaggctcctgtaatcccagctattcgggaggctgaggcaggagaatcgcttgaacctaggaggcggaggttgcagtgagccaaggtcgcaccacggcactccagcctgggggagaagagcgagactttgtcattaaaaaaaaaaaaaaaacaaccaaacttccttggatttgtagaatcctcatcctcatgttcttgattactgtggctgcatcttatcttagtttccctctgcctctcagattgctcttatacagtttcctttgttgatttctcttattgctggattttagctgtggacatttttgaagccttggtgcacattattttctttctgtgacattttatcttaagatctcaactttggagaatgtgctattgatcacaaattataatttagattctgtcttttcttctgggtctggacaaatgttcttaactatcatttatattttcacttggttagttcagtatcacctcagttttaataaatttaccactgattttattatgacttttacctgcaaatttttttcttccaatccttctatttcagtcagtaaagttattggcctgcaaataataaagatgtaaagttagccttgaaataaccttgtttttattattatctttcacttttatgtttagtcagctaatctggtctgtatgctaaatgaatgtgcatttgaaaagtgatttatagaagcaaggttttatccgaatgaatacaatttattttgcctgtagtcttctttacattgatatttctgccaccaaagatctcttgcctattaactcaataggctatgtactctcttagctgactttcctccttaaatatagtcaatacaatttaggctagtcctcctcataaggttgaatggacttcattcccaacctcagtaatttctagtacccttccctacttcttagcctggctttcaaagactggtttattcagaatgtctccccctatttttctgggcttacttggtctggctcttgtatttataagctttttcatgttttgaggcgaagggaagtctaagcctctttgccccaagcctactgttgttcatagtctattttctgggctgtaacaaagggagaagactttctaagccaaacaaacataagcttagacatcagcattatcacttactgacagactgattagccttgataaattacttaaactctgaacttcaatttcttcatttcttaaaaagtgataattatatctacctcagagaagctatgtagggattgacattcatgtatattaaaaatatgctgctgtttagaatgtttgctataattattctctactgcacaacttcagagtaaacttaatgttttgttttaggcacacgatttttcatatttattaagcacttcttgccagtttgtctcactgaccctttaaacttaaaaaaacagtatcttaactatcctcttctatcattgtgagcatttatcacaattctgaaaatataagaagataatagaaatcaagttagctgatttcaacttctagatttactacttaacagccatacaacttaatgaagttataaaaattccctatgccagtttctttatttgtaaaacagaagtaaattttgtaactcaagggttattgtacatattaaagtaatcaatatgtgtaaagtatttataaaagttctagttatggccaggtgcagtggctaacgcctgtaatcccagcactttggtaggccgaggtgggcagatcacgaggtcaggagttcgagaccagcctggccaacatggtgaaatcccatctctactaaaaatacaaaaactagctgggtgtcgtggtgggttcctgtagtcccagctacttgggaggctgaggcaggagaattgtttgaacccaggaggcagaagttgcagtaagccaagatcgtgccattgcactcctgcctgggtaacagggcgagactccgtctaaaaataaaataaaataaaaaagtactagttatgtggaaattgcacctcataaatgtcaattcattattgtagagaaaatctctaaaattagcatgatttgcttgaataaattattttataattacattatacatttattgtagagttatataatagtaagttaacattatatatatctatatatttgaatttcatcaaatttatcgctaaatgtgttacagaaacactaaacatgcaaaggataagagggctttcaaaagtcatccattgttggaaaaatataactgagaagcatcatgcagaattctacaatgaataatatgaaagacccacaaaataataaataaaattcttgtgtatagtacctacagaaaagcagaaatttgtttgactacattaataagtttacttgacataaaaaccatgggaggctaaaaactgtcaatacattctgctgctattagctaatgagtatatcatgcatatgcactattaatcattagtttttcaaggaacttgtggagaaaagtaataaaataaatagaaaccaagaacagtttagaaacctttcgattttataaacattacattatttatctagttaaagataattatgttgaaaaaggtaaaactgcaattttttgtgactatcaagagtaaatccctaccctaggaacctgcatttttcagtttcatgaaattctgcacctgaaaatgcctagggtaaagatttactcttgttgtattatagatgtggaaattgaggctcaaaaagttgcataatttgcctaaaattgtacaattgtttttattttattttattttattttattttattttattttattttattttattttattttatttttgagacagggtcatcttttgttgcccaggctggagagtggtggtgtgatcatggctcattgcagcctctgtctcctgctggactcaagtgatcctctcaccccagcctcccgagtagctgggactacagatgcataccaccatgcctggctaatttttgtgttttttatagagatgggatttctttccatgttgcccaggctggtctggaactactgagctcaagcgattcgcctgtcttggtctccaaagtgctgtgtttacaggtgtgagccactgcacccagtctacaaatgttttatataacaattctcaactacctagcatgagcttaccattgtgttagcaaacagaaagaggaataaaaaactactcgtttctttaaggaacttccaattgttcaataaactttttaactcgttttcagaagtatgttgaacatgtgtgaatttttctaacttcacagaaagttcatggataatgatcttgaacattattttaatgctgacttaaataaaagccattagctaaatagatattgagttttaatcttcctctgcaatctgtttccctgtggaaaaaaaatgaaaatgttaaagaactttaattgctttctcaaaacttatatttgtatggtttgaaaattactcacaatatttaaaatgtcctttctaatatgaacaaataatacttaaggagtttgccaaatttgtgtgccattactcatttcagttagcctttcctaaataagaaaccatctcaccttactgccttgtaaaaataatttattatttctcatgattctgtggattagtggaggttcttctgctgttcctacatggactcactgatgttggtagcctttagatggagggtcagctgggaactggttcaacttggacagctggtatgtgtgggtctctctttatctctcaaggtggccccaccaggttttctcttgtggtggcagcaaaatctcagaagacaattccccaagcgcttataaaacctctattggtctactggtatcacttaggtggatgtccatttgactaaagcaagtctgttggcaaagcccagaatcagtgtgggaagggtctatggtcatggatgtattttttgctctacattattctactgaccaaattaagagatttttaaaataacaattctggaagggacagtaaaaacccttaatatttttttgatcgacaaactgatgcacagaaaaaggtaattgcccaatattaaagtcaaattaccagacagctagatttaatattaggccagttacaaaggctaaaacacttttagtgttattccccagtgtttggggaaaaagagttactgaaaagagctcatcatattactttagttaagaaaatgaagatttttcagtaatatttgaagaaactcagagaataaatatttctcactatttggcaaaaagtattgctggtagaaatatatatatatatatatatatatatatgtttgtgtatgtatgtatatgtatacacatatattgtgtatgtacatatgtgtgtatatgtatgtatattgtatagactgtctgtcctcattatgcccagtaatgttctataaagactgtgatgtccccacaaacactgaattagcaaatactaagccattgtccttaggggaagaactatgtatatagttacatgtaaaagatgataatcttaaatcttaaaaacaactcatcctagtagattctatttccttaaaagaaaacaaagtttaaatgtgttcagtcatttgcctgaggccaccccactaacaatgaaagagttagaattcaaaccctgcctaactaaacccagtccagaccttattgcactatattgtactgccatctccatcccctggtcatctcagtatgagagctgaaacaagaaggcaagttttgttctgtttaacctcagttagataggtgctcttgcattgaagcaagttttttttttttttttttttttgctcttctgcacatgtctgaaagggaaagggctttgagtattgatttttagggctccacataaatattagcaactaggccaatttgcaaatacagaatctgggaataatgaagattgactatatctaaataataagaattattctaatattaatgtactcaatggagcaaagataagatgtgtaaaaggaatatgataggggagtcttaagcttaccccatttgtgatatatccgacacagtttcagacatttgtctctgtttttcatacctaatcaaagtagggttaatttatggaatgggttgcttctagggaaaggagtaaacagattgtactcagtgagacctgagattatagcttaaagtcaagagaaaggatggaaaattttaaaattaggtaaattactatctaatagcaataacctggaatcgtttcttattgcaaatagttgttttcatcccaatattttcttagaataacattgagcctgagcagagtattcacactgatgaccccatgttacattatacaaaagttatgagatgaaattcacattagccgattctaagaactagggaggggcaaaaaaatatacaaatagtacatcaaaatattacaaatggaatgttattgggctacacaatgaaaaatgtttctatttcaaaattccttttaagtgtattctgaaatctcagaagtttcaaataatgttatcaaatggaaaatatgtagtattcactacaaatgagatttgatgagtgacagagttttcttactgatagtggaaattatttttatatgttagaaagcatcataagagcagaattatttttttgccgtgtctgaaggattaggcggtagacataagaaataaaattatccttacagttgatgtaagatatttatgaataatattttatttatcttttaaacatagtacctagataaaagcctaacatgctgtatacacactttctttttattggaactaaattagttttggacacataatcttcttatgttttaatcagtccgtggaatgaattttgcatttgaatgacacattgttcttttaagtcacaagactcttcacaattaccttgaaagagtaattcaataaatggtgccctaatggagaaacaattaatttccttctaaccattacatttatttgttcgcagaaattgctccgaagtacaaattgctatgtgttcaaacttcacagtaaagttctaatataattttataaaattaaatatcaatttttcatagaactttagaaccccaaagtaccttagagattacataattcaaaattccttgaatttcaaatgatgaagccaaagagcaaagacgtttgctgacttaattcattgatatggtatatattagaaaataaatgtatactgtaaaatactgtatacaattgaagtaatataattattagttttgaaattcatccaaatagtgtctcgtcagcactaatatatatgttagctcccagtccaaagtccttagttctatgacagtctgaattttctcagctaaagaaaaaattgaagtttatatctaaacacaggtgttttttttttttttttttgggacggagtctggttctgtcacctaggctggagtgcagtggctccatcttggctcatagcaaactctgcctcccgagttcacgccattctcctgcctcagcctctcaagtagctgggactacaggtgcccgccaccacacccggctaattttttgcatttttagtagagacgaggtttcactgtgttagccaggatggtcttgatctcctgaccttgtgatctgcccgcccttggcctcccaaagtgctgggattacaggtgtgagccaccgcgcctggcctaggttttaaaataatcaccagtttgtagaatgtccttaagtattgtggtagattattatagttctatgtacgaataagtcatttccatagcagtatctgaatcaagaaaatgattattatgggaaaattacaaataaaaagactgggtcaaaatcttaaattatcaggtacatactttatgccaggtagcatagctaaagaaaagtccatatattttctcatctaattcataaaacaatcatgagaaatatttagtaattttcctcatcttataaacaaaaataagaaatatcatataacgttgccaatgtaaaaaagctaagaagtggcagcacctgggttcaaaaccggtgtgctgtgctgttagtcactttgtaaggcatttctcagattcaaaatattttacctgtaatgttttattttcatatttcggttagaacctgtaaaagtagcactaaaaagtactctagatatagtaaatataagccatgaaattaggcccatgtttgattaagatattgatgaatcatattttattcatttttttagacatagtagttagagagaagcctaattatgctgtacatactcaatttttactaatcgtataacaattgaggagaggaaagcgttggagaaagggaaaaaacttgtagagaaagttgagaacagtgaatgagaaaatacctgaagcattttctttaattcataactgaaaccatttgctgtgaatttccaatggtagagaaaactcattaccagatgaatatttgctttagggaatggaagagtgaatcatcaatacaagatttcttttgtctaacagcttttgtaaatagcaaaaacaaccaaaagataaaaacaagtaattttaataagagtaaccaaatgcaattatagcctaaacttaatacaataattttcaaaatttatgagcgatgaaaaaactaaagatcttcaaatgaagcaacaaaaccttgaaaattatttttgctaccctgaacctgaagataagttaactgagtttgtgtccttaggttcctttttatataatggagcaaaatgggaatgtatatctgttaggaagaaattagaaaaatagggaaaatgtgcaaagggaatgactgccttcgatataagccaagactgcagggttgcccaattatttgaataggtcttgcatatctcctttgggaatgggatgcatcttcaagtagtatgggttgcagtatagaaatactaagaacttctaagaagagggaaaaaagcacaattattcaattaaatgacatatatttcttcagttgatttagtattccaatcttcactcaggccttagaaagataaataaaatatgaaatacccagctctaaaatttattctaaattgctaagattaatagataacaaaagaaattgcccacagtgtatttgccccaaagaaatgtctgaacaatttctgaagacagcataatgaacagaaaaaatatatgaatagtcaaaatataccaataaaggaggggaggagaaaaacaaaagttgaatataacaagggagaaagatactcagctataaaataataaaatagataaagggtaatgatatagttgggctttgtgttcccacccaaatcttatcttgaattgtaatccgtataattcccgtaatccacatgggtcaagggtgggaccaagtggagataattgaatcataggcccagttttccccatgctgttctcataatagtgagtgagttctcatgagatctgatggttttataagggtctcttcctccttcgctcggcacttcttcctgctgccttgtgaagaaggtgccttgcttccccttgcccttccaccatgattgttaagtttcctcttgatcagtagtccaacgctttacctccgacctatagcccctcctcatgattgtaagtttcctgaggcctccccagccatgctgaactgtgagtcaattaaacctctttcctttataaattacccagtcccagacaattctttatagcagtgtgaaaacagactaatacaggtaattatctcagttgttttgctgtgtagaaatacctgataacattataaatttttaaaaatgtaacaaaattggtactgtatggattggctatgaaggatactgtggaacaaagttatatcttgtataaatcacagtctatctgtgctctgataggaaatctagtagcctcccagcaaacaaacagaaaatagttgacacagaagagtagtaagcattgagccaacacaaagccattggtttgtttggttggttggttttggaaagaaaatgcactgcatatagaatctaaaccttggcaagggatgagtggtttttcttaacctgagacctcaaggtaggccagtaacctgaaaggtgctcagatagtcacaggttaataggattatttggctcagggagaagcaaatgcaaatcctctctgcagaaaactaactccaaagttggccctcaagatgctcacacacaaagatgaactaaatatgatcttaaagtgaaagatcacgtggttctcaaataaattagctacaatgagtgacagttggcagaaactacattcagaagttttagtgtccaatcccaaataattttagatattgggataaccattaacagtatataaaattttgacattcagtgggcaactagaaataaaagaaatttaggagagaagaatgtatgagtgataaagatttcattttcctgaaaaatatgtagtttttttttttaaaaaaaacataagaattatttcaaaaagaaggaataaacaagtatgcctggggcagatattgaggaataatcagaagagtatgctgttgtcgaaatcaaattctaagaggaaagttgtggtcaatagtgtcacggagtaaaaactcaaacacaggcaggccaccaaattcaatactgaagtcactttaatcttcctttcttgtctgaatgctctgtgcagaggttcccgtacctgccaaccaaagcagccgcagtaggaattgtatgagaatggggaattactgaattttcctttccaaaattactgatagtaagaagaaaagggaaaaaaagcatgaaaaattatatatattattccaagccattagaggaaattttgatgtcatttaggcgtaatattgctttgctctgtaaatgtgtgatctttattcgttagtcctatagcatcttttcaagcccagtatcttttacttttattcccaaaggatagttgtggctctacctattgcccataagtagttgccaaaacaaccaggagctctgtcaacacaggtctttctgtttcagaagtcaatttaaggcagaaagtcaataccatagtttctaaagacaattttcattgaattgcccattgctgacgtttttcttttcaacctcttttcattcggatcgatttttaaactcttttttatttcaaaactctcgaaatgaaataattgcattaaattggatgcaaacttttctaaaactgaaaggaaaataaatatgaaaagtcaactgagagttcatttaaaaggatcatcaacccaccgacagaactgacatttctcagagaaaacgtgagaatgttttaggtggttctttaggtggttcaccctgacaaaaattgaggaaaaatatatattgctaatccattacctttggatatcatttctggagtatgaatgaatgttaaatatcgaaaagtaaaacacattttaaatattaaggacatcttgtagagaattactgagagaataaatttttcccttatgtgcagtgttatctaaatcaatctccaggactaaactgtcatgtttctaagcaagggattcaggagatctaaaatgacagctttaatttaacattgtgacagaagagttcatctcaaaaaaactgtagacttttcttgggcctacatttttctatgctgcctttccaactatttgttcttttaacatttgagattgcagggctaagttttgttttaatacctactgaacaacgacaacaacagaaagcttccatggtactaaaccacatcagataaatgactgaatatgcctaattattaatatatagcaatatcacctctgaagtacatattatcattttaaagttgcaagaactaaattttagggcacattctcaaagaatatgactagatattttaatttaaatattttaatgaaagtagtacttgactcattttgtgtattgaacaaatgtttgagtatattctgtgtgtcaggcaacgtgatagatgcttctgataaaataaaaaagaagaccagcaaggcccttgccctaacagaatttaaactctaatcaattatgaattaagaaattttctgcaggtttccaaagttatttggaatcggtagataatagtgagagaatgaatgaacataggtgtatataaatatatattcaggtaatgaagagtcattattccaccaatttgaaaatattatctgtctttagtatttagctacaatctacaatctatttacagttagctggtggacaaatatttatgtaacctccctcataatgaaaaggaaactgtactaagtgctacaggaactattaaaaggaagaaagatgcagctctcaggggacagaaatagatattatattatgcatgaataatacaagtagtagctgtcaatagaatttaaaggaggaagctgttgttttagctgggatgatcagagcagttttaaaaaaagaaataggatttgatgtgtctccttaagaatgggtagaatttcagtacttggagagaaaaacaatagctgtatgtggataaaaagaaggatagaaaggtattatttcccctaaaagttttatattttgtggatgagacaaaaattaaacacaaatttttaacaggaattttgtaaaattacatgtttccttgagtatgtttaaattgaaatatgtttttaattatcagtttaaatagcgttaagatgtataatttttaaagattcttaatattgatattattaaattagattgttatattatttttataaatatggccaatggaattcaaatgcattagcaacttggtaatcacttttatgtattttttttaaatggtcatgtttaacagtcagaaattataaattatttttctccatgaactcaaattttcacttcacttcccgctgcaggattttagattaatgtaacgtatttcattcttgaaattcttttgttgacatcctacattttcatggttctcagtaattctttagaatttactttgaccattggactccaaatcttaatacttctgaattatataatcattatgagtacacaactgatcaaaactatatacatttatatttaaattgtgacaaattaataacaaagtattatttgtattgcatctgttaatgagataaatgaggcttatttagctaatttcagtaccatggatcaatattaactattgttaagaaaagatatgtatcagtgttaattctatccttatttttttataaatgtgagtgctgagaaaaattatttacacaaataagtaagtgaacataaaaagtgttttaaaatagcaatgccacttaactttttgaaatccttcagtgttacatgttaaaatttgatagagatttatcatcaaaagtcatttttagtaatcaatcagattacactcagggctcacacatgagaattgcgctataaaaagactcaagatgttgagaggtaatgcatttcttctataaaatataaaaacaatatttgtaagagaaagttaattgggaattgggaaacggtaaaggaaaaatctatatatctattatggatttgttatcatatagactaattttaggaaaaaataactgtccactgatgctctgaaaaccgatttccttaaagctattcgtgccaatacataaagtccttgaaatgcctttctgaacccaagcgaatgcccatacttgagtttgaagcccataagaagaacatactatggaaccatatagccttggtatagtgagtcatttcaagagaatgttagtgaaggaaaaacctgaagtctggggaactgagcaaataaagtttgaattaggaggaagagtaattctcaagacagcagtgattgccttggaggtctagtagatgagcaagaaccttatgtactgtaagaaggaattgcaagaagttttgtgccatctgaagtagagtgtgtaagacagagggcgttgaataatgaacctagagagctgtttggaaacaaacgaagtcagctttgtaagttaggccatgaaatacagacttacctgtggacagtggtaaactactaaaatgtttttgacagagttagttattttgtttttgtctttttaagaccttcttggggcaataaggaaaatatatcccaggggaatatgtgataccaggaagatcttttagcaggtgcttggggtgaaaaagaaagaaatgatagtttcttgaaatgagctgatggcaaagaagatggaaacaattaagtttgaggactatgaaggacataaaattgcccaacatgaaaattaatagtggggagtgaggaaaatgaatttttttctaggtattattgagaagtcaaaatgagaccagatatggagctttggatttaagttgaatgaatagtgactctcttccctaaatatttggaaacatttgaaattttttaagtagtaagactaatatgatagaaatggcattttatgagcattaacattattagaatatgccattacaatggaagagtctggaggaagtgagtatatctttaactgagactagcatgaactatgctgcatgcaaggaataaaaaggacagttttgattcagtgggtgttacaaaataaagcatgaaatgatatgaactcaagacttcaggaatatatttttttctattttaattatgtgctggtcactgcctttgcacagagcaacgaacaagacacctctgtaacctaatgaagcttaaggtctggtggataagaaagcaatgaaatatatatgtgcatatatttacaatggcaatgtgtcttatgagagaaatattaatactagttgtcatgagaactggtaacaaaagggcttaaatcttttggagaagtgagaagggcaattaaagaagtaaaagaatgagatatctggagtgagacataggctcaaatatgccttaagtcataacaaaaatagaaggagctagtattactagacacatggaaattaggagcagagattattttaaaggaaaaaaaactgggtgatttagttttgttctgtatgaagtgatattagtgggtcaacatagaaatatgcattagatagttggacatggaggactagagcttaaaaatagatggaatgcgggtgtcttccaaataaagaatgtcgtgctaaaccaggacatgcaaacatcagaaaaaaatataaaacttttaatgtaaagcaatagaaattatttaaaaattatttcttaaatagaaattatctcttaaatagaaatttttaaagaaatatttaagaaattatttaagaaatatttaagaaatattaattatttaagaaattatttaagaaataattttccagtaaaatagatacattgtagtagaaagcacatttctcatgagttaagaagtactgttaactttgttttatgtgtccaaacattgtatttttccattattttcaggaaagacatatttactctctttaaatatcagaaatattgcagtaaacaaacacataaggaatactacaaggaataattcatttttttacaaagtttaaactttaaatcaggaaattagatacatcttgtgaagcttaagatattgagaaagaagaattagaaggtaaagtaaaagacatcctctggccaacacgtattaactgactggacttaccctcctgcctaaagcgatttttaaaaactttacgaatataagaaccagtgattttcagatactgaaaatcaggaaacttgaaacagtgaatcctgaaagagggaaaagtcgaattctcgtaccttgctagtgagagtttaaagtgatatagtcactttggaatcacgttatcaatttcttacatagtaaaatacatatacctcccaaacgatccatccattccaatcataagtcttcattcaagaaaaaatctttaaaatgcccatatgaagatttgttgaaaattattcattataacaagtttatttgtaaaggccaaaaattggaaaacacctaaaagctcatcaacaggtgaatgggtaaataaattgtatccacacaacagaatattactcagcaataaagttgatgccctcaaaacatatatgaatcttaataattatctgagtaaaataaaccaagaaaaagtggacatattgttggctttatttataaaaattattttaaaatgtagatgatatatagtaacagaaagcagatcagtagttgactgggattcggggaaggtataagtaggtagaaacagaagggcaaattctaggcaattgtcaaggtgtatgtttttgatgtgctactgacattttggcaggataattctttcttatgcaggtaagaactgccgtaggtttgtcgtttctggttttctcctactaaacatcaatgttgtcattcacttataactaaaataaatatttttctctatattttcaaatgccccaagagatcgcctatgaagaccaacaaggatgtgaggagaaagtacagcctaattcacctaaaaaaaatctgtagaatacccttggaattccttgaaaaatttgaaatgttttttgcaagaatttgtttaataattagaaataaacatttactaagaaagcattgatattgcttagttccttgggatgttcaatatagtagtaaatttctgactggagctgagcctgtcaaaagttgtattctagtattctaatcctagacgcagcattgtttgattagcatttttttttctgattccagtttcacaaagtataaactcttttccatgtctgaatattctgctaaagtgctaacactttcaagaatgtgctaccctctttaaaatgtgcaacttttttttaaaatgtagaatttaaaatagaattgtgttacaatatcagattatgtatttatcatgatcataaagtaaatgtgttttcttcaaaattattttttgttttgaggcatttttaaattgatgcctaaaacttcaaagcatgttctatttatgctattcaatacaataacccactagtgattagtagccattgagtactggaatagtggctatttttactgagaacctaaatatttagtttcatttaaataactcagtgtggtttgtggctaccatattatacagcgcagttctagagtgactgggaaggtataacataaccattgagatttacatgatcactctctgtattaattctactaaaccactgactctatttttaaaataccctagacacattgaaattaggggaattgataaaagtttgtattttgtattttattcagggagaaagagaaagaaacaagaaacaatggcaggaaaaaatgtgtagattgtcctttttctttcttttttttctttttttcttttcttttcttttttttttttttttacatttttcaacatactccacaagttggcaaaaatttctagagagacttcttcaattgtttaagtgtcatgaatgagcattatattgatgtgccctggaagaaatattagctcaacaggtgttcactactgtaagttgattcttaactagtcccaaccagtatggtgattaataatgtataaatatttgaagttaattcatctttttgaaaaacaagaccgtaataatgcctttgtcactcagcaaagactggagttaacatcctccaaaagagtccggtagtactgaatacgcccgctcccttgctaacacctgaaacctatactgtaattgtcacttactggctgctacctcattggtgaattactgatttgtagattaggactgcaggagtaggggaggaaatttcaactagaaaatgcaatagcttcggcacgacggctcatgcctgtaatccctgtactttgtgacgctgaggcaggtggatcatttgaggttaggagttcgagaccagccggataaacacggtgaaaccccgtctctactaaaaatacaaaaacaaaacaaaacaaacaaaaaaaattagccgggtgcggtggcacatgcctgtagtcccagctacttggaaggctgaggcaggagaattgcttgaacacaggaggcggaggttgcagtgagcagatatcacgccactgcactccagcctgggctagagagcaagactccatctcaaaataaataaataaataaataaataaataaataaataaaagtaaaaaagtccaggcgcggtgactcatgcctgtaatcccagcactttgggaggccgaggcgggtagatcacgaggtcaggagatcgagaccatcctggctaacacggtgaaaccccatctctactaaaaatacaaaaaattagctgggcgtggtggcgggcgcctgtagtcccagctactcgggaggctgaggcgggagaatggcgtgaacccgggaggcggagcttacagtgagccgagatcgcgccactgcactccaacctgggcaacagagcgagactctgtctcaaaaagaaaaaaaaaaaaaaaacaatagaagaatgaatgaaaaatccaactttcagtgaagaattgaactcattatacttaaaaaatgtctgctattccaagctagtactgtataatgtctatactgtataatgtctgctattccaagctagtactgtagctatgtaatgagcatagagaatctgagacagaatcagtcatttatagctataaagaaggaaaaatagaaccatttaatatattatagattcctttgcatgatttgtaatatttgtttgactaaaagtacctatggcatctgaaatgaaaaatgcaaacttatttctgatactacaaattaattaaattctgtaaataagtatgtatgtgtaaagacagaataatcaaggaaataattttatgcttcctctattcagaagctcgtcttatatagtgaaatattttaaatagcagtttttaaactaaaagaagattattgatttttctgaatataaaaatgatccttctcactaaaatgtgatcaaataaaaagtaaaactataccctatactgcaaaattataatattatgatgatcatagtgaatttttgaagctctctttactaatttctttaactgggtttgtaattttcctccatattatagcagacagatgcagctgttgaaagaagacttggagaacacattgtggcttatccagcataagtgtgctaagtgttccttggactctattagtgatttccatattcagcatgtaactttggggagtatcttatgctgcctttgaacgtaatcacaattttttgaagtgtgctcaatttataaaattaaacagctgttccatccaggggaattggggataaatgagcacatgttatcattggaagtggatgatatagccctagatatcattttcctaaagagatgcaaactttcattttaaatcatgaatccagcaatcaaacaatttcattgatgatctagtttgaaggtattcagtatgaacatatttgtgaaagctggcaaatagttttaaatatatttataggtgatgagtataaaaaaagaagatgtctaagtttctaagtattatggctatgacttcttggtcccttgaaatataacaggaaaaggtgtctgtttctttatgttataagcattgaaattgaattacatactcagagtattttggaatcttgaccaaagttatttatgcagttttactattgggaacctacagattcaattggttgaagttgaaactgtatacatttggattaatttgaggttgttggattagaatatgcagtgtttttcccccaaacaaaacaaataataacctataggaaatatgttataatatgtatatatttacataaaaatagtttaatcaattgttaccactggagattggtaaccaactcatttcacctcaaaattcacaacttgtgggtaacaactgtagttagtttactattttattatcataaattagcatttacagagcattttgctttattttttatttggaatattttggaataaacacagggccatatgcaagataaccaaatattctgctaggagttatttctaaaagttaatgattcagcttgagaacggaaatcatgcagaaaaatgtatgcaagagaaagttaatagtgtatgttaggaagacaaataatgcttttgagtaaagtagagtagtcccttctaaaagtagtaaatgtgtgggtcaggttggaaactggctaataaatacttcacctatttgtttcccttctcattactgatctgtgttcttcagttgatttagccccccacagcttcctttcgttgctccaacactgtggtcaactttcattgtcttttactgggcttaaattgtttttatttaaagcaacaaatatttttctaaaccctatgaaataatacagtgatatcaaacacttctagcccttgcactttctatgcattatacatatatttaatgtttacatattaagtaaaaatatatttaatctagtttcattatagtttctataatgtattataacatcatttctagaatttagacaatatgtgttttccataggcctcattctcttgtgttcagtgctacacaccagcttctagaatattacttggtatatagtaggaaatcagtatatatatttattaaattaatgaataaattaattttttttagataagctgtattggtctgttcttagatagctaaaaagaaatacctgagatggggtaatttataaagaaaagaggtttagttggcttatggtgccgcaggctgcacaggaagcatggctgaggaggcctctggagacttaaaattgtggtggaaggcaaagggggaagcaggcatgtcttacgtggccggaacaggaggaagagagagaaggggaaggtgccacacaccttttttttttttttttttttcctttgagacggagtctcgctctgtcgcccaggctggagtgcagtggtgcgatctcggctcactgcaagctccgcctcctgggttcacgccattctcctgcctcagcctcccgagtagctgggactacaggtgtccgccaccatgccctgctcaattttttgtatttttagtagaggtggggtttcaccgtgttagccaggatggcctcgatctcctgacctcgtgatccacccgccttggcctcccaaagtgctgggattacaggcttgagccactgtgcccggctgatgtcacttttaaacaaccatatcacatgagaactcactcacttctacgagaacagcaagggggaaatctttcctcatgacccaatcaatcacctcttaccagtcccctcttccaacattgggtattacaattcgacatgagatttgggaggggacacaaatccaaaccatatcatgtaccattcctaaaaccttctgggatttttattattctaaaaaattcactttaccttctcgatatctttgatattcttttttcagaaccccatgttgtgttttactttgatgtggtcaatctttctttgatttttatatggtttcttatatagtttcctgataaagactgcaaagagaggcaaaactttttataaattttttattagagtaggcaaggctactgtgtaataacacatctctaagtcttaaacattaaaatgaaatttaattgttttaattaatgaaatattagactgctgtagtctaactcaagaggggattaggggactttagggctctgttccagtcattaggagacttaagctccccctatctatgacactgaaaccttcagcacatcacctccaaagccactactgagcgggaagagagggtttggctgatcacataaggacatttttattttgatttttttttaaatacggatttcatatttagacagagaagtgacatgtacataattgccagcacattctattggccggaagtcaatcacctagccttactcaactgcaaggagaaatgggagatacagatttcctatgtgcctagagaaaaatgaatgtatttactgaatgcatagtgttatctctgccacatcatggatatctgacaatgtctttattctttcctcacttgagtaatactttgactatagaattttagttcagaaatcatttttccacagaattttgaagataatttcattttctctgaagagacacagtgtttttttatgtttaaaacataaaaacaaactgatataaaacaaaactttaatatagttatatccaaatgatttttgttctatatttgcgcttttttgggtctttcttgggaacttttacctgttaaaatgtgatgaaaatgctatcctgcagtttttactatttactttataattttccccttatatttaggactttcattcatttggaatttacccttatacatggtgtaagattagaatccaatttaacttttctcctatggtgctagttacatgagtaacgtcttctaaacaactttctttttttgtttaatcactaatttgtcataccgctttatcatgaatgtctgatccttgtataaatcgtcttctcatctgctcggttaactcatccttcaattttattgatctctttgttcttgccccaatattagtctttttcaaaattttaattactctagctttgttacacatccttttactaaaaaagagagccccacaacactatcttaactttatgctttttctgcaggattgggcaggctcttgatcctttcatttataatacttaactaaagttaattattttctcaatagtcaccagtttatatttaaatgttgctgtttctttcttgctcaaattatctgattacctttctttttatttaactatattaatgtgcttatatcttaccatattttcatttcttctcaagctgtttccttcttctagctttttgctgatatttttaggtggtattgagattgggaaacataagattctaaaatttcctcttcattcctgttatatatatttcagagatcatatttaccccttgagtcttcaaaataatgtgccatgcatgctcttagtgttgagatatcttaaataattattttattattaattttatcttttagcatttattattaggtgagctctatctgaatccagctgtagatacataaaagaagagagtgaattgtctttagctgtgtttattatgcatgttgggtgaactccctcagatatactgctgacaaaaacgaatatgcacagctattaattccctttctagtgtctgataagtatacatgtctccattctgtgagtacttagactcatgtaggatcatcttctgtcccatatcctaatatctggtactctgaaccaatggagtatatagcatagtatcaacacaaactatgtgctaccacctttcctgtctctatcagaaccaagaacattgcttatgaggacttaaatcggagaatgtaatgaattactcctaaattttctctcacccccaacaatccctgttgtacttcaacaatgtgaactctagctgccgccaacagccttacatacactggtctatatgatggatggttaggcaatgtagcctgcagagtcattgcaatgtttgcttagcttctttccactcaaattctttccatcttccaagttatatgttaagattaacatataagtgtgagttttcaccttttttttttttggaattttcatggatgttttcagtggagatttcaaagaggctgcattgatgtttattgttagaaactttttttttttttttttctgagaaggagtttccctcttgttgcccaggctggagtgcaatgttgcgatcttggctcactgcaacctccatctcccaggttcaagcgattctcctgtctcaggaaactttttcatataaatgctttctactagttttaggaatagatttatacatgttaatagcatctatttgtgaaactaggattaacggaaaaagaaatatgtgaaattcaaaattacctgtgcttatttttgatatttactccttggccttcacagcattaattccatgctatttacataagatttagaaagtttaaaattagcttttattttgctagtaagatactgtagtactggtaaaagaaaagagctgtaagttaaatgtagtatttgttttaaattcccatattcccattgtaagatagaaatgaccatatttaaaatcttagtattatcaataagcaattcattatgttcaaaatagcgaatttctatggagtcaatgaatacgaaatttgacatattcccaattaattgagcaattaataattgcatgattagagacttagctttcatccattcatggtataaactattctacagttttatttctatcctgtttcaaaattatctatttcttacagtccgtagagattgtatataaaactactacaaatatatcagtatttattattttaaaagttgaattattcatggttctctttcttgttttatttttaattgttcattatttctaaattcccacttaacttactgtataatattgatctatgttgggataatattttatagctctgattttcccattccccacaaagtagtttaaacagagtatgcacgttgtatgcatactattgagtttaaactcaataataatttatttcaatgaggataaataaatggaaagaaattaaattcctgatgcttttctttgtagtgctagttttgtctgtctatggttttatttataatactgataaatttttaaatttttttttggcttttgatttggagttgcacctaaatatctatgtacctttaagcaaatctcaaaatatttatgaaattcaattactcttactggaagtgataaggttaaataagctaatttctagtctctaaagtttctcctacttttctttatgaataataatcatcatcataagaactacaatttaatgagtgtcagtcatatactaggcattagtacttaaaacagacctattcatttagtagaagaagaaactgaggttcaaagagttagagcagcctgtccaagacagcacatccatgaggtggtgaattcagaattgtaacctgggcaggctacgtgatagctgcttcaagtgttctctgtcagttcgttagagtttgtgaggccatattctctcatttcattcttgctttagttatgaatcagttatttcattgatatttcaatttagtttatgtcctccactgaatctttgccaaattcttttattcctccaatcatacctgcccaagtctgagtcctactctcataaaatcagaatgatagaagcctcaggtctcaacatttaaacatatttaactgtattttcatacttatactctttcttgttcctacacaaataaaaataatgttcattttctttccaaagtgattattttgtattctaataattctagtaattcatccaagttcatttatatatttactttgtaatgaagtgagagaataaaaatgaaataagtcttcaatttagttcattttcttcccctttctctacactggttctatactggttcatttttcaagtagaaaatctgaaaataatttttatttattacctgatataatatgtatttgatgatatgtaccttatttcctcatccacaaataatacacacctaacttttttgccccaaagaggcatcaaacttgatttacaaaaaaggaaatgttccaattatgaacattattctgaagaggatacccaatatataagctcagtcttggaaatgtgcctaaatttttaatttacaattaaaatatagaaggaaaatcacaaatttatttttttttatcattatagctatattctgattaagtttgcagttggatgctttgacatactttcacaagtatagattcatggcagaatgtgaagtaagtaaaaagttaggtagatcttatttattcctgtaagtcttcattagtcaaggactgctgtcatccccaaaataactgtcattgacactttcaggtctgggttcaaaataatatctgaactgattctgaacctgaggcagtcaagctgaaattgcagagagcacctagtcccatttcacaaactttccagatatatttttggaatcacaagtacattttatatttaaagtaatgttgctaaaaaaaaaaacaaattttctaataaacattttccttaaacagcaataaaaggtaacacaataataactcacaatattttatacccccataaagtagccatctgcttccagaatataaaatatcttccaaacccaatcaaacaatataagtaatctttatatctagaacttggaatcacaggtatgttttaatattagaaatgaagtcagtttttactctcatgtactttctggatcatattttcacctcccacttttgcttggcctgatactacctgtccttaaggtttctccaggaagctcctttcctggtctaaatttgtcattccatcagtgaagagacaggttagctagcgattaagagcacagattattcttaacccctactttgcaatttaaaagctgtgccatcttgagaaagttgtgaaacatctctgtacctcactccttcatctgtaaattggagatgagatacttacttcatgtgttttttttttcctgaggattatactatttaagtcatgaaaagcatgtggaaacagtggctgacatatagtaagtacccaagatgggccatgcattggtaataagttttgtgttcttcaatagcattttgtacattccctatcatgatagtaaccactctgtaattatgcttcttagttgtcccttttcccagaaagattataatgtccaatcactcagaaattatatctctgtttgtcacagtacctcaatacctatcatgatgcctaagacatagtaaacacttaatctgcatttattgaatgaattaagtttctatatgtcacagggaccaagatacatattttatgtatattatctgcttaaaatttaatcataaccaaggaataaaatagtagtatataggtaaggaaactgaacctcagttttcatggttatcagacaaaccccaagttaatcaacctacacatcaaagtttctccgctacttcccgatgatttcccctgcaagtctccatcgaggcacaaagtcaaagtagtcaaaagaaaagtaaaatttggaaattaagtctgtagtatgagtctgtgaatttgctaaaattatggctggctcatcattttccaggaatgaagattgctttgaaaatgctgaaataatcacccctagattctgattttgtacatgagcagtttatcataatgacacctcctttatctcatctttgtaccttcttttcttggcatttacttcatttactgcaaattttgtgtagtctgtttcacatcattgtaaacttgcctcaaatcacctgatgctatgtttctatgattatgccaagttttgcactatgcttagttcattcttttgtaattagtttttctgtctgtttgttcaacacttactgttgtgcgtgaatacttcctgtgaagttttctttgtcagtgatcaagtttacattgaaaatttgcagccaagcgacattgatgtattggaaatggaaacatacatgcattagcatatttctttccttctttcttttttttcttttcttgagatggagtctcactcggttgcccaggctgaagtgcagtggtatgatctcagcccactgcaacctctacctcctgagttcaagcgattcttattcctcaccctccccaggtgcacaccacatgtgcacacattacaaaacaattatgaacgataacaaacattttggttcaagttcatctctagaaaatcattttctatggcaccttatccttctgtgattgtttcatcaaattgagcttcttgatagcttaaatcttatgagttaatcattttgttccctctctgacagcgaccaacaaatatgtctgacacctactataaatattcgaattaattaatgctgccagaagaagtgattctgacacatctctttgcttagagtatacatatttattttgtctgttctataaacattccactgtaaaaagaaagggctagttcttatactagaatgaattatttttctcatgtagacaaattatttttactatttcttatttatacttgctttgctttttagcaacaaccttggaaaatcttttgatacttgaaatgaaggctattaggatggattttctttccttggtatctgtagactaattttgattttcacttttaaacatatatctacttgtcaaagcttctaaacacaagtaaaacatataataataatgctagaattaaaatatagcttaaagcattatattccttttgcaaatactacagaagtaatttataaccctttgagatcagagtttgcaaattttggctttctcatataacaagaataatttgcatttgaaatatagtgtatgtttaaattctcttctatgggagttagatgttgaaatctttactgaagtgattttttttttcctgcgaacacttacaagattcctgttctcaacttaaagattgagatttatgtgtccaacactttaaatttttttttaaatttttacacatttctcagtgaaacccacttgttgtctttgacttagagactctataattaaagtaaaagcacatttcaatttaaactctaattcacagatagtttcttagttagtctttattatatcaaataattgcagcaacatttaaaactattatatttaaaatataatatatatgaaactgctaaagtaaacatttacattctagaattctttataaaccatagacagtaaatatatttgaaataatcagcttgccacactggctagagtgtcaaagtagccatagtgctactggtttttaagtccactgctgagtttggccagggctactactttttacataaaatggctttaaaaaactactaagaatacttgtttacatggtgagtagtaatatactctttattgcaccaaaacaattttcttaaatgggagtacttgcttacattgtgaactgaaaaatatctccagtctataatatgcctgattccaagtaattcaagtgtaagattctaatttatatataaaaaatactgtattgtaataagaagttctagggattttttaataattacataatattttggatatttctttgttgattttgatatttattttggattatgatctgctggagctcaaaattttcctaaaaccatcaaaaaaatacccatcctctgcgtcttcttccccactgatttgaaatcctaactttacattttaaagtctctttcatatagaatttgtttactgagctttctatcatctgtcataattctgtatgcccttgttcacatattataccattaattattattaccattatcattgaaattacatagcatatttaaattctaataaaaaaagcccatttcgttgtctttttaaaatttgacaatttattttatttatttttgcagatgaaacagaataatcaagattgaaggaaaaatcaatttttgtttttacccaaaaggtgtctctataatttaatttatggagaacacccaactttgcagtatttaatctttcagggacatattttttattcaatttttaatgtcactatattttttgagcgttttcaaataaatcttaaaagtttctaattaaatctatttttaggtttccacatttggttttcaccattaatacactctttctagcaccccctgccatggctagctaatgtttccggaataaaacaatatttgtttgataactcattaattcttattatttctagtagttttttctcttagatgtctactatcatttgaatgttcctccaaaactcacgttgaaatgtaactgtcattgtaacagttttaagaggtgggtcttataagaagtgactagaccatgtaagatccaccctcatgaatgtgggattagaccatgtaagatccaccctcatgaatgtgggattagaccatgtaagatccaccctcatgaatgtgggattagaccatgtaagatccaccctcatgaatgtgggattagaccatgtaagatccaccctccctctttactgtgggagtgaattaattatcactatagtgggttccttataagatggatgagtttggcacaatttcgtctccatgtctcatggcttgcctgccatctgccctgtcataacacagcacaaaggcccacatcagatgccagaactatgctcttgaatatcccagcctctagaactgtacaaaataaatctttattctttaaaaattactcagttccaggtattctgttacagtagcagaaaatgaaataggaaaactaccaacataggccatcatattatctgaaaacagtcatttatttattcaataaatagctgcagagtacttgttatctctgttatatagcttacactgtattatacttttgtcctctttctaaaattatttccttctcttatcttattctctgatttaaacttcctggaaatattaataattttgattatgccataaaccttgtcttttttaagcctgtaatggaaatacctctagtatgacatcattaaatattatattggtttttatttgtaaataaatgattttattgcatttaagtttctaattctaataatttttaaaataataaatggaagagttttgtctaatgctttttttttcgtttttggatggtttctatttccctctttaacatgacaaaatgatgcttgaaattaagttcccaatgtttaaatcatatttgatggctgaaacaaattcttagtcttggaatctctctccccttcttttcctcttttccttcacgtggaactttattctgccaccaggcttcatctgatctttgcttaatgcaaattcctgtgagcatctggcctaacatatcattgacaaacagcctctaatatttcttcataatattttattctcttgctctctttctcttttttcccccaaagaaaggatggaattgagtgaatttgttgtcattcatgtcctggcacaattccccaaatttattttatatttatttttctttgatttatttttaaatattgctatgacattaaaattatcacaagataagataattatcacttgaggctaaaaatcatatatgtgtttatcaatctattaatatttatctactttctcattttattacaatttagagcattctttggctctgtttctcattttaacatcttactaaatttcaaaatttcacactttcattacttagaattttctttaatggaaatacatttctattcctaatgtaataaaatataattcaccatatggaatatgttaagcaatgatcttttaaaaaattacttcatgagttatgatgcatatcacgtagatttgtgataggaaattatagtgcacaaaatatgatacgtactttgtgttacctaaacattctggtcaacttcttatagaacttagtctttaaagctaattggcatatgtagcaataagcattcataattatgaactgatttcttcaatgagtggtcagattggggcccaagtttcccagtttattttgtttgttcactgctgctatagctcaaattatttccttcttagtagattctgaattcattctgattaaaatctctgacatattaaggattttagcagctgaagtatgatagctcatgtttaatcaactgatcctttcaaagggttgtagatatcctcaaccaacaagtgaatggctaattacaatccgaacttttattgagtttctattgttttgttatctcttcccgtttcctaagtgagatacatatatagatgccaccctatgcttgtgtttacctttacttatttttgtggttttgcttttttcttaccatctctccagtcagactttctttaaaaaaaatttatccatttttatttctctcttagcatcattttcatagatctaattactttgcatgcactatatattgaatttatttaatttgaaaaaatatttagttaatatccttaaatgaatatataattaagatataaattgaagaagcatacagttttaatatttgatagttgttttgtttaggaaaagattattaatattacacaattgagactcttttaaaaaataatttagtacccctacataagatgcagttctctgcattttctgtatagttattttctaattttcacaaagaaaattttgtttttgtagggatcttgtattctgtgatgaatctagtattttcttcattgtataactaaactctgagtctctttccatttatttcattattttattacatgaacacttttatttcaatatttttcttctggctttcaccatatttttaattattctaaccctaaatagtaataaagttgataaaatttcacatatatagagacagaaatggtatatgcgtttatagacaaacatacatataaagggaaagagagaaacttagaaaactatagttagaagtataccaaagcaaaatttaacaaaaataaaaataataacccttcaaggaagatcaggggccgggtgcagtggctcacacctgtaatcctagctctttgggaagccaagggaggaggattgcctgaggccaggaattcaagaccaacctggccaatatagtgagaccccatctctaaaaaaaaaaaaaggtaattatttcctttaaaaaaataaaaagaagctgaatattttatcttacataaagttggaaatactttaaaattgctaaatattggaggtacaatataattagtaagtgaaaaactgaaaaaatcctgctgttgtagaatcagaatgtgaatattatagagacacattgcagaggtttagttggagatgatttttttctttgcctcaagaaaaattgtgaagttaagtcttttttaactaatgagtatttcaaatatcttttctttatttattatctattgtgctgtaacacattttcacaaacttagtggcttaaaacaatgcatatttattatctcacagattatgtgggtagagtctgggcatggctgggctgtgccttcctccagtctctcacaagactgcaatgaaggtgtcagctaaaactggggttttatctgaagactcagttggaaagggctcactttcaagcttacttccatggctgttgggaggattcagtttcttttgggttgctggactgagggtctttggctgggggcccaccctcagtttcttgccatgtggatctctctaccttggtaacagcaaaatagagtatctactaacaaaatgggttaaaatctcttttaaccaattcacagaagtaggatcctattatgtctgttgtattattttgcctagaaataagtttctaggcctacccacactcaaaggatggagattacaaaagggtgtgagtatcaggaggaggggatctttgagggccatcttggcattggctactacaattccttttctctttccccctctccaaataggctctttcaacaatgtggatatatggatttttttttgagatggttgttaaaccaagataacatgtaaaatgcatggtgaaggtagccaaaatattttgaaaattcaaaatcattactaacttgtttgaaaataaaccattttaagaatgctacatgacttcagctatagagtgatgtttcctacttttaaaaatatacatgtgcattttattgattctatttaatagatatatttctattacacagagcaaatgatttaatctatacattaatgtccatttaacctgaaaatattttgtagctaatgttttagattctttttggtttgttttaaattgtgtttgggatttcttttagcccctaaacactaaattgtttgaatgaatatagaaataaaatagaccccattcatcaaaatgaacactaatgcaaatagcatatattaaaatgtaaaacaatggattaaaattcatatggcttttctggttcttggtggaaatagagcataaagaaatcaactggtcatcctcttctagtttcattaattcttatttttaagaactatttgtttgtttaagactgtgaatattgataacactggaaaccaataacttttaatctatcaggttcagaatgcccttcacacttttttttttactattttataagaaaatgttatttattatgaaagataatttaatttaaattttactgctatccatttactagttctatatgcagcataaaagtcatttaatacagttctgaaaaaaagaaaccctttgactggttttacttaattcatgtcattctaggtaatatagagcagggctttaaaacccttgtaaacactgtaaatgcaggaaactagataatttttcttgggaacaaattttgaaggtagatgaaacttaaataatctaattataaataagcaatgatcatacttttcttacctttgcattttaaatctagaaatacatcataccaagccatttggcataaagctaaaataccacttttaatgggttaaatgttttgaaatcttctcttaaagtttttaagtgatggaacaggctccggttctctaaatatgtgtaataatactctacttaattaaatttaaaaaacaaaattttattaattttcacctccagcaacagatgtatatgttttgaggtaaagaaaaaaaaacattttataaatggtctgatgaaaattttagttggctgacacatttaattttcacagctgtttatttttttttgtccagtttagtttatttttcttatcagaactggataaagacctattagaccaaatttattcccaatggcataaaaagaaagaaaaaaagctaaaccctttattacaagacaaaacagtttcattggctaaaagtagagatacaaaatatagataacagatggcatttaaggttgttgctattcaactttaatcagattggtgatatctttgatgctggttgtaagtaagcatgattttttctggtacatattaactatatgatggagtgttagttgtctgtggaagtacacctattaatataaaatatgctctacaacaaattaaatacttgttctctccttttattatcttctccatgcctttcctatgccagttttgcttcttgaaatgataaactttctctcctgtggaactgccagtaagtagccaacatttggtcaggtaaagagtataggctctggtgtcggacagctgtttcactggctttcaatggcatctttggcaggatatttgatctctggggacctgtttccttatctgtaaaactgggacatcagaattatcaaattcataagattattgtaaggcttaaatgactaaatatctgtagaacatatggaacaatggctggaataattatgaacatcatataaacatttgctattaattttacctgattcttgaatgtttgcatattcttgagattcactatatgtttattctacaatctttgctttacaacctgtttcctaacatctagagtgtatctatgtaacttctgttactattgaaattcataacttctaatatgtatagtcattttttttgttttgttttttctacctgtgaactagcccctagtgtctatccaactcacattaggacctgatatgttacaggccatgaggtatttctgtggcttacctaactaatgatcaacagtcctcattcaacatcagggcatcttttaccctactaagttctaaaagaatgttctatggaaagaagaggatggttttcgattcaatgagaattcattggggatattgtgtatctaagataaccacgaaattcacttgcatatgtccttgaaacttttgagaagaatgtgcacctactctcactcagcttactgcagtctatagtgatgagactgggttgaaaattatgcctataccatcctatatctcagttccacagaggattggcatttaaaaaaaaaagaatattgcaaggattgttttagttcctactggatatctgcattcaaaggttcttgccactgggtcttcagtaagcagtaattctagtgcctttttaaaattttcatctttggaatattacttttctttatctcaggatattttctcacaattatctacatcatatcatgctaattaaagcctgacaccattaatatcaaaatatttgtctttttaatatgttcttaagcaaccaaatcttacacaaaatatattagagtgctctattttctgagcctctaataattttgtttttgttctgtttttctccaatcatagtccttttcccttattcactgttgtatccctagcatcctgcactggtgatcagtaaaatacattgacttttaatgaatatatttgctgattatgtgagaaatcttttaaaatacaaagctgatgctgttattccactgagtaaaatattaaaacaacttaatcactcagtattacctacaaattcattatcacggaataaaagactcttcaggagttggccctgcttattgcttcaagctcccccgtgatttccttctctaagtgttgacaaccaccttacttccccacctgaatgaatacatttggttttcaagactcagtctaaatacttatctttttaattcctccaagagctaattattttctcccctgtgccagaagtatattctgtagctaagcctaccatagtcaagattctctgtactgcaattatactgttatatttctatatctccttggaggtgattgtttagggaagagatgatattttcttaaattttgtgtaataagaacataatcagcacacaataaatgttataagaatgatttaagaattaatgaataaattgataccttgctaaggttcaacatccctaacataatattttgagtctgaaattcccagtgattgcatataaaggaaaaggtaaattttgagggttttaaggggaataaaaattcaataaaaatgcattattaatctccctatgaactgaacatatgaattagtacgctatacctttccctttcagatactgagcaaagggatgcaatgaaagatgattcctattaagtatgtaaccaaacaagttaggcaaaatgctacttttaataaaaattattattttcccatagacaagatacacatttttgaaagctgcaaagaacagaaaggtaattctacattgctttaaatgataaagaaattatagtgcaaactttagtgttagcttctcaactagtatcattttagcatttgtatctatgttggatctgtaacagttgaataataagttatatttaaacttaaatttcaaaaacccagaagagttacttttgtatgtaacttgtgaatttagtcagttgctttttgttcttaatgttttcaaatgtgaaatgtgacttttcagtaaatggaaatattgcatttactttttaaatatttaataaaatcaattgttttcttgaaataaaaaccgaaatcgcttttcaaaataggtcatagacctaaatgcaaaatcccaaactataaaaatcctagaagataacgtaggagaaaacctagaagaacttgggtatggcaccaacttatttagacagaacaccaaaggcatgttccatgaaagaaataattaatacccggaacttcactaaaattaaaatcttttactctgtgaaagataatgtcaaaaaatgagaagtcaagactgggattaaatatttgcaaaaaaacacgtatgctaaacgactcctatccaaaatacaaaaataactcttaaaactcaaatactgaggcgggtggatcactagatcaagagaccgaggccatcttggccaatatggttaaagcctgtctctactaaaaatacaaaaattagctgggcgtggggtggcccgtgccagtagtcccagctactggggaggctgaggcaggagaatggcgtgaacccgggaggtggagcttgcagtgagccgagatcgcgccactgcactccagcctggcaacagagtgagactccttctcaaaaaaaaaaaaaaaaaaaaaaaaaaaagttttagaacagaaacaaaaggaagtaaagtgcacttggaagagggccaagctggcaacttgagaaattcaagcacacagtttgacctttgacttggggttttatacattgccattcttcgtgcgcagtggcctgctagtacttgagaggggtctcatgcacagtgtcaacaatgtgtttactggagttgtgcgcatgctcacttgaggcatttttcccttaccagttgagtgctcctagaagaaggtcctataccagttaaactccacgattttgtctcttagtgcacattcttgagcccactcacccaactccggagattttattgggaagctgctgctcaccattttcaggtgtttgtatctattaggagcctccctggtgccagctgtgaccaattattattttagtgagacagcgtagcaaccacctgaccatcacctgatggtctcctgacacttctggttggccagggttgtggggttgcgggggtgtgctctaatgacattttccacagaaatagaaaaaaaagaagctaaaattagtatagaagcataaaaggtgacaaatagtcaaagcaagagtaccaagaacataaactgggctaagcacagtctcttcagtaaatggtgctaaaagtagatatccatatgcagaagaattaaactagatccctgccttctcaccctatacaaaaattaactcaaaataaataaaaggcctaaatataagaccccaaactgtaaaactagtagaagaaaacacacgtgaaatgctttaggacattagtctgaaaaaagatttgatgataagacctcaaagcacaggcaacaaaagcaaaaataaacaaatgggactatatctaactaaaaaacgtctacacaacaaaggaaacggtcaatagaatgaaataacaatgatctgacgaggattaatacccagaatatacaaagaactcaaaaagctcaaaagcaaaaaataaaaacaaaaaaacacaatacaatttaaaaagtatgagttatctgaatatacatttcttaagatatacaaatggccaacaaatatatgaaaaaaaagctcaacaacaccagtcatcagggaaatgcaaatcaaaaccacaatgaggtatcatctcacccctactagaatagcatttatccaaaagacaaaaaataacaaacgctggtgaggatgtggagagaaggaaactctcatacactgttgatgggaatgtaaactactacagccactacggagaatagcatgaaaattcctcagaaaaactataaacagtgttaccatttgatctagcaatgccactactgggtatttattcaaaggaaagtaatcagtacatccaaaagacatctacagctctatgtttattatggtattattcacaacaacccatttatgttcattattagacaaccaaggtgtccaacaatggatgaatgaataaggaaaatgttgtgtattacaccatagaatactagtcagctacaaaaaaaaaaggtgaaataatcattctctgttacacgaatggaactgaagacattatgaagaaataagcctggaacagaaagttaaacaccacctgttctcattcacattcatatgtggaagcaaaaacacatacaaacaacaacaacaaaacactttatctcatagaagtaaaaagtagaacagaggatactagagattgggaagggccggggagaggggagcattgggagagatttgttaaaggatacacaagatatttgttacagctagataggaggaataggttagtgtcctgtagctctgtaggatgactatagttaacaataatacatagtttcaaatagctagaaggaggatattgaatgctcccaacataaagaaatggtaaatatttgatggatatgctaattattctgatctgatcactagacattacatttatttcaacatcgccattgaccccataaatatgtacattatgagtcaatgaaacatttttgaaaattaaaaaagcaaaaaccccccaaaattgtttaaaaaaaaaagggaagtgatttccatggattagtggggagagagagataaataggcagagcacaaaggattttaggggaatagaactattctatatgttactaaagtggtaactatgtgtcattatatatttttcaaaagccacagaatgtacaatactaaaagtgaactgtaatgtaaataatgatctttggacataatgatttgtcagtataggctcatcaattgtaacatatgtaccattgtgttttgggatgttgacaatacagaaggttgtacatgtgtgaggacaggggacataaaggaactctctaaactctgtaattaattttactgtgaacctaaaaatgctctaaagtttattgattaataaaagcatcctgcggaataaaaatatatactaggataaaatgagattttctctgtttaatcagaatgatttaaacttgaaaatgcaaacagacaaaaaaaacccctgaatttctgtcttaatattattatgtccaatttatagtttggacatctttacaaccatgaaatttctcacagtattctttatttccactctaaaattacggagaggtaatgagtataatactcaatgtattcattcatagtaggcaatcaagcaattggttttcatttacttggtttggaaaagctataaaaacctttctttgtaatcatggactaataattacaaaaattgttttgtctctgtttctatacaatacgcttacaattaatatgaatcttctgggctcagttatcctgctgttgaattctacaatttttgcctattttctctttcccagagagtttatttttactgtataatacgttgaggaagtattttagttcattcttataatttatttggtcttttctgcttttatgagtacaattcagttaatagtatttgtttaaaatgcctgctttaatctttttcagatatgtctagaccaagttgatgtctttcatagagcatatcaacttttaataaactaatttagatactctgacttgctgccatgattatataataatatttccattatgcattatacttttgtctatgcttatgtctctacctggaaaagtaagctttgaaaagctcatactgtgtattgtttattccctaaatctttgtatccaagcatagtgcataacaaataatgggttcccagaaatttgtttagataatagtcagtatattattccattttagaacagttaaatttgtttagataatagtcagtatattattccattttagaacaatttatttaatgtaaattagtgtgagtaaatgatggtttaatatgaattaaagtgatgattatttttcagttaactgtaaaattgaaatataaaacacaaaagaactcagtgaaaataaaacctaaaaatgtagtttagattttcaagagttttagaaactatttctttcaaatgcaaaaactggactgttgatttttgcattgttgttgttgtcatcttaacttcaaaagcattactttgatcaatattggcttttgaaacagagtgcagaggttaaccataagttataaagtgggaaaggaatgatgacatagatctattttcttactacacaaaagagattagaaaaattttttattggctataaaatgatgggaaataaggcttatagacagtgagctatattatacaatccccaaataaggtaatttaaggggacataggaactgcatctgtcttttcctctggtatttttggaagagtcagcctgaaagaacacactgcaacaacatggttggccatattagagtaaaagtgccaagtaaatagatgttggcagagagaaggtcgagaaagtacctaagttctacataggttctgacagatcacagaagacatttagtttggttctgcatgttaaagtggagaactgagtgttaccatcacgtgtccaccacgttttaaggtgaagtgactatacagcaaggctgacacattaattaaagggtaggatgtaagtgtgaacctgaagaccatcagaagaaggatccagtatgacaatttattcaacaaaggaaactgatgaattcctaggaaccatgctttttttctggcttctgcactgtgattacttatgtaataaagcaggccactgcagtgaaattgtcacaaataagatgcttcttgtctgatgccaagatcttatcagtgcataaatgttggatgagagtagggatgaggcaaatgcaaatattcacttataacctgggaagccagacatccctgtagaagaatttacaaaatcaaacgtaatagtctttgatgaaaacatcctcatgaagagttcttcttatttccttatgttgtgtttcatttcagtgtgcctaatacactttccttctagcagacatcacttggatcatctccattcttcacataaacaaaacctaaaaacatgaaatatcaagaatgtcttaatttcttttcaaccaggagactcctttaatcctatgaaaatttgcctattgcttctccaaacaccagctccttataacaaaatatataaattaaggcaacttttaatgagttaagaataagttctctcccagtcacctaaatgagtttgtacgtgccacatacttgcatagccaagagggcttactcaaatgttatgaaagagtgggagaagatttatcccacagtaaatataactaattataagttaattatatttgatctctaggatcattgtatttaatcctacaataataaagatattttgcattagctgctatcatgaacaatttccaaatgccagagggattaatcaaatgaaagattatttcttatttatttattttttcttactttcccatctgatgctagtgaagaatctcttctaagaatctccaagaagtttttttttttttttttttttcctcttttttgacatggagtctcgctctgtcgtccaggctggagtgcagtggcgcgatctcggctcactggaacctccatctcctgggttcaagcgattttcctgcctcagcctcctgagtagctgcaactataggcatgcaccaccatggccggctaatttttgtatttttagtagagacggggtttcaccatgttggtcaggctggtctcgaactcctgacctcgtgatctgcctgtcttggcctcccaaagtgctgggtttacagacattagccaccatttttaagaacttccaggctccagaatccttctactgtgtggctttcttatctcaaaatctttgctgctaaccactagtatggaggctaggtcttcaaccaagaatcttgcaagaaattctaagggccaagagaaaagttgggtgtatcatcactttctacattctgtctgcatccagaactagttatagtgtaccaatttaattacatagaattgtggaaaatgtaatcttcctgtatacactgcaagagaaaacaaaattgatgagaatctatgcaatcattttaccaaaactccacacattctaactttgccacatgctgggtcaggatagattgcttctccttggaggattagtcatgtaattaacaaaaatgtttgtgggagttcattgaaagatactgaaaaagaggggaaagtgagcattgttctgaatactagaagtcttgttttagcatgaaaagcaaacagaaagtattagactactatttttgaatctaaatagaatgctatgtgctatcgcgtctatcaaacaagagcagaagatctcaagagagcctactctatgatttgccaaggataaaaaaaaaatactatttttttctaaaaaataaatacccttgcttttcttttctctttatcctttattgcatttgtacaattgattactttctttccgtttggagttttctagatttagagacacttctttcaggccatacaagtgccaaatgctgtctttttagtcaacttgctaaattacaggtaactcagccaaaaagtagtttaagtggcattcaggtgagtttgcattactctagagagtcatgtaactggataaaaatcagccttcaaatgcaatagagcgttatttattctggtatataagcatgtaaacatgacaaagtgaagctgttaaaacaatgaactatgattcccctaaagatttagagcaccatttagtattttacagcaccaggcttactcttaacagtatctgattttgtcatatatatattttaacttctcattctctctagtggttcctggctttaaggaatctcagcattgctttatttgctaatactgacacctgtgattaatgaaggcttaatatctgagataatttgttgtcacttggagtccctattaaattatagagtctatgtattattttaacataacagggatatgactaaggtaatatttatgaattgtgaagcaagatatccattctgtagcgtggagtctgccaggagttggtacaccatagaaagaattcaggaaagtacagatgttatcatattcctactgcagacctcttgcagggagaatgtgggagagcaagtgatgaaagagcaaaagtgagagtgaaagtgagagggaaagacagacagagagagacaaagagagagattgaatgtaaaataggaaaacatttaaaaaaggaagataaatacttttgcatattatgggggattgaaacaagtgccttgatcttaaattttaatgtttaacatccatttaactcttttattatatctggacatattcacccctagaattcagacacgttatttcacttcttagatttcttatttagtaatatgatgacttcacagaaacagaattactaagttttatttcaaaaatgtattggggacttatatttaatatgcttataccttacaaataataatgtcattctgtgatattaattagtcttaataatattataagaaagaagtgctaaatttgacaattattcagacaattattcaccaattttgaccaactcaagaagcataatttaggtgttcatcatttggacattaagttattacataattttttttctccacaccatgattctgtagtttattacataaattcattattgagggagaacaaagtaatctgcttacaaacataatttttatttgaccataaagtccatacataattatttagtggagaataccagtgtctcacaattcacttttagtgtactcttcttactttgtaaatatgcagtcaaataatagattatttttcagtgtgcgttcctcagaaattgtagcctgagacaaagtgcttagttactgttacttattagggagtgtgatcccagtgagtagaagtgaggctcagaaggtgaagtaggttaggagggacagccaacatgaggctgtattagcaagctgcctgctgattgcatgatgccttaggatgtccccaaagaaaccagaaatttactgcttctcagtttatatgggatggccaccatgtggtgagtgaagtggaacagtttatccatggtttcctatctctcattgataaaagttttgctccactgggtgttaactcccaaatacttctgagtcccatggagccatccttagggaatcctctgggcaggagctgcaggcatgaggcacagttgttgaagttgcccttgtgtggggttactcagagctcaccgagatctaaccactattgggacagctaaaacagaatactggtaaggcctgggagagctcaagttgcatatgtgggaagaatactatattccagatagcacagcacggatacactactgccctccacagctggcttccatactgtaatctggggtctccatagttgtgagaacaatgtactcctttagtttccaagcaaagaaggggatattggggatacaaattcaatcaatcattcccatgtatttgttaggccgtgttggctggaattcccatatagtggttcagcaggccaggcagggtagtgctaagagttgtgccagagaattccctgggttccagtctttctccttattcctattttcttgtcttcagagcaacaaggctagttttcatagtaataagattgctaacatactgtcaaaacggactaaaggcgaattgattatattcggaggttaatgatcagaggaatccttattgactcccggtggaagtatttattccctagtaagcagacctctagcatagaagagcctgagatttccagagtaggagacacacaaatttcacaaggtggatactgacagttaaggtaggagggaccaatcctgtttctacccattgtttctgagacaatatgctattgggattatattaattaatgattcatcgaatatacatccagaagcatagcatttcaattctgttgcatatttccttgagaaggactcttaactgaggctttaccaggccagttatctaactattaggctgactgtctcaatgaggaacatgaaatcaccagtacattttgctttcatgtgcctatgatcatagctgctttgtcagaaaatggttcccttggtctaatgcagtgccatgtggtattgcatattaaaagataaaatattttgtaagtccttggatggtggtgcaagtaggaatcacaggaaggaaagataaatcattatcctgaagaggttttaagctgttaaagagctgtcccaacctgggtagaagaagtcatataaccaacttgaagcctgattcctgcaaggaattgtgctctgttgaaggctcatttttagtatctgttgttggaaattcagaacaccaagcagtgcagtagatacattatctttgttgaggggagccatctgttgggttcacgctattcctgccaacaaagatactttgttcatggcccattgttcaaacattgcaggatgggtggggtgaagacatgttggctgacatttatgtgacgggtcatgttcattcttcgttaaaagtctcctctgtaagttgatgctctctggtgatcattatgaaaaacaaagatctacatattttgtgacaatagccatatcaattacctctttaatagaccttactcccaatcttccaatcttgcttccttcaggcctttaaactggaagaatttattttttctttctcaggaatccaagctcatgtttacctcagcattcttttttctttgtagctttttgtgatgactaatataacatattcatatgctaaaatcttctgaaaagatatacctcaaaggaaggtgattagtgctatagcgctgtgatagttgagaatctagtttattattactattaattttaaaatttggtttggttctgtataggggagaaaaagtaagatcttttccttacccattgcaagggtcattgctgagacccctataaccaaaagacacattaacaagagaaaaacataacaaattcattcaatgtcatgtttacatgacacaggttattcaaaatgaagactcaaagaaacaggaaaagctgtatatttttatgcttggatttgaggaaggggagccaggcatgcagaactgtgaatgaacaaaatggatatggtctaatggtaataaaatgaagaggggacaccgtgaggaccgtttgttcagattcttcttggcatctttatgtcttcagttcagagatgaggacgtgtttttctctgggaacaggaaaagtccctctggaatgagtaacttatggactcctttaaaggaaggtcagataattctttaatggtttgtttcaggggagaaatgcaggagactgtttgaaagaccttcctgcttctactgctacctcaaatgcccaggcaccatattctgagatagcatgtcctgaaccccatcgctttgtttgtatttttaacttatattttaacttatatagttgatgatatttaagttttacaaaaattatctgaaatagttaagtttgtttctttctttttgaagacaaaatcgcctaaagaatgtgttggaattcaaagttggtttaagtcacagtttcaaaagatgaagtcagcataatgattacaattaatcttagtaaatgctaaagcagtgtataaagtacttttatttgggctcatttcatgcacccaacgaacaactccaataaatgccatgtgtattttcattttataggtcagttattgagtatcgataattctataccttttgccataatgagcagtagctcaagccaatgctgtctaattccaaatcttgaaaataaattaagtttataaattcagttagcaaatattaatggagaaacttaagtgacagagatacagcagtgactcaaacaaattccggttctagtgcaggttcaaaaaaacaaatacatatataatatgatatgagtaaaattaaatgttaagaagaaaaggcagggtaaagggatagacattagcagaggaggattgaggtgttcaaggaagttccacctgagcaaatgtcatttgagcaaacgattggtccatgtattttttaacaaatagaaagttaaaggatttacttaccttacatgtgctctgtaactctcattattataaatacaatatttaaatttctataagattttaccaagatttactaaaggtagtaaacttcaaaagcaatctatatagtcatgtagaattggaattaaaattaaatttaataactttaaattctatactcattctgatattggtagctaccgattttattaatcttctgttaatcatttattatacgaaaaagaaatattgcagaaagttgttttcctgagaattaaaatctatagagatgcctccacatttatttaattttggtgtagtaccactctgagacattcatgtcagagctttcgaattctcccctggatctgatggaactcactccgtagtaatcgaccaaatttagaagtaatcaactccatgtggcaaaccaaagcccagatggaatgcctcttaatctttagattaatgtgtctactcagcatttaaggtgtaactccaaaataatggagttgcaatacccttttactttctcaccaggctatattaagctacgagacctaaaacagatttaatcctaaaatatatccatttgtctaacatatttaatagcaaggctaaatcctttgaactgtataccttttatccttattgggataaataattgcttcacaaaatactaacagtttttagatattgaatttaaaaggtgaagaaaatcttgttactttcttgtaatggggtccaggaagctgatgtaactttaatgcctgaagaaaaacactgtagggaaaaaaagtctactctggaaataaaagttttacatagattttcccaggctattagccctggacagtctgtgataattagcttaccacagatgactatggtgaggagtcacatgctttcttatatagctgaacgagtgcaggctaaccaagctgacgggcatgccctcatttttagctccaagtaaaggtgtcgtttgattttccagtgctgtataattattgtttcttcccaggatattaatcttgaccttagggaactggagttttaaatgaaagcctacttttaaaagtgatagaacagtatctgttcatttttttcacacattttaaaagacatcagattcttgctcatattttgttacaattaattataattggtgcaaaggtagtcattttccaatataaacttttatagataaaatcaaaaacactaaaaagtgttgatacagggtcttaatatttttaaattaccacacatgtatctctccaatacctttatttaaatcacccctgctgggcgtggtggctcatgcctgtaatcccagtactttgggaggctaaggcggcagatcacgaagtcaggagttcaagaccagcctgaccaacatgatgaaaccccgtctctactaaaaatacaaaaaattagccaggtatggtggtgcacacctgtaatcccagctactcaggaggctgaggcaagagaatagcttgaaccctggaggcggaggctgtagagagctgagatcgcaccactgcactccagcctgggcaacagagcgagactttgtctcaaaaaattaaaaataaataaatcatcccttcatatattgctaaaactaagccatttgccgtgtacatatcttatgagatatggcgctttctggaattagcaagtctttgttatggcccactcacatagaaagtcagaaagagaaatagcagttttcatggcttctgagtaggcctttcagagcatcaactccaattttgtaagagaaaatatataccaaagtcacactagcacatgcataaaggccatggtgtatcatgcgatgaagattgcattcttccctgaatgtaatgaaggctttctggaagtagagagctttatcctttaaaaaagccactttgatagcagggtagagaataaattacggaagggggagtgttttaatccagaagagcaattgagaggatggtgtacaaatctagaaaataattagagaagggttaatctaaggtagtaagaagtgcagagcgagacttgaaagatagaagataaaaccaatataatatggtgactgggttgggagactgagaaagaagaaaatgtttagtttattggcttggatgactgagtggatgaatgcaccacttactgacatgggaattatgtattgaaggaaagaagagcaatgtgggaaagggtacacatttttgtttaagcacattaatttaaaatgtctatggtatatccaagtgtaaatgttttgtgaactgttgagtatcttagagtacaataagctgagatagagattaggagtcagtgattctttatacatgcttattaaatcacaataatagaagtaatcatgcatctatttttgatagagaagcgtgacgaggactgaggtcacactctgtgaagtttaacgtttaagtgatgtgtcaaagactaggaacccatgaaaaatgatttattttatttatttatttgagacagagtctcgttctgtcgccaggctggagtgcagtggccagatctcggctcactgcagtgaaaatgatttttttaagtggtcagaaaggtaggatgaaatgtaaaatgctttgacctcataaatctaaggagaagaatgtttttcaccatctcatttttaatatagtacttgacatattaaaaatgtcttgaaagaaatacagttcaactgtcaggtcttacctaatgtaagtttcctataaagtatatgggaacagcaaatgggaacatttgtaaaggcatacacataattcccagatagatagatcagtggctgtctagcaagaggctgaggaaacaaaatgcaggcattaaacaaattctgcctctctactacttaaaatcatgtaagatagtccagatgatgtatttgagtgaaagatgcatagcaatctctgtgaagttgttaggatgccttctcaagaggtggtaagtaactggggttggatgttgtgaaaacactctccattcataaataactatggattttcatacgttttcagcctgtgtaaagtcaaccctaaatgtagacctctgctagtcataattcaaaggaacgaaaaatagagagaagcaaaacatactggttaaataaattaggcttttaatatcgtcggccagaattcaagtatacacttccagtgcttcctagttgtttgattttattctcatagagcttaatttactcatctgtgaaatgtagatgttagcacttcctatatcacagccttgaggattgaaagagaaaatatttgtaaagtgtgttaaacagggcataccacatgaaagcattctaaaaaagaagtaacttataccaataattagagacccaaaagagaaaaatataacaatcccagatgggaaaaatattaacttaatgctggtctgtgaaattttatggaaacaggttatttagtaaacccgtatgtttctaaaaacctaataaactagggagaaatagattgctttgatgagttagatgtcttgataaaactagtcagaagccatttgtgagaacagacaagggaacactgcctttgatgtaagttctggctgttaagaagaaaaatgctcacagctgaagccacaaaaaagctagtaacccagatagaaaattccccttttctgtaggaacttagtagtggcaaaacccagaaagaaaacttatttctagctctccaagaaagggcagtaataacatgggccaggacaactaaacaaaactagcaaacaaaaagggaggaaacaaacgaataaaaacagaatattcaaaaagagttgaatgacatacatgtagctcaactcaatatataatcctaagattatgagcttgaaaataaactctgctagatattcattgtttgaaattggagacttcttcctaccactgtaaaagatgggatgtacctgacagattacaggtacagtgaaaatgtgaagagaatatattactgaataaggaaaatggggacatactaggaatcatcgttttcacatcagaaaactgcttgttaaatacactactgataggttcagaaatttacctaggaaattaagtctccaggtgagacttgtttagggtaaattccaaagtgttccaaaggccatcaaagttctaatcatcagacaattttttctagagttgattttgaccagagatatcattttctacatgttagctactgtgtgttcaggcgtatagtcttgccaattttatacatgctgccaagtaacatctttatggttacctaatgggtccgcatagagctacagtgagtttagaggctgagagacaataggttacattttccatgtctttttgtcatttttgttgcttttctctaatttctttcaaaatagtgatctctaaacagtattgatttttataataagtataatgtgtaataaatgtactgcattttttgtagctctaaatagcattatcgcagttcagtgtaaagtcagtgtgtcatttgttgctatagttttcgacctcccatctctggtttatctattcattaccacagttaacttgttagtcacagcttttattagcttgattctgagttattgtaattgtttccaactaatttttttattctaattcattctacaaaaatctaggtaatttttcttaagcaattctcattgtgttaattcctccattttcctctccctaactagcatcaatgttccctttttcccaaactttcctttgagaatttcctccctactcccacccacctccacagtattcagatacggagtttgaataagtttggtttcctgccaatgatatacaaataggctctgatctgtggaagccaaccattatatctcatacctgtgtcaccagtgaggggtttaagaatgaatacataagctattagggaaaaatgatgcctcagtttgtagttagggcttctgggaaaaatcttccttcttcccttgaaggaggtaaaagaaataatttttcttcttgtgcacattgcagtgagagtgtgtgagatccaaaaccattgcagccatttttgtaattagggaaactaattttaggatgaaactgacacaactgagtaaggagatctaggagatggaggtttgtttggtaaagcaaaattccagcgatgtcatgataaaggcagctctacctctgatgtttgcaatcacatgagccaatacatccccttgttggcttaaagcactattgagttactgctttctttctcaatcaaaagcattttatcagatagaagatatttttggtcagtgatatcatatctaaattttgtcactgctactttgaattctattcctactgagatagttaacaccccactattcccaaattggaatgtgaactgtttcctagtaatttctgttcttcatgaatttttaacaaaaatgttatacctagtgctatggtttgaatgtgtcccctccaaaattcaaatgttcccagtgtgatagtatgtagacgtgaggatttaggaggttataaggccatgaggacttctccctcatgaataagattaaggcccttaagaaagcatttgcatgcagcgttcagtctcttgcccttctgcctactgtcatgtgaagatgcagcctccctcccttccataggatgcagccctcaccggacaactgaacctgctggtgccttggtcttgtgcgtcccggcctccagaaccacgagaaatcaatttctgttctttataaattacccagtctcaggtatctgtatcctgttatagcagaacaaatggactaagacacctagttagtatccatgttgtctcataaaaattctacacgagttgttgacaaaaatttatttattctaacaattttgaaaatgttagtcaactcaattttgatatttatttgacacatgtcatatttccttttgctgacaatgagatatttataatgtttaatcaattgaacagttatatttttcaggccatattgttttctgtttttgatgtgtttcctatgaaattcatgtcacaacataaataaaatcctacctctttctttatgtattgggtgccatagaaaaagttagacttacgtaaaaaatataggctttggcaagagtatttatgactactattctgtatcatgtgcttatttttgactttgaaaaagaatggcaaaaaaatggctggtttcaaatatttcaccatgttgagttctgggttgtagcttccaatgaaatggggatctgaaagttggagaagagtgaaaatagtgtaatgactataggagtagatttgtttgataatgaaaaaaacagaggcaaaacacactcaaatattaggctggcgcaaaagtaattgtgatttttgccactgaaagtattacaaattattgctgatcttgatcttatatcaaaatcctgagagtttgtttatatgcagtgatagtaactcaaagcatttgaacaaatggattaacctctcttttaaggcactcaaattaattccaatgatacctttaaaaaaagttgtaaagctaacacatttgttttaatggaagataaacaaatgagatctgaagagcttaaaatggaaaaaatatttttttctaaactctcgtttctatttttcagagtccttgtatatttccagaaaaatgtttatacctacccaaaagtttatcaatttcctttttctttcctttctttcttttcttttttctttccttctctctatacattctgtgtgaaacttgctttctatttaatgtcacctaaaaatatttgggacattatgctgtatatatgcatagcattattttttcatggctacatagtattccatgaattgtatatatcttaatttatgtatgtattgtttaagcatatttgaattattttgcattgttttcatacaaacataatagcaatgggtgtattcctatttgcagatgtcctatctacttatctagacttttttgtgtagattactgaactgaaattgattgtcaataagtatgtttatttaaatatttttagatattaacaaatttcttccaaaatgtttcaaaaatttatactcctagcaaagctatatgaaagttattttttcttacctgtaatctgtatgccttttgtgaaaaaaagacttcagaaatttgtgtgcacagtgaagatccttgatatatgcaccatgcatacatacgtgtatttgtatatattctctgttttgtgtgtgtttgtgtgcatctgtgtgtgtatgtgttctatttgtaagagagaatgattgcattatgtcagaaataaaacactataaatatttgctgagtgggtaattgaatgaatggttgaatcacctatgctgttctgtgctgttcatagaattgagttgaatctactattctgctggaattataattgggacgctcagtgacaagcttctgctcagcaattggctttatagtaatggttgttctgctccttcatgaaatgaatgagatccaggtcaagccaattatgaagggagaaaacattgaagttaatgcaaatcattcagaataggtttaaataaccctagatttgtttaactaacatttagtttaaagaatatttgaaataactacttcctctgtgagtcctttcccaactaagtaaacctgaaatgtacatgcatccttcaagaaaccactgacacagccactttctcctggcatcaggcaagatgctgcagttgcaaaagaactgatttgcttcttcagtagcaagtgagcccattcttaggacaaaaaaagttttgaattttatccacaggtaaaagatatttttgttattagtggaatcagtgattcaaccattcattcaattacccactcagcaaatattattagtgctttatttataaaataatgcaattattctgtcttagaaataaggcacacctggtttgaaaactaattttctctctgactgtttgacattgcatatgtcattcacattctccaagatgatacactcacctgtcagtattttcagtatttgattttaaaaatgtggaaggcctgactcataggcatttagtgattctgttatcttcttttccatcttttattagcgtaaatgattgtcatcataatcaggtcatcaaccagggatttctggcttagaattattcataggtacaacgctgatggctcttctgaaattgcccctgcataggttaatccacaaattgtacatgtatctaatcttcggcctcataacattgtattccctcaacacctccattattttataattctgcaacagacaattcaattgtattatgttgtccattgctaacatctatgttggatggtttttatcaacagtctgtattgtagagggtgagaaaaacagtacaggtagcagggttcattttacctcatttgtatttatttagaacgatgctttttcaaatatttcaaatattgctatttttttcttgtgtctttaatatggttaggctttgtgtccccacccaaatctcagcttggattgtaatccccataatccacaagtgtcaagggagggacgagatggaggtaattgaatcacgggggttgggggggtggtttcctccacgctgttctcataatagtgagtgagttctaaggagatctgatggttttataaggagctcttccccacaactttgcttggcacttctttctgctgccttgagaggaaggtgccttgcttctccttcacctttttccatgattataactttcttgagacctccccaagcatgctgaactgtaagtcaattaaacctcttttctttataaattacccagtctcaggcagtttttatagcagtatgaacatgaactaatacaccccaacagtaacttattttcaacaaaagcacagttatgctctaggtccctactcttctaaaccatacaccctcctagaggtaaactaaagacctatatgatgtctcacttttcatctttacctgtgtttgccaaaggcacttcaaactcatctgtcctttctttaacatgtcttctccttcccaaagtatttttcttcaccttcagtccacattttagtaaatgacatcatatttcagtcattctgcatggctagaaaattaggaattatcttgggttacaatttcccaaacttttatattaaaaagagtatctaacactaccagttttatatcttaaatatttgttatatatctatcctttccatctttatttatagcacttttaagtcctttttaatttttacttgcagtttgacaaatatggttcttactaggattatactatgcgtattcctctataaccttttccctatgtaactctacatctttcttcccttcacttccttaatgtgttttgtcattccatgcccaccatgttcgcatacactaattactagaatgtgagacaacccctctttaaccctgtcatccctttgggttgtcaaaaccgggtgatccatctttatttattgctacacaactatgaataaagtttgttcccaagaaaagacagcaacgtgtctgggtaaaaggggatcatattctctgtaaaagatatgctagattctcagcctcatattcatttgtttctcaaccacctaagagctatgcattctcccaagctcagttcagacataatcacttccaggaagctttctgcaatgctgtgagtgtgaaacaagtgtgcctctcaatgtaatttagggcaaaatctgtaatatagcacttgattgttaatatatctttcacctttgttggactgcaaagtactgaaggacaaaaacctgggtcttttattttgtcatccgcagcttctaataatactgttccaggcatataacagataattgacatatagatgggtagacagacagataaatagatctatatctattacatataatggaattttttttgtaatatatattatattctatgatggcaaggaattgtacctcatttctcctttctgttaaactactttaatggcaaaatccattttagttaataattattcaataaatatgaaccaaattgagttaaattagcaagatacatcgtttaaattacaatgtatttgtaacaaaaatcttagtgtaatacagtgatttatatgttactttttaatattcattttttgctttatatttgtgtgttaattgttcaatgagatgcttggcttacaagatttttctcacccatatttaggtgaatgtatttgaattataaatctgtggtgaacaggggctgcacagatttaaggtaattttaatatgatcaacaaactgactttttttagaaaaggtagagttttgatgtaaactaatattttgataataatcctagcacccatgggtttagacaagtgtttttactcttatatgatccaaaagaaattaaagtggctgggcgtgatggctcatgcctgtaatcccagcactttgggaggctgaggtgggcacatcatgagggcaggagatcgagaccatcatggctaacacggtgaaaccccgtctctactaaagtacaaaaaattagccgggcatagtggcacaggcctttagccccagctacttgggaggctgaggtaggagaatcgcttgaacccgggaggcggagggtgcagtgagccactgcacgccagcctgggcaacagagccagactccgtctcaaaaaaaaaaaaaaaaaagaaagaaaagaaattaaaatataattttacatttgagacacactaacaattcagttgtctgatttaatatttctactcttgttgtggatgaatgtatatatttttaatagaactttggattttaagcaggaagttactgtaacatcaagtaaattgttagaaagtcgttcttcaagctccaaatgaaagattcttcactctttgaaaccttcttttgctgactccatagacttaaccacttgtgattagagttcccttgaccttgaaattgcattacagatagttgtctttggtgctactttccttaacagaccacaacttcttgagtgcagaaaccatagtttattgctctcctaattctaagtgaaaaaggaaaggagaagagaatgtaaaaagcaggggaaagaggcaagcagaaataaaatagtctttgaatattttgcagccacttaataaattcttaagtcagatcctttttgtcccacttctgacttctggttgactttatgtctactgggatggcctcttctcaagactcaattgtgttccagtatgttttctttcttctctctcagcatacctcccatttcgcccaagttatacagtaaacttgctgtttgaaagaaagcgctggacttgtttaatttatattaaagaatgggtgaccatttattgcttttatatggtatcccaatttgatgttaacattttaaaaaaagacatgctgacacaaagtagtaaatctctaatggtagaaattatctgtacaaatttgggatataagagcattgattatcagtactctttgtcctgctttcctcactgtcctgctttgctgaatagtatttgcagaagagagaaagagttagtatgcaggataatttacagaaacaagtatgatgtgggaagaatagagttttttgagagcttaataaatttttttcaacataacttttgaatgattcactctggtcatttagacaggaggcccaaatagcaatgttagaaagctgccagagaatttgttacacaagataaatccagcctttgggaaatcttgtggtattcctaattaccttcttgtttctttatacacgtaaggcttggatgctggaagataacacaattatatctcctcccccaatccctatgtaacagattttccacattgaatttcatttttgttttttaaataatatcaaacctttgcatttctccaggttagtaaaaatgcaggcctcattgtgttgctaaaggatcttcctcttttccccacttagaattttctgaacctaatcagcaaggagcattttgccaggctcctggtcattggtccataaatgaatgacactcttcaggccaagggctagctaattgccaattccgaactctgtgtgttaactagtgtgtgttcttttcacttttcaaagtcataacggatcaggtacagtggcttttgcttccacatttgagctgcctgaataaacaggaggtaatccctcaccttaggctgctgcataatgcattccagcttgttgctctgagtattttttgacagctttaacatttgttactggtagttgatcttggactttttgatccatgaatctgaatggtacggcttgtcctcatgctcatcatttcttggtcagcaaattagtctggggcccttgctcaggatcgtactaaaaatgaaaatccccatgcaaaataagtatttccataattttgagtatctttgttgaaaaagaaaaaaatgttctctctttttaatggcatgagacagttattcttccatcatgtgagcatcttgctctctgtttacaatgtgtatgttatgcagattcttatacaaatatcttttctatttttttaaacgaaggcaggttcacacctctgtcttgtgtccacctttccaggtaccagtgcctctcatttattcttagttttcagtattgcgatttgttttaggtagacgatttgcgccttgaaaaatagtcattgcaaacaatgagtaaatacttaaaaaaaattatagtgtttgtatagtaaaagtgtgtgttttttctcttctaaatttactgtaatgtcacattttacttgtaaataagtaggaatttcaatgtagtaacgtaaataagtaaaattaaataaccagtagttctaaatactgttttaattgttattgtctgtttacttcatagtagtaattgtaggaatatatttcaagaaagtaaatgtaaagtctaacaaagtcactacattatttgttatagtaaaaaatatcaataaccaaaatgcccaaaatgaagtaattgatcaaatttaatgagaacaacctgagggaatattatatgagtggagacaattgtatttatttaaaaaaatataaaaagttgaaaaatgctatttttatgaaaaagcagaatttgacatctaacatatgaaatgatctaaatcaatgtttttcagatgttttagtttccatttttaaaaataaaaagtgtattgtacctatgaccctcatatatgcatacataatacacaaataaaacaagtttttctcacacctgtaatcccagtactttgggaggccgaggcaggcagatcatgaggtcaagagctcgagaccatcctggccaacatggtgaaactctcttctacactaaaaatacaaaaattagctaggcatggtggtgcgcacctgtagtcccagctactcgggaggctgaggcaggagaatcgcttgaacccgggaggcagaagttgcagtgagccgagatggtgccactgcactccagcctggcaacaaaaggagactctgtctcaaaaaaaaaaaaaaaaaaaagaaaggtttttcaaaacaatagtcatcccattaaatataatgtatattgacattttcttttttctctctgttttaatttaattttaaaagaatttgaattgtgacctgttaaagtgatttattgaccaaaaaatgggttgtgatgtgtagctaacaagacattgacctaaaatacataaacgatgtactttgaaaatattctagaaagaaatgcagtataatattaatattttatacataacatttagatatggaatatttacatttttccctcattctgctccaaagttttaaaaatattggcagtaaacattttaacctcacaagtgtgactcaacttttcacgtgccatattttttcatcaagtgtaaatatgttttacttttccaagtgctttcttccagcttcttttccgtttttggtagggtagagcccaggttttaaaacacagagtatttttctggacctagtaagttcaagataaataactattacatgagtgagtgagttaagtgcttgaatggctttataaaacttaactcaaatgtgtttttatgaagtaaatgttagtttttattattattttattcacttcattacagagcaacatcagctctactaaaatggaagttaatatagtcaaatgacattttcatattcaaaatatactcttgtccaaaacatgtcttcagtgttaggacagagttatgtttggtgataatgctgtataaaatgtcatcctgctgaagaaagaacgtaggcttgggagccaaaacagtttgtagtgatctcgctgagccactccgttgtaaaatgaaaataataatatttgcctcataagctttctgagtaattaatttgtataaaatacctaggttcatgactggcacatatgttaagcgcctgcctttccttttccccagctactgggtaatattttaaaatattttataattttaaagaaaattgttgtcatttacagtcagcccttcgtatgtgatgtggaacccgtggacacagagggccggcttttggatccagggttgttgactgagtacaccgatgcagagccacacatactgagtgctggctgtactaccatttcatacaagcgacttgagcatccacagctttttgtatccacagggtttgcggagcccttcctcaatggataatgagagcaaactgcaattagctgtatataaaattacaatctttaaaaacgtaggcttttatatcaactgaagtgactcaggttcagcaacgcataatataatttttcttttctttcttttttttttgacacggaattttgttcttgtcacccaggctggagtgcggtgtggcgcgatctcggctcactgtaacttcctcctcctgagttcaagcgattctcctgcctcagcctcccaagtagctgggattacaggcatgcgccacaatgcccggctaattttttatttttagtagagacggggtttcaccagattggccaggctggtttcaaactcctgacctcaagtgatcagcccgccgcagcctcccaaagtgctgggattacaggcgtgagccaccatgcccggccgccaagataaattttataaataaatacataaagtgtaaatatgaagtgggaaaaaaataccatctaattttaaaaagatacaacacttacacagatatgatatggggggaatatatcttagaaccaaaagtactaagttgaatataaatcatcatgttgtactatacctatgaaagggaattctcatatatatttcagaagatttggccaacaagaatagaaaatgtctttgagctcatccctgtgttctttaggatcttcatttaaaaagcagagttgtcattcttgttttttgtttgttttcagggtgtactaaaaaactaaagtcagttcaccatcgtacatgaaaaattctcaaaaaatttgtaaacaaacattaaagatttaatttgatttaatttaatagaggaaattaagattaatttaatacaaatctctgtgcacattcaaaatagaaatggtgaattcttcttcatgttcactgagaagagataaggatattggttaaactggcaaagagaaagagcaaaaagggaaggtgctgttgaaattttaaagcagtcttttaaaatataactgaccaaaatgatttttagactctgatacaacaaaataagtgattgaatttttgaagtctcataacttaataaaatagtatgatgtcccagaggttttgatttacatctgaatagaaccttttaatgaaaacaaaatatacacaaaaatgaataaataaaaataaaaaatattttactgagaaaaaaagagattattgatcatttaatataggggtaatttccttaatacatctatttattaatgttatgaattaattttctcaacttagaaaaagtattccctacatagtatgaaaaattcaaacaatgtgataataaaaggtaatgctgcacaggaggtaaacacacaaactactgggcttgaattcaagttctgactccatctattaatatttctgtaagtctatatacaaatgtcgcttaatctctctttgcctcaattttaaaaaaaatgtaaatgaaaattaaaataattcttgtttctattatggggcttaaattgcgtaatactggcagattacttaaaacagtgcttggcacagaataactatccaatatattttagcctttataattattgtataataatatagtcaaaagacacaagcagagagtgcttacagaaagaacaaaatggggcaacaagtatataaatcagagccaaccattcttacaaccaagtaaatgaaacaatgagacctttgttaacatatcggattgaaagatttatctgttgttataggtgtgggaaaaaaagagactctcaaacactgttggtgagagtataaactggcataacctttctgagggcaatttagaaactatcaaagtgaaactgcacgcatcttttgacctagaaatctgacttctaatattactgatatttaaacatgtctacaatcttgttaacagaaaactaatggatgcaacatagcagttctagtatgagttgtatgtgcttcagaaaagtacatatacacattcatacaaaatatgagtatgcatacagtcatgtaccccataacaatgttttggtcaataatggactgcatatatgagggtgcttcaatagtggagctgaaaaattcctatcatttagtgacattgtgtcctttgtaatgtactgcaatgcattattcaacgtttatggtgatgctgctgtaaacaaaactattggactgccagttacataatgataatatacaactatgttactggtttacatatgtactatactatacttttcatcattactttagaatgttctcctttcagatattttttataaagttgagtgtaaaacagccttaggcaagttcttcaggaagtattccagaggaagtcattattataatcataggagatgacagcttcgtgcatcttattaccactaaagacctttcagtggaacaagatgtaaaggggcaagacagtgatactgatgatcctgaccctttgcaggcctcggctgatgtgtttgtttatgttttagtttttaatttaaaaagcgtaaacattaaaaaaaattaaatagaaaaaatcttatagaaaagaacataaagaaaaatatttttgtagggtgtcaattttggatctttcctgctttctcttgtgagcatttagtgctataaatttccctctacacactgctttgaatgtgtcccagagattctggtatgtggtgtctttgttctcgttggtttcaaagaacatctttatttctgccttcatttcgttacgtacccagtagtcattcaggagcaggttgttcagtttccatgtagttgagaggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaagaatgtatattctgttgatttggggtggagagttctgtagatgtctattaggtctgcttggtgcagagctgaattcaattcctgggtatccttgttaactttctgtctcgttgatctgtctaatgttgacagtggggtgttaaagtctcccattattattgtgtgggaatctaagtctctttgtaggtcactcaggacttgctttatgaatctgggtactcctgtattgggtgcatatatatttagcatggcacatgtatacatatgtaactaacctgcacattgtgcacatgtaccctaaaacttaaagtataataataaaatttaaataaataaataaataaataattttgaatatgtagttgcataaaaaaagaaaaatatttttgtatagctctacaatgcatttgtgttttaagctcaatgttatgagtcaaaaaagtttacaaaattaagtttataaagtaaattaattacagtaagctaaggctaatttattgaagatacaaaaagattttaaataaatttagtgtagcctaaatgcacagtgtttataaagtctacagtagtgtacagtaatgtcctagggcttcacattcactcccattcactcctgaactcacctagagcaaaataccaaccctgccgcctccattcaaagtaagagccctagacaggtatagcattttttctttcataccacattttgctatacctttaatacatttagatacatgcgtaaggttactaaccattgtcttccaattgcctatagtgtgcagcacggtaacatgctgtgcaggtctgtagcctaggagcagcaggctatgtcccataaagcctaggattgtagtaatctataccacccaggttcgttaaagtatatttatgatgttttcacaagaaatcgcctaatggggcatttctcaaaatatatccctgccattaagtgaagagtgactgtataggcataccttgctttattgctctttggtttattgcagtttgcagatattgtcttatttataacgtgaaggctcgtggaaaccctgtgtccagcaagtctgttagtgccattttttcaacatcatgtgctcacttcctgtctttgtgtcatgtcagtaattctagaatagtttcaagctttttcattattattatgcctgttacggtgatcagtgatcagtgatctttgatgtcactattgtaattgttttggggtgccacaaacagatcccatataagagggtgaacataactgatgtgttctgccttctccatcaaccaaccattacatcatttctctcttcctcctccatccttattccctgagacacaacagtattgaaataggccaatgaataactgtacaatggcttctaagtgttcaagtaaaaggaaaaatagcatgtttctcattttaaatcaaaagctagaaatgattaagttttgtgaggaagacatgtcaaaagctgagataggccaagagtgaggcctcttatgccaaacagttagccaagttccaaatgcaaagggaaattttctgaaggaatttaaagtgctactccagtgaatacatgaatgataaaagagaaaaagctttattgccaatagagagaaagttttggtggtctggatagaggatcaaaccagccacaacattcccttttagccaaagcctaatacagagaaaagcccttactctttgattctttgaaggctgacagagttgaggaagctgcaaaagcaaagtttgaagatagcagacgttggttcataggattgaaggaaagaagctttttccataacaaagtgcacggtgaaacagcaagtgctgacatagaagctgcagcaagtcatccagaagatctagttaagatcgttgatgaagatggccactaaacaacagatttttgatgtagacaaagagccttctgttggaagaagatgccgtctaggactttcatagctagagagtagaagttaatgcctggctttaaagcttcaaaatacaggcagcctctcttgttaagggctaatgcagctggtgactaagttgaagccaatgctcatgtagcattccaaaattcctagagcttaagaattatgctaaatctactctgcctgttctatgtaaatggaacaaaaaagcttgaatgacagttcacatgtttacagtatgttttaccaaatattttaaacccactattgagatttaatgctcagagaaaaaaaaaagattcctttcaaaatattaccattcactgacaaagcacctggtcatgcaagagctctgatggagatgtacaaggagagtaatgttatttttatgcctgttagcagaatatccattctgtagcccatggatcaaggagtaattttgtcttttaagtctttttatttaagaaatacattttgtaaagctattatgaccatagtgatttctttgatggattttgggaaaataaattaaaaaccttcttgaaaggatttaccgttctagatcccatcaagaatatttgttattcatggaagaaagttaaaatatgaacattaacaaggggttaaaagatgtcaattttaaccctcatggatgaattttaggggtccaagacttcggtggaggaagtaactgcagatgtgatggaaatagtaagaaaattagaattataactgaaacataaagacgtaactgaattactgcaatctcatgatcaaacttgaattgatgagaagttgctttttatggatgagtaacaaaagtaatttcttgagatggaaactactcctgataaagatgctgtgaacattgtggaaatgacaacaaaatatgagattacataaatgcagttgataaagcagcatcagggtttgagaggattgacttcaattctgaaagacattctaccatgggcaaaatgttatcaaacagtgttgcatgctaccgagaaatctttcaagaaaagaagagtccactgaaatggaaaacttctttgcttattgtaagttaaaaaattgccacagccatctcaaccttcagaactactaatcttgtcatccagaacccaataacattaaggcaggatccttcactagcaaaaagatgaccatttgccaaaggctcagatgatggttagcatattgttttggcaataaagtattttaaattgaggtatatacgttgttttttacctaatgctattgcacacttagtagacttcagtgtagtataaaaataacttttattgcactgcgaaaccaaaaagctagtgtgacttgttttactatgatatttgctttattgcagtagtcaagaattgaacttgcactatatcccgagtatgcctatatatggaaagataaactgaaaactgaaaacttttgatatttcctttaagtcagtgagactatgaagggtgggacctatcatggttaaagaaaggaagatattagactttcatctcatagctttttaaaaaacgatgtgcaattgttatagtaaaaatgtctaaatgaaatatatagcttcaggcataaaatgtataatcataagggctaagcaaaattgaaaacaggtcactgaacaaaaaggatatttaaaaagctctacttaatttaaaagctctgttggttcagtatgtatatttatacatatttgttgaagaaattatgtattttttataaaagaagcagcgaagagagattaacactgctgaatgtggtgtcagacaaagcaaaaaaattaacaactgtcacaattcttgtagtgtagataatttttgataaaatatatgcaaaattagaattgatagccacagcctgaatagatttagctgaaattcctgctagagaaaaatgactttgttctgaatatttgaaatactagctatgggattcagaataaaaatgcattgttgtagtattaggtaaacacttgcttaatagaacaaactgacaaagatatcatctgtctttttcaccattgtatttcatgcctgcgttgagattctcattttatttataataagaggtaattattaggccatagaattcacttagaaaaaactgatgcattttataaagttcaaagtaggaacatattttaaaaatgtaaaagctttgccttaattgtcccctcaatttattagttaattactaatcagtttattagaaatgtgatttgtacatcaagatcagcattaaaccataaatgcatgtgttttctagatgcatttatgctgttttatttctatatgctattttattaagagatttatagatgaaataggaatctttaagttagctgatatatagtaaatattcattatatcaattgctattatctcatacaaaatgaataattgctagctatgctttaaaagatatattttaaactacattgtagagagtcatacacttaaatgtttatttatataattttatgaaaaaaaaaaaacaaaatcatatctatacaccttaccaaatggaaagttttatggtcagctaggtttttctgaccgcttaccctacactaaaacagtggttcacatatgattatgttatgaattgatcaattgctcggctatatgcaataccataagtaacagaataaagagaaggtgctaattgttaaaaaaaatggcttatttacaatactcataaatataagtccaacctgtcttttatccttaagctaaaatgagatatataaactggaagatctagcaataaaaatcatttttaccattccagtggtatatgttctaatcaatttctaatatgtagaattttctcaaactaagagtctattttatattggcaaaaattttcctaataaccttgggtaattaaaattcatatttagctcaaatttctggtaagagaaaacgaactccatatagactagaattagtctctgtggaaactagtatgttctctgaaaagagcacttttcaggttcttctctttttgaaaagtgagttggtcaacaaaatgaaaaataacaatggtgcatacataatgcacacatccacacacatacatgcttacgcacgggcacacaatccaaactgagagcatcgagtgagggtcaccaatggggcagtgactggcaaatgtgaatttctttcatggctgttgatatagttgttaggaaaaaaagatttaagtacacttgttttcaaaatatattatggaaaacattgcagttttacctcaatcctaatcctgaatttttttaagatttcttgttaatgaaattcactatcatgtgtaaaaatgttagtattaaaaatgtaagaacttgttttttcatttcatttggaatgcacataaaaattagtctgtgagatacttatgttaggtgtcattttgtaagggatttgttttaatcccaacaagtgaaataattagcagtttaaacaatgaaaaatgaatgggcactaattgtgattgacatgaaagagtatttctttgattattttaagttatttggtaagtagaataaaagggggagggaaactaaatctgtttgaattcctgctatatgttacacacacagttgaattctccacaaatgatctaagtttattccttacaacaccctatagacaggttttatctctcttttaaagaccagtcaaatacagggaggttaagtatcaagtcagaaatatgagaagtcttctctttcctttatccacaaatttaaccggtcatcaagctctatcaaatttccttaatgtcttgtatattaaacccctttttatattttctttattattcccttaacccttcatcacctctttcctggactcttccaagagtagatcttgcagtagatcttctccacagcctttttctacaatgcaaaactaatcacatgactcctttccttaatgcccttcaacatgtctccatttttcataggatgtactccgaaattcttggcaagctctacaagactctccacaatctggtccctgctcatcacttaaggtttatattcacacattcttattctatttctctcctagacttctcagccatcccaagataattgcagttctgaatctattttctgctgctttatgtctgagtattttctcacctgcctttctttgacttgagctcaccacgccccacctcaaaatttctgccagattgtcttctgtaagctagtgataacgtcacttccttcataaaccatttgctcacctgctacccttgttctctgtcccctcttacaagtgaattgacagctctaacacacatttctaccatagcccacctaactttagtttcagtagtaacttaaatgtttttctttgatcgttagtctgggattaagtttagggttaggacagggacaatgttatattttgtgtgcaaacctggtaactagcatatttcttgggacatcataggcattgtatttcttattttgtttgtaaaggaatgatattggagaatatgaagggtattagaccaagggaaagattagacattcacccataacctagaaaagaatcaattcagggtatccaaacagttatcagtcatggaccttcttttagagttttataattaatattactcaattctaattatttcatatctgtgtgtgtgtcttttccaggtttcaaatttccagtatattaaatctgatttgctcaagttcagtcggatgcgtacaactgaattagaaaaataacttagactcatgtgagatgtgaccagtaggtgtcattcacaggaaagcagcattgttaagactcaggtcgccactttatgagacacccgttggaggtattcaaaggactttagctggctaggtagtatttaaccgataaaacagagcaagtatatatagaaaacatttatcaacaaaaatacagtagacccacaaatttaaaatcactacgagtcaaaacctctagcgacaaatcatgaagtgggtcttcaagctcttgtgaaactctggtgtcctgaattatgcatatcactgcagtcacaacaatttgagaaaaattttacttccaaaaggaagtagcaacaataaggttaatgttttacattggaaaagtgatcgttctccagggcaatatggcagcaatggctatattaagtatttagtcaaatatactataagcttatggtcttccattgtttcttattaagataaatgacaagatcttccattttctttgtagtccagagaatttgaaatcattcctaatatcttcttcttttcatatttaatttcccaagtaattataataattatgcccatataatgtctcttaaaacttttacattgtctacctccagtgcaacactttacttcaaattacaattttatttcacctatactgtgaattagcctcctaatttataactaattgtattaaatgcatccattctgctaagctccacccttctaatttcttcttcatacctcatccagagttaacttttgaaaactcaaacctaagcatgtttctatcctgcctgaaactttttagtgggtttccatttctcctggaataaagacagaagctcataacttggtctaccagtaccccatctccaacttcactaggctctgcctaatcaaactcgtctttttttcttatcctttgtacttagactgctccagtaagtgtacatgatgttctctgtggaattcccttttattgcttttttacttagttaatttctactcacccttacgttctcagctcaagctaacttctttatagaagccctctttgatctccctgctgggtcaaattcctctactgtctttcttatgcaatactcttcttcttaacatcatgctgctatccttacagtttgttcacagcaccaattttactcatttgagtgtgattatttaattaatgtctctacactaaagtataatttttgtgaatgtggggatatgtgtgtttctgtttctaaggtgtctatcacatggcaacaaattaggcaatcaaatatttgtcaaatacatttatgtatcattcaccaaaatgttagataataatttgaatatgtcaattttcttccttctaattatgctctcatttataatacatgttcacagtattatttctacttttatcatatattaaaacagttattaatagataatgctcagttttaatcttcatttatgagtagataaattgctagtttaactgcataaaaatatacatttcacattccatgtttattcaaccagtctgggaacaattctagagtttacatggaaaaaaagaagagcattttgtactgtcaaaagagttgatatgccctaattctcaccctaactagactgcaggtttccctgtcagagaccatgcatttaatgtttttacccctaaggaatcaggagaattccagactttaagtggatagtcaataaataatttactgtatttttcttcccacattcatgctcccttagctgtttttgattacttgtctgccatttttgtggcaaccttttgtgctagttcactgaaccagaatatttaaatgtttttatatagcatttattttacgctcaccctggcttttatagcacatgagaattcaatacaaccagaaagtatttggtgacttaaaaattaaagtatttatgttagattctctggcagaatatttatattttggatttacatacagctattgaaatactctaaatataaagtgagagtttcctaaactttgaagtagcttagaaaacatctaacctggctgtaagaaattaataacaccaaatttgtatagtctctcctagataactgcttttaatgaactattatttctcatttttattctctttgtactcccccaatcctcatcagtgatactaaggtaaacttacatgctttatgcatgatcaaagtgcttacacaagaaagataggatgattaagaaaaacaatgtagggagcagtttcttaaacttcttattaaagccaacttaattctctggaaaagaattaagcagcatttgaaggtcaccagctcttcccaaacctttcagagtatcttgtcctgagacacaatgtttgtgcagcaacaactggttgcctgataaagaaagaaaagagtgagggacctcactgataaagaattgtcatggggtaaaggacatgagggaaggtaggagtgttagtacatacaacctcctgctttttctttccttctcatacgtattttgggatccaagagaagatcacaaatatttatggtccaaaaattttttaccaaaataaaaaatgtatgtacaacatcataaaaatgttacaatggcttgggtagctcaaaaaatgtcaactgggcacctttgtttgtactgctttaaggcatcaaataaatgttagttaaggcaggatccatggtagaggtaaatggcttatgatatgatcagaataatagctttcaattgcatagtaatatgcggtttatatagctccttcagattaattatatcctttaaatctcatcacaaccaaagattatatgattaaaatttagaagagccagaaccaaaacccaagccttccattttaagtccagtaagctttccactatgggatgctgaatcctttcttttccttcctcatctcctcctactcctcctcctcctccttctgtcaactatattagttaaatttagatgtgctagcattgttggagctggggaaaagatgtggctgaaggttgataacatcaatccttcaagcctgcttcctgagcttccagaagttgggcttgccacttaacttgctggatatatgtctaacttttctgagatcaagtatctaggtgtaaaatagaggcattacctctcatgcctaaatcacaagtttctttttaagtttgataccaaataatttagaaggaaatactttgtaatctctaaaaaaataattttaggtgacttattttaattgtatttatcattttcaaagaataacattataataattgcattcactaggtacaaatttcaattgatgaataaaaatgtgagtcatcctttcttttagaggagaggaataaaaaaaggacactttgtaaataaagtttgctttaactgcgttagcttgctatttcccaccatcacttttgtcctcctccttgctcattaagcagtgagtccaaagtgtatctgttgctcttgttgctgtagttgactctgagtggctacagtcttttctaacttggacaagaaaagctagagcatcagtaatcagtcttttcctcgcattttgcttttgtttctggtaggtaacagttgttttagaacaaaattcattcaaacatgtttctctattaattagctggggatgagtttatctgttatcaggaagaagaataaggaacaggctcaaaatgtaagaacatttgcaatctctttacctttgcagtaagtttccttctgcaagtagtcttgtgactagcagagatttaaagcttgggtaataaaaaaaatgaataaaaaatcatcttctatgagaatgtcaaccatggggccacagaggaaaactggaaacttgggaaaactgacatgaagtggaggaggtttattttctttttctctctcttatggtaagatttggagacagcagaaggagagaatatgaacacctataaaagaacatataaagttcttttcagagaaagaactttaaggaactttttgaatagagcaagtttataattaaaataccatcttttagattacaactgttgtcattatggaattagcagatatttaaattggattatttttaccaaattactgaattttcatcattaattgaggtcaataaatctaatttgaagtatcaggaactaagtggttattttaataacaagtctagaaaataaaatactatacatttttttcaaatatgcaaagggctattctagtatactactggaacaagtaacggtattctaggaaagttttatccatatttactacagaaaatttaaagaaggaataaaaagatacttcttgtaattctctatagacattcactaaagagctgagttatttggagaatataaataaattatttaatactttgtaattttaaccaatgactcatcttttaaaaattgtttggattttctgcctttaatgtagtcgaaggatcatatgattaatatagtaggaatgaaaagaatactttttaagttgtacattccagctacttttaggaaagctcatatttaaatactggcatctatctttctttattgatattctttagaatacttcaatattaatgtaatagccttaactcctctccttgtaactaatgccgtgccttctcgcccttccttcatgtgttacaagaatcatccttccaaacaaatttgattaggtcacactcccactgaagaccattcaataacctctccctgtacacacactaaattccaaaaaagtccaagatacttacttatgttctggcactaaccaaaacttctgtttattattatttcacattatgttccagcaataccaagccataggcaattatctacattctatcaagctatcatatttttcctcctttcagtacttgaaatgactttccctcttttaccccgtacagcctttctcatctttcaaagtctactacattcgtctgttgacactcttcctttgtgtcaactacttgcgtacattgagtatactcttattattgctcttatcacactgtatttgaacatactggtacagtaaattacagtctggattatgggctgtttaaaatagaatgcttgtggctggctgggtgcagtggctcagcattttgggaggctgagaggggcggatcccttgagtttaggacttccagaccagcctaggcgacgtggcgaaaccccatctctacaaaaaacacaaaaattagccaggtgtgatcgtgtgtgcctgtcattccagctactcaggaggctgaggctggaggattacttgagccctggcgatggaggtagctgtgagcaaaggtcactgcactccagcctgggtgacagagggagaccccatctcaaagaaagatagaatagaatagaatagaatagaatagaatagaatagaatagaatagaatagaacagaacagatcagaacagaacagaacagaacagaacagaacagaatagaacagaatagaatagaatagaatagaatatgtgtttgtttttgtatcctcggttcccacactccccagcacatatctaggaagcgtgattgagcaaacatagaacagatctagagtaagagagactcaacaaatgccaagtggtttctttactgagcgcatgctgatgtttgccagagtttaggttggatgttagatgagtacaagcagtcattaatttgcaaaagattgatattctctgaatagcccagactacttcttccataatctcttttctccagagctgtgccaaagatgaaggactttcttttttttctggctgaaattgggagaaatgacaagaaatttgaaaaatagaaataaataaatacctataaaagtaaaaaaatgaatgaaaataacttttcagaatatctcttcagaaatagacaatttatggctcaacatgccatagcaacaggcagaaaatggtcaatcacagtttctggtctgggtcacttttgatggtgcttttaatctggcattgtcaggtcactatttggaggatattccctgactaagctgttaaaatttctgattatacaagtttgttttgtattttcataaaatgatcattttaatttaaaggtataataatattcttatttcttattcaacattttatatctttgtgtagaatattttccttattgttttcatctagtttgttaaattaaaattaaatctctaaaaccaactatttgtgacaaatcaccaaagcctttagtggtatttgtacagcgaaatcatgaaataatacgtgtgtcaatgaaatatatttatacttataggccgagagcagtggctcatgcctgtaatcctagcactttgggaggctgaggcaggcagattacttgaggtcaggagttctaaaccagcctgtcctacatggtgaaaacccatctctactaaaaatacaaaaaattgatgatgggtacctgtaatctcagctactcgagaggcttaggaacaagaattgtgtgaacctgggaggcagaggttgcagtgagttgagatcatgccactgcactccagcctgggcgacagagcaagattccatctcaaaaaaaaacaaaaaaaaagtgtatttatatgtatatatattttcaataaaaacatactaaattgtataaatactaaaatccttccatctttttcccctaattttagtcatcaagttcttatgatcaattggctttcaaaacatactgaggccttcttaacaacaagtgaaaatttccaaataaatgatcttaattaaatcatttaaagtacagagcaaacatgaaagaactattagttatgcctcagtcctcatagaaattatgtgcactagatacagtacacattgtcatattttcctacattattgtcatcatttaccatgaaaagccaatttaaagggaggctttttttttacattaggaagacctatcttctagcaaaatattataaactttaaagcaagatcaaaactaaagtcaggacactagttaatgaatctggaaatgaaggtcaaatgggactttgtggatcaacttataatttaaaaaaaataaggacaaaaacagcacacagcttgtttaaagagacttccaggtgctgctatatctttagaaattttgattatcttataagtacgtactaagtacaatagtcactattcctaaagtacttctagtgcacagatgaatagattatgaaatatacaaggctcaaacgatatgtcaaaaacattgtccagataagtagtataggagttttgaggaagcaggattcacttcaagttaggatgatctggggtaattaaaatgatagatggacttgtttggcaaatgaggtgacagaggtatttctgaatttgtatgaagagaatttaggtaatagctgcaagctacaaaagtttgaagaaatgcatagacttgctagagtggaatattagtaggtccactttaagaaagcaaaaggaagaatgtggttttaatagccaggcagagagccaataatcaatagagtcttgagcgtgaatttctactcagaaacaaaatgactgacctggtattttttgttattgttcagatagttttattattttttctaagacattttcattaactagaatagagagaggatgattatcaatcctattgctttgaaaggcacaaaacaaacactgacatgagataaattaaaaaataaaggtttattttagttacatcaaagcagttctacatttaaaaggcattatacattaatgttttatcactttttatatatgtaataatttttctttgaagtgaagatgcagtttagctcattggatttgtgagtaaaacagatactttcagctcctttaagcaaaaaactgtaaggctatattaaaacttgtcagtctattgataccatagtctctggttctgacttgccaataacttgatctaataataaagaagagaaaatatttaggaaatgacgtggtagaagaagaaaagaagtagtgtgttttttctttaaatgcttcaaaatagagctcttcccactgacttatacacctgcgtgtggggaacaagacctaccagccactgtgtggtctcctttgatacttagaacagcccagaataacccattcaattcattggatgacttcatttcagaaatcatgctttttactgaaatctgaaagccgagaagtccggaactggctttacaaagagatgaaatagttttatgcaagaatagctcaaacaaaatgcagggatttttttgtattccttgtggcttcgttgacagtgatgcattgatagtttgggggcaaatcttcctaggttggagctgatcaacaagtgggaatctgtagcaaattgtgtcaagtcacgatcaattctttgaggtgtaatgatatttttattaaggcaagtcagtggatacttagtacctattaatgttatatacaaggtgtggcatcgaatgtgttcaagtgtaagtctgtgttaactgatgcttctttacaacagatacctacatattcattatgtgtacatttgttttcatttgagagtgaacttgatgttatttgagtccacagtctgtaaaactcagccaacacacagaaaagtacactgctgctagaattgctttccaagatcgtgaaactgctctgatgttttactcagagagaaacctttacaccatttccacagtcgggtttgattgaacaaacaggttgtgcatttgtaatgaagcatgtggatgaaaaacacaaagtacccaatcacctttgtgctcattgtaagcctgttaacatctcacatatctcctgagatccactgcccttttaactaagagtaaagccacttgtctcccctaggatagctgggatgtctgaaatagcagaatgtttgcttttgggctaaatgcctctcctgctagctagtttagctattgattgtgctttagcttatgactactttgccctgagacttctctcaaggattataatctatctaacatttattcagcacagccaatgcctttagtcttcagggtttcctttctgattgaccttatgttcccttcaagaaactaccagagtataggcatgagggatattaatgtgatccctaggttaaatattatttcattccttttatgcaactgttctcttacagtcagagacaccaagtctttaataaattataatttctttaaaattataaaaatgtgttggttagatttaacaaaattaactatgcaaaagaatgcagagaaaagctacataccaagacttccagtatgaatatggaagaaaaatagagcaacttctccctttttctgcatttcctacaaaagtgacaaggtaaacagaaaaaaaaataacctctctattttcattgaaacatgaaggcatatatcaatcacagactgtgtgactctcatagaagccatgtgaagtgaggttcagcagaagcctcgaatgggaaagtgttcactaacagaatgacagtacaactgccagggcaatgccagtaaaaatacacctcacgaaggcataaggcaaaggcagagttggaaaaaatttattatctgcatcaaacaagagttgcaggatctagacagagtagacagagatcaagcagatgctgcatagacagaaaagttgcaacaaagccccgcagagaacagtcaaacaatccagagatgcaaattttagaaaaggcaacaaatcatgtaatctttgaaggaaatttttacaaataactgggccaggaaatctaatgcattccttggtgaaccctataaaagttggaaacaatcaatataaaaatactattggaaagctttgctagaatgatgctgtcataaaacactaaattcaggagaactatcctaaccttgaaagatcaaaatcctgaaactataatgctggaaaaaataattttaaaattattctaaaaaattctttacatatttaaagaggaattatttgagaaacatacaaaagcacaacaatacttcctaggccaatttacacaataaaatacacaatggtaacatatttttgcaagcataaacagtaaggtatactaatgacagtcacatacatgtaatagttacgagcacgtgaattgtattcatacagaaatacatctaaaagcaaaatctataaatgcatatcactatggtcagttagtgtgagcaccaagctttataactggagtcatctgaaataccatggcagacaacctgagatttttgacaagatctatggaaaaccacagtaagttacaactgcatatgcagtcaccaaaagagctgagatcttgagaaactttatctttcacaaatgcacacgtacaaatgggacatttctccatttattaaggaagcttcagtgttttcactttgagaaccagagaagctgatggtgtaattctcatttgtaggctgaaagcttcaggacttagaaagtccaaaggccagtgagctttaagttctaatgtcaaaggtgacataagaaaggtcagccaggtgcctatggctcaggccgggcgtagtggctcatgcctgtaatcccagcactttgggaggccaaggcgggtggatcacctgaggtcaggagttcgagaacagcctgaccaacatggagaaaccccgtttctactaaaaaaaaaaaaaaattgcctggcatagtggtgcatgcccataataccagctaataccagctactagggaggctgaggcagaagaattgcttgaacctgggaggcagaggttgcagtgagccaagattgtgccattgcactccagcctgggcaacaagagtgaaactgagtctcaaaaaacaaacaaacaaacaaaaccacaaaaaagaaaggtctgtcccagctctcagaaagagaccaattcacctttgtatttgttctctccagggcccagctgattggatggtgcccaccatcactgagggcagatcttccccacctgatccactcaggttcgcacactagtctcctctggaaacacccacacagacatattcaaaataatgctttacgaagtttctatgtatgacttactccagtcaagttgacacctaaaactaagtccacaaatctaccccttgtcaacttggcacctgtaagcatcctcttaaaccatacttcatttccaaataaagacaataacaaggtaacagttacacttaacatgaaacaacgatcttgtgattgggatttttagaacttttcttttaaatgttagggattttgaactgtagatatttagacataaggaatttttatatttcaggatttcaacattagggttaaggcatttgggattgagtctttggggattatgatccaaacccaaagttcagaccaaacactttaccatgactttgaaaaggtaacaaaataattatttcaatgaaaataatacagaaaaaaatgaaatgcaagaactcaggtgaagcaacagtagttggttaaaattaatttttagaacacaatataaaaataaaacaagttaaaaaaagaacaaagaacaaggtaaaatggacaatgtggaaaacactgtaattaacatggagtggagtatggaaaagaaaaaatatgagaatgaaaaaccagtgaaataagattagaaaatgttaaacaaataaacagtaagcaaaaatattaaatatttgcataattgaagtttcctttaataagaaaaacaaaaatacttaaaaatattttaaagtgattagagggacataaaacatttaaggaaagcattattttatttttccatattttgtatttttggtacttgttagtctttacaactttgcaatgtgttgtgatgtttttccctaaccaagcaagcattcaatttgtacccaattctgtacttaaaattgtatattatttttctaaagaagacactcagtatgatcttcagataccctaactccttggcctgctcctgcattactgtatttctctccttaagatactataaatattaaatgcattcttaatcatccttttgcaatcagtctgtattaaaaaactgtaggttactgagagtctaatttcataaggtaaacatgattttgttgctgtagtatgaaaccacaaaggaaatagcagatattaggagaatgattatgatttccctcattgattcatacaataacaaacacttattgaagtcctgctatgtgatacacttttagtctaggcaatgtacaagaaaagataagccaaactttccacagccctgaacctcatggatcttacactctggtgggaagtgagcattaaaggaataattacacagataattacacagcttccatactgatatgggttggctgtgtccccacccaaattccaacttgaattgtatctcccaggattctcacatgttgtgggaaggacccaagaggaggtaattgaatcatgggggccagtctttcccatgctattcttgtgatagtgaatacgtctcatgagatctgataggtttatcaggtgtttccgcttctgtttcttcctcattctctcttactgccacagtgtaagaagtgcctttagccctctgccatgattatgagtcttcctcagccatgtggaactgtaagtcaaattaaacctctttttcttcccactgttgggcatgtctttatcagcagcatgaaaacagactaatacaataaattgataccagtagagtcgggcgttgctgaaaagatacccgaaactggggaagcaactttgaaactgggtaacaggcagaggctggaacagtttggaaggctcagaagaagacaggaaaatgtggaagagtttggaacttcctagagacttgttgaatggcttttcccaaaatgctgatagggatatggacaataaggtccagactgaggtggtctcagatggagatgaggaacttgtggggaactggagcaaagatgactcttgttttgttttagcagagagactggcagcatttgcccctgccatagagatttgcggaactttgaacttgagagagatgatttagggtttctggcggaagaactttttaagcagcaaagctttcaagaggtggcttgggaactgttaaaggcattcaatttttaaaagggaaacagcataaaagttcagaaaatttgcagcctgactattcaatagaaaataaaaacccattttctggggagaaattctagtcagctgcagaaatttccataagtagcaaggagcctaatgttaatccccaagaccatgaggaaaatatctccaggccatgccagagacttcatagcagcgcctcccatcaccagcctggaggcccaggaggaaaacgtggtttcacgggccaggcccagcgtccccgtgctgtgtgcagcctatggacttggtgcactgtgtcccaaccgttccagccgtggctgaaaggggccaatgtacagctcaggctgtggcttcaggggatgtaagccttaagccttcgcagtttccacgtggcattgagcgttcgagtgcacagaactagaagtcaagaattcaggtttgggaaagttcgcttagatttcagaagatgtacagaaacacctggccgcccaggcaaaagtttcctgtaggggcggggccctacattctccattctcatggagaatctctgctagggcagtgcaaaagggaaatatgaggtcggagaacccacacagagtcccttctggggcactgcttagtggagctctgagaagagggccactgtcctccagaccctagaatggcagatccaccgacagcttgccccgtgtgcctggaaaagccacagacagtcaacagcagcccctgaaaccagccagaagggaggctataccctgcaaagccacaggggcagagcttcccaagaccatggcaatacacctcttgcatcagcgtgacctggttgtgagacctggagtcaaaggagatcaatttgactgccccgctggatttgggacttgcatgggccctgtaaaccctttgttttggccaatttcttctgtttggaatggctgtatttacccaatacctgtaccccattgtttctaggaagtaactaacttgcttttgattttacagtctcataggcagaagggacttgccttgtctcagatgagactttgttttgggttactgccgaaatgagttaagactttgggggactgttgggaaggtatgattggttttgaaatgtgaggacatgagatttggaggggccagggcagaatgatatgggttggccatgtctccactcaaatctcaacttgaattgtatctccccagaatactcacatgttgtgggagggacccaggaggagataatggaatcatggtggccagtctttcccatgttattctcatgctagtgaataagcctcaggagatctgattggtttatcagtggtttctgcctttctttcttcctcattctctcttgctgctgccatgtaagaagtgccttttgccctctgccatgattataagacctcccaatccatgtggaactgtaagtcatataaaaactctttttcctcccagtctccagtatgtctttatcagcagtgtgaaaatggactagtacaggtatttaaccagtatacacaccaataaagacaatccagttgatagattgttacaatccttaaataccaattggggctgggcacggtggctcatgcctgtaatcccagcactttgggaggctgtggcaggtggatcacttgaggccaggagttcgagaccagcctggccaacatggcaaaaccacatctctatcaaaaatacaaaaattagccatgtatagtgaaatgtgcctgtaatcccagctattcaggagtctgaggccagagaatcacttgaacccgggagaaggaggttgcagtgagccaagattgtgccactgtactccagccttggtgacagaacaagtgagactttgtctcaaaaccaaaccaacaaacaaatgacaacaacaagaacaaaacccagttggtaaagtggataaatggctgccatcctcaagagtgcaatcttccccttccccacctttcctgatatccagcagctaaaacagtaacatcaggtaggcacagaagcaggtctctggttcccagatccagtttaatccatttgtattttgattggtcaatgtaaataccactcagtctcttgtaaatcttgcctcctcacttggttctgtcattgaatccaaaggagacaaagggatagtgacatctcactctctggtctcctgccttgcccaggcaatgggggcttcagtagggagaaggctggtgcctgtcagctgtccagctagccctcttccacccatacacttacactcagggcagagcaggaggcactcagccataaagataccgctgttcactggtgggggtacagggaacccaatgcctaaaggttggaactcatttagtccgaaatatgtgtggtagacattgccagccagcattctcactactccctttgttggagggaaactatggcctccttggaatattagcttttagcgaactggatagagactgagatagccggggctgtggtgtaactggggcagctggggatgtgggaaacattgcagggtccatactcatagagaaaattccgtgggtttggtttagaggagattagacctggggatgctgaagaaaagtcctcctttttaccatctctattaatttttaccttttaatgcaacaattctgttaaaacccatcaaatgtctgccttcttgatcaaatgtaacaaaatacatttgtaaatataatgtgtaaatataaatgtggctgactgccacacggctctacttcacacctttaaccagaaggattaagttgagacccattaaatgagatgttgcaataaatactttttgcgacttggtcaataatatagatactgagtatattaaaaatacagtattttcaagaccaaaagcacgatagtgtaattaccattaatttgacaggagctatgaatattcagcaccaagcatattattgttggtgtaaagataaatgatctgcttattgatagtgtcatcgaatgagcatgattttaatgagattttcatttaaatagttttatctggtttcttatgttaaaccgtaggatagaaaaggactttacgtagctcataacatctgatataaataaaagatcacaaaaaatgccttctaaaaatcaacaaaaaatttgggcatagttagaataatttgatggacaatttatgctataagtcatcatttaataaatggtagtttacacacactcatacaaaaatactgagtgttggtgtatttagagaatggggaatatacttgaatttttgctttatatgttaattatatattattttatattgctgtacaagttgtgacataatttgaatatcaccctgtaatcacactaataaatgtgtaatgccaggttgggatgggattaccattctacaggggaagggtccagttctatgagcatgtagtaaagtaatatttcatatattgggatggtcagggagaacttttgtctggtagtgataagtcaactacaatataaggatgattagaattaaaagcattctagatttacccaagatgtgtgaaaggtggtatgttggaaaggagctggttgtgttcagagaactgaaagaaggctagtggactggagtggaatgaataatagaaagagcactatgtgttgagggttgagtcatagttggaggccagcccatgtagtatgtatgccataggtcagatgaagaatatagtctgcactaatgctgaagccgttaaaggaatttgatgagcttggtgaagtgattacattttaatttagaaaataccactctgtaagtgtaaaaaacaaactggagggagacaagtggcattattgaaagacaagatattaggaactttcagtggttcaggcaaaaatatgatgatagctaatagtaggctattactgtagcaatggaatgatggactaatacatggaaaatttaggaagatttgtgttagatgtggaggatgagagagaggtagataaacagtagacagaatagaaatatccaaatttacgtttagctttgctgagtttgagcttcttatattgtgccacatgaaaattccattcccttctttggtgctatagaaaacaaatggaaccctcaaaatattgttgccaaaatctacttggatcccattagaatcacatggggagctctattcagagactctgattcaattggtctggagtaagacctaggcatgagaatgtcttaaaagctcctcaggggtttctaatgtacagcgaggctgaaaactactgatttagagagaagtgtggttggtttgaactatgaggtttaagagaaatgaatagacagcaaagtagaaatattttacaagtgaacaaaaatacagcaaaatctttgtaaaaatgatgctttctctttgtctctggctttgtctaggttatgttcagttttttttggtaaaaaaatcttccagatgcaggagacttaattgaatccactaagatgcatttagaattattaactcactaaaatattacttcttatttgattccttttttagggtataaaagcgaaaaaatcatgttaattctgattagttttgttttgaatattgatcgttggtgggttgctagcctttcagaaataaaagtatcaaccacattctaaactatttaataggtcagatgatatgtggttagaagggtgtctgtgcatgagagatagggtatacaaatgaatcatttaataggtaaatattaactgatgaaactgcaatgtctttctttcaacctcagaagctaagtatttaaaagtaacatttattctcatactggtggcacttactaatgtccttgtattttaatgcattgtttgattagatgtaatagactattggccttcaaataataagaaaatcttttttttattgaaattggtaactagttatagttaattttaaatactaaagtttcctttaacatatataatattttggaattataaagcctgtaacaataaaacaggtaaaaatatgggaccttgttctggagatgtaaaaatgtctaagacatattctgtgctctaaggaatcttaaaaaccgactggttaataaatgaaataaaatattgaacttacagagtagcatgtaacattgaaaacctgcagataaacagtacaattttgtgcttcctattttaaggatatgaaccagaaaaatacagcaaaaggacttcacaatttgcagaaacttgccctccctcatgcctgggggaggaagaaaagaaccaagtgatgataacactaatagctactgtgttctaggcattggaataagtgagttttatacatgacatcgttaatacccatgacaattctttggagaaaatattattactaactctgttttatggatgagaaaaatgcttaggaagtcctgcccaatagaaatacaaaaagagtcacaaaaagaagccagatatgtaattttaaattttctagtagtcacattaaaaaaaaaaaaaagaaaaaggaaacaattaaaacgtaataaattgtgttataaaatccaatatatgtaatccaaaaatagaatcatttcaacatttattaaactgggatattttacattcctttttctgtactaaagcttcatatatatttgacacttccagaatatctcaatatggactaagtacattttaaatactcaatagccatatgtggttagaagctaccacagctcagacttagagattttaaataagttgtccaagttttagctactggaaaaaggaagagctgaaattcaaacctggatggtctaaccacagagcatgagctcttaaatgcaatcctgttctgcttaggaagatttgatctcatattaagaaatctaacttgagatcatcttattcatacagaattttttgaaaattacagaatacatatcctcatttcgcaagcaaataaatcgtcttaatgaggttaggtaaaatcctaaaagattcacaattagtaactaatacaatcagatgttgaacccacacctgtctagtttcaaagcccatattttaactacaccacaaataaataactagattcactgaaaaggaattcaaaggtaagtaagacccctccccacccaatggaaataatagatggtaattaccaagcagggtgttcttataactaagcacccttcttcgcttctcttatttttaaaaattgtctatgctttctcattctctttaaaaatacaacagtaagtactaccaaccccaccatcacaaccacaaaaacttcaattaatgggttatggcctacagagctcatgttgtctgtggcattttattggcaaacagctgtaagaagtatgtaataaacatctaagaaccatgcctggtatttagactatagtggcatgttaggaacacagtaccccgtggacacgatgctgcagcaatgatacagctttctagggaatagcagaggtagcctcaggcaacaaggaggtgggaggctactctaatgctttatcattaatggcctagaagacttcatgttatggtgtcttgggttttaaattaaatgtcaaatacaatttgccattgaaaatgtgaagtgtggaactgcccttagagactctgagaattcagtcctctaattggtggctgcctagtactgagtagaaatagttagagattattatttggtaaattctcacaccagtctgcagaaatgtgtggacttttacatcttacacttcaagtctgtagtaaaaccttgagacagtattttaaaatatgcagtgttcaatgtagttttaaatacagtggaactgataaactcttccctttgggatcatgccatcatttatgtcctgatctctctgacatttaatctataatatcaggaaatctgtgaaagaaactgaagcagcacacgttctatttacagtggtttatttagttgcccccttccctgctgacaagagtctgttttaataataggacgaataaaaagatttccaatccacttcaatgtgttagcattatatctttctgaactatgtgtatattagcgctaattatgagatgtgtttaagtctaaaactgtaggcttaaacacaaaggcgttatttttactgccggttttaattagaaacctaaagaaacacgtacaattaaatatgctcataaaaataatagatacattcctataatcctcgtcaatttgttgcaccattaatatcattccgcatggcagatttaagaatgtattggagtaagtcaagtggaaaatggcaaagaacaaaattactagcatttaaaccactgtaactgttttagaacagtgagtactgctctaggtatctgctgcaatcactgttttattttgcaaccacaatttaaagttaactgtttgcccatttcatgtatctcttgtttctaagaacaattaatcttgtactaaaaatacacagcttcagaataaaattgacttcaaacatttattttgcaaacataatttttaaaggaaatattaatatgcttaaattttcctgataccaagagaaagatttattttacttgaagaaatatactgtttggcaactctcctcctccatgtaatatgtaaacccaggtggagtagggtatcacaatgccattttataggttaaaaaatgtctccatgacttttccagccacacgatacctacaataagagaacctcaggagatatgcaagctttattcatagataacttgaacttcataccagatttagtctaaatgatcataaattatgaaatgataagtttaaaattaagttttatcacaatgttatagttcattgcaaagtgaaatacaattttatattcctagttaagatgtaaatgttattttgagattgtttatgacatgatttttactattaaaaatcatttggtaatattaaaagcttagtcttataaatctttaaactattaaactgaaacagtagactttaaataaagattaggtcttattattttctccacatgacccaaattatcgttttattgtttgtgatctattccctaaatcctctctaaacattaataattgttcttttatacttaaatcttaagctgaaagagaaaactagtctaagataaaaatatttatggaatccctatatttctagcatttttcatttatttcatgtaagtatcataaaaatttatgaaataattattactaccaattatctttccttttcacatgaggaagcggagtgtcagaatagttaaaagtatcaaacactatcacacagccaggaacatgtccagctgagatttaaaattcatgtcttctcttccaaatctcatgttctttctgtaatattgcacatacttcccatactatagtcacttttgcaaaagtattaaaaagttttaaagtgttgtaggaaatgagttcaacataaaaatccttgtaccatatatgtaaatcattttcctcatctctagccccacagttttaataataattaagctacttgatttagtaatttgatccagtatactcatttttgtcatgtattttaaatcttaggtgctttcttcttttgtgaaagtgttgaattaattacatccaatatatgcaaagatggtgaatttgcctgttacagatacttctttctcctgtgtcatctgagaaaatgtgaacaagtcccacaaggactctctttgttgtgctttgcccctgcatgatgtggccttttttgaaggatgttatgaaaaacaataatatagacaagatacctgtagagtaagaagcttctatattgggaaagtctatagaagtaagcacagcacagataaaggcctaagaactaatgataactaaatatgtgttgtgttcaagttctgagacaaagaaagaacgaaaaagtgcatacaatgtatatttgatattaggattttgttattattttctttgcttacaatttaaagataaataaattaaatgtgatcatttattgagtacctaacaatgcacggcattttgctgggtgtcttcaagacaaatgtagacaacatatggcatgcactttcaatgtgttcacaggttcagatcaggagacacactcataattgctatattattataacatagatgtggcctgggatacaaactaattgctacaaaaagcacaataaagtgttagattaatgcagaggtcaagaaaaaatttttttcaaaggcatgagacttaaaatatagagcagaaatagactaccaagagctaaagaaagtttagtcatgggaaggagcatgaatgaagagcatcttaagtttggaaaggggcaaatgatactcaactgctaaagcagtctgagctacggggctatgtctgtctttctcactattatatctgcctatcacagaaatttggtatatgatagatgtacaggtgctcactgaggaatgaatgaaaatctagggtatgtatgggaaaaatattagataagtctacgaaggcaaattataacgaatttagaagtatcttgataaacatccaaagcagtctgaaatgtattctgtagcccaatgactgccagtaatactacgttaaaaagaaataatcagttttgcttttatgcaaaaacactaccctttaatgtgtagcattcagtcaggatctccctgccctcttaaatctttacccttcatcttctgacagatgctgcccaaccctatatgaagaatcgtaacaactccacacttgagaaataactctgccctactctggaagatttaaggacaccaggttaaaaatgagcagtacactagctgactgaatcctctgacatgcacagtgggcatgcctgaaacttcttgtagtgtagagcttccattgaattttaatatattaatattcactgtattttgtgttatgaaggttttctatgttctaacacatgatctccttgaaatacagttcatctcttgtttatacttttctcttagcagctagtatggtggttggtactttttatgattaataaatgtttattaaagggtgtcagttggatgttccagaaatcagaactcttacactgaataagaaatgccaagagagagttaacaactggagggccaaagaggagatggagcacagttgaataggaaaggtattggactgacctgcagctctgacacctgtgaaaaggaggaagatacaagattgctcagggaaatcctcaaatcatgttttgatgtgatgaattctgggtcaaggtttctcagcctcagcactattgaaattttgggctcagccaggtgcagtgaatcacacctgtaatcccaacactatgggaagccaaggcaaaagaatggcttgagcccaggagtttgaggctaggctgggcgacaaagtgaaatctcgtctctatggaaaatcaaaaaattggctacgtaggatggcatgtgcctgtagtcctagctactccggagactgaggttgtgggagagcttgaacctaggagattggggctgcagggctacagtgaggtgtgatcatgccattgcactctggtcttggtgacagagggagatcttgtctcaaaaaaaaaaaaaaaaaaaaaaagaaaagaaaagaaagaaatgtggggacaaatattttcaataatttactttccaaatttatctctttgtttttaattgtcatataataattgtacgtatttatgggatataatgtattgtttcaatacattaatacattgtgtaatgattaatgcagggtaattaacatatctatcacctcaaacatttataacttctttgtagtaagaacattccaactcctctcttctagcaatttattgttgactatagtcaccctactgtgtgataggacactgtaactttttcttcatttaaatttgtaactttgtacccagtaaccaacctcttcccatgcctcctcccttacaccctcccaagtctctggtaaccactgttctgttcactacttctatgattttaacttttaaaaattccacatatgaatgagaacatatggtatctgtctttctatgtctggcttatttcacttaagataatgtccccattgaggaaggctgaatattattaggttgttccaaaataattgtgggttttgccattactttcaatgtcaaaaccgcatttacttttgcgccaacttaacacaatgtttactagtctctctggcccctactactagatgccagtagcataccagtgacaacaacaaaaaaatctccaaatattgctaaatgttccctggagggcaaaatcacctctggtggaaataagtagcctgggccacccctctttgtacatccagagccaagattgcctattagaggcatctctcattaggcagaaatggacaggtccttgtaccaccaccctgctcagtcagtggttggggctgctgggaaatcacatggcccaagctaagacacagaggtggatcctggagttgcaaacaactggaagctggcagctcactgctccctttgcagctgaactgaaagtttttccttggaaggaacttagagcaaggtatcttcaaggctgcctcataaaggccataggtcctccttttcagttgaaggccttgtgttgtgccttgtctggtatgccttatttggccacctctattaaatttatccttgatatataatctgtgctctgttatatatatattcctggaatagaattctttctgtcaaaacatctgcaactttagctattccctttcctgggtgataaaaatctcagtttgactctacagaatcatatttctctgcattcaaaccttgaaatataaagctcttggacttcagaaatgaagtgatttctgcaaatgaacaatagcacaagaatagctaaatatagtccacattcattttatacagcatcttatatttgggtcactggccaattgactgtggtcacctatttcttgtactttctgcttttattatacatttctggaaaatattaaggtatctgtcaagtggatctttctggtgggtggctttgctgaccatcacatttacttgcacttctgatatcaaattcagttaggccataactctgctagacttactttcttaatctgctctgacatttctcagagcatctcaaagattgtgtgagtcaatcacaatggtctaaaaatatcaaggcacaatgaacctagataaacaatacatagttattgttgctttattagatataatagaaattaggccgggtgcggtggctcatgcctgtaatcccagcactttgggaggctgaggtgggtggatcacctgaggtcaggagttcaagaccagcctggccaacatggtgaaaccccatctctactgaaactacaaaaattagctgtgcgtggtggcacacgcctgtaattcctgctactcaggaggctgctgtggcaggagaattgcttgaactcaggaatcggaggttgcagtgagctgagattgcgccattgcactccagcttgggtaacagagagagtctgtctcaaaaaaacaaaaaaaaaaaaaaaaaaaaggaaataaagtaggggtagtattaccttgaaaacttttctaaatatagggacattgtgttaaactattcttgtgttgctgttaagaatacctgaagttgcataattcataaagaaaggggtttaattggctcacagttatgcaggctgtataagcgtggcactggcatctgcttagtttctggggaggcctcaggaagcctttactacggtggaaggtgaagcaggaccaagaggatcttgtgagaactcgctcactattgcaagtatagcactgagaagacggggctgaactgttcatgaaatatctaccctcaagatccaatcacctcccactaggcccgacttccaacactgcgaattacaactcaacatgagatttagaggttacaacatcaaactgtattaggcatattctgagatcagcagctattaaaagacatttaaactcatgtaaattaaatgtgctatttatactatgtagaatgactgcttcagattatttaggtactgtgctgagaacataatgaaattattatctgcttgaagaactgagtcagggattgaaaaatccaatagctttctttttgagtaattattttaaatgcttgtttctgaaataaacagtattaagaatttttaaagccatttaactaacagaaacaatgtggagaaattatagtgactctactgaattttttttttatctgtgaggtttcaaaggagttaatgaaatcaggtaactggttcctaggagtctgcaaaggctggtgctacctggacacagaataaagaagctaaaatagagagaggcagtttattagggacttggctttgcccagaattcagatttctttactttccttactagttcctatctacttgatcacaatgcttctcagtcattactgtgtgggggaaaaaatcaataatagccatttggattaaagtttgagatataaaaacatccactgcatatccctgtagtatctctttttccttcattgagatttctttgtaattcctttgccaacaacatagaagaccactcttacagattcttgtcacattgtgagtaaaattccaccaggggatctgcctaatattttataactatagtatatatttttacagaatacgttcccaagtttgttgtttgtttggcttattttttatcagacatttgccttgcctttagagaatatgaatatttcaggtaaaaaggtttaatgtggaaatgaagtacaaaaatgtatatgactcctaagggtatttctatttgctgtttcaaacattgccttggaattatttacaattcccagtttaactatgtgcctataacaagacattgtttaaatgcaatttagccctgtggtttcgactgccagatgaagatagtgattcaaaatgccaatttttccaaggggatgtgggttaaattttaagtaaatcattaaaagcccaatttagccaacaataaccaagcataattactcttacttaactgccttccaaagatccttattttcatatttaattaaattaaaagagaatttaaataacagagtaaatatgggtttatttctcttgctagagaccatggccctaaaatcttattcatatcacgttatacaaaggaaatttttaaaactcaaaatctttcaggtttcctcattgctccactaactttttcagaaaacaaatttatccatgtgaaatatttattacctctcactgttgtgcagagtatatattctgcaaattatatgttgaaaactatttaagtcagaatttagtcgacttacttgttcatgcagaaccctgaacaggtgttctcatgttctcactggtttgttttccaggaagcagtaacccaagtccccttttccgtaagttgcacattttggaatgtgtgagacattctctccctgcacgtagccagggcttcatctcctaagtcgtcccactcattattagaagaacttctcctaaaatggatacaaatctgttctcttaaattcttcaacaacttggactttgaatagattttcctatcagtaggaaatgaaaaagtcagcatgagtacattatttagacctgctgaccaggaatgagaaggtgcagctctaattctgatgccgagtttgaattactgggggcattagggaaatcctattactttgtcacgtctctttgtcttctctgtaatgatggaatgtcatttgatgctgtgtactgtcaatggaagcttgataagatctataaatttggaaagatttcatttttcataaagggttatgtcctgcaaggtggccattctgatgggctagaaagggtagccttccacaaagaccattagcaggcactttgagggaggggagggtggaacaggaatttatacaaacaggttgcttaaaaatacatattcaaaaggatacaggaggaactatgaatcccattcagaaccccaagctcatctgtcagatatatcaactgaagaatcacaagatctataaattgagagaggaaactttagttgttataaagagttacagcctgtcaagatggacaccctgcaggctataaccctttataataaataaagtctcctcctcacatttgtagatctcatgactcttcacttgacagtatattatattgcaaaaaatatataggtagtattggaagttatcagagaacttttgaaatttagttatatgattatttatttatgatggtgtttttaataaaattcacactcctttcactgacctatggatactttgcggtctggccttctatgatcctcaggcttgatctcctaccacttactcctgggcattactttgcactcatgatggccttttctctgcagcttggacacgcaaagcccattcttacgttaagatctttgcactgactcttaattaagtgacttatttcatttctgacaaagctagatattttgaagtaagaaatgttatagggaagagtgtgagtgtgagtctttcatgaaagatacacaacacaaattaggtttgtgaatgaaaattattttctttttttttttttttttgagacagagttttgcccttgttgtccaggctggagtgcaacggcacgatcttggctcaccgcaacctccactccctgggttcaagcgattctcctgcctcagcctcccaagtagctgggattacagtcatgcaccaccacacccggctaattttgtatttttttagtagagacagggtttctccatgtcggtcaggctagtcccgaactcctgacctcaggtgatccgcctgcctcggcctcccaagtgctgggattacaggcgtgagccaccgcgcctggtcgaaaattattttcattagctgagctataaatgtttgaagtggagcagtggaaggtatgtgggcagacaaatcatttgagatagactatagggagcctgcaatgccagactaaaaatttaggtttctgttttataggaaatgtagaaagttgccttatatgctaaactgtatgtaaaagagtttttaataaataatttcaggtgtgtatctgttttattaccaaacagcaggaggttgtaaagatttaagatggatatgaattcattttcagaataatttattttccagcagttaccctagaaaatttaacatagatattttacaaaaatctaaagttaattgcattatcctccttctgagtaatacaagttgaatatttaacttcagccactttctcttaatttatatgctactatcttccattatcttaactttatatttgtcttactttttaccctaaaggatatgattattattgatttataaagacaatcaccacatttttgactcattattctttcagatagttcagtgtgttggttaaagacatggcttctggagttagactgtctagatattaatatgcagtttacttagtagttgtgcaactttagaaaatttgcttaacctttctgtgccccagcttcgttatctgtaaaatggaaataatatatttacctatatggttctttttgtaaaatgaattcctctagaaaagcacttagaacagtacctggcaggtaataacaattatatgtgttttctattgttatttttccctttatgaattttatagcttacttctgcagttactatttttccttttgtctgataaatattattatttttctctgtaaggatttatttttggaaaaatcagtttttgatttaatagaaagaggtatttctctcctgtcctttacataaattttcactgggtctggaatagtacattgctaaaaaccttagacaagttaaatttcacagtttatttaggcaaataatgattcataaatcaggcagcactcaaaattgaaagaggttcagagagctcttctctatcagtctgagcagtgagaatttgtaggctgaacataaaagcaaagttgaaaaattacctgattggctacagctaagtgtttgccttatttggacatgagctgactggaggtccataattgtatagccaatcgctggttgaatgtttgtgattggctgagacttatttttcttcagtcagttacggggaaggtttccaagttaagtttcagtttgcttatctaagtgcttgaattagggagacatcctccggctaatggattccttatttgctttagcaataaagtacattattctcatttgtttgtatctcacagtacattattttaattttttgagtctcattcttgctatcagaaagtcaaatgcgagtctggttttcctacttttatagttactttctttttctctctggctgctttttggttttagtattttccattttcaatatgatgtgcacaggtatttcttctttttggatttctctggtctttaagaatcttaaaattggtaaattttatcaattctggaaaatcttagcaattatctatcttttcacatgttgcctcatcccattttctttctcactcaaaaaaatctgattagacatattaagaccttttcactatcattgtgtttctttcttccatagcttccagctattgcctttctgggctacttttaggtaatctttttattcctatttcctctttctcatggtgtcaattccttttttttttttataacacaagtaatatgcctgaaaagtcaaatatctgaagtctttgctggtatgattctgacctttatcatttctattgactctcacttttagtgatttcttttcctgtaagtgacatgactcttgactgaatttttgactattgagattttctttattccttctacttctatttattcccatagtttagacctgaaaattctattttactcttttatgaatggagtatctctctagagagatatccctttgggatcttagacatatggattctcctatttgattacccagctgtgtgggccctaggctttggttttggtcccccacttccaaagcagccatatacataaatctgaagtacattgagaattgcaaagtcactgaatagtaaagtcttctttggttcccagcttaccactcttatttagctttcacatctagtacgtttttctcttcctaagtagttcactgaggcattcaagaatattttataatattctctgtattactttaagaaggacatactccttcttagtcatgatatccagttcccaaattgccagaaaggaaatctactgccactcagccatgaaatggtattcagcatcccaacacaacacaaggcctgtcagaatttatgtggagtcgtgagccatagttgtgtctttaccctgttctaatatcagtcactaggtggtaggaatcacaaactatttctggcatcagattctagagtagttatctttttttctttctgattccagtatccattaattatacttttgagtagtaagtaatctcgaaccatactttttctactcttatattttaaataaaattataaagttgacttgaagtctcagaaaactagtgtggctccttttaaaatttttgctggaccctattccacgcaggttttgttgaggcttaaaaaatgtttatatttaaaagagtaagaaaaactgatcttcactatgcctcacggtgtttaacacactatagaaaatcatgttaaaaagaatgcctccaaaacatgtgaacactgtgagctcagtctgctcactacatctcttagcactttgtccaggacacaaaactgtcatttgcttttctaagataaacaatatcataactcaatctggctaaatttgaaagccaaaatatttttttgctgcttggtcctcaaaagatatatgacagcaagcaataaggagacacattcttctttattcctgctataactttggccacattttgttatctattttttttccccaggtgcattgagctagataacttcaaggatatcttgaaagcaattcacctcaaaaacttattttatgttccttttctatgagccctattccaaccttattcagcctttcaagggaacttccaagcaaaatgtcacaagcttcagtcttagcaaagagtcatggttgagatggagaataaggtccacggaaaaagagatgtttcttcattttattcctttcaccaaaatttacatacaaggccctcacattgaggccttatcacatgcaagtgggagtagaaacacttttactcaacctctactgttctaatttcacagaataactaacatccatcattaccttaataaatgaaaataactcagaatatagatgatattaacaggtaagtaggctaatctctagtttattcactgccactttttcagtcacatatttaccaagattcagttgtgtttgttacaagtctagttatataagttgtccatgttattgtaattacgtaagttaaataagcattttggaaatcacagattacatgagagtaccaagagtaagagcatttggcaaaaagtttgtttaaggctaaagccctaaactttataagatagtcacttaaaaatgctataatgtacgtatgaaataactgcataaaaataatgaaagcctccaagaatcctgccatcagatcacttcatatgtttttaggccactttaaataaatttaaagttgtatatgatgcaacacaggcactatttatacactgcagtttcctgtgatgctgagttaaaagaaatcattttttccaccagaatctttataatcataaaaagatgtcactgctatataataattggcatatatattctgtatattaagaatacagaattaaatattagatggcaaacatttaaggcatatgtgaattaagtgtttttaaagggttttttattaactcagtaccagtcccaattgtgtcagagtaaaggttgtctggtctctcacagggattgctttggaatcttaagacgtgatggagcttaagggttaacattatttattaactggggcaaattagcttcatcaataagagatgtcctagagattgtgtaggtaaagtgcttaacacaatgcttgtaatttatctaataaatggtagttgttattaggatagtcaagtatcccttaatgactgagccatattctgagaaatatcttcttaggtgatataatcattgtgtgaacactgtagagtttatttacacaaacctatatggtgcagcttgctacagatctagcctgtaatatagtctattgcttctaggctacagacctgtacaggatgttactgtactgaataatgtaggcaattataacacaataagtatttgtgtatctaaacatatgaaaagtacagaaaatataattatcttatgggaacatcatcatatatgcagttcaacgttgactgaaatgtcattatatagcacatgactgtagtatgaaaatctaagaaacactgagttttttctttttttttttttttgagacagagtctcactccatcacccaggctggagtgcagtggcacaatcttggctcactgcaacctctgtctccctggttcaagtgattctcatgtctcagcctctcaagtaactggtattataggcaagtgccaccaggcctagctaatttctgtattcttagtagagacaaggtttcaccatgttggccaggctggtctcaaactcctgacctcaagtgatctgcctgccttgcctcccaaagtgctgggattacagacatgagctacgcacctggtcagtttttgtgtttttttttttgtattatattttgccaaaaaatttatttcctagagacttcagtttattcaataattattatctaaaaaataataattgaatactttctatggtggtcactgttctagatgctggttctgtaaagataaacaagacaaaaatccttgcttccatggatatgacattctagtaggagaaaaagataactaagatgtaaatagactagtttaacctcaggcactgataattgctaagaataaaaataaggcagggcaaatgtaagaaaaatcagtgacagagctgacaggagggggcttgctattttaaggagagtaaccaagaaaggcttctagaaagaacagtctgcaatgatttaaaactctaaggtatggaaaaaactgatgttggagaggcctaggcagaggacacagtatgtgcttggcatgcttgaggactagcaagaaagtcagtgttgtgggaatggagttagtctaaaaagttagaagatgaaattaaaaagttagacagggaccggattgcatacggccgtgggcaaaactgtatagaattggtgaaaccagcagtctgtaatagatatttctttctctcgctggttctctccctctctctctctcttaatttgcagatgtatgcactattaacaccttgcatttttaaaagactaacttgtaaccaagtggaaatatactattattacttgacttacttcgtagacatatattcagacctattaaggtgtaatgctttaaagtatttgtacatgcagtcaacctcacaatgcacttattctttgtaatctatgactgaatccgaacactattatctacttattgcactctacttgcaaatatttgcaatagttcagaggaaaatgccaagaaatgggatgtcatttcatacattattctttgaatgtaatagttgacagaaagtacatattctaagaattgaaataagttattttaaaaatgtgagattaaacaaattccaattagtagtttccaaattcctgtttgtgactttttaatctcacaatgcacagcagtttaatgtaaactggtacattaaactggtagccaaaaaggcatttccaaatacacatccttctctttgctttggtaacttttattcattgattataacttaaccttgcatctagtaggaacctaatatatgtgtaattaattatattgtcatttctttgatgcaggaattttattaaagtcatcggataactatgttttcaaaagaaacgtgtaaaaagtttacatatttcagaatcttaaatattatttcatttactttttattttactcagaagagttattttacttagcttaatgtccttcagtattatgtattttaaaaaaaccaagagagtaaatttcagatgtctcatcataaaaatatgatacgtaagtgaggtgatggatatcttaattagcttgatttaattatactatattttatatacatatcaaagcattatgttgtactacataaatgtatacagctacaatttgtcaatagaaaaagcacaaactaataatctcaatactagaaagagacagaaagggagaaaaagagagagagaataagggaggagagcaaaaataaaatataatgtaattatgtatcttaaaaagaatgactttttaagaaatattatgttgtgtgtatttaagaaatattattttgtttatgccctaaggaccaagcactggtgcttgaaaatgaatacacacacacacacacacacacacacacacatacacacacacacacttcttcttttacaagagattttaacataaaataagttattttagaaatcaaattcagtgtaccatttatatttgagagtaggaaaaatgtgcctggagtttatacttaaagattatttcataacacccctacatggcatcttatgaaaagtgcttcacatgcattcctactaaaatctcaccttctatcctccggtcacaggttgtccctttactctgttaatttcttcagagtatgtatcactgtttgacactgacttatttatccatgtgttccttgtcagtctttccacactgttccactcaaaaataagttctttatctaagaccaataactccttgaaattttactgaagatcctttgctactgtgtccagtttctcctgctatcttcatgagtcaatgctccttttgatggctctcaacccatgtatgtgtgtgcacatgaatgtctgtgggttttccctctgacagtcccagaaacagcccttaagggttgtaataacatttgtatttgtttatgaagaatatttagaacaacagaggaccttaggacattgtaaatagagcgagaagtaccaatttggggagtatgggactgagcacaagctcataaaaatgagttaagccaaagctatattaccttctcagaattcacaatttcaaaaaaggtcaatttaatcatgaattgaaactttgctaactcaactgtgcagttctcatgagtcataatcatacttctggcaactttaatctctccagttattatgtgtgatatgtggattttattattttcctttctggtaaaaagcagtgtataaataaccaagatgctttaaattgtcacaattagctatgaggttgttatttagtactttgaattatatgtatatctgatatttactcataaaatacagaaaatgatgaaaaaattcttttgtttaggcttgttataaataaattaaccattattgtcttaactttcttctccattaatgatccccaaatataaagttaaaatagactaccaagacttatatttaaaattataaataaaaatggaagtaacttcatttaggtagaggtactaacaataaattcctttctttgacataactatattacattatgatctagctaggggaaaaaatacgtgtctatatttttcagatgtttcctaaaatatagagataacctagacttctaatttcataaggagggatcagataccaagaaggcaatcattattcaaaaatcattgacatactttacaattatttctcaactgaacggctttgcgccaaggagaacatagctgacacgtgaaaattctggaggtacttgtggattacagaaacttccaatatatatttgtcaagttcttgcagaaagtttagtgtcagaattttctattcttttcatgtttattgtatcattcagggaaaaaaaggaaccaaatatattaatgtgctatactggttattgttataaaaatggcattagacaaaaacattaaatattcatgaaaatcctttttcccttacgttccagccagcaaaagatactgaaagaaataattcaccaaaggagagaactataacacagtacagataatcataggagttataaacaaaggaagttgacattaataattaaatgagaaaaattccctgtggtggttttgatgagctacaggcacaatgtgtaaaatcacttggccaaccgatcattagttatgctctagaccaaaggagtatatattaatgtaactggtttctctaccctatttttctagtccaataatttgtctaaggtaataaatatagctattacacattccctgtgaggaaaaattatccccattagaacctgatgtttttactatctgtatgggagtattcaatgtagataaatgtgaaaaggagagttgatcacatttcctaagtacttgtattgtgtattacatgaattctaacagaaactgtattattgctgtctagtgcatattaatctgacctttgcactaatggttatttatcatgttattaggagatttttgcattggtttgtatttgttggcttttctgtttgtttatttcctctgtttaagaaaattgttatctatctcaaacagggcactctttaatgaagaaacaccagagctgttaaacacattgagacacagaagattctagtgactgaggatggcttcctcttggaaactaatgctgtttctgtcagtcaccatgtgtctttcaggtaaaagtcctgattaattaattatttgattttctaagtatcaaaataaccaaaatatatcaaggtctccattacaaaatatcctcaggtattaatttaaatttatatcagtatttatactttccaacaagagaaaggcagcaacccttaagccgctgttaacattgcaaaatgccatatacaatttaatataataaggtacactataaatgttaataaaatgagtatttacctccttgacattcatttgcaatctaaaccatctagctttcagaaggcttggaaatatatatatatatatatatatatatatatatatatatatctcccacacatatatacatacatatgtgcatatatttatgcatataatgtatatgtatataaataattatgtattttatagcagctaattataaaagtgtctcatcacaatgctaaatttcaccatataaaacagaatcaggttagctttattatatataacacagtatctaaaggcatctctaacacaatgtattttttcagattgtctcaccttctctgactttgttgtaattaaacttatttttctatatcttgactctaaaatgagatactttattccgaagaaaagtttatagtattggtagtaataatatcataatgcctaaagttaatatgtcagagcttatttgctttaattgaagaatgattagaaattaaattgtggtcataatttaagcgctatgcatgtaacatttacagcttgattatatttaaatcagtacctatattgtgggctaaatttaggtagtatgtatggtaagagagtctgaaataaaatgtaacagctgataattttagattaaaagattgctttcattttaaacacatttttaatgtgttaattatactaaatatatttttaaagcagtaaaatattcattttgatatatatgatcattcagtactctatgcaaatattgatataaatacatacatgttccatttatacatatatatgaggataacacatgttcaagatatgtatttatgatcatatataatatagaatacaaactacataaagatatagaacatgcatattatttacatatgatcactaatattgcctcatcttctatatggttatattactatgcaacaaaaatatctaattgattatactaaatttctttatttcaaagaactaaacacattctcctgtcaattaagtctttcctgtattgtgtaacatgaagaaaactgcagattgtctaaagaaaaaaggactgatagaagaacaaacccaaatacaagaaaatataaactctttttagaatcatttaagctatattttttaaattataattttacaatggttattctttagcctttatactattattactattcgtaatgtaccaaaagtataacttcaattatgtatgatatatgagtcttctttataactgaaaaggcaatcctcaacttatcagattatgctccaaaacattatttgaaatctaaaagaatttctttatatacagaaataaatttagtatttcagttatataagttgttatgtgttgaatgtaatatctgcagcatacctgcactcatctaaatgcttttacaagatatataaaagcctttttattgcaatactagtaattaaataactgaaaaaacaaaaaaccaagtaattatttatatattagtactattatacgttcaacacgttgcttacagaaaaaacaggtttaataagagacatgcaaggaaaaaggatacctctataaaaagttggtagagacatctatgacatgaaaaggtaaggtatctcaaaggcattaagagttaagtgaaaactgtgattcatcaatattatggttacttaaaaaagaaatcaagagtcttcagatattttattcagtgttgggtttcttttttttgtgcagcattactgtcttccctgctgatctcagttgtttctcttttatcttctcaatgtcattttcctcttgaacttataagccaactgaaggagatggaggtagggttgcaagatgaaataaaggacacccagttagatttggatttcaaaagaaagttttgtgtgtatgttttttgttgttgttttgtttttagctctggtatgttccatgcaatattttatttcattttatctagaaattaaatttaacagatgtccagtgcttttatttattaatctgacaatgctagaaagaaagaaggtggtgttctataataatactgtaaagtttcattctcttgtatttgtccaatattgtttcctcaaataaacagtccctgcaaaagagctattatacagtggttgtggaaacaaacacaaaaatactcagcctgatatggggtccatgatccctagatttccagctaatactggaatcaagttactattcatttcatgaaataaaggaaacattggaagacagaaataattaggaagagtttgggtatgagtggcatttcaaatgttataggcaaagcagaaagaaaagttgaaaacaaaggtcatgtacaattgctacatgggatttgatctttaatcatcatatctgcggttgatgtgcagcaaatattcagttgcttttttaaacagatgaatttcttttttgctgtagatatctgtttaaaataaaattgattaggatacttgaaaggatcatttatcaagaatgattatgttcaaaatctttcatttgccttcatcctcattttatcatactatttcagaggtggagcccctattctgcttttgttccttggttaatgcttacactctatattgccctcactattttaaatatttagtattttattatttcattttcactggttattgcttttagctgtatatgaatgtcacattatagggcctatttggcacactgagttaattactattacgaaaatgagggccattaagctgtggatcacgagcacattttacgttgttggtgctgtttgaaccaaaaagactaactgaagaataccctgattgtattccatatttcctttatttattcagtttttgaaaatctacggattatcttgggtgtgtctaagaaacggaaaagaactcttacctaactctatgtttgaaaactcactacaggtagtcataaaagcttggcatctttcacaagaacaggcaaccttatattaaaaatgaatccacaattaaaacaacaatgatatattgctacagatatcaaaatggctaaaatccaaataaataaaaattaataaaaacaataccaattctggtgaagatacagattgatgggaactctcattgacagtgagaattcaacatggtatagccattttggaaggcagttttgcagtttcttacaaagctaaacacaattttgtcatatgatcaaacagtaggtcttctaggcatttacctaactgatttgaaaacttatatccacacaaaaactaccatataagcgtttaccagagatttagtaataataaccccaaactggaaacaacaaatgtccttcaataagtgattaaactatggaattctatacaatggaatactattcagtgataaaaaagaatgaattaccaataccaaactacacaaacatattaatggattctatatacaaatggctaattgaaaaaaagatgatagtttgaacagactacatgctatatgattttctttatataacaactggaaagagaaaagctgtggagactataaacagatcagtgattgccagggtcagggagaaggttgaatgggtaaatgaagcaaaggacattttttagggcattgaaactactttgtatgatactataatcatggatgcaagatattacacatttatcaaaatcaactagaactttccagcatggagtaaaccataatgtttgcatatttaaaaaatatatagtagtaggtcagaggatctgaggacaaaaagcagaatatgacaaagaatctaactgtattattattattattattattattattattattattattttgagatggagtttcaccttgtctcccaggctgcagtgcagtgaagctatctcagctcactgccatctctgcctccgggttcaagaaattctcctgcctcagactcccgagtagctgggattacagatgtgtgccaccatgaccagctaatttttctatttttagtagaggtgggtttcaccatgttggccaggctggtctcaaattcccaacctcaggtgatccgcctgcctcggcctcccaaactgctgggataacaggcgtgagccaccgcgcccagcctgtattattaataggaagcaacttcacttaggggagttaggggataaacagacttaaataacttcagaaatgagtctgcaaaactaaaggcaaaaaatactgtacttaagcactgcactctagttaataatattttttcccatgtcagcactcctaaaatccataaacatgtatactggaacaactaagtccatggaaggcagatggtggaggccaggtttctcactgttggtgtgggagattacaataagcaagagaagaagtttagaatgatccatgtgataatggattagaatttgagacacacacatgtgtgtgtgtttgggtgggtgtgtgtatacttctgcagatatactaatacctatttcatttctctaacagctgagaaggattagaatctatgtgtctgagtagcaaccaacacacaaagtatcaacatttcggtttctaataccatttataccattttctactcaaagcaaccagggctgtttagagagaagcctaattctaggactgggccaagaaatatataaatcattctagagtatcctgtagtgccagaaagtaagcgagtgctaaaacaaacaaaccaaaaccaaaacaaaaccagaaagaatatgagagtctggtgtgtcaaagagatgtaggagccaactgggatagttcccagtaaccaaaactgggacaatttcagcaaataagtaagtaagtaagtaagtaaataaataaataaatattgggttatagtccaaataaatgaatattcataagtccatattgatatagataaaagattaaataaataatgaatcaggaaaattgatcaatctttatgtagattaatttcaaataatttatgtagatacttcatcctcaaggaggtgtgaaataaatatctcttttcttaagtattcgctgtgcatactgacttgtttccaaagagtacagaatgggaaatgggggccaaaagagaagtgatttcatggtggagaaaactggtaaacatttcctcagccatgtaataatcatgatcaatattagcagagataagtcatgttgatgatattacccttggtatgatgagaatgacagctcagctttgtggttttcctccccaaaacctataaccccaaaactttcgaagtcatcaaaacttaggaaaattagggaaacttttgcacagaaagaggagactaaggagatatgataactaaatgtaatgaggtatattggataggatctcataagagaaaaagagcattacataaatactaaggaaatgtcagtcaagtatgtgtgttagtgataatgctcaggacatttcatccccagaatataactgctggagatcagaatatgccactccaaagtatgcctccttggcatactagttattttgagttggttattttgaaaaactgcagacacaggactggctctgagaagttgcccttttgtaagaaaaatgtgtgtttgcataagaaatacctgtttgtaagagtgtctctctctctctgcaccatgaagaggacaactaaattactagagactcataatcaataaagcaggcattgactaaaatctgcatatcaaatcttacctttgtttaagctgtttttctggccatcttatcttaactgagccttccttgcacttttttttcctttctattaaaaagcaatgatgttgaaacctaaagtttaattttattttctttgagatctgctctagacatttacatatttctctgagttatcagtcatatacagggaatatacatgttaataaacttttttactcctgttgatctgtctttcattacaggaagtcttagttaagaactattaagtccacagaaaaaaataaattatcttttctcctctacattcgttacaaataaaatataaatattagtttattaactgtggtacatgtttcatactaccatgagatgttaataggaaaaactggttatgaatacatgagaattagactaagcatagcattctgaatacttgaataaaatatgatgagggcctgaaaataagactacagtgaagattatcaacaggagtgaaatatttaaaaacatactggcattaaaatatataggacttagtaattgattaaatatttattggtagaggaaatggtttcttaccttgcttataggtgtagatgatcttgccatttacctggattcttaataaaatgggaagtgcagatttaaagctgggaaatactgagctcaacaatgtacatgttgagctttagatgtctacaatacccttaggtgaaaaatatctaaaatttagggaagatgaccgagctaaaagtaaatctgtgattcattcttgcatggatgacattttaagatatgggaaaggaaataatcactcaacaactatggatgtaataatgagttataagacaaggaagcatgtctgagtagcatgtacttttttaaggggaaagaggaagtacaggctgaaaagaatgaaaggcaaattataaattttgggaaacggtgggaaagaaggaaagcaaaacatctccagaaagagagtggtcagcagtggcaatgcattaggaagtttaaatgtgactggtactaaactcttttcttttaatgatagtaatagttacatttaatgaagtagtagaaaccccagcgttacggcagtgagttgtgaattggttagtagaagaggaaaattagacaattattgtcaaatctgttttctgacaatgtaaacctaggaaaaggagaaagaatggtagagagcttggaaaagacaaaaatttgaggaggagtgtgtgtctttccatttgtggatatgtgttttaaggctggagaaactgtttatggaaattcaattcactttatgcccaatgtacatgaagaatgcatattgccttagttagcttttgcagcataacaaatcagcccacaatttattcacttaaaataaaatagcatgtattctttcctacaattccaagggttagagctcggtggttcttctggtctgggcagcctcagtttatctctgcagtacccatgacgcacttgatggtgttatttggccttactcacattgcttgtgattgatgccttgttagcaaaggcaatgggaatgacttggtcatgtctctgatcatccagaaggctagcttaggctctttcatgtagttgtaggctttttaggtacaggaagaaacaggaaaatccccagtttacaagcacttttcatgcctctgttatatttgctaatatttcattggacaaagcaaatcccatgagccaagatcagattcaagaggtggaaaagtagattcaatctcttcaagagagtagctgcaaaagcacattatacagagagcacgtacagcaataagaaaaacgtgggctcattttttactctaacacatatttatatatgtctgtgactgtttcacatgcaaatagaagcaattctgttttttttaaaatttacttatttatttagacagggtcttgctttgtcacccaagctagagtgcagcggcatcatcatagctcactgaaacattgaatccctgagatcaagtgatcttctcacttcaccctcccaagtagctaggactacaggcatgtgtcaccacatcagggtaatttttttatttttattttttattttgtagagatagggtgtcactaagttggctggttttgaattcctggcctcaagcgatcctcctgcccaggcctcctaaagtgctgggattacaggcatgagccaccacacctggccaacaattctgtttatagcaaaagtaaagtagactaaatatttctctgtatcctcattttcaaatacagtagcagtgaaagaactgtgtcctaaactcattagctgaacgtaaaaaaacaaaaacaaaaacaaaaaagaactttaaaactctgtaaattaatttagttttcttaatatgaaattaattaacttcaagaaaatctaagctattatcaaagaatatgtgaaatcatttgaggtaatcataattactgtagcctatttttaatatatatgtgaaaaaagcatcaacattttaatctctattgtgccaaaatctgttattgttctctttgagaattctttttttggaacacatacatcccccaaatgtgtgcagagatagcaattggaagaagacaatacggtccaggatttatctactttcaatttataagcagctttcctgatggttttcggctctttgtaaattcagtctccatgtttaaacaaactcaacaacagaaactaaaattttatgttcctttactctgttatgcagaatttctccagctaatgggtttttttaactatcatattctttttagactatggccagtaattattctaatttctttataagtatttaacatttcaataagtatatcacaataatatttagtacaaatagcttcctttttgtgaaatataaattgttctttattcatgtgtttgggcttaaagaacaataacccaaaatatgatgctttgtcatgctgagcactttcaacttgtcttaaaggaagttggaagcccctagaagccgcctcataaccaaggactttccacctttcccttgtttctctcctcccaagggcactttctgtggaagtgcccttatctgactgaggaaatttcttccaaaagaaatgcaattgtcttaaagcctcctcctcagaaatctcatcaaatgatcaggcaatattaactagcagagaagagaaaaagactaaaagttgtcaccatgcccagatagacttttcatgtattcttctgagggtacagtcaagagattacttgagagactttatatacataataagacaacctttgtttacagtgaagtttcacccctcactttctcacaatttgttgccatctgccccagagctcagaggaaccttgtcccttgctattttctgttccccattaccacttggtattcaaagagaatcatttacaaaccattgtctgctctttgggaccattcagttctcctgaaaaatgatttactactccttaaaattgcctacattctcctatctctgtctttccaatgaagaagagtatatacgattgtgaacctgattgggttgttaggtaatcattctcccatgatttccccccatgcatgttagtaaatttgtatgccttttcttctgttaatctttccattgtcagtacatttcagccaaccttcagagggcagaagggaagtcttcccttcatacctataggtggaacacaaaaccatgtatgacatccgtttaggtcatacagagtggtataaacaattaataataatagtgatatcattgctttcaataagagtagctttatgaaggcagataattatctgaaattgttttggcttgctagcatgctgaaagagtttggatgtttgtcttctgcaaatctcgtgttgaaatgtaatcccccattttggaggtgaggtctagtgggaggtctttggatcatgggagtagatccttcctgaatagcttggtgccctcctcttggtaatgggtgagttctcactccgaataacgtgagatctggttgtttaaaagagtgtggcaccttccccctcactattgcttgctcctgctctcaccctgtgatacaccagctcctcttgctttctgccattgttataagcttcctaaagccctcaccagaagccaagagtgttggtgccagcagaactgtgagccaattaagcctctcttctttacgaattatctagcttcagatatttctttatagacacgtaagaacgaactaacacacatgcacaagggttagcaggatcactttcatctcttttcccagcgtgttttgtcttcctgtaaattttacttaatgtcacattcttttttactactgtcgtcatttttttggttgtgtgtttagttaaactaaaaaatataggtaagaaatgagatggaaagacacagagaatagcagtggccagctcattaaagaggatttgcagaaaagggttatgtatatgaagtcattaatatgagtctgactatttcctgactggtgtaatagagattttaatagaacagcctaataggacactgagatcaggggaaataatgcatgggagatatgtcatatacaaatattattagtatttattcttagaataggctggaaagccatgattattaattcattaacattctatcctttggttggaggtttttgaaaaagcattcattttgtactcctcagtactagcatatatttttgtcaacatcctaaatttacctatatatttctagcaaaagttgtagactaaataagaataatacttaattaggtttattaaaactaggtatatttatatcttttccttgactaaatttataaatcttagaatcaaaaataatttgaggtttatgtagtctgtatctttgcacttgggtaagtaaagtatttttttcttctcaatagggatgaggctcagaaagattctgtctgtctataggtgttacctagtaggagaataatgggaggactgtctcctgtagcagcgcttttcaacataccagacaatatgaaggtgagacaagagaggaaatctaattcctggagccacagtgacctccttcctagacctacattaatacatatagtttttttcttctgaatcactttcagatgcttctaatgtcagctgtattgctttaaaaacaacaacaaaaggcattttttttttctctactttgaccccattctcctccattgagttaaatccattttattggaaaggtgacagtttgttccttctgccaagatgatgatgtactgttgaacagagagtgtctgtcattgataagcttatacaaatacagtccttcttggtggccgtgtggtaaattgcacagaactttgtcactgccagttagtgctgcctaagaacttccaaaggaaaatgaaaatagaagtgttacagaaaacaggtgcctgctaatataaattctgacttccctgctgcagttgagaaagagaaatggattatggctcctccatgatcaaattaaaattatgtatttgcacattgtatctgtccctggggaagttatgatgataatggagactacctctgtgtggaaacccaagttgacttttatcagctgtgccctggcggtattagacgtgtaattaatcagaagacaatttaatttctccttgtcagtgggcggtgggaactggattacctgaacttagtgagctttgttatttttatattaaaagaaaagaaaatgttaaaaggtttctataattgtcacaaattcctggggtgatataaaattaaactatcaactaaaaagccaggttcagcatcctagagaaataagagcaaatttgtgtctcagtgtattggagattaaagaaaaagttaacttattaggtcagctaaatattactttttacattagaaaatatttattgaaaaatatttttccccttgagtattggctaaggagtatgcaatgtacatcaaaagtgttttggaatctagaagatgacatggacatcatctcttctttaaactggactaaccctttctggcaagataactttcaacaataatacatccttcctgatagaagattaataattacattgattttctttattattataaagtaatgctccaataattcacattatatcaagtgtccatgagaacttgtgaatgaatgtttatattatcatttgttaagcagaaataaatttgtaccactataatactgctgtaaaatatgcttgcttatggtaagaattgttttactgcttagcacgagcatctggggaactgcctctatgcagtcatttgaataatttgtgagcaagaaaacagcttattttctgtacctcacctgttcaaattcaggtctctttggaatataaagtggaaagacaattacattcattgagcactcaagcaagcagacataagtgcgatgcagaatgcaaaggaagattcttgatctcctttatattaaacaaattttatagttttatcaggatccaaatatggattatatataatatgtaaaacgaaccatgtataactaattacaagaatgagttaaatgccatatattttctgtttattttagctctttgagaaaaatcctattttgctagccattaataaagttaacaattgactttttgaaactctgtcaactttcatatctgataatatttaacatagacatcaaccagaagatttttcttttctattatctggaaaagaacattttccattctaattttcgttatagctttcacactgaaatttgtcagagcacttagttaaatatcaatgaagtcttcaggttggtgactaggcttatagtatggctttaacctctctgtggctctagggtatgctggaccatctgaatggtccagatcatggataaacatggtttgaagtgaaaattttttatttttcagcatttgaatattttgcaattatgatttttacatgtttatacaaaagtacaagatcatctgttctataagaatagataaaatatctatctgttctatttgctgtttcatatacaggacctagcataatccttgctatgaatgcttgctatgggataactgttttttatttttattatttatttatttatttatttattttttgaggcagagtctcgctctggcgcccaggctggagggcagtggcgcaatgtggcctcactgcaagctccgcctcccgggttcaagcgattctcccgcgtcagcctcccgagtagctgggattacaggtgtgcaccaccatgcctggctaatttttgtatatttagtagagacagggtttcatcatgttggccaggctggtctcgaactcctgaccttgtggtccgcctgcctcggcctcccaaactgctgggattacaggcttgagccaccatttttaagaacttccaggctccagaatccttctattgtgtggctttcttatctcaaaatcttcactgctaaccactagtatggaggcatgatgggataactattttttaaatgaatgaaaagaaatatttactttaatttttttcttgggtttagagggacacaaactatgctccctgttgcagtaatttctggtgaagaaacatccgaataggatgaataattttacattctccaaatctgatcattctaatatttttaatataagaaataagctgagatttctttgggcatttggaaatcctactgaattaaagccatagcaattatcttagcttagttcaggggattgtaaaaacaaccaataaaaaattactaaaggcaaaagaaagaaagtaaagaaaaaaacaaagaaggtaagatatttgaatagtcaatgtcttcatcaggctgctcagcctcatgtcatccattttcacacatcactgaggcctgcaagaatttgcttcaagaggttctaaaggttactttaaaaaaaaaaaaaaagaagaaaagaaaaaagcttgggtcatatgcctctttacttgtttctctatggtaattcagagatgtactggctcacagtgccgttgctggcccaaagctatttttatttaatacctaaattcagaaagaactatttcaacctggccccaggatccttatttgttccagaatagccctgaaggaattgactgtttttaaaataggattctataaaacccaacatgcagcatttgtttcatttatggttcagtcgttcttctaagaaacatcatagctatagatagaaagtttcaagtagtcgtagcctatatactttgtcaaagatattgtgtattggggataaagattacagagatcaaaggcatttaaaaatattatttcaggtaccagttacataataattttcaaggatcttttagtataattcatttgtctgttaatttaccaagtatttattatgtgcctgctagatattttgctaggtgctaaggctataggagtgaacaagacaggcaaaatccctgtctttctggaactcacattcttgtagagaagacagacactttagcaagaaataacataatatctaataggaataattcccataaagaaattaaatggaataaaatgatagtgagtaatattgggggagatggggtggcaaggtgttattaaacatagaatgatcaagtaagttcactctgaagaggtctctaaggaaaaacgcaatgaacatggaaatacaagccacatgaatatctgaaacagtatttcaggcaggcagggaaagacaaatgtcaaaaccctcaaaaggaaacagatactgtacataaagaataactaatacagatgagagaagaatcaatacagacaaagagtctgtgacaagaagagtgataggtggtgaaataatgagatagacaatggccagagcagaggagaggtataagttaataacacgtaaaggcagcctgctttctgctttatggaaaaccaactgtccagcttgagtaagaaagaaggcctggacatgtgtaggatgctattgtagtagttgcgagagaaaaggtaacatgaagtatttagacctgtaggttttcaatggctatttgttagcttcattatgagtcagtactggtatgaatctaccaaataaggagctcacataatcttcagctgtatcaataatgcctagaataagggagaggttagatctgtattgctgtcatgctaacaatgactgattttatgttcagttccagactcagtcttataatggaaacagataatcacaaatgtattcaggggagggaaaccaaagttaggaaaccttgacactttaaactctgttgtaacagaaatgagaattgaaatggaatgactagaatgagaactgaattaaagactcagctattatttaggggaatttttgaccaaaactcaggaagcacatctttcttcttgcaagatcttcactgaattaattattgctttttgtaagtcaatgagtaaaagatgcagaaggttaagatacaaatgacttaggagggaaggcaaaaaaggtttatcataatgaagtatgggtacatatcctggtcatacttccatagagtgatttggcctgtctcttctctcatattcaaattaatcatagtgaatttcagttatagatttcttctttacttaggacatcaagagttagcctttgtatattctctaataacaagcagctatcattgtaaatgacataaagcaagctataaagactttgaagaaagtaatattttttcttcatataatatacataaatataatttcagtatcctgctctaatcttaatgagatacgaaagcctctcagttcacacagcaataatcattacatggcccatagcaagaaatctcatctcaaaaagacagaatttccaaaagttaatactacatacaaccactatcattaaatagctaaaagtttgttatatgtaagccatttagacttattttcagagatgtaaaataggaatgttcaatcctttggcttccatgggccacactggaaaaagaagaattgtcttgggtcacacataaaatacaccatcgctaacgatagctgatgagcaaaacaaaaacaaaaacaaaacaaaacaaaagctaaaaaaaatcgtattatgttttaagaaaatttacaaatttatgttgggctgcatttaaagccatcctgtgctagatgcagcctgctggccacggtttggacaagcttgctctgaaagaacaaaccggtagaagctacagaatagcaaagggtagaattagtttgcctaaaaaggtcctttttagtttgcctaagtgtccagagttggtcagtgatagaattggcactatcataagagtttttcaagaaggttcatgtcaagcctgaacttccttaacacggaaatgatcattatttagtaaatgatcattatgtaaagacaattttagcatcaaagggcttgctcagactgatgatataatgctcccctccccttgtccatagatctattatactgtaagtcagactttcagaaatagttaaaagttttattttattttgttaatttttaataattgagggttttttttaaaaaatagattatcaaatgagaaaacagtgaatgattgtgggtagaagaattgagaatggaagaatatattggcggttagaaacatatgatggacttaacacatttcagattacaggaaaaagagaggaggggttaaaatatatttgtgtttgatgttttgagccagcatgcgggagaacagtggagccagcaatagagataaaggaagactaaaaagaaggggactatttttaaatttaaaatagccaaatatgatggaatatttaatttaagaaataaacagttgttattgtcaaatggaatataattaatttagtagaaaatttaatacactagaatcagttttaaaatgaagtatgttgccaagaagctactctgttttggattccacccaaggagtgtttttttttttaaataataaaatggacctgattacataatactctttttatgaactcagataattccactctgccaggctattctacatggtaggaacgttgttttaaatagttcctggccgggtgcagtggctcacgcctgtaatcccagcactttgggcggcctaggcgggcggatcacgaggtcagcagatcgagaccatcctggctaacacagtgaaaccccgtctctactaaaaatacaaaaaattagccgggcgtggtggcaggcgcctgtagtcccagctattcgggaggctgaggcaggagaatggcgtgaaccaggaaggcggagtttgcagtgagcccagatcacgccactgcactccagcctgggcgacagacagagtgagactccgtctcaaaaaaaaataaaaataaaaaataaaaaataaaaatagttcctaataagcttccaggaatgaatttttttctattgagacggagtctcgctctattgccaggcctgagtgcggtggcgtgatcttggctcactgcaacctctgcctcctgggttcaagagattctcctgcccctgaccatttccttttttgtcttcttttcattggccatgcatgcattttggagaaacctttctagagcatatgtaattctttgaaacttctctaagtttccaagacatgttcttctaccaccgtcacacgtttcaattcttaaaagaaatcaaagctaaaattattattatttattatactttaagttctgggatacatgtgcagaacgtgcaggtttgttacgtaagtatacacatgccatggtggtttgctgcacccatcaacccgtcatctacattaggtatttctcctaatgctatcactccctataccccccactccccgacaggcccaggtgtgtgatgtttccctccctgtgtccacatgttctcattgttcaactctcacttatgagtgagaacgtgcagtgttttcttttctgttcctgtgttagtttgctgagaatgatggtttcctgcttcatccatgtccctgcaaaggacacaaactcatccttttttacagctgcatagtattccatggtgtatatttgtgccacattttctttacccagtcaatcattgatgggcatttgggttgattccatttccttgctattgtgaatagtgctgcaataaacatatgcatgcatgcatctttataacagaatgatttatattcctttggatatttacccagtaatggattgctgggtcaaatgttatttctggttccagatccttgaggaattgccacactgtcttccacaatgattgaactaatttacattcccaccaacagtataaaaacttttccttatttctccacagcctctccagcatctggtgtttcttgactttttcatgatcaccattctgactggcattagatagtatcacattttggatttgatttgcattcctctaatgactggtgatgttgagctttttttcatatctttgttggccacataaatgcctttcttttgagaagtgtctgtttatgttctttgcccactttttgatggggttgtttgtttttttttcctgtaaacgtgttttaagtttcttgtagattctggatattagaactttgccagatggatagattgcaaaagttttctcccactccgtaggttgtctgttcattctgatgatagtttcttttgctgtacagaagctctttagtcagaaatgacttcttttaaaatgaaaaatggtacatttttgggaaatagactggaaataggagggctatatactagtttcaactttgccatgaattgtgggactttggagaagtcattatttccttctctgtaacaaaatgggttaggctacattatttgaatcttcttacatattctaatgttgttttccaataatctcatatcttttattataaagtctcaaacttgggaacaacagaccttaagtatctcaatttttgaagaaatggtgttagacgtgtctatataatatttactaaaatatgtaaaatagaatcccccttaaatattcagaaaatttgatacttaaagaaagttaagagaagtgaaaaagaagtcaccaggctaaatgatgctgttggcagtggtctgagatttcttttcccctcactcagagaaaggaaaaagtgatgattttctttacctcggaataggtaccagaggaactgcttgtggtcattggagtgtctgcagagaggaaagatatgccttttactctacatctaaatgtttactaagtgacagaaactcagatttgttaagaacatgctaaaacaatcttgagaaaggctgacgtgcttcctgtggattttgagggtcgctaacatggcagcgtaagagcatagaaactagattctgttttccaaagtaagttgataaaagctactcttggagcaaaataaaattaaaaggtggtagagtacatactgaatcccagcatttggaagagcaaaggttcatgaaccttctgtgggacagaagttgatgcttcataagtagccaggcatgacccttattgatggattctagccaatgccaccagacaggaggaggtgacttcagaagaaagaggaaggtagtctccccaggggtggagctgggagaagagcaccagcataagacatcagttagagagtagatttctgtgtcttagaactaagcagcatggcagattagaaggaacttccaaagaaccaataggggcaacccactagagaatccgtacttggacaactaccacacagagggccccggtggccacatcacagctgcaccattcagctaaaacttgtggcctgtatattccagcaacattggaaggatttttcaggagaagagaagggagacaaataaagatcaaaacaaaaatagaaacaaataaccgctttttccctaccacaggttccgaagcaccacggcaagcctgatctgtgaggagaagagagtggaggaatgagagattgaattttttgtctaggcagagctggatatattagtattctcaaaatgagtcttaattgccaaaacaagctttgttttaataccttaaggtatatggaatgctgaagacccatcaagaacctcatctatggcagagaaagggaaatctggcaggaggtgtttaaagcagtaattggagaaatagaaagtgttttagtccctattataaatgcattacatatacttggatattttctccttattgacatataacccttttggtagcctttcattgatgtttttctttcagtaaaaatgtaatgaatactactctgagtaaggcaatgtccaggacagacactgtagataaaccagagaaaaaggcaacccttcagtcttaattcatagaggtaacagactctcttaatccatttgggctgctataacaaaataccataaactgggtggcttataaacaatggaagtttatttcttatatttctggaaggtgggaagtccaaaatccagttgcctgcagatttggtgtttggggagggtgtgttttgtcatagatggtgccttctcagtgtaccctcatcacttgttggaaggagcagggcagctctctggggcctcttttataagggtactaatcctattcttaagggtttcaccctcatgacctaatcacctccccaaagttctcatctcttcatactatcaccttgggggattaagatttgagggtatatgcattttggagggacacaaacattcagaccacagcacaaatctttggactgagtaatcaaatttgaaccacaataaagggaaaaaatgttgagggatttctatggtattatgaatttcttttattaatcaaagtttcggtagaggtctttattggactttttgtggcacaattgttaaataattcacaccaaaagacttcaggaaaagacagggcttaagagggaggttgaaggattgagggtatttgaataggtagagagaaaaaaagattgcattagtgcattaaagcagggagaaatgtccagcacttttcacatagagttgtagctctgcctgcttgtgtcctttgacacattacagagattcttgcccccatccctctccctttgcctcaagcactcatattctacaaccatatgctctaaatgggctcttcacatttaggaaaataaattgagagtacatgactagtgattctaccaatgattaatcttaatgtttagagaaagcatggagtccaggacaaatagatgtttttactagattaacgtacagagttatgacatttatgtttctatgaagcaatttgctgtaacttatgctaatattgtagtttgctgtaggatgtcatgattttcatttaattaaaaataatgtgtgacagatgattatttttccattgagcccgatcattaaaaatttatttctagagtaataaaataaaaaatacagtgtttaaaagagtttgtgggactatcacaaggtaattaccatagacatatatattgaaaacaaagtttggacagttctttagttattgcttctaaaatgtttaaagatgattctgcatttgtgcagatctttatagtgaggaattaattctcaaagattttcttttattattattattattattatactttaagttttagggtacatgtgcacaacgtgcaggtttgttacatatgtatacatgtgccatgttggtgtgctgcacccattaactcgtcgtttagcattaggtatatctcctaatgctatccctcccccctccccccaccccacaacagtccctggtgtgtgatgttccccttccagtgtccatgtgttctcattgttcaattcccatctatgagtgagaacatgcggtgtttggttttttctccgtgcgatagtttgctgagaatgatggtttccagtttcatccatgtccctacaaaggatgtgaactcatcctttttcatggctgcatagtattccatggtgtatatgtgccacattttcttaatccagtctatcattgttggacatttggcttggttccaagtctttgctattgtgactagtgccacaataaacatacgtgtgcatgtgtctttatggcagcatgatttataatcctttgggtatatacccagtaatgggatagttgggtcaaatggtatttctagttctagatccctgaggaatcgccacaatgacttccacaatggttgaactagtttacagtcccaccaacagtgtaaaagtgttcctatttctccacatcctctccagcacctgttgtttcctgactttttaatgatcgccattctaactggtgtcagatggtatctcactgtggttttgatttgcatttctctgatggccagtgatcatgagcattttttcatgtgttttttggctgcataaatgtcttcttttgagaagtgtctgttcatgtccttcgcccactttttgatggggttgtttgtctttttcttgtaaatttgtttgagttcattgtagattctggatattagccctttgtcagatgagtaggttgcaaaaattttctcccattctgtaggttgcctgttcattctgatagtggtttcttttgctgtgcagaagctctttagtttaattagatcccatttgtcaattttggcttttgtcgccattgcttttggtgttttagacatgaagtccttgcccatgcctatgtcctgaatggtattgcctaggttttcttctagggtttttatggttttaggtctaaccatgtaagtctttaatccatcttgagttaatttttgtataaggtgtaaggaagggatccagtttcagctttctacatatggctagccagtttccccagcaccatttattaaatagggaatcctttccccattgcttgtttttgtcaggtttgtcaaagatcagatagttgtagatatgcggcattatttctgagggctctgttctgttccattggtctatatcctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattgaatgtataaattaccttgggcagaatggccattttcatgatattgattcttcctacccatgagcatggaatgttcttccattggtttgtatcctcttttatttcattgagcagtggtttgtagtcctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatgagcttaaggagattttgggctgagacgatggggttttctagatatacaatgatgtcatctgcaaacagggacaatttgacttccttttttcctaattgaatgccctttattcccttctcctgcctgactgccctggccagaacttccaacactatgttgaataggagtggtgagagagggcatccctgtcttgtgccagttttcaaagagaatgcttccagtttttgcccattcagtatgatattggctgtgggtttgtcatagatagctcttactattttgagatacgtcccatcaatatctaatttattgagagtttttagcatgaaggttgttgaattttgtcaaaggccttttctgtatctattgagataatcatgtggtttttgtctttggttctgtttagacgctggattacatttattgatttgggtatgttgaaccagccttgcatcccagggatgaagcccacttgatcatggtggataagctttttgatgtgttgctggattcagtttgccagtattttagtgaggatttttgcatcaatgttcatcaaagatattggtctaaaattctctttttttgttgtgtctctgctcggctttggtatcaggatgatgctggcctcataaaatgagttagggaggattccctctttttctattaactggaatagtttcagaaggaatggtaccagctcttccttgtacctctggtagaatttgactgtgaatccatctggtcctggactttttttggttggtaatctattaattattgcctcaatttcagagcctgctattggtctattcagatattcaacttcttcctggtttagtcttgggagggtgtatgtgccgaggaatttatccatttcttctagattttctagtttatttgcgtagacgtgtttatagtattctctgatggtagtttgtagttctgtggggtcggtggtgatatcccctttgtcattttttattgcatctatttgattcttctctcttttcttctttattagtcttgctaacggtctatcaattttgttgatcttttcaaaaaaccagctcctggattcattgattttttcaagggtttttttgtgtctttatttccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacacactgctttgaatatgtcccagagattctggtatgttgtgtctttgttctcgttggtttcaaagaacatctttatttctgccttcatttcattatgtacccagtagtcattcaggagcaggttgttcagtttccatgtagttgagcagttttgagtgagtttcttaatcctgagttctactttgattgcactgtggtctgagagacagtttgttataatttctgttcttttacatttgctgaggagagctttacttccaactatgtggtcaattttggagtaggtgtggtgtggtgctgaaaagaatgtatattctgttgatttggggtggagagttctgtagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccgttatgtaatggccttctttgtctcttttgatctttgttggtttaaagtccgttttatccgagactaggattgcaacccctgcctttttttgttttccatttgcttggtagatcgtcctctatccctttattttgagactatgtgtgtctcagcacatgagatgggtttcctgaatacagcacactgtattttctttatccaattttccagtctgtgccttttaattggagcatttagcccatttacatttaaggttattattgttatatgtgaatttgatcctgtcattatgatgttagctggttattttgctcgttagttgatgcagttgcttcctagccttgatggtctttacaatttggcatgtttttgcagtggctggtaccagttgttcctttccatgtttagtacttccttcaggagctcttttagggcaggcctggtggtgacaaaatctctcaacatttgcttgtctgtaaagtattttatttctccttcacttatgaagcttaatttggctggatatgaaattctgggttgaaaattcttttctttaagaatgttgaatattggcccccactctcttcttgcttgtagagtttctgccgagagatcagctgttagtctgatgggcttccatttgtgggtaacccgacctttctctctggctgcccttaacattttttccttcatttcaactttgatgaatctgacaattatgtgtcttggagttgctcttctcgaggagtatctttgtgccattctctttatttcctgaatttgaatgttggcctgccttgctaggttggagaagttctcctggataatatcctgcagagtgttttccaacttggctccattctccccgtcactttcaggtacaccaattagacatagattttgtcttttcacatagtgccatatttcttggaggctttgttcatttctttttattcttttttctctcaacttctcttcatgcttcatttcattcatttcgtcttccatcgctgataccctttcttccagttgatctcatcggttactgaggcttgtgcattcacacatagttctcatgccatgcttttcagctccatcaggtcctttaagaacttctctgcattggttattctagttagccatttgtctaatttttttcaaagtttttaacttctttgccattggttcagacttcctcctttagctcagagtagtttgatcttctgaagccttcctctctcaactcgtcaaagtcattccctgtccagctttgttccattgctggtgaggagctgtgttcctttggaggaggagaggcactctgatttttagagtttctggtttttctgctttgttttttccccatctttgtggttttatctacctttggtttttgatgatggtgacgtacagatgggtttttggtgtggatgtcctctctgtttgttagttttccttctaacagtcaggactctcagcttcaggtctgttggagtttactggaggtccactctagaccctgtttgcctgggtatcagcagcgctggctgcagaacagcagatattggtgaaccgtaaatgctgctgcctgatcgttcctctggaagttttgtctcagaggagtacccggccgtgtgaggtgttagtctgcccctaattgggggtgcctcccagttaggctacttgggggtcagggacccacttgaggaggctgtctgcccattctcagatctcaagctgtgtgctgggagtaccactactctcttcaaagctgtcagacagggacatttaagtctgcagaggttactgctgtctttttgtttgtctgtgccctacccccagaggtggagcctacaaaggcaggcaggcctccttgagctgtggtgggctccacccagtttgagcttcccatccgctttgtttacctactcaagcctgagcaatggtgggtgcccctcccccagcctcgctgcctccttgcagttagatctcagactgctgtgctagcaatgagcgaggctccgtgggtgtaggactctctgagccatgcgcgggatataatctcctggtgtgccgtttgttaagcccgttggaaaagtgcagtattagggtgggagtgacctgattttccaggtgccgtctgtcacccctttctttgactaggaaagggaattccttgaccccttgtgcttcccgggtgaggggatgcctcaccctgctttggctcatgcatggtgtgctgcacccacagtcctgcacctactgtcttgcactccccagtgagatgaactcggtacctcagttggaaatgcagaaatcacccatcttctgcatggctcaagctgggagctgtagactggagctgtttgtattcggccatcttggctccaccctctcaaagattttcattgtgtttatttattattgactgtaagtaacagccatcattataaaattaatctcatgaaatagatcagataattttttactgggatcaaagggattaaggaggatgtgatttctctaccaaatgttctttatgctgggttcttcaaactaatttttcaatttgaaagtattaactttaaaattgaatatttaaattgttcaacgttgttcccttttgggggacaaagtatatagtacattaccgggacataacactcagagtattaaaattagctctgtattctcctacttgaaaaataattgcatggcttttctcctagctcaccatacttattcacactggccctgattactgttatatccttagtgcagagcttctcatgctgttggccacagacagaaggaccttggagatgctccagagtgtccatggtgttaaaactattttccttataatacaataatgttattggcctgctttattctcttgacattgttactaatggagcaaaagcaatggtgagaaaattcgggagccatggcttacacatggcactagcaactgtattaaataaaatattaaatcttgtctcactcaataatatctcccatgaaacaacaaaaatattaatattattaaataaaacccttaaatacacatatgttagtaatttgtgtgacaaacaggaggcatacacaaagcacttctgcttcacgcatgcagaagtacagtggctgcctcagggaaaagcattctgctttcatttgagattgtgtagttgtttgaactgtgaaacaaactagcagcagctgctttttcatgaaacactgtttttacttgaaagaaagaacaacagacaaactgttattcaggcttgcatacttggtggatattttcttaaaagtgaactgagtaggcctgttgctgcaagggaaacaactaacaagatctgttgccaatggcaacattcaagcttttgtgtaaaaactaaaatttttgaagacttgtatccaacttcatgagctagaccatttcccaattcttagagacttacctgattgttaaggatttgtgcaattcagtggacacatattttccaaatgaccaaacacacagtgttacaaaatcacacatggataaaagatctaatctataagacagatgaaaggattttaattttacagtatgaaaagttcactcaggtgatttcagattactcattacaactagcctttaagaaacttgagttttggtatagtatcaaagaagaatattcataattatctgaaaaggttattacaattcttctctcttttttgactacatatgtgtgagagcagggttttctttagctgcttcaaaaagaacaaaactacaactggttgaatgaaaaaaggtaggaggatctagctgttttctattaagctaaattcagttttacaaaacttataacaatgccactcttcttacaggctttacattttgtcttgaaaaatatggttatttaaaaaaatatatatatttaggttaacttatagtgggattttcatagttattttaagatcatttaatacataattttattttttcagtattgatttctaatatagtaaaaatacagatagatataactcacctaaacaaagttctttcaagacttccattattttccaactgtaaatgggccctaatatcaaaaggtttgagaacaactactttagcacaaagttaaatgggatcgtagacactggaatgaagatgtgaggagtaaaggctggagagttagtcatgtttgagagcatggagataatatctgaaacattttgtaattcataaagaatttggacgattgcaaaccactgatatatccaaggaaattactgaatttaaaatttccgtggtgaagcaggtgaatggcaatgacaaagtcaggattttcttgtaaaataaattgttctttctttccttccttcctatttttcttcctctgaattcagtcagctaccgtgttagtttatttcttctattataatatatcatatcatttattcctttcttgatatatatctcatatcatgtatttcattcatttaattaaatcccgttccaaatggcctcatgtctagtctgctaatttctttctggtttctgtgcaatcagtttttatttttttctctttcaacccatcctgaaatctgctgactgattaacccacttcaatccagtcttagctctattaccatcatcccacaagctcaatcaaatataatgaaaacatttgtgctaaccattggtgagatgataaatctcaaacttctcagcataataactgacataactcagcataataacggacataactcagcataatggctaaaggaccctctctgagcatgttttaccctttctctaaataaaaaatgctctaattaaagtagtttattcgttttctttttaatgtgccaaatctgttttaaccatggtacctttctgcatatcatgttctctagcctgaaatgcccgcagtctttgccttatcatcttatacagataaaatgagataatacttttcaataaattagtacaatacctgaaacataataagcagtaaattaaagccagttatttttcttattaatattacgactatactgtaaacttctggagggaagatactataccctatatcatagttgattctccattgtatagtagatgtctctctatgtaatatatgttcacaaaatatatgtggcttatagtgatgattatccatattttgactgactttatttaaagttttaaggaagggccactcatctaataaatctgtccaacaagacataatattttaacatagtcaccaaaataaagtaaaaaactctaactcagggcaccataaagtgctagatatgtaagcttatccaggaacgttaatgcacctaggcagagaatcatcaacaatagtctagtaattggcaagagtatcattaatcaacttttttccaggcaagtaaagttaaatcagaattcagttaacaattcgtaatgtgtgtgcgagtgaggatcagttaaccatttatgaagtttatgccatatgttgaaaaccaggtcatattgcaatgaagtcatgttggctactaagaaagagcaactcagaaatgaagaggttttgcagtatgggtaatccgctggatatcctgtctctgacaacagagagagaagcggctatagaagctgcctactctatactgcacaggatctcctcatagaatagaacatggaaacaaagctctatttgctaccattatatagagaatgagctttctttggaagaaagtatacatgtggaggatctaaacaaaacaatgcacaaggtaaactgacttaaagacacagtgtctcccataaaggagcgacaaattcaatagcaggtatctgctatgggagctagttccctgaaaagaagagcaaccagattcaattacaggatacctgagagaaaaacctacagtttgatgctgtttgctactaacgaggatccattttcttctggtaatctgcccagggaatcatatgtgtggctgcattagatggtacgtttcttctttccaaacaccactcagaatttgaaagatgtgtgtgggagtgaggatatgttatgaagatgggggtcatttgcaagtagtataaagatttgataaaggaaaattgctgagaatttttttaaaagtaatgatcagcttaaaaactagtagcagagttctctcttaaacaaaataaatgccatttgctagcaaaacactttgaaggattatctaggttttcaaaagagtgctttaatagttgggtcaaaatgggttcatgctgagtgacattaggagcagaatggttctgcttaataaagtggaaacatttttattttcttggagctgatctagagaaggaagaagcaaagaggaacagcataacaagagaacaagaaccttaggaaaatatgtggccagtgagaaagtcctaagactgctataccttctccactgtgagcccaaaatccatagtttaagaccaccggccgggcgcagtggctcacgcctgtaatcccggcactttgggaggccgaggcgggcggatcacgatgtcaggagatggataccatcctggctaacacggtgaaaccccgtctctactaaaacacacaaaaaattagctgggcctattggcggacgcctatagtcccagctactcaggaggctgaggcaggagaatggcgtgaacccaggaggcagagcttgccgtgagccaagatagcgccactgcactccagcctgggcgacagagcaagactccttctcaaaaaaaaaaaaaaaaaaaaaaaagaccaccatatacaatcactttatgtaaatggcattttgtagaagtcaaggcaaaggtacaatgttccatgtttgtgtcattttcagattaagaagaggaaaagaaattgttcatgggtaaaattaggaattctgggaaactgggactttgggacaaggtataataatgaaacattaaacccctagtgagctcttagggggcacgtggtggaggtaggagaatttcaacattccaccctctgtggggtgagtcttcaatccattttatttaatacgttaaagtaaaaggaaaattcctaaaaccagaggacttatggatacctagcagttgacatctgggctaacatctgacctgtatttaccttcagaaatcagggaaatccaggatggtggcaaccgtgtcaatatgacacagtgaagcaggtctcaccacagaccaacctggttgcaatattcctgcctgcgttgggagctaagtaactggaacaagtttttgtaacgtgattagagtttcttagaatgagtaattgtcacagttgctgttgtggaaaagtaattaattatatgaagtaattagttttccctcaagcatacttaggcttgatatttttgtgtatagaaatgaaaataacaaaagcaataatatatgtatcttgataggtagtgtgctggattgtagatagaaaatggcgttgatggaacgtgaaacatgaacatgttgtgaaactatagaagtgcagcaaattggtacacaaacactgtcataatacaaggggatgactttgaaggggcagctttaaaatcaatatcttctttagtagtggtaaatgctttataaatgctgtctgcctgaataacaagatgggaataagccagacaaatgtagtcatgattttacaatttcagaggaaatcaccatcaataacatgcaaaatgcaataatttggaagtgttgtaaatgtgcatatttaagttctttaattaatttcaacatataattcaataagttctaccctgattattcagtattcatgtattcaacattctaaaccactaaaagcagaaaaatactgcttccaaagaaggatctgaagtaaagcacatgtatatttagaatatgaaaacagtaattttgccttgaagaaatatactaatagaaaatgaatcaaaggtgatcttgggaatatgttttctatagtgaatacacatgttagttcaagtcacaaattccttcctataaatatttagaaagtatattgatgttcataaatcattatgctttaaatatatttgaagaaaagatatatgagtagaaagaaaattcaaacatacacatttacatgttaatatcaacttaaaagttaatggctattatcagtcaagtgtacatgaatataaaacaaatactatgtctctaacattggaatagaaggaatggcacatgtttacagaagtataaaatgagcttcctatcctcataatatttttctaatattcttgagtataggggaaagttaatgagcagaaaaattaaggtgagtaatacaagatgtgtcatattgtatgcagtgcatccacacactatctaaacaatgaaggaagagagttttacagaagaatgatttacggagagattcactgggctagtgagggtatagccagtccttgagagatgaacttcaggtatagaggaggaaggatcatccagaggaagataaacatcatgagcagagatgaacaggcctctatgtaagcggaagagaaattcagtgaatgcagtgggaggggaaagtggaaaaaaaagaggacagcaatgattatacaagtcaaataaagcataaaagcatcagttacacagagtacaatttcaaaaactaccattgataataataaaaatagataagaagagactgctggatacagaaaggcaaaagcatgagtgatgtcagagattaatgcaaaagagatccaaactcagaaaccctgggttcaaaccctggcattgttgtttattagctgtatgactttgtgcaatcactaagccactctgaaattcctccactcctcaaatggcaatgatattaattaattgacaagtggcaaagttaagataggacaatatttccaagtagataacacagtacttgatataatagaaatatctgttatacaaaggtcattgaatgtaaatctggaaaaaatatttagatctctgtacaaattatgtgttgtagatatgtgtcagtaaagccactatgcagagtcatggcaagaacattccagacaaagggaatagcaaatgcaaaggctatggcaggaaagagtttagagtaagaaatgaaaaggaggcaaacacagaaagactatagtaagcaaagggaacaatggtttgagatgattaaagaagaaggctaatgccaatcatcttgaccatgctagggtttattctgaaaagtgccacaacaccagggatgctagcattaagaaaaagttgttcagaatatattttttccaaatatgtatagaaataaatatttactatatttcaaataaagatatggtaaacatgaaatatcaaacaaagcataaactaatataactatacatgcaaataataaattacaattataatgtaaattgtgaaccactgatgactctgctttttttaacttcagcccactgtgtgtgaggatcactgagctgctgctgcctttgatgtaacatctccacgttggcccaggctttcctgccctgtttagaggctttacgagacgtttagttgatcttttatcttaggcccgtgtatctttttgatggttctctggagggaggttgggatagctttttcttggacagcaaatttaaacccctgctaacaccagcagagcccatctcatgatttacctcttctcctctccaccagacatctgcttattttagagtactctttttacatgactcaacaaaaccttttttttttttttttttgagacagaatcttgctctgtcgcccaggctggagtgcagtggcgtgatcttggctcactgaaacctctgcctcctgggttcgagcaattctcctgcctcagcctcccgagtagctgagactacaggcgcgtgccaccatgcccggctaatttttttgtatttttagtagagatggggtttcaccatgttagtcaggatggtctccatctcctgacatcatgatccacccacctcagcctcccaaagtgctggaattacaggcgtgagccaccacgcccagcccctcaacaaaacctttttatttggcagctggtgcgggaagagagataacgagatactgtcatggatattgtaagaattgtggagtaaagagaggctgggggaacttgagatacaggtgtcctgaataaggataagagaaggcaggaaaggggagagtaagaaaaatatacagtgccaaacatttgcaggaaaatgcccaaaataaagattttatgcaaactgaaataccagtattttgacacttaaaattgcttagtataatggaaaaataaaaatcaatattgaaattccaatagagatggagaaaagtaacaatttttttaagaatatggaaagaaaacaagggcaattcctaagtttttgccttgagcagctaagtatagttttaaacaggtggactgtttactaaagggtgaagattggaagcatatgaaatttgaaagaaaaactaagagctccactttgaatatcttaaatttgagattcctctaaacagaggttgcttaggtggttggatatataagtctggagtctccagaagtcagtgatagaaatctacacaaagttgactgttttcaagatatctctggctttaaaagccatggaacaggatgagatttcctagagaggggttattagatgagtaacagtagaagttcctataaaatctgcagataagtttaaacaatgtccggggaaggaatagagataaaaactcaagaacaagttgccagcaaagtagaaagcaagccagcagagcataagtcagagaaaccaagttaaagaaatgatctaaacatgaggaagacgtcagcatatcaaatgctgcaatgatgacaaatatgatggagatggagacacagccatttgagtatgataacatgggaagacgccaagctggagttggggaagtgaaacagaggtcaagaactggacatcatgagtagagaaaattccccttaaaaattctctgttgaagcgttcaaaaaattagacaaaaaagaaagaaaagaaaagggaaaaaaaggtaccaagatataagagtaactaaggggaatgtaaaattaatatcatgtaaatatttttgtttgttttttctttgtaaatttgaagtagaacatgatcatatttcaaaagcagaaggattgttttgaggaactgtaggaggtgagtgggaagaatgtgaggaggtgaatatagtagtctgagtaagaaatgatggtgggttggacaagcatggtaacagaggatgtggagcttaattgtcagcttctggatgtatgttaaaattagaagcaaaaacattttttaatgttttgcaaacgaaatgtgagagaaaaagggaggcaatggtaatagatatgacaactcatagaatatgacaacataggctttcaacaaatagatttttagcaagaatgtgtaaataaatgatttttccctaccaagactggcttttataactagcttagatacctctctaacttttggccctggatttccctattctgatggagagtgttttctctccttcattataaccctaaaatccaaatgcatattttagctgtttatggattaagagcataaagatttttgatcttatcttgtaatatccccttgattgctagaatgcctgaaggatatgtaataaaaataaataaataacaacaactctgtgttccaggccaacaaggcacataagacataaaaatggaatgtaaactcttgtcactgatttgaaaggaactgtcagttgtttgattctttaagtgattctgtcacacactggggacccccgtcagtgcagtttcactcctaaactacttttattaaaagtatgtatcatcatgtggccacaaaagcatgctatgacagaatagtaattttttctttctcttatcttcactatcttcatcatagaaaagtgttgtgtttctatggttgcaggaactaattaattctatatcaagcagatatattaatagaaaatactttttgggtattgaaaaacaaagttagtattttaacaaattttaggttgttttgttcttcccatcaacaaaatcccaccatttaaaagctattcctgtattattgttttcaacctctccttcttctgtgtttacagaggatctaggccagaatgtgtaacttctgccagattcccatgatgtggattatatccatctctacttctgagtgttttccagaatctctttcttattcccagtgtaatgccaagatgagatcaatcactggaatgtgccaattatcttaatatatgcctttgtcagaggtcaacagcgtgaagtgtgtcctctcttttatatacagagattgtggtgttgttagggatttttccctctttagaattggtgcattttaactgggatgttctatggacatatctgatgattacaattactatataggcctgattgttgttctgcctagaatagtctctatttttcatgcatgctctatccagtattgttatactttttaatggattcagcagatagtgttgctttattgtgaagaagcattttatcctcaaccttacatgacctagccttgtctactcttctagcattgtggaaagtagtgtttatttgctacaaacacttttgctgagtggagtgctttggttggtagctttttccattaagtgcagtactgtgaaaagctgcagctaatgcagacaagtgaggctttaacactctgcctgtctgggggatgttgctgatatctggacaaagcttgcactcagaaggtagtcttggtctgtttctttgcgtttagaccattgtgtaagctcaattcatagcatgcagttgttcttcacctgtgcactgttaagaagggtcctgtactttaggaacaggtaaaggttaactattagaatccacccagcacataataggatacagtgggatttgtggttcactttggccggttctatcaatatgagctcttaacttggagtgcaactgtgaaaagaagtactttagtcacaaagcaataggtagcatcaggtttgcccagcacaaagctgcaggtggttaacgatggtttgccacaccgctgttaatggtgctgctttagatcagtacaaccctgtaagtggtagcatttaaatccagcacaacaatgtaaaaggtggtgttttcatctcattcagaaagaccctggtgtggtaatcctcactttctagttgatttttgataggacacataggtgataatatggactgtttccatcattattctcatcaagtcacagatcattaaagacaacattaagtgaaataagccaggtacagaatgacaaacactgcatgatctcactcatatgtagaatcaattagttgatttcctgaaagtagagagtaggatagtggttaccagaggctggtaaggtagtggggagatggggggaccagaagagggtggtcaatgggtacaaagttagttagatgggaagaatgagtttcagtgttctgttacacactagggtgactatagcaaagaacaatgtactgtatatttcaagacagctagaatattttaaatgttgccactacaaaaaaaggtaaacgtttaaagtgattgatatggtaattacaccaatttggtcattatactttgtatatatgcactgaaacatcacagtgtaccccataaatatgtacaattattatgtgtcaattatatattaaaaaataaaataagggaaatatttttatgtatttccttagtaccaatgatttccttacccataactcagtctttgttttaagataagtggacttaatatgaaaatattctaaacctctcaaacatgtctcttttaaacaagtatcaacatgaaatattagtaaaaataataggtaaagtgcaatattaaaaagcgatttgtggaaaagcaaaggtaaatatgccacaggaatcaggaacatatgataagccataaagcacacagtttatgtatgaattaccagtgtttttctctaataccttattctaaataaagaaaaactaacaatacagaggctttgtcctcgatgtatgaatctcaatttttataatgctgatacttcactgaattcctccttctgccatatatatatatatatgactgtatatactattagttgcaagaaatgtgtgatctttataattaaaatcaataaatattgaactttagtgtggtgcatcatatccctcataagggtttaaggccttttaaagcctttgtgcttcaagtctaagtccctaaccagccacatcagtatcacttgggaacttgttagacatgcagaatcttaacccaatctacagactccgaaatttgcatttcagcaagatccccctgattcaagacacgctttaaagtttgaggatcactgatctaagagacccagataatcttttgggtcttgccttggtgaagatactttccaaggctcaggcatcacaatctaaattaaagcttttgcaggatagtcaagaagaccattactaaattttggagccacttcaggactttgctaaaaattacagagatcatttactttgtggctgagaaatgtcgtcctataccaaaagataggattaagatatgagtttaagtaacctggaatcctgctgaagagatgaattcagtcattgactatcctactaatagcatagtaagagcaaggagttctggaaactcagaagacaatatagatttttattcatagaaatgcaatgtgaagaaaagatcacagcaaactaccaagggctactatctcttatgtgaatctcttatttaacacacattcattcaatcagcattttgtaaacatctcataaacacccactaatcacagatttagggaaaaagctcataagcttcataaagaagtctgaagcaaattatcttaaagaaatgttttcttatatgtctttgcttcagaagtaaaattaacatagactgtatattagtatacttggtaccattacataaacatgtgggaggaaaaaacatatttgttccgattgaattatttgtgttggcagatagccaattctcttttcagaattccactactggaatacttgaagttgaatgaaatataaagcaacttctgtttgccaggctataaaactaaagatgtccatcaggccaaaggattcaaaactttataaatagacaataataatcgcaataaattatattgggttgaaataggcatacatataaaactaatatgcttgaaaaatgatgacctgttctggtattattattattaatcctgttatacatgggaagttttcttcaatcaatgattagcaagaaaaatgatcagcacttagtttttgagataagttttctttatacatctaattttttagaagctatacatagtattcattttcagatctcaacttcttgatgcgttagagttaggaaatggtttctgatccagaagactctcctactgttgtaagaggatatattaaacaataccaatcatatgattcatttgagtaacaaatataattgaatatttagcatcagatataagcaaatataaagctggagtctcacggaatgttcttggttctgaagcctcagcatgcctcacccctgtagcaagtcgtctacaagtgattctatcccaattagttaaattcagtccacctttgtatgctttcaattccttcaggtttgagtagtctctagtagaatagaggtaggaaaattaagctattttgaattcttctccttcctattgcacgttctaaactcccaaaatatttcaagcccgtccaaagagtagtgaggggagcttggaaggagtggaaactctatttatgtttaagactgaaaaaaaaaaatataggttgtttgtttagtgtgtgctcagttatctactggctctgactgtcagggtttttacccagcctgttttccggtactggttatatctagctgtttaattttaggtcctctgctttctcagatatcttatactaactcttttgtgttattataagactaacttgtggcacattaagtgttcctccagtgcccagctggccacacactccataacctcagggtaccaagaattctacagagaaatgattacttctacctcacattttcaatgagtaatcaccccacagctttctccggtatttttcacttctggatgccttcttggtgtggggccatggaagtggcaagcttatgaatgccatagcatctccttggttccttgggtgtgtgggaagcccagggattccttcccaggttgcatcagctacgcagaaatagtaagccctcattgacaccttccttcttgtaataccactctgtcatctctttttggcatttaccacaattctgagccattaggatgtgtctagagattctgttgattggaaaattccatgtagggaatatgataccagtttccttcacttgcaaatattcctacatattgtggggaggtatgtcaagaataacaatttttgctccctaaaactgtatccatgctacccccattcctcaggcgggaaccttttcttccttcctcccttctttccttcctttttcttagctttccttttcttttcttttcttttcttttcttttcttttcttttcttttcttttcttttcttttcttttctgtccctctctctctctctctctctctctctctctctctctctctctctccctctctctctctgtctccttccttccctccctctctccctcccttccttcctccctccctccctcccttccttccttccttcctttttcccttccttctttccttcccttcttccttcctttctttgtctctttgtccctttctttcatggcagaagccttttgcctccttaatatcttaagggagatttttgaagtttgccctttggaaaggtacttctttttaatttaggattaaaaagatagcttttttttttttctcatatgtgacctaacagtccagcacttccagtttagcactcagatgggaaggtgccagtgatagctgagggaagcaggaaagggcatatgtaggtgatatttcacatcatcacattatatttggccataaacttttgctaatattactgtggaactttaggacttttacagtagggaataatttatattttaatatgcaggaaaaacaccatttttcctgacaagcaatgacatatttcattttaatctatgataaatgttagttaaagtcaatttaaaaaatactgtaaagctcaaaattatgcctatgatatatatgtctttaataatgtcttttattaatgagataagattaggagaatttgatatgagagctaacatttaagaaaatcaaaattatgagtcatagtttcactttttaaagttgatttttgaaataatgtagatacatggttaattgattttaaagcagtgaaatattgtatcctcataatatacactgtgtctaaaaactacctgtaaatctcaatttgttacttggaggtgttttttttttaacataaaataagatatctacattctgaggcattgaggaaattggattttataaaataactacaataacccttttaagttgtttttttgaaaatgtctccacctttcataggttgcttattgacacatagcttgagaagagaacgattttctgagagatttttttaacattgatttagccatttagaaatggattttaacttgttattgatttgtgtattattttacatattatatctgtaagattttataagaaatcaaacatcctttaagatgccagttgcctgctaagttacttgtcattttgataatatttcggtgttatttccaaatagtgttctatgttgaagggcacagatgttattacattatgtattttaaagtaaagtgagttatactaattatatgtaaaacattttatcacatattaatctcccttcctcctgatataccaaggttaatatgttcacatccagaccaaattctttgtgcaaatgttcctcaaaatctttgggtggccatcatcaatgcatcaatgacataataagaatttattgaatgtttacaacatattgaatggtgtattatttgatttattaggcacagacactttgtcagaagtttaaaatccatataggaaaatgacagatttacaaaaagacatttaaaagtcaataaaactagatcattaatatttaatatattatacataaaagctataggaatgtggagaaaggaaaccaaatggggtcatctactttaaaagtaaagagaaaaaaacctttcctgatgacggcaggactgaagttgacttttaagaactgatacgaggatgaagagaaatgagtttaagggtacaaacaagggaggaggaataaactcagtcgttgatagcagagtaaaatggctacacttaacaaaaatgtgctgtacacttaacaaaaatgtgctgtgatggacaccctgagtaccctgattttttaatcactatgcattttatacctgtaacaaaattcctcatgtactccataaatttgcacaaatgaagaaaaaaactgacatgtaaatatattttctctaattttaaacctagtaaccaattacttgctatgtgagcaatataagaccagcgtagaaggttcatgttccctgctgaaataggatgttgtgagctaatgcaacttacataaaaattaatgtgacacatttaattatttgcataatgattattttacctcatgttaattaggtataaattgtaatgggtaagggaaaggccaaggactaactttgcccacttcagctgttgcctgagtacatctaggctaagaatacggtcaccctcaattcatcccagcttcccagggcaaactgcctctccttacccctaggataagtgttggactccggaggattggggtactgttctctgaagttctcagccagccctctacaactataataccagctcaataggaagatgggtagaagccagttttttcaaacaatttttatacaaggttatccaccagtgttggagcacctaaatgaggaattttagcttctcctttctttttttcacctttacatattaaaggagaaaatattctgtttaccatggaaatgaaaaataaataaacacataggatgacattttcaagaagctcaaaggtattttgggtccagttgatcattgttaatttctaagcatctcttcactgaatttcgttgacactgaacttctactgtatcaagcagcatttatatctactgcaaatgtaattggcttaggacccttctctccttgttttgtcttaaatatttatttactttttgtgtttgtttgtctctcctactaaacaacaaggatcacatataccttatttccctttttatctccaaagtttggcacttggaaggtttttaataagtatttgttaaataaatttctgatttcatctgccatctctctataaattatttccaaattacaacaaatgtgactttatttaatctttactcaagatgttgaaagtggaactcattgcttcttacattttctactttataacctcaaaaaatatagtcctttctgagggttctgtcttcccttctaagtccacttagtaaatcatcaaactttgttttctttccttcgggctgtcttggtaaacctctttttctttctacctgctagtcctagcagttaccacttcctgtcaatatttgtcatccctcaagcctcttctaaacattaataatagaaaagatccttaaatcacaccttctaaactttgcctagaaatatcccttgagagtaagaaaataatctaaattaacttgatattcaaagtactccacagggatttccaccacaacctcctcaaattcattatacataaactttttgacaaagcaaactttactaaacaacgaatttgtatttctccttctttggtgacaccacaccctaaaatttttctttccttaattctcatcctgctctgagactaatcaatcccacctcatctctgttctccaacgcccagtaggatactggcttcctctttaaattctgtgctgcctgctttctgagccagccacctggcaactagccataaaagactgtgtatgcttttttacatttagaggtatatgtcacacttctgcacataaagttactttgctcaatagtagagagtatgccatatacctttttaatcatatcactttacacactagcttatatctacaaaatgcataaccattttacctatatactatatatacctatatacctatatatacctacatactaacaaatgttttaaatattacatatacagagatatgcatacatatataataactgtgttatagaaattccaaattcatcagataaagtacaagttcttaagaatctaataatagatacaaatcatgtagattactgaagaggtgcagacaaaatagttaccatgagatagagacacacttttatacgaatatatattatgtatacataatatttgtgggggatataattttgtatattaacttctagtttctatcttgattatttactttattgaataataataataagaaacatatttttgatggagaatagaaatagatttagttagtagaaatagtacttgttaacttagtgaattcagaggagatattaaagaggaaagcgcagtgtttacattcatatgaactcaagtgttaggtgagccaagaacacagcagaagagccaataaaaggagcaaaaggttcattgacaattgtattgatcaggcacatttctggctacttcaattgagagcactacccatatattaatatagttataataaaaaacacatacaaatgaactgtggccatttaaggaaaacaacacatggtttggctcccactactttatgggaaggtctggggaggagtttgtgcaatgtaaaaaaaaaaaaatgtatcaaaaatcacagtgttgaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaatgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagcagaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccgatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcagcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggagttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtatgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacagtctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactagcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtgcaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaattaaagaggacacaaacaaatggaagaacattccatgctcatgggtaggaagaatcaatatcgtgaaaatggccatactgcccaaggtaatttacagattcaatgccatccccatcaagctaccaatgactttcttcaaagaattggaaaaaactactttaaagttcatatggaaccaaaaaagagcccgcatcaccaagtcaatcctaagccaaaagatcaaagctggagacatcacactacctgacttcaaactatactacaaggctacagtaaccaaaacagcatgttactggtacgaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggattccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaatgaaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcaccatcactggccatcagagaaatgcaaatcaaaaccactgtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaagggctataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaagatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaatcacagtgtttgtgaactcaaaacttctatactgccaatctcttttaaactactatattatctgctgaaaagtcataattttcaataaaatgtttaataaatatgtgttgtcccatctatgctgcatactaggaattggaagtccttttagttactggcagatgttacagcccactaccttgtttgcttgcccaggaaactgatgtcagcaagaatgatcaggtctacaaaacagtaagattagactaggtagtaagggcaatgcatgggttgaattttgtcttacaaggaaaacaatgttgaccttctaacctccctggtcagaatgtgactttatttggagattgggcctttacagaggtaatcaatgtaaaatgagttgatgagattgggacctaatccagtaagcctggtttccttataaaaagagaaaaattgtacacagaaacaaacatgcataaagtgaagatgatatgaagagacacagggagattaacatagtcatctacaagccaagtagagagaccccagatcagattttatcctcagagcctccagaactgtgagatgctaaacttgtgttgcttaagccactctatttgtggtccttcattacactagccctagtcagctattacaggcagtaaacttaatcatctagctttccattcttctagttcacatatgtatgtagattattatgacaagaacaatgtgtgtctatatgagttctaagtctcaatagttatgaatgttcattaagtggcgatcatagaactgtaggagtattaaaatctagcaatggacatagacattgcaatctgctctattaaaattaatttcaacacttattctcctttctcactgataaatatgcaccccattttcttaaacttgtcctttagctttgtatgccagtttcacatgactattcccaaatgtctccctttcttcctggaaatgacgtggttatgacagatgatccatatagcttagaatggatgttttggataaatgtataaaactccagttagaattcaaatttgtgttctcttgccttgtgcttatttatacttatggttgtttaaacttgtgttacaatactgatgtctctttgtatttgataaacaacaaaacagtagataaacaaggatatatagacccaaagagataagtggcaagcaattattctgagcaaggatacacagaccccaaaagatgagtggtaagcaattattctgagcatctgactaaggaagggctcctcataatactagtggttatgggtgatacctgtgcagatcagaaagaccccacctgtctaggttctttttcttttcataaggttatggctgatgcctaatgtaatcattaatgtattcagggagccgtggaacacacagaagtccaggaagacacaagtagaaaattaggaattgattattagggaaaagaggaaagaaacaggaattggttgatatgcctatcctggttctggctgatgaagcaggttcatcaggaacataggaacagattctcaggctcattcacttaggaactttagattattgagataagataggtatcatcatctctcagagccactgttgaggtgatgtttatattgggtagaagattatagtggaaagaatatagactttgaaaacagaaaaagaaacaatattagtgctctggctcaactgtttactgggtgtagttctttttgcaaggtccttagttttactcagtgccattttctttttcttagggttgttagaaagacagaggtaatagcagttaatggaaattcctcatgttctatgtgccaggcactatgtatagtgattcacatgtgttaccttattcaatccttataacatgtttataagataaattgcactgttaatccttttaatacaaatgaagaaatcgagattcaggtacttgttcaatgccacaaagacgatatatggtagagctttgtcagtctagttcaaaagtcaaaacacttaaccctgctttctaatgtgtgcaaaacacttagcataatgtatgacatacagaaggattaagcgaatattaagtccctttttcccaactaactctaaaatattcagactgtaggggttctattaatgggttctctagtctgccaataggaaaatatcactgatgtaatggcctatttgagtctggccctgatgcatcatattctatctggtgttatttctcagtcaggtatagattctcagtcccacaccaatatttaggaccaggactagacataacatgatgagaaataatgggatccaaatgatgaatttatggaggaaggtggatagggatcttagaacatattttgttttccagacagtgctttaatcagattcaaagaggtaaaattagtttgtaagaagtcgaactattacttcatgacatgggtctctgtaagagaggatggtgacatttatataattatcaggtgaaagcaaaacgtagtttcagtgcagacgggaaaattactacaagggaacatgtgaagaacatgtgatattaaaccgagcagggattccagtggccgcatgttaggaaatgataaaagttagatagatagctataatgaaaggtcgcaagcttagtttaggttgttttcattaaatattccaggtaatgggagcaagtgtgagagatttccccaaggtaagggtatagcagggatggaagaagcaatggtttcagaagcaaaagagaaatatttgttaaagagagcaataaataagcagcgctatgtgcttagaaaaaagcggggagtagacacacaatcctaagtacccaagtacgcgtgcacaccaaagcaaatcattgaaactgcttactaatgtagttgagccttcatggtattttgcactcaaggtgctggtgaatgatcacaaagtaaaggtctccattcacttttttaatgtgatgcaaatgatttcaaactttattttcaaggtgccaacaaagacagcttaggctgtcattttcctatagatgctgctgtaccttcatacatcaaaaagtttatttgaataattacatattgtccacattcttatcacaggagtttcctaacccataataactacatcaaaagaatactcagctacagcatagtgcatttcaatagtgtagtcagtaacagatacattctaaaagcttttcaaacccaccagtatttagagattcccccaaacagatataattcatctgagtaaaatatatacagctgtaatttatcaggttgactcaagggagataaatcttactaaagacgtacaattaatcacagtccttctagtatttatctggcggcttagaaaagttaaatgtaaaataagagtcagttcaaattctctaagtgtgcattaatagagtctgtggttgagtaaatacacagaggaaaatggatttgtgttcaatttaaagtaaactatatttaaatcagtagtcctattcaatagctatgaatttaccaatttcaactctttcatgattcatgtatattataatcaacccaagtagttgaaaaaggtggatggaggaatacacaatcttcactacaaaggtataatatgcttccttttttccgtcattctaatagcttcatttgaccaggaaacaaaattacatatggaaaagttgtcttaacagccaattggatagactggcagttttatacttttggataactttaagaaaggtctttgagaatagtacctgaacacctaacatggataatagaattctataatcctacaatgaaggaggtattttgtggaatttattccatatgggagagtaaaaagcagagttaacaggggttgtcatccatactcatgattgcattttgtatttttcaagggctcactagagccacaaccttcaaaatagatcaataacattactcagcaactgatatgtaggaggcacttgcaataagaatttctgagtctttatactaactctgtgaggtacatcatattatttagaccatccctacgaggaaactgagactcataattgttcaacggaatgttcaaaatcagaaagctactatattgcaaagtctgaccaggttttctgatctcaagactgatgtaatttctacttgagcaagatgcagcagaaagtgaatgggtttttggagtttggggtcagatgcacctgcttgaaaggctgtctcacttatcacctgtggatctaaggattattctcttaatccctctgaccccatcttcctcttacgtaatttaaattgagtaggtaaaaagttaattttttataaaagcttaaaaattacaccacctgtactatgtaaaaaccctattgaattcccttcctagtatattgaacatctattatagtacagtaattaaacccatattgtcttctttagtctttttaaaaacttttgatctggaggattctaagtctttcatgaaacaacaacgtaggagcctgagctctccaaagctgcctttacaaaattgaaaggttctctagtttctcaaaacacaggcattatcatttattaatctttttaacttcactttatgcattcaatgactcattccctttttcatataacatttcatatgattccctctttcaactatttattattctttatttgaaaggcactctgccagattcagaatgcactaagacaaaattctggccttggagatgtcaacactgttgtgaagtgaagttgacacaccagtagacagatgagtggtataaagaggagcgggcaaggaactgagagcactggacccagaaacaagaactgaggttagaaagccaatgcaagtgtggagcccagggaattggcaggtttcagagtcacttacactccaggaagtttggaagccaaatggcaaagtagagctagatttctggctcaaggtctttagtccacaaccacgatgctcacaggcaccatccatcattaaagaaaaaaagccaaaggaggatgatatggttaggctttgtgtccccacctgattctcatcttgaattgtaagcaccataatgcccacgtgtcaagaaagagaccaggtggaggtagttaaatcatgggggcggttttccccgtgctgttctctgccatggtgagttagctctcatgagatctgatggttttataaggggctcttcccggcttcgctgggcctgtcttcttcctgcagtcttggggagaagggtccttgcttctctttcgccttccgccatgtttgtgagtttttctgaggcctccccagccgtgctgaactgtgagtcaagtaaacctctttcctttataaattacccagtcttgggcagttctctatagcagcatgaaaatagacttatacaaaggacatagcaaaaagtaaagcgagaataaaatcaggcaagaagcaggcaataaagatagcagggataagaagagagagaaaaagtaccgataatatgcagcaaaaagattgaaattttaatctttattttggcattaaatataaaaaactaaaatccttatagtaaagtaatatcaggatgatatatttgacaaaataatgattcaccatttttattctgaggataatagatacttgcatttgtgatttgatggaattaaaaagcatccactaaataaagtttgtcagatgaaataaaatgaagggttatttgcacaaatatattttagaataaatatttttgatgtaaactgttaacttgtactttatgtttggctaattttagatgtttaaaatctagattttgctaaaaatattggaatgagtcaaaatgtttcctgaattgttttctgcattgttataactatagaataattataaaactctgttatagctatatagcatgtgaattatgtttccaaaagattagcaaagttttatatgtgtttgaaatattcattttctgtcagtcaaaataaacttgaaagtggaagaatttaggctaggcagctttaatcattttttatccaaatgtagcaacaagctgtaattgcattatttcatataggtattacactcctatgtgcttgtttttactatatcaattccaaatatctatgtgaagtattttcattcattgtttatttttgtcatgtacatacaatcatttctcaggtttccgaatcaagtcataataacagtgaaacaatccagagtaaagggaaaaataaacatggttttctcaagttcaagctttcatacttatattttgcttttttcattgcaccacgagtggagggatggtgggagccacaaatagctgacttaaggactccatctgttagcaaggcttgtctcagtggcttgagagatcacatacaccctttggctgtttaagggaagaaaaaggcactgaattggattagtgattcttagccttaggggttgggaggagttagagctgggaggtggaaaaggaatccagtatccactgtgcatctcccagttctctgggctttgctggatgtttctgcgacaatctgttacagatctttgctcctcgatccaggtgcttaaatgctaacaataaaaatttgtgttgtgaggctggaactgtggaactgatggaaagtaaccctattttcctagtccattgccttatttttttttattgtaccccacttgataaataacttggcagccaatagcaacacaaagcacaacctataaagaagtatcccctttttctgtaagcttataatccttacgatgaactttctcaagaacaaggtagaatttaagtttttcctaagaatggccgtactgttgtttatgtgtgtgtgtgcatgtgtgtgtaggtaggtagggagacagataaatatagaagtaatactatatctattttattatatatacctattatatataacaatataatggtatatatcataaatatataaaaatatatattatatagatataaaatgtgtatataagaaaatgtatcttgccgaggaagagtgaataagaaaaaatttaccaagattaattatttgataactaagaaatcataaatacttgaaactactacttatatttgttcttgtttcatgcaaatgagaggatctgcttcatttgttattgggctctaattgtacttttggcttttggacttctctaaactgactatttttaccatcaaaattacattgttttgttaatagatttttctttataaaatcacaagattagaatttaacttcaagttagtataaacccaactttttaagaagaatttttattgaaaatttactcaattattactgattttgtgaaacctaatccacaattttcctacctatatttggatgaatagtgatatcccttcttctgatgatgacagcttagctactgaaactgacttgttcttttgatttacttttcttttggggctttttgttttgaaataattaggaattcacaggaagttgccaagaatagtacagagaagtcctatgtacctttcaactagttacccctactggtattaatagtatgttgtgtaattatagtacaacatcacattcaggaaattgacattgataaaatccacacactttatttggattttacacatcttgttttttttttttaattttttttggagcagagtctcattctattgtccaggctggagagtagtggcatgatctcagctcactgaaacctccacatcttgcactcaagcgatcctcccacctcagcctcctgagtagctgggattaatttttgtgctttttgccgagacagggttttgccattttgttcaggctggtcttcaactcctgggctcaagtaatttgcactcctcggcctctcaatgtgttgggattacatgtgtaagccaccatgactggcctagatttcacatgttctacacctgttctgtatacacttctccatgtaagcattgtatgtttttagttctgtgcaactttatgacatttatagatttgtataagtcaaaatatagaattattctatcacctcaagaatcactcttgctacccttttataagtccgctctgttccctctacttcccctaacatttgccattccgatgtggcagtcactagaaataaaaataacacataagatatatcattaagaataataatagtctaagctctaaagtcagactacttgattctgcaccctggctttacacttcctgccatgtgactttgaacttaatctccttaaacatcagttctcttaactataatgtgagtatattataccatgtacttcatggtgttatgataaaataattctgataattcactatgatagaaattgctatgatgtttgtccctgactagagaattacccatatcctcgaccagattataagatatagatatgaatagaatatggatattttcttataatctagtagagaatgtggataataggctattatatagcagtttatatagcagtataagagttagtggaggttgctgtggcaaaacctatgaagaaatttaacttagaatttggggaaagaatgtgaggaagtgataaaaactgatatagatgatgatacagatgatgactacatgggaggtaaagaaggtgaaatatttttcacagagggtagaggctggaattaaggaaagcataggtcctttaaaaaactgtcaattatggcctggtgcagtggctcacgcctgtaatcccagcactttgggaggccgaggcgggtcgatgacctgaggtcaggagttcgagaccagcctggccaacatggcaaaaccctgtctctactaaaaatataaaaattagctgggcgtggtggcacgtgcctgtaatcccagctactcgggaggctgaggcaggagaattgcttgaacccaggaggtggaggttgcagtgagccaagattgtgccattgcactctagcctgggcaacagagtgagactccatctcaaacaaaacgtaacaaaaacaaaaacaaaaacctgtcaattgtttgatatggctgcaactcaaagattgagagagaaggaccttttaagatatgctaactagtctaatttccaacctgagaaccacgtagcatgatcagttcagatctgcatttctgaaaaaccatcctggctgcagtgtaagttattattgaaggggatggtgacaggtatgtttctttataaatgaaacatttataaagttctaagaaggataatagtacattttcaaggaatattagtgcagatgtttgttacatgatttttgatagacacaatggaggtgatttatccattatcttcccgaaggctctgacaaagtttccataaagcttggctatattagtccatagaaaagtgacacataaactttagtagagactaatgacaatttttctttgaaaagatactctaatctcttattttcctcaatgacaacttatgaaacattttagaacttgagatccctatagttctagaggagattttttcgatgtgcaaaggaatattgagatcaatatattaccaaattctgtgcattatccattggggagacagaagaacttaacacatgaagacaaaccaaaaggaagtatgaataaataaatgtataaaatgaaaccactgagacaaatgagtcggtaaaatgaatgttgaaagacaaattccacctaacagttcatctatagtgccctacacatagttttatcacagaatttattacctactttgttcattattggttaacattcccatgtcctgtactagagaacatattactcaacaacaaagcttttattttatctgtaattacagcccctaatacagtatctcacacaataaagtactcatagaactttaatgaaggagtggagtagtgactgaatggtgtcaaagtatgtgggggtaaatatttttaactatattcaaggatgagaattttaaaagaaatacctaaaacttggcagaggtctggaaagtggttttcaaatttttggtctcagtatacctttaccctcctaaaaattgtgtttacagggcttctattaagactatattagatgtcaaatttcagattataaaacatgtattgattcatttaaaacaaacacattaatataaaaattgttggaagttgaatagtcttcatgaaattcttataaactaaccgaaggcaggaacatggtgggtggaagcacttttattgctttcaactgggcaatgatttgatgtgccagtcattttacaaatatatggtaagtatattgattcatcacttgattaatcactcacagtttcatgtactaagcttcatcttctgtgtaatctacgtgaaagcagataaccaaatttaactgttctttgtcacctaccagaagaggaaattggtatcctaagaatttctatcttcagcacaaagtttcactcaatagatgttgccattattctttttcaatcatagtgatttactgaggaaaactacaatgattaagcctgtcatcagttcttctaatacatggacaataaataagataaacatataatctagttaacctgggactgttgctgattgtgtctgttataccaggctaatactttcactctcagaatatttgggttttctaattttccatgatgtgatgattatgcattgcatgcctgtaccaaaatatctcatttaccccataaataaatgcatacacctactatctgcaaaaattaaaaataaaaaatttaaagagaatatctaggtttagatattaaactgtttggctaacccagccataatgcacaactttgtcagaagttttattaatcaatgagtctgacttcacatgccaaatgcacatctagatcatgtagtgaataaaataatagacatttcaatgaaagcttataaaatcatttaatgtcaccaaatggaaaaaaaggtgcagaattgtcaatagaatgctttagttatattatcccatttgtcccattcaagatcaaaactgactccatcaaaattcttaaaatcagagttttttgttaaaacaaaaaaatcaaaaaactatattagattttaacaatgttatttatatatcctaaaatatttctaattggagatcaatagagcctatattaaattctaaatttttcacaaaagtttacaaatttaattctgagtttgtaaaatgtattataatagctcaatgagcaactaattaaacataatatatatttctgtctggtttttcgttatgtttctattgtggttaaatacatgtaacctaaaattgaccattttatgatttttaagtataaaattgcttccatttcacatttccatggagctgtcatcaccatctatctccagaaatttgttactttactgaagttctgcttgattgtgatttttaagagtagaaaaagtatttttatacttttttgcatcaaaacgagatttaaatacattactcaaaaaataaactataattttggaactctgtgatcgaggcctagtaaataagttggtttttctttagagtgagtcttaaagattaaaaagttctttcaggtcttacataaaatgtgaaatactaagaaacaaagctgtcgggcgtggtggctcaagcctgtaatcccagcactttgggaggccgaggcgggcggatcacaaggtcaggagatcaagaccatcctggctaacacgctgaaaccctgtctctactaaaaatacaaaaaattagccgggcatggtggcgggcgcctgtagtcccagctactcggaaggctgaggcaggagaatggcgtgaacccgggaggcggagcttgcagtgagccgagatcgtgccactgcactccagcctgggcgacagagcaagactccgtctcaaaaaaaaaaaacaaaaaacaaagcttagatcagttgagggctctaagcaatgttaatctataattacttttcattaaacttaaattttaatatttttataagtgcttaaagtaaatctgcaggatacatattggttaagagacgaaaagtatttggctgcagaagcttgccacttttcagcgttaagcttgtcctcaaggctgagtataattattcccagttgtgttcattgttattttatccataatgagttccagaacctctttttaatatttttaacctcgtctttatctctaaatgtacatttaaaaatatcttaatagtatacaattaaataaaaagtaaacattcattgccagcatataatatttaattataaatattgcaaattcttatgtctttcatttgacatttcagtagtattttgctttctgagtagagttaatgatttagcaggatcttaaaactctttttttcttttcttttttttttttttctttttgctctttaactacatgaaaagtaaaatgaataaataagctatgcctaaaatagttaactgcatgcctggttttaaaggctgatggccaagcagttagtatcagcagaaatcccaggaaaggtaacaagttgcatatcaaatagtgggcatagaaaatcaaacgatggaaagctaggcccccgctcccccccggccatcagcagcacacaattttatagtggttttcattttgaaaaaaataggggactctcaaaaatcagaaagcaggttcctgagactgtgagttatcaagatataaaactgtgaaatcatcaaagagttgaaagtaaatatacaccaatagagacagaaaaataaaaactttagagaaatttaagcatctaactatacttagaattttttttctttacattttctaataaaataattcaatggatacttgtatgcctattttttttcattcaaacaatgtgaggcactatgttaggcaaaaggaatacaaataacacacataaagtctacctgcatggagtacggcgtctgtggtagaacgggcaactataatacaaagatacttattgtaagggccctgataggagtaggcacaggatactatggagcatgtaggattggaaccattgttcagtcatggccagtgatgaaagactacccaaaagcattgcatttaagttgaggtgttaaattcgagttaaccagacagagcagaaatgagaaaagcaatcagaggtaatgatgtggaaaagcctggagtcaggagatggctaaattggagtcaaaaaacaaataagcaaaaccagtgtacttgactgatgaatataaccagattgtaaattttaagttacacacaaaaatatatcaaaaaaggatattttttcatatttaaagtgaattactgtatagaaagatgccaagattattaaaacagctacaagtagtgagaacactgttttcatttcaagaataatatatctttataatacaaaaatagtaaatattaaaatatttgcttgcgatatttgggataatttttgtactgctctataatctatcacgagggctttgagcaggtgaacattactcctaatttttgcattggtaatatttttcattggtaatagaacaacatatgaatttgttcataatatttaagattgcaactgtaacatttctttattaaccttcttttagtaggcaagttatcctgaaaattagaaaagttgatgagcacacatgcgaaattgtcttcccagcactcttatatttgcccacataagtctaattgaaaagttagaacatttaccagtgagtatagaattatatggcatggttctatagcatgcctttaagcagaaatgttgaccacaatttttttgttggcactgctatccactgaccatttcctaaatagctgactgaattctctaacatcatggataaaatctgactcgttttatctggaacactttagagctacacacatttgggtggttaatatctaattgagtataagcccttacacctccccataccaaggcagccattgagcacatcttctatctgttgcctagtacttggctaagtgaaaatcctttttcatttacataactttttcattcacatgtagaattcagcaagttaataactgtatatttgcaatagcaggtgactgttcccctaattttgttgtatcatatattccaacgatttaaaataaaatttacaacacgtggctgtcttaaatgtaaacaagcttgcaatcaatttggtttaatgaaattaaagccctatagtatgactaaagagaagaaagcttttggttctttcctgaatttgtaatggaaacaactgttttggtctaaagagataatgaaaaacatgattgtgccaaaactctaggaaaagatttattcggtattagtcaacaaagtagaaaattctgattatctggggaagattatagagactgcattttaaagtggtgtggtttttcaggtactttatattgctcttgtgtgttaaggtgtggaataggatcaatcactttttcaatgaaaggaagatttaagcatagatgctgagccaacttctctgagcttttagtagaatgctaattaacagagatggtaatctaaatttcattgtattcttaaatttgggaacaggtgttatagcattgattattcaatgaaaaggcccgttccctggaaaggttatacacatgacttttgctaacttgttaattgatttttccccatggtattctgtttcacctttttattagaaaactgaaaaaaaaagtgccaagtgaacctgcatgctctttttcaaaaaattttaatggctctccaaacataaccctccaacattactgggaccctacacagtcctctcgctttaactttaaattagtgtctgtctcaattagaatgactctacattctgtaaaaatcctcgggcttctcttactcttgaaagtagcattgccttctttgttatagatagcagtacattgttcatttttttaagattcatttcaatgtaacctctgtttcatgaaggttttcctgataatccccctcatcctagtgatgtcttctgagttacaagtgtccttggtacctatttaccgcttaaaattatattagttagggtcttttcagctgtaggtgataaaacctcactaaaaataatttatgccacaaattatgtggggagttattaacccaagttagtgggaagttcaaggagtagcaataacttaagctcaactggatcccagggctcaaattatatggtcaagatactatctttgactaagttttgcttttctttgcatgaacttggctctcagccacttcatccccagtaggatggcactgatagtcaacagtcttgccaagcttacattcttaggaggtagcatccattttcccaaatatttcaacagtgtatctaagaaaattgctgattacattagcatattttgacttacataacctctccacagataaattactgtgacaaagaaaatgaagaaggccatattctcacccacaaacccagggtctcgggtctaatccaagaatgtcatatgagttgagaaaagggaggcatagttccataaaagaaatctcaactagttttaccaacaaacagtagtggagaaaaagaatgtttagcagagaaagatacaaaaaataaaaaaaaaaagataaaagctgtgcactaaggtatctgtatttatttgtactgatatatactatttgatttataaattgatattggggtgcgtagtaacctggatagctatcaaaacctttgtttctgacatacatcatttaaataactgtagttctcatttaaaaatactgtttaatgaagatgttacagaaacttgtaaattaagggtgagaagttgatattctgtcttcagttgttaactttgttgatcaaaagataaaattgtatctcaatatactaagaactaaagaaaagttaacagggaaatttgatggtaatcttctgaaccctcatttggtttatcagcatgtctcctcataggcttattctcattacaatagtttaatgaatgtattttgtactgtgtccttaggaatactgagtggtctttgaaagcagaacctatttctcggtgcccttctgtgtatgcattgcctagatcagtaccttatctatataatagttgttttaattgttgatccttttaaaagtgaaacattttcaaataaaagtacggcctgtattaaaggattattttgtttacttctgccttaagtagtctcactgttgacatttgagcagtttagaagctgtccttctaattggctagtcatttcttagctactgataatttacaagttgcatttgttttttgagctcacttcaaataatgtttgagtttctaggtaagtgttaatcctccttatcagatgaggtggtgggttttgagagtgaacataaaatttgagaaaaataacaatttttgaccatatattgccagaacaagtttttgctttagtcaatttagttgactaaagttcattttagctttcttttctcattttcaatagatagctgtaacattcttatatatttgagaaagcataacatggtgaaatccattctgagaagcaccctgccacaggcagcacggttattaagctcttggcaaatgtgactgatacatgtctgatggtgatacactgttgcatgtacacaaacttcatctttctccaaatatagctcattgcttctgcaaatacaggccatcagtcaggaagatagaatatggagatggtttaggaacccatcacccctaaagggagaatgtagaaaaacagctcaaacccttgcctgctagtgctgacaccatggtgtttgtttcacttgacgtgatcagagagcattaccagttacctgagatgctgttttgtttaccatgtggtgatttccatttcattctgcctagtatctagtccagtgttggacacatggcagaagagtaaataattgttccagaattaatgaaagattatctattggttaaagtcaccctgcaggacaggaaatagattaagtgcctttttcttttatactcatctgctattgaatttcacagtgatctattgtttgtcccaaatccatttcttgtttggcttttctactgaatgatgagaattaactttgtggaagaatgcaggtgggtgctatgagtgagcaaacaacttttgttacctctaagtcactaagcctcaaagcaattgtgtttcagagggataaaaaaacacattatttggaaagtcatgagtctaaatagaagagtaacatcaccagtaacataattctttccccgtcagtggaggttctactaatactggttatttcctagtatatctgaattatttttaaatgtatattctgtgagattcaatacagaaaaaggaaatgtcaattttcattattgtaacaactgtaccaaagggtttcttaattaatgaccaaaatacattaagatatgtacatattttatctaatcattagaagtcattttcatttctccagaaatttaacagctattaataataaatgactatggaagtacatcattaaatcttataaagaccttttttctgtacatacatcccatcacttttcttcaggtgaggtaatgaaactattgactcctttatcatattcaattaaaaagatattgattgagagagtttcatgaaagatactttttagatatttcacgatgacgtaagaagtagaaagatgagtgaaatatgatctttatgtcaagtctcatgagctcatgataagggcaagattatatatatatatatatatatatacacacacacacacacacacataaatctaatgaaatttaggattaatatgtattctcaaaacacataaaaggagatcaaagcagggaaatatgtaaaatgggagcagaaagaggccaacttcatgaaattatgagggaggccgtgaaggacacacagagatgtgttaaggggtgaatgggagaatggagagaagcgctgtagaaattgcaggaagaaggagtcatgcaagcgaagacatgcacagagggtgacattgagcccggctctatggatggggattaattcagcctgatggaaacatagattttctgtaggggactaatgagaattgacagtggaaaggttgcttggatccaaattgttcagtgcctccgacttggtaaagaggttttaagaaagttggaacatgagaaactgttttttaacatcacggaataatagaaggacactttaaagactgttttagtggaagtattcagagtatttatagattttttttgccttgttcatttagtttgatgcagctgaaatgcctcttctttacatctctgtttctccaaatcctgcctatccctcaagtccagtgcaaatgttgcccttcttcaagaagtcttctattgccccaccagactgaaggaatcactgctagagattgcagtgctggctttctgcatgtaattgcaaacatttttagtatgtcattttattttttttgtataaaatactatatatgaggataaagatctatgtaatctaaaacatgaatcgctgacattttaagggagacctagagagtactacgctgttaagaacatactgtgtatttcaaagtagttagaagagaaaacttgaaatattcacaacacagtgaaacgatactcaaggtgacagatgccccaaatactgacttgatcattatacattctatgcatacagaaatgtatgttcttttagaaagtattcctgtataattgcacaatgatcaagagggtgaagaaaatggtaaattaaagtaccatttctctgctatattatccttagtcagctcagcctcattgttcaattttccgtagtttccttttctccatgtagtttcagatgagaatctgccaagaaacattcaaggcttggaagggagaagtggagaggttagttgcagaaagattggtggatagaagcctgtcccctgagaggctcgctgttcgtgttgcaggcagcgaaaattgttggtgcccacactccatgagattgccaagatttgtcactgaccatgtgaatgactagattctagcagctatatccctcgccttactttcttagcccttccaacagtttttaaagcctctgtttctccatattgaacatttccaaactgaactacctaaagtggcttgtagcttttatttttcttaatgaaaatttgactgatacaacttctgttacaaaaactattcttaccatagttgaaggtttatctgatgagtaataccaaacatgattaatgttacgaaatggaaaaatatggtttttaatgtgagaaaaaactacaccgcattaaaatagtaaacctcagttcctgctacaagtgaaaataatttaaaaataacacttcaaggttatcatgtagactataaccccagtggggaatttagaagaaatatgtgtctcagaattaatttattatacgagtaaggagaatgagctggttacacacccactcaagtattaaaataagctcaggtggcattaattaccaagcactgccctaaaaatgtagttggaggccagaaaaagctcttatgcacttgttggtctttaatatctgggccagccaggcattgaaaggacaagatctgaaaggatataaatagagcactgacaagtcttgtgcagacaggttaaatgttttatttatctcaggattccccatatcatgcagattattcccctgttcctaggtttgttgaccattcaccaaaataaaattgtgtatcagatgggtaacttggctactagatcagggaagcacattcagctacaaattgtaggcatttcattcttatttgtgttggattactttgacttaaactgaacatgtttggtagaatgaacccctggatttaatcaggcaaaagtcttaatgtattcgttggttacacaaggtctcttgcagccttaaaaggagcaattagagtattcatttcagcatcaacttggttcaaattgcagacaaattgaagtctaatttattctataatttatcatcattatcactcacaatgtaactaggaaacttagtagtagtatttttagggtaaacatttgacccatctagaaatttcattacctatgcattgtattttctttaactgtttttaagagacaacactgcctaaaaggaaagacaactctagattgaaacaccacatctttaatgaaaacataacctcacttatttctggtacttgggaaattatgccagtgttaaagtaaagcatctgttattcctgagatcatgttgcattatttaatcaacctccaatgctttgtaaaactggtctcccagttggctgcaatgtaccgtgtattatatacaggtattaattcaaccaaaacgtgtataaaaatctgaattatgtctatctacacacacttccattggccaagaaacagaaagctaaataatgacacacacacacacacacacacacacacacacacacacacagaaagagataaataatatttatcaacattgaatataacagctcataaatcttataggtaagaaaatatttagagagctaacaaagggcacagggaaataaactggcatcaattacttctgtttgatttttttcctactttgtcagggaaatggaattgcatctaaataatggccttcccttatattttagaagcaaagttgtttacaaacctcaaacatgtaaaagctataaccagttcatttataaataatttgctgttaagataattgagatagtggcacttgcttgtgagagcattattggaaaaaatctggtagactcagcacatattcacaagtacaaattaaatactaaaacaaacaaaaagtcaacttttaaaattattaactgctcctgaaatttgccttactaaatactcacagaaaaaacaataaatatgttgggtcaatgccagaaattacaggcctactaatgaaaagaatgtaaagcttattactgttagcatagtaagaggcaaaaatggtgatgataatttaatttattttgtagccacaaaattattatataaaagattgaattaaggcattttggattgttcctttgctttagaaacttcagataagaaataactaatttaaaacaatgatatttcactaggtggtgagattttattcttgtctctatttggactagagtcccaaagtttaaaaagtaatttcctctaaattctaaaaaccattgtttgaggtctttactcttctggaacagacattttctcaggatctattaagaaatggcccaaatggtcttattatcctacagttatctatgaatatcttaacatccttgttcctagtctatacagttaaataagtattagcatattaaggggataagataaaggaatgatcaggggtacaggatttatggggaaagtatattaaaaataaaaattattagatttttctcatcatcaaaaaattaacaattgatgtacatataattttaaaaaaccttaattcttactactcgatgtttatgtaaatattctgatgacacaattatacagagcctattgctaggttccgtaaaaatataaaatgagatactcaattcatttcttagcattttgtatatataattacagtcaaataaatgttagagtggagactgatttgtattatattttaatatggtaatatttgatataaaatataaaaatacttgatataaaatatttgataaaaataatacttgatataaaatatttatgctcagattattattaaataaaaacattccaatagatatatccaaattagttttaatttaattgaagtgaattgatgatacgcatggatttacacggtgggagatataaaaacaaaacaattggtaactcccatgctagactgaaaaaaatcaagtgatttaaatgcctatcagtaggtatataattaaataaattacgataaaataattcattaaaaataaagatggatttgtactgattaaaaataataattgcaaaaatatttggttttaagacaaatttcaaaatgtactttgcttatggatgtgtgtgtgtatatacatatatatatatatatatatatgtatatacacataatatggttggaaagatcatttaaaaagttaacagtaattgcctctggagagcaattttcaggacatcagggtggcagggtttataaggagactttcctttagtctaatctctcctatgttgatttcttctaatcatgtgaacatggtttacattaattttctgaccatggattcataggtgactcaaatgattacattagctgtctttcaccaccccgcacccccatagcaactatcatgcctcaccccccgtttcacacagtccaggcacatggccacatgtgataaagaacacaaatttctcaagacaaaaatcttcctatttcttagtcacaattcaggtctgcttttaatatttaactattaattctacgtgctggagttcgcaatttacttcaacacattctctgtccggggtatacccttgggcctcagttatttgtggattagacagtagaaactttatatcaagtccttgaccaatctcttaattatttaccatgtcaaagattcttcagtgttgttgcttttattgcacccttgtggaccatttgctaaaaagcaatttgctattttggagataaattagctttattacttcctgttcatgcacattgaaaagcaccgtggactgttattttccctaactcatccctcatcctcagcatcaatgcatctattaaatctaaaggcgtttatttttcacatcataaaaaggtagagttaggttatttgtcctgactaaaaacacaaaatacttttgctaatttatcctgcagagttgctgggttttatttccatgaaattaatcatgacaaaccaacaagcaaagaatcacactgagtgcttttcagtttattgaaatacagtgttagtttattctttatgtatatggagtataagattttgagatttaatactgtactaaatttctagaaacatagaattattaaaacatttgatttttaataagagataatggatacaaatattcctcttaccttaaataactttgatgtgtttcagacccatataatgagccatttatgtacagtgtaatatcaacctgtatagtaatagcattagtaaaatacagagtgcactttcagggtacttaacaaactgcttgaattagtaaagaacgaaatcaataataatataaatgtttaattataaaaacattattgaaaataattataatgctgaaaattgtagttaaaccaaactgtttattatagactaaagtttattgtattctatttatttccttttaattcagttgtatttacttttttgtgataaatgttacattgctaagcagtagtaagtttttagtaatatcatgtcagtcatttcaaatacttttttttttactttgttaaaataaagctgactaattggtattgtcacactcattgggaaaacacacacaaagacacacacatacaaactgaggttcagagaagttaaatgatttgtataagataacagcaagtaactggaatctagtagtctccccttatcagcagttttgctttctgtggttgtagttacctgtggttacttgtggtctgaaaataggtgaatacaatacaagtaggtattttgagagacagaccacattcgtgtaacttttattacagtatcttgttataattgttctagttttattgtcagttattgttgacttcttactgtacctaacttataaattaaactttatcataggaagaacatatgtataggaagaaacatagtaatatagaaggtttggtgcatccatggtttcaggtatcccctgggggacttggaaggtataccctgcgaataagtggggatactgtatctgaaatacaaactaagatttgtctgattatacaaaccatcttaaaattgtcttacaatttagtgctaaaatgtaataatgtacaaatatgtacatgtaatctaatgtagctaaatatgttaattgaaataaaattatatactgtaaatgttcatagtaattatcattaaatttgtaataatgcaagtatctttatagcttttctcaactgaactgcaactagagttctgtgattatgcttagggtaaacatgtcatttttcccatttcacagctaaagtacaggggttggaacagtcagccaaggtgaggatgattttgaatgactccaaaggcccaggattacacagacagaaatctaagggttgtgtcttactagggagtcctctactcttgaaatccttttctttctttacttgtaccccaaattgatttttactctaatactgcaggcttgtggcctgaactcatggctttcaacttcacaaaattgaaagtagagaatatttaaaaattagtttcccacatatatttaacagtgttattaaccactgaatcagtagagtctagatctaaatggtatagatccagtaatttttaatgttcccattatgtatagagaaaagtctgagatgttgttttgcattgattggcattagattttcagatttgaaaagtttttggggtaaattattcagtttccatatattcagaagagttttgttgaaaccatccaaatgtccttaattacttaaggtatcttcttgggggggttacaaaaatagtcatctttgagttctgagacaaaatactgcaaaataatggatttattcattatctgaacggaaatgtaactgtttgcatgctaaaaagatacaccctctccctaagttagttcacaatttttaggcatgaaggactgtaaaagtatgagtcaggtcatggtgaaatggggaatcagctcccatttgaaacctccagaaataactctcctccaagtaagtggctacagaattcttaaaaagaggaaagaactttcagtttctcagtggccattttttattgcataataaacctgacaagaatagacttctattcctagaattgtcaatttgtcatatctgatgagcacaaagtgtcctatttttaaactgacgcatacaggccttgctcctgctatgcctgcattgtatagtaatggcatatttagaaatactgtacaatagaaatatttctgctaattttcagatctaaaaaggagacatttctcacatgtctaataaagagcaaggctctactgaatattagtcagaaaaatttgcccagtatcattggatattgcgatacatatttatcaagcagcttctacaagcaagatcatctaccaggtacttcatactgaaaggtgacataagacaaaataaatatttatcaagcagcttctacaagcaagatcatctaccaggtacttcatactgaaaggtggcataagacaaaacaacaacagtaaaacacccagaaaagtaaaccatttaatagagatataccctcggtgctataaagccacaaaagaaaagcccattgctttctcctgatcaggaaaagtgcagcaatattagggtttatgtttgtttgtttgtttaaggtttcacataagatgtgtagagcttttgaaatactgtgagaaaacatgggcaaagtgagctaggcaagaagcatctaaaatgcacataggcctggaaggagcatgacccacatgggagacaagaatttcaggagagagtacaggacacgtgtgccagcgggctgcagatcaggtcgaagagaaacgtgaggtccagatacagcaaaagtttaatactgcttgagaggttagcatacactttgtctcattccaaagcaataaagagtgttaagtaaggaagagatcctcgggtttgtgtttagaaaagttaggcagtaatatgcaggatgtattggaagtggacttgggagattaaaagcaagaaaatagtgttagaaagtagtttgcatggttgaagaaaaagttgtaagggctaaattcaaaacctgattaacgtctacacttcatgggtatttaaagataaatgtgtacaactttaaatgggataaaataaccagagaagaagagggaacagtgatgaaagtcaagggatgagggagatttaaggaaatacagtgttcaccagtgcacatattactaacaagtcaaattagatgaaagtggacaggctttattggatttagaaattctgaaggtgtttgattattgctggcaaaatttcgggggaaaggtagagagggaagactgactgcagtgggcacgaacggtgtctgaaggttgtttctatgaataagatatactaaaatatttacttgtattttaatcttggccctgatacttagtacttgattctgtctatttaaatggaaatatggttgaattagactatgctaatgttcctgttagtctctcttagtctaatctatacactactcctcagataagcatctgaaagcaccctccctctgtcaaacaccttacatttgtgaatgtattcctaaggattaggaactctgcccagtctcttctctgtcactccactttgtactttccacagtcagtattgggcaagaacggagatggattggaacagaagtaggcaagatgacagctctcctggtgaaaggtgacccgtgtcatcaatgtccctccacccatagcacctgtttgttccaccctattgtctagcaagagacagatatggaactctcaccggtgtaattaacgtaaggtttgctcattgcaatgaaaataggaaatagataaatagaagacaaaatatatactaatatctgtatacatttgtggggaataaagaaggaatgcttctcacaccattaatgtttattcctggacagaagtggaaatggtgtgggtttgactagaaagagaagtcttttacttttcacttgctataattgcttttctcctttttaattttcagtatttttcaaacaaaatcttcaacatgtaggttacttatgttgatatataaatgtgaaaattacagagtgttctgaatcaaaagcatgaaaatcagcaattgcaaacttgggagatcagcacaccctcatggaaatctcagtttagctattttttgcttatgcgagtcagttaaattctttgaggcccagtttctttaagatgaggaaaatgttaacaaaatttcacagttcctttaaaattagagattacatatttttaaacagcctggacagcgtagagcaggagcttagcaaatggtagatgataaaattggaaatcctagcagaagtaataaaacaaattgagcctactacatatgactgctctactccctacctttctgcttgccaattcctgagtcgaggaaggtttttgtgttctgagtagtaacctctgcagggaatttgaatcccagggatgtggtggcatttttatttttacaaatatatttatcagctatgtgtataggtgtgaaaacaaagaggagagggagaaatgtcctttaaatgacagcatccctagggaaaatgacaagctcatggtaggtaaataaattatgtttatgtatttgtatgttcatgtcagttttgttactattttcaagctggcatttgggggttcacagctttcagtttattacagtcactttatttataaaagtataaaacccaggaaaaaatttcccaagtggtgcactaaaccagtactctgaagcaagaaaaagcttttgtctgctttctttgactatttgcaatggaaaatgaatttgaaaaaagaattagaagcctttttacatggataaaatttaattaaaatttatttttagtctcttgaatatgcttcattcttaaaaaaggactgaagtagaaaactatataactaggaaagcatttttttttaatgttctgtaaattcctgacctaggaaaatagatacccatatgcatataccaatggacacttcataaatcatctaagaacaaaaaagaatgggaattctacttttatctttaactatttttacattttcagtactatagttatatgggggagattgggtggcctagccaaataattacccaatgaaagtgaaaaagcatcttccctaatatatgccaagatatttagacatagtttgacatgagcatagaggaaagttgttaatcaaatgagttctttttttttttctttttttttgttgttgttgtttgcaatttgctcttcagatccactttccacccttttctgttctggcctatcagtgttctaggaggctgggtctttgtcctgtaccaatgacctttcttttccttttcctccaggttttatttgggttgatgctatcagtgacaggagtagaagattgaagggcaaaagaaatgtaggattagaatattagttccctggtgtcctccagaccaagtcactgttagttgcctgtgttcttctactaaaggccaaaacttgatcaggcaactcttcatgtagctgtattttccagcatagtaacctgttaggttaaaaagtaaatgactcagctgggcgcggtggctcatacctgtaatctcagcactttgggaggccaaggtggggggatggacgagatcaggagatcaggacgatcctggccaacatggtgaaacccgtctctactaaaaatacaaaaattagctgggcatggcggcacatgcctgtaatcccagctattggggaggctgaggcaggagaatcacttgagcccaggaggcagaggttgcagtgagcgaagatcatgccactgcactccagcctggtgacagagctaactttgtctcaaaaaaaaaaaaaaaaaaaaaaaaaaaaaaagtaaatgactctgtattgcagaataggcactgtcactttgatggtttcctatattctagtatctctttggcaaagtgtcctattatttaatgataataatcattaaaatgtaattgttttctaccttaccctgtccaaattctgagacagtttatagtagcaaaattttagaaacaacttaaaccattagctatgagtaaagtatgctaagcctcataaataatatatagccatatagaataccttatagcatataaatgaataaagtagatgtacacagatcaacatggatgaatcacaatgtcatgatatcaaaggaaaaaaattagcgttgtatatagcataatacttgtataaattgaataaacataagcaaacacatcacatggcaatcatgtacatgtatacatagagggtgaattgggagaactcacatccagctcatcttggagaatttcaggtggttgatgaagactgtgccaattactaaaaaataaagttacatataggggttactgaaaaataattttaaaaatcagtatttttttaagtagtaggaaatgggcatttctcatattctttttagtttgtttttaaacttctcacgttttttgagtatattcacataatgtcaaaaatagaaaaggtgctcaaaaatatataactatttattttactttaaaattaactattatatcagtcttgcctttacatttcctatttgtctctacttattacttatatataatattatctacatattattttatacatattcaaaagactccattttatattcatagctctggttttaatcctcctgtgtctctgagccagcctttcagcatttcctctctttagcctagccttcatgttaagtgttaagagggctcttgtaggttgtttttatttttggtttatagtcatgcatctcataatgatgtttcagtcaatggtggaccacatatgtaacagtggtcccttaagattattgtatttgtttttacactgctgataaagacatacctgaaactgagaaacaaacaaaggtttaattggacttacagttccacgtaccttgtgaggcctcagaatcttggcgggaggtgaaaggttctttgtacatggtggtggcaagagaaaatgaggaagcaaaagcagaaatccctaataaacccactgaatctcatgagacttactatcatgagactagcacgggaaagaccagcccccatgattcatttgacctcccactgggtcccttccacaacatgtgggaattctgggagataaaattcaagttgagatttgaatggggacacagccaaaccatatcattctgccctgacccctccaaacctcatgtccttgcgtttcaaaaccagtcatgccttctcaacagtcccccaaactctcgactcatttgggcattaacccaaaagtccaaagtccaaagtctcatctgagtcaagtctcatcttaactcttctgcctatgagcctgtaaaatcaaaagcaaactagttacttcctagatacaatggtggtacaggcaattgggtaaatataaccattcccaacgggagaaatcggctaaaacaaaggggttttcagggtccatgcaagtccaaaatccagcagggcagtccaattttaaagctccaaaatgatctcctttgactccatatctcatacccaggttacactgatgtaagagatgggttcccatgatcttggccctgtggctttccagggtacagcctccctcccagctgctttcacgggctgcgtttgagtgtctgtggcttttccaggtgcatggtgcaagccatcagtggatctactgttctggggtctggaagatggtggccctcttctcacaactctactaggcagtgccccagtagggactttgtgaaggggctccaaccccacatttccatctgtactgccctagaagagattctcgtgaggtccctgtccctgcagcaaacttttgcctgtgcatccaagagtttccatatatcttctgaaatctaggcaaaggttcccaaacctcaattcttgacttctgtgtaccttcaggctcaagaccacgtggacactgccaaggcttggggcttccaccctctgaagccacagcctgagctgtacattggccttttcagccacacctggagtggctgggacacagagcaccaagtcccttggctgcacacaacacagagaccctgggcctggcccatgaaaccactttttcctcctgggcctctgggcctgtggtgtgaggaatggccgtgaagctctctgacatggcctggagatattttccccatagtcttgaggatgaacattaggctgcttggtacttatgcaaatttttgcagccagcttaaatttcttcccagaaaatgggtttttattttctattgcatagtcaggctgcaaattttccaaacttgtatgctctgcttcccttataaaacaatgtatttaacagcacccaagtcacctttatgtttttttttttttttttttttttgagacggagttttatcttgcttcccaggctggagtgcaatggtgcaatctcggctcactgaggcctctgcctcctgggttcaagcgattcccctgcctcagcctcccaagtagctgagattacaggcatgagccactacgcccagctaattttttgtatttagtggagatgaggtttcaccatgttggtcaggctggtctgaaacaccagacctcaggtgatccacccacctcagcctcccaaagtgctgggattaccggtgtgagccaccacgtcagtcccaagtcagcttttgaatgctttgttgcttagaaatttcttctgccagataccctaaatcatctctctcaagttcaaagttccacaaatctctagggcagggacaaaatgccgccagtctctttgctaaaatgttaccaagattcacctctgcttcagctcccaggaagtttctcatctccatctgagaccacctcagcctcgattttattgttcatattactatcagcattttggacaaagccactcaacaagtctctaagaagttccaaactctcccacattttcctgtcttctgagccctccaaactgttcccagttctgcctgtcacccatttccaaaattgcttccatgtttttgggtatcttttcagcaaggcccctctctactggtaccgatacactgtattagtttgttttcaccctgctgataaattcatatacaaaactgggaaacaaaaatttaattggacttatagttccatatgcctggcaaggcctctgaattatggtgggaggcaaaagagaaaatgaggaagaagcaaaagcggaaacccctgataaacccatcagatctcatgtgacttattcactaccatgagaatagcaagggaaagaccagcccccatgattcaattacctcctgctgggtcccttcctcaacgcttgggaattctgggagataaaattccaattgagatttgaatggggacacagccaaatcatgtcaattataatactatatttttagtgtacttttctatgttttaattaccattgtgttataattgcctacagtattctacacagtaatgcacatgctgtccaggtctttagcctagaagcaataggctataccatacctatagtctaagtatgtagtaagctgtactacctaggtttgtgtaagtatactctgatatttgcacaataaaattgcctgacagcacatttctcagaatgtatcccccttgttaagcaatgcatgaatgtatttttaagatgcagtgtcagctatttctgtaaaaacacaactcttgttctcaaagatttggtctctttttcatacctaccttgatgttcctgtaattgtttgcctagtcagactaacatctcactgatgaccatcagttgatgcttaaacatacttttgtaacttaattattggaggagacatgaaatgtaatgagttaagatttgaagtaagtacacttaaggaggttaaaaattgggagggggcaaagttgggagaaacagatggctgtgaagagcttgatcggataatctttttccaacaaattgagatttaaactatcaggtgtagccattacacttgaaataatccagctattgggatttcttaaaaggagatgcagacaaagtctgcacactgaattatcagaagaaatactgagtggaacaaaagggccaagaactacctgaacagtgaggatcaactttgataataataatgaaacaataggaaaagcaacctggaaaagtttataatacctcaattctagttactaaactgtgaattggttccaatcctcctcccggcctggttctcaaagggaacaggtagaagttctcacctctgtatgggactgaagacagagggatttaaaggaggagacgtaggagggcatgtcctggaagttcacgggtggagaaatggcaagccaccccatcttaggaagtagaaatgtgtagtgaaccggaaattcctacatcattatctggaatctggcctatgaaagagatgtcggctaatggggatttctggagtcagtgccattattgtcaaagtcccagccatcacaggatccatagtattccattaatatttaagcaggagaggtggaaccaaacctcaacttaaacctgggcagatctgatctcatggtcagcttagcttccctccctttgcctatctcccaacttttccaaccctgctcaatcctgctattaaatacataatagcaacaatagctaacattatttgtttgccataacttccagtatttgagagcgttacttcttcctcatcccacctctttggttcagttgagggttgccaggactgtaccctagctcccctaaaagcagggaagcatgtgacctcctccctttggatatgataattgggccaaagattgagatgaaacccacattagatcttcaagcatccttttctgggatttttctaagtgtagctgatagggaagatttcattctacttaagagaatgaaagagtgccagtcttgagtagcctctggtcatgttccctgctgtgctgaaaaattccatttgatgtgttatgtaataggagaaaatggcatgaatacagaaaaacaagattcagagagaaattgagagtcctgagaatatccaggtttcttgtttgattgtcactgattctacagtggtattctgtcatttggttttatgaagtaaaaaacctccctgtttttgaaatttttaattcttaatatctttcaagttggatctctgtcatttgtaatagaaattttcttataaacactccatatgtgcgaaatgctgaattaagctttttttattgatctttttcattgtttactttgtattttgtcattagttgacacatagtaattgtacatatttacagggtacagtgtgatgttttgatacatttatacatcgtgtaatgaacaattcaggtaattagcatatctgtcacctcaaatacttggcatttcttttggtaagaactttcaaagtctgctagctattttgaaatatgctttatttttaactgtagtcacgctactgtacagaacaccaaaacttattcctcctgtctaactataactttgtacacattgaccaacctttctccatcctcttctcccctctaccctctcagcctctggtaaccactgctctactctgcctctgtgagatcaactttctagattccacttatgaatgacagtatgaggtattagccctgtgcttgacttatttcacttaccataatgtcctctaggttcatccatgttgttgcaaatgacaggttttattctttttcatggctaaatcgtattccattgtgtatgtataccatgttttttcacccatttacctgattgatatatatttaggtctattctgtatcaacctattggctattgtgaatagtacagcaataacacaggaatacagatatctctgtggaacactgattttatttcctttggatatataaggttttaaaaatggattatctcatacaaaacttagaaatactcctatgggagtattttatgcaaccaaaacaaggatgtgcaaaatctcaataatggggaactagaaaagtcttgaatatgtgtgtgtaggtgttggtatgtctctgtaaaaatgtaggtgtatacgaatatttgattctttatataatacacatgcacagaggtaatctgaatatagatacataatgaggcaataccttgtgattaagagaatggatatgtagctgtattacctcagacattatacattctgtttcgagcatttgtaattccagcaatgtattattctggaaactcttctactacttggtatttcaatttttatatctataaataaggatgataactatacttatctcataggtttgttgagtattatatgagtgaatgtacatatattatttagaacaataaattgcaatgcataaaacaaggaatagagattgccaagacatattaatgttgttaatattaacaataattataataatagctaccactggctgggctcttactgttattccacatatattctaagcacagctggtatactttctgactgtgagccacacaaaccctacatagatgggaaccctatggtccttctaatggaatggaattgagtttctccagtaacatatatttagaaaaaaatgaaataatgtttcctatgtttaaattcttatatttcaaaataattttaattaaaaatgtaaaagaactatattaactttttgaaacaatatatgtggctttaacaaatttcagtaatttaaaaatataaacaattttttcagtatgccagaaatacatgtcccatgcaaagcccatattctatatgcacacatgataattttacccttaaaatattttgaattaaatatgtaagaatttctatatacaaaaacataaagcttcacatataaagctacttacaccttcatgtgttagcctctaaacatatgcccatatgcccactgaacttgtaaatatcatttccaaaaaagactgtctctagcgtagaaagaggaaatttgacccatgtcttggagaggagtcaaatcagaaactcctcctattacgtctttttcctttgctcgttttgctttgagttccagttgagcactttgaacacatatgtgaagaaggaaaactgctacctcacaattggcaaggtcttagtttcttttttaatgttgcctttggattgtactgtccttgaaatgtggaagaattgaggaagcaaacagtagaaccatatttagctctatatcacttcataactaataatttagaaatgaatctcaagtcaaataattaattcttcctatctataggatttcaaatgggcaaaacgatgttctcaccattagaattctgacgtttaaaattttttcacagattcccatcaatattgtaaaaaaatccttaaaaatatgttgtaaatataagcgcaagaaatcagtcaaaattggccatttaaaacatgttttgcttgttggtcaattcaactaaatttattttggcaaattatattaaatatttactaattaagcaactgagcaaagcactacaagttattgatatatttgaacatttagcctagtagatttttgttctaatatgttgtttttattctgatactcaaagaataaacactaaaggaactatacaacaggattccttttaaaagacattttcttttaacaataaatacagctttagattcttatatgtaaaattgcacttcgtattttaaataccttccagaaactgtttccaaactttaacattaagaaacaaacaaaaagatatgaaaaaaaaaattttgaggtcaggcgtggtggcttatgcctgtaatcccagcactttgggaggctgaggcaggtgaatcacaaggtcaggagttgagaccagcctggccaatatggtgaaactccgtctctactttaaaaaaaaaagccaggcgtgatgctgggttcctgtagtcccagctgctcgggaggctgaagctggagaattgcttgaaccagggaggcagaggttagagtgagccaagattgcaccactgcactccagcctgggcaacagagcgaggctccatctcaacaaaaaaaaaaaaaaaaaaaaaaaaagattgagaaaaagcctatgaatttctgagacttaaactactctgaggatgtatatgtttgtcaataaaataattgcctaatgtatatacccagtacccagtaatgggattgctgggtcagatggtattcctgattctagatccttgaggaatcgccacactgtcttccacagtagttgaactaatcattctactataaagacatatgtacacgtatgtttattggagcactgttcacagtaacaaacacttggaaccaacccaaatgtccattaatgatagactggattaagaaaatgtggtaatatacaccatggaatactatgcagccataaaaaaggatgagttcatgtcctttgcagtgacatggatgaagctggaaaccatcattctcaggaaactaacacaggaacagaaaaccaaacaccacatgatctcactcataagtggtagttgaacaatgagaacacatcgccacagggaggggaacattgcacacttgggcctgtcggggtggggggctaggggagcgagagcattaggagaaatacctaatgtaaatgacgggttgataggtgcagcaaaccaccatgatacgtgtatagctatgtaacaaacctgcaagttttgcacatgtatcccataacttaaagtataacttaaaaaataattgcctaatatgtaatgtattccttgattggattcctgacacaataagggttaagcaatagcagagcaaaagtttactgaacaagtccaagtcactagtgcagttaatttgtttttgtggagtccatctctcagcattgatttttgatctgggcatactttgccaggagctggagttatttgcagtcgaaaacattggctctgttttgtttattttgtcgggcagctcatgtctatgtacaatcactgcctggaataaaaaatggaaaagcctgttacaagtgaagaagctggatagcaaactacataagtaccttctttctatctggaaggattacatctaccctaatatacatatgcattcaacttgttttcccttttttgctataagtcaaatatgagaaatttattctatctgcattgacactttgcttgtgtcttcagctagagaagcaaatgtttttaaggccatgcttttttctacaatctatcagaatattcaatgtaagggccaaccaaaaggtaagatggaaaaactcaaggcagtattttccacatctctgtcagaatatacaatcaatccactcacacacgtttggctgactggtcaatatgactatttagaacataaagttggcatgcacttatgtccttagaaggtgtgtcttccctaatattttgagagctctttaaggaaaaagagtgcattttatttactaatgtaattcctattaagtatattgcccattagtatatctcactgaaattgacaatatgtgtaaatgacaatatgtgataaaagactgaacaaaaatttaaaaagaacttgaagcacttcatcaatgtcaattcttaaaaaaaaaaaaaaaaaaggaaaaaaaccctagacttgctattcagatcatttgcccatattacaagtagatgattggcttttttgctactgagatgtttgtgttccttacatattctgggtattaattccctgtcagatgaatagtttgcccatattttttcccattctgtagttgtctttttactcttgtttcctttgccatgtacaagcttattagtttacattaaccccatttgtttgtttctgcttttattgtctgtgcttttgaggtcttagtcatcacatctttttcacagatcagtttcctgaagcatttcccctatgttttcttctagtagttttatagtttcaagtcttacattgaggtcttcaatccattttgagcttcagtctatttagtgcttcaatacatttggtaaagggtgtagtttcactcttcttcatttggatatccaattttccccgaactgttttttaaagagactgtactttcccccgtgaaagttcttggcacctttgtcaaaaatcagttggctacaaacgtggatttatttctggcttctcttttctgttccattggtctatgtgtttgtttttatgccagtagtatgctgttttgtttactataatcttgtagtatattttgaaatctagtagtctcatactttcagtcttgttctttttgctcagtattatttttcactattaatgatcttttgtggttccatacaaacgttaatttttttctatttttgtatagaatatcatttgtattttgatagaaattgcattgaatttgtagattgctttgcatagtatgaacattttagcaatattaattcttccagttcatgaatatgagatttctcttcatttttttgtgtgtcttctttgatttctttcatcagtttgttatactattttttttttggagggaccttttacctccatcattaaatttattccaaggcattttattttttttttgtatctatactaatggggttacttattcagctactttgttatttgtgtatagaaacactgttgattcttgtatgttgattttgtatttgcaacttgatcaaatgtatttatcagttcccaaaggtttttcttagggtttttaggtttttctatatataagatcacatggtctacacagataatttaacttcctctttccctatttggatgttccttcttgctttctggtttcctcattcagtatgatgttacctgtgggtttaccacagatagcctttattgtgttgaggtactttccttctttgcctaacttgtcgagtgattttatcatgaaagaatattgaattttagtaaatgctgtttctgcatctattgaaattattacgtggtttttggcttttattctgttgatggtgatgtatcatgtttattgatttgcatatcatgaactagccttgcattcctgggataaataaatcccacttgatcatggttttggccaataaatttgtaaaaaatgttcagcattactaatgatcaggtaaatgcaaatgaaaaccacaataagctgtcatctcacccaagttacaatgactattatcaaaaaggcaatacataacaaatgctgggaaagatgtggagaaaagggaactcttgtatgctgttggtaggaatgtaaaccagtgcagtcactatggagaacagtatggaggttccttaaagaactaaaaatagcactaccatatgattcattaatcctactactggatatttatccaaaagaagtaagtatgtcaaagagatattctcaccctacgtttattgcagcactattcacaatagccaaaatatggaatcaacccaaatgtccaagaggaaacgaataaagagaatgtggtatatatttacaatggaatactatgtggctattaaaaagaataaaaccccatcatttctggtaacatgaatgagctagaggatattatgctaagtaaaataagtcaggaagaggaaattaaacactgcatgtcccactcatatgcagaaaaagttaaattcacagaagtaaagactggaaccgagaattctagaagttgagaatggtaggaagaagcagggagggggatagggagaaatttgttaaaggatacacaactacagctagattggaggaataagttatagtattctataacactatggcataactatagtcaagaaaataccaaatattttcaataagagaagatattgaaagttcccaataaacaaaaaatgataaatatttgagaatcttgatatgctagttgtgctaattactatacattttatgtatcaaaacatcactgtatgccccataaatagaaacaattattgtgaatttaaaaataaataatattgaaaaatagtcttgctaattacaaattatttcgcatgtttatatagaagtatctcccaaattacttctattaatttaaacttagtaaaatactctggatttatttattcaaccatttagttttatcctgatcaaaatgagtcagaatcccactgaaattctgaaacaagagaaacatcaataaggtagaattgtcattaggagaaaattcagaatttattggctatcataaagatgaaaatgtcaatgttgcaactttattttccctggaataaatctcaggtattttactgacacaaatgggcacagaagtctttgaataatgagcagatactgaaagaaaatattttttggtgacctgcagaacttccaaaaccacagtatgtgttgtaaagttactttgggttgaatatgaagacctacaatatagtaagatatttattgcttaaaagataaaaaatgaagaaagcaaaattatctggagagaaatttcatttgtttaagaagggggctcactgaagaaggaaatttttagtgaaacattaagtttttttcctacagagcaaatagttttttgaagaaaacagtctggagacttgattcatttggctctgtttactcaaggttatctgaagtattgccaatactttatgttggttacttgattacaaaaattgtttgtattttcaacctttttataaatgagtctttacagcaaacctataccacttctcattcccacaggaatgattcttggaatacctatatgtatgtcaggatcctctctcacatcaataagagttgtaatctacctgaaatgtgttatttttccatgcatttggagcatgcaaaagacataaaaagagtatttttttctgaactgttgagctatatgccaatctaaaaaatgaaagctacttctgtaataaattttttggtatggaacattattactcaagttgaatcttaatattacagagtcacaagagaattgtaaaaactgtgatctcaatgaattaatttatagtgagaaatataactatcaagtaggctactcatgttcggagtcagtgttttctttcctcatcagcaaatctaatggggagtcagatattattcagaaagtgttttggtaggcatgaactctaagcaagtggagttagttcattcacctgaacagatgattataaagctatgataacataaataacgcatcagtctctattatactaatcatctctgctacatgagtaagacccaggcttttgtgggataggctactctcagccagatagcaccataagaacattactgattttttttaaaacatagatgttacataaactactttcatttttgttctttccttagacaaaaagcaaggcaacttcctgtgataaaagttttcttagttaaaaggaacaacattcagttgctcttctctaatactcatctctctttagctgaattttggaagtacactggcaatctcttgtgtgatccttctactacaaatgaaataatactcagtagtagttcaacattccaattatgactttttcattgtaattatttttaaactgatatctgaaattgtacacatttatggggtacatggtgatgctttgatacataagctaaatgccctaattattatatattgtatctgtaatctcaaatatttagcaatttgggcaattaggcccaaaacacagttcaataatgttcttatctatgtctttccacttaaggatttaaagaaaccaagtttctaccttcagaaaagatgttaaatgagaagaataagagaaattgtctcatcgtttctaatttattctcaatatatgctccaacttagaagttatttgttatttaacatgcacaatcaagatgggactctgtcctttttagaaaaggaaagttgcttagcataaaatgcaagatacaggtgaataatttgaggacatatatcacagctcatgtagcctgaaatttgaaaaagggaaacagttatgttaaaacagaaatcccacaaacaatcatcaaaaatttagtaaaattgataacatagtatcttagatcattctattaaatgtttattgcatgtggcaattggagagtgcagaaaggggaaagaagttaaaatataagcagatgagaaaaggttaaaaaaaaattctaaaggaacaatatcttccctaaaagcaattcatcctagaaaatgatagaaattctaatctgtgggtaggcaatttgatccaaagcacatttaaatgtaatatcattgaacaagctctcttcatgcccctagtaagaatcgaagtgacagatataaagtgttttagctattagactttcatgaatcatactccaaattgtaaaatattttgttttatttttatcaaatctgtgtttcatctaggagaacagactggtttaaaaaacccatctagttaaaataaaatgaagtgttatataaattaaaatcaagtcacttccctaatatgcttttatcagcacttactttttaaccctatcaacggcctcaggattatatgtaaactttctttaacatgaaaatcaactataaaattaaaaatcctcatctcaagatatccttttgttttttacttacccatatgactgagacaataactgaataagaattacagaaaatggataagatttcatataaagatttgaaaaaaaagttctgcgttagaaaggaatgaaatttactgactacattagttttctactgctgcataacacgttgccacaaacttggcagcacaaacaccacaaatgcattatctcaaagtttctgtggttcagaatctccagcgtggattaaggatctcctctgttgagcatctcacaagactaaaatcaagatgttgtctggggctgcagtcttatctctcatctgaaggtcttccaaggtgatttaggttgttggaagaattcagtttactgaggttaagactgaagtcttcattgtcttgctacctgtcagccagagtgactttcacctcctagaagctgtcctcaggccttagtcatatagccccctctcacaacatgactgcttacttcttcagtgccagcagggcaatctatcttcagttggttataatagcatcttacataacataaaataatgacaccatcatctatactatctataccatcatctttgtcatataaagtaacctaatcaagagagtgactgttctatatgattcagaggttctcccaacatttaaaaggaacgctttataagagctgtgtccaccggaaagcggtattacgaagtacatctcacgatcctgtcaaccagagtgatttatttgaatcttacaaggctgtagtcactatcccaattataaattttgaaagctctgaaaatcaaaaccttgtctaacttatttggtgaaaaattttgatcagaacttacacataatttatataacttagtccattttgtacaactatttaagtttgcagtcgaaatactaacatgcttcagaatgaagtacattatgtatacactattatataatcattattttgtgtgttattaaacaactcactgaaggtgttcagtaatatactgaatatgtgcagcaaagtagtacctttctaaagtctaaacaatctctaaccctgaaacacatctgcccccaagggtttcagataagaaattttgggccaaatttattaaagttctttaaaaaggagttcattgagaaagggtttatttcaagaatatataaaccttggggtaagctcaacatttgctgatttaaatgaccttcaaaaggataaggatgaggaaagacaaagaaaaaacaattgtttatacatcaaatctgaattcactggtttcaattttattggtgacaactttgaaaaatagggcaataatgacagggagatccatattaaatacaaggtaagggaaaatatttattttactaatttgttcaagttactaaatgagtgaactcatagacagattggatttgtactactaaactgtagtacaaagaattgtctctttcattttcccaaaatgcatggtacatttagggcaagacatttttttataagcttgtttatctcatctttttccccataagcacagtatctggctcttggggcaaaacctgtttcacttaacagccaatttatccatccagatttgagtcaactaataaaaattttacatgttcatagctcccccgtctcagatttcaaccttaaatcagtaagtagttctatttattgaagaattaccatatttaaagaaagtgtgtatcttggtgacaatagctaggaaaacggaagtcctcaatccgtgtctatcaatactaaatgtaaaatgtgaggggggaaaatgcttataggcaagaaagaaatgtaaattggtctgtcaccaaagtccctctcctttgaaatgtcttataatttacatgtaatatatgtgaatttacaagcagcactataacttgcactttgaaagcaatgcttgagttaattaaatgagctcctaggagagcatggatttctcatcagatctttgctatagtcaggtttgagaatttaattgaggatattcgcttcttcataatgaacagagtaattttatagaattttttttaatgatttctacaatggattgttaggcagcttctaaactgtaagttaaaatgatatatccctctttgtctaaatactgccaaagcagtcagtcaaggcagttcaactgctgttatttctattaaaaaaaaaatccatcaagttgtttaagtacaaaacaaaatcaaaaaagccgttaatgaatatttttacccttcagtgatgataaatattttattagaatgcaaacaagcagtgaaagcacaaaaggaaatttatcagaactgagtctttgcttgaattttgagtgattactaggtatgttttcaaacagcactgcctgaacatagcttttaagtttttcaaattaaaatagcagatgtccacagtagctgtgtgtattagaattgtttaatttatggagctaaaatatatggtaggccaaatctaaacagtgttagaattttgagattggtagcctcctcttcctatggaaggagcttgctaaggggtgtatcagcttcttaaataggccattggcattcttagaggtttagcgtggatgggattaggcaaaggtggagttcaatttggaggttctgataatgcaaaagaggcaagagaggatggctgtggaacagggggtagtatgggaccaatggatatgaaatggtccttcagaaatcacattaaaaatgatgtaggtttcaatcaaatcagattttctgatctacatctactggtgaagttactgagttgggtgagaaagaatgaagacctgagttgttgttaaattaaattgcttattatgtaagcaattgcctgcctaaaatgatgtcccttaagtgcttaaaaggtctgaacattaattgcattttctataatgctcgtttagactaaaacaaattaaatcaattaaacaaatcttagaagatgtattgtgtaaaaatcccaagtcttttttagtagaccttaaataaaagttttgtaaacataatagatttgttgcctgatgtacacagcaagtcagtgtgttgagaaactaggttgcagcagaaaaaaaggtttaatcttagtgtccctgaatgaggagatgggaggacacatcaactctatctcaacttatatgggtttagagtttataagggttttggaatgggctgcagtgtgaagatctctgattggtggaagagtgctgcgtgaagtcatgggccagggagatgaagaagctgtattctcatgcagatcccattcctctgtgggggtcttcaaactggtaggtagaatttggggtcttcaaaaaatcttaagtggtccttaagtaaaatccttgtgattctaatgtcagaggtcctgtctgaagggacaatgagtatcaaatcaattattaaacagtcttacaagcctaatgtcagaaatcctatctataggaacaatgtggatgtgaacagtatctagtgctacaagactctcggcaagaagaagtggtccaaagtacagcctgactaatactaagttatgattatatttctgtccagaacttggcaaacgattcttgtcaactgcatgaggacaattccagttctatagcttaaaagttagatatgcagactgggagacttcttcagaaaaatctcttgcatgcttccttcaggctagttgtctgtcccctcaaggtcctaggtccatagtcttttcataaaggtcagaatctctttggaagcaaacagttgcagtgtcagtaaattactcccttgaactgatcttggggactgtgggattaatttggctttgaacacggaatactgaaaatagaagcatcagtctttatttatccagtttctgtataataaattccattgctgctttatccattttatatacatacatacacctatacacacacatagatgtatatacgcacacacatatcacacacatacacacataggtaatgaggtagtagtagaataaagaggtaggatgtaaagacaggaataaatttatccatgactccaaataaatgtgtgaacttttaatattccatttagctattcagaggctccacaataatacacgcataaaatacaaatatatacacacacgtgtatatacacacatatatatacacatatatgcatgtgtgtatatatatgtgtttctgtattgtagcacctctgaatacaggtatgtgtgtatgtgtgtatataggtataagtgtgtgtacatatgtgtaagtgtgtgtgttattgtggagcctctgaagagctaaatggagtattaaaagcccacaaatttatttgcagtcatagataaattaattcctgtctttacatcctacctctttaacctcttcatttaaaaatgaattgtaaggtatgaaaaagagatagattaaaacaagtgtgtcctaataagcttttggcatattaatttgcattttattgctactctttctccctccaccttcttaatttcaaagagatagctagacctttcatattttttttccctcaggaaattttccagatcacaaagtagaaactgttggaaaacaaagctttctcctgtccaaaaacttaagttcatagaaatgatgatgcaaagcgccaggcgtaagaggaaagaaagctaaatgcctgccctttaaggcaacacttgagaagggcaaaatttctggaaaatggaagaaagatagtttagtaagtttctagactgtcctggacccatgcactagttaatggaccttaagagtgggctgataaaatcttagaggtgacagttgtgcaaggtacccaggaagctggcacatttgcccagagatgccagtctcagcaaagatgcctgcactccactagagacatggaagactggaagccaagagcaacaaggctgcaaaacaccaggaaaacaggagatcagcaaatgaccacagtggactggatagcaaaggcccttcctttcattatcaggcagcttataagcctctctgactctgttcagggcctccaaaatacccaccagaacgtatttctttagaaaattgtctgtagaaaacccctgtagaagtacaggagttcagtatctaatttaacccagacattttgaaaaaaaaaaatgtgtttcttgcatagttaagtttgtggaccaaaaagtatgttgcctggaaaaaatgtcaaagttcaaaagagaagagttccctctgtcccagtgcccaacaaaaaataagaaaaaaaaaaaagagaaaaaaaataaatctaagtacagatagcttaatgaaaaaatcgcaaacctccaacaaaatctatacagaaagcctcactgaactgttgtaaattacaaaaaacattcctaaccatctacttagcaccttactggagctcggcatgttaaagggaaagtctttccagaagtgtttgaaaaacatcaacatcacaaaaagcacataatggatatatagaatagtacaacaaatgtataaaataaatatacctgcatctattttgggaatttgggggtttgggggtttccatatccaattccatatggtctaaggaccggaagtacacattgggcagggctgcctaatactcttgaaacagtctccatggtatccttgattgctgtacacggtgacacaaattccttgtatatcactgtaacctgcaaaagggattcactcaactgattattactacccagtaatgacaatttatttaaaaaaatattttaaacatttttgtgtgtttcataggaaggtttcgcttttgtttgtttttttaaaaacctgagtcttttaaaaagagacctgagtagtttttaggtacttgacaagttgcatagtcctgctgtcaattatgacgtattataatgaatggtaacacaaatgaaacatctgtttgatcattcagtgactacatctgttatgtcacatttgacacattgagcaggagaacataaaaaattcaaggaaaatttgtaaatgtgagtgctagatcattgattttgaaggatgagatgtgttaagattactagacccattcagaatttattataaaagcactaaccctgtaaattggccttctttcaccactgaggcccactctaatggatactatgtttgtaaatgcaattatatgcttttaaaacaaagtttaaatataagttcttaaaatttatattttattaatttaaatatttatgaatctttaagttgtatcaaacacctttttaggtgctaggatgtagctgtgaacaaaacacctcttgtggagtttacattctaaaacaagagtgtgcaaacacaaaagcaaaacaaaaaaaaattactcaggttgcaacaagtaatctgaaaagcagagcaaggtaagtggataacagctagtgtgccaatttatgcagggtgtttagagtatatgattctgttcattatctactgcaaaacttttaaataattgataatacaaaatgaaatcaaatcccctctaattcagaacaagtgaatagagtcagagctaaaagtctgatttgaaaggagaaatgcttcgtgtaggctgtctggagaatataaaattagaactaaaattttatattccagttttttcttaatatctcaggcaatgtctgataatttcagcaagctctccaatctacagagtatatagtaaatatttactcttgcatcacatttaacaattaggaatttagacagttagcttatttactgcttccgaaaataaatgtaaccagtgggcctagcgcagaggctcatgcctgtaatcccagcactttgggaggctgagacaggtggatcacctgaggtcaggggtttgagaacagcctgacaaacatagtgaaattctgtctctactaaaaaaaaaatatatatatatatataaaattagccaggcgcggtggcacatgcctgtaatcccagctactagggaggctgaggcaggagaattgcttgaacccaggaggtggaggatgcagtgggccaagatggcaccattgcactccagactgggcaacaggagtgaaactctgtctcaaaaaaaaaaaaaaaaagaaaaagaaaaatataatgagtgccattgccctgtctagaaccctcttcctttaggatcaatctcctacacaacatttacagggctgcagcacaaacatcattttatattgtgcctccaacccctgccacagttgatttacttggagatgggcacctcacccaagctggtcaaagacacttactcatgggctttggagggttgggaatgaaagatacatgatcatttactctttaaaataaaagttgtaaataccaagctggcagcagccatatcctgttaggtgaggacctctgagaagcagagaaagtcagactttctgaatgagtaataaaagaaaaagggaaaaaaattatgaaaggaagagaatcataagatgtggagagatccaatggcatttgtattccaggctctagttgttcctgagagcaggttttctatctttggataccataagatatataagtaaacataacaaattttatgtttaagctagtttgttttaggttttggtaactgtaaaccgtgttttaattaatataaatacactgcgtatcaatatactagtcttagttcttcagaaaaacagaacaaattgggtgtgtatatgtatatagacagatttattataaggaattggctcagaggattctaggagctggtaagtccaaaatctgtggagtaggctggcaggctagagacctagggaaaagttgatgttgcagctcaagcccaaaggcagtctggaagtagaattctcccttcctctggaaacctcagtcttttttatcttaaggccctcatagactggaggagacccacccaatcattatggagaataatctgcttcagtcaaagtctatggatcctaatgttaatctcttctaaaagataccttcagagaaatgtaatgacatatttgaccaaatttgtgggtaccatggattagccaagttggcgtgtaaaattatcttaaccaaatctagtaattatttaactttgctgttattgattgaaacaagaaaattatgagccacacatgtgggcagctgaccttttagaaaggtgcaaaggcaactgagcagaggaaagataatcttttcaacaaattttactggaacaaattggttaccagtatgcagaaatatgaacattgatccatccttcattttatatagaaaatttcacccataatatattatatagctatatataaaacctgaatctataaagttctggatgaaaaaatacaagaaaatctaggtgaccttgtgttactcaaagaattcttggatctcaaaataatcttcataagtgaaaaaaattatttaattcattctgtttgcttatatgtatgtaaaccttagaaagtacaagctaatttatagtgacagaaagcaaaatgttggttgcctaatgattttgtgaagtggggccaaggaagattacaaattggcctgaggaaagttttagggttgatgaatatgttcatcctctatattgtggtgatggtttcacaggtgtatctatatgtcaaaactcagaaaattatgcaacttaaatatgtgcagttttattatatgccatttacacctcaataaacctgttataaaactgacaaattatttttatagcctaaatagtaggtgatgactgcctgaattagggtagtaacaggggatcatggaaagaaagaaatggattaaggatttatgtatttttggtagagccagcatgacttgtttgaaataaagaaaataatgggataaagatggttcttacgctagaggagctgtgtaaataattgttccaatgtaacatatttattctttagaatccaaattctatgcagccgcctcagtagtagttacagtggtaagagaatctcagtgaatagaaactcttagttaatagttgtttttttcttctctacatttcaatgggtagaccttagttccttggtaaagttttctatattaatatactatataagattttatttagataattaatttcactgccaaacaggagggttgaaaatcactttactagcatctgggaaaatacattgattattcttgtattcttccttggcaaaaaatgaaaataattatatgaaaatattgatattttagtcaggatagattgatgttcattatatgtccagctcaattctaaaccatttaagtgtcttagattgtattctcataatcctataatatgggtagtattaacctcagctgataaaggatcaagatcagaaaggtcaagcacacaaatggttgggatgatacttaaattaggtctgataacaacatttatatgtgctcatctacagcacagaaaattctcctagactgaataatagaaaagtttaaactatattttctgatacatatctttgctgcaaagcagtaatgaaattaaaataagaacttagcgaagtgtcttacagagggaccttgttaatttcaaacttccttgaagttatcactaattagtataaagtgcctgtgtacagagttattacaattcatatttgtcaagaataagcaatcacttaataatgggttattttaataatcttagatccatttattatatattagattttcttttaaagttactatatgtgtatatgcatatatgtgtgtacgatgtgcatgcatttgtttgcataacaaccactatcaccaaaactgtgtccccactatgccgggtatccagcagtgtgagaatggactaatgcatatgcatttgtttgcgttcacatcatacacacatatatacatatacacatatagtaactttaaaaaatctaatataaatgtatcaaagattattaaaataaccccagttattaagtgattagttgagattggaacacataggtttcagaggtatttagaaattgcttcaaaaactaggtacaggtactccacgatacaatacttaaatgttagaagacttacttgaagagcatacgtattttcaatttatgtagaagcaagagaaaactcagtaataaaatatcatacatatagacagactatcatgagagcaatagagcaaattgattgtgtttacatggtttttttctatattcaggatgacaagtaatacctacaagtctataggaattatccaagtttttcaatatctagttcaaattgtaggtgaaaaatctgaatttacataaacattttttaataattttctactaacggggtttgcccttctgaactatatacttaaaagtgtttaaacttttactaagtactgagaatatttcaaagaaataggaaacaaagttgtttttcacaacattgttaataatgacataaaattagcagcagtgcaagtgactaataaggggggattgattaggaatatttggtatatcccatatgctacaataatcgacatccattaagcactgtgtagacaatcatattgagaaatgactgtatccaacataagatttaagaaatgtaaaacagcatggataatgttatcgaaatttcattaaaacaagctagataaaagtagtatacagaaatacatttaaaacgtaacaatggttatcaatttctgaagtgatgatagattatgctcattttcttcacattttctctttgcggtgttataataaacacgtatttatcttcaaaatttttaaaggaatagattaagaatctgatgtaataatgacagtaataaacctttaacatataagctaaaatacttcagtgtgtgtatttagcatcattatattctaattttaggagctcaagtacatttgaacactgctgtgatctggaaatttacaacttgcaatgtagtcccagagcagcaacagcagcagcatcaccagggcagtactttttagaaataaagaatctcagacgccatccagagcaactgatttagtaactgcatttttaaaaagctcctcagatgcatgtacattataatttgagaagctctgctctagaggacaaaaactctcttaagtagaaatgttgtttcctgatttttgattaaatgaacactgaatatacaatagaacatttaacaaaatattttataaaacaaaacaccagctaagttgtattatgtaagaaactcattagttcacatgagtagtactttgagtcatcttctagcagtgcaaaagacagtaagtaagatggtcttacagacaatagtctgatagaaagctgcaatgttaactctatagacaaatttaaatattttaagacttgcattaagaaaagaaataggcagagtgcagtggctcatgcctgtaatcccagcactttgggaggccgagggctggcagatcctgaggtcaggagttcgagaccagcctggccaacatggtgaaaccttgtctgtactaaaaatacaaaaaatagctgagcgtgttcatgggtgcctataatcccagctacttgggaggctgaagcagaagaatcccttgaacctgggagacagaggttgtagtgggccaagatggtgccactgcactccatcctgggtaacagagcgagactccgtctcaaaaaacaatgaaacaaaacaaaaaagaaacaaaaagacacgttaaatgaatttaatggtatatggttgatatggtttgactttgtgtccccatccgaacctcatcttgaattgtaatccacacatgccaagggagagagggaggtgattggattagggtggtttcccccatgctgttctcctgatagttttcacaagatctgatggttctataacgagctcttacccctttgctctttgctctttctctcaattgccaccgtgtaagacgtgcctgcttccccttctgccatgattctaagtttcctgaggccttcctgggcatgcaaaagtgtgagtcaattaaacctcttttctttatacttacccagtctcaggtagtatctttatagcagcgtgagaagggacaatgatacatttaggccaacacaatcaaagtattgtccttttaatagcaatcaaaaattattaatggggaattttacatttattgtacttattgttcaaactctgttgtgtatatcttaaggtcagactagccacgtttcaaatgctcaatacatggctagtgtctacagtattggaacggcgcgggtagagaccatggcttaatttgtaagttataaagtctattaagactgagccttatgtctttcagtttgtactctatcactgtgttcattatattctttggatgtgggaagacatgctttgtacaaatggctccaggagttttcaaaatctttatgaagacatgatgacattccagctacacttaataattgcattattgtttacatatgattgtgctgcccgagttcccactcagtggtccagtaacaaccacactcactaaaactgcatccccactgtgccgggtatccagcttgaatttatacaagttgtaggttgtggtgattttctttccccaccagtagagtagagagatctccaggatccagaaaaggccgtgctttaggggcaagggtgcaaggaaaacctggaccagagttttcagttctcagtaacaacattttcagtaattcttgttctagaaatacaggatatcaatggcatttttcgctatagccatcgttttgctataacattttattacattagaattataattttctctaatattagattaatttgaagaataagtatggctgcttaaggaacaaatactttgttggatcactggaactattatgctgattacaagttgaggaatttatatttagtcaatgcccaaatgtattataacttaaaataactcagagatgccacattttttccatttatataatttgaagaaatatttattactactgaaatttatgaccacatggatcttccagggtaccttattaatttttaatttattctttaatagaaaaaatgtgcacatgctaatttagctaatatggtataatgtggaatgccaaatgttgtgtctaacacagaatctttttcctggtagcactaaagctgctttatcaggacagactcatattctgtcctcaattccaagatacacaataattgaataagaatatgtaattatgtttagaaaataaaccttgaagtgatacttcattgaatatatagttcgctataagaaggatttcattttcagaagtgtaaaaatgtgaataataggaagaaaacttttattttcaaatcaagaaactatgtattaattgggaagttaacacagcagcagatgctaatttgcataacttgccttactgtattctagcaaaagaaatatgtgaaattcaaaactgaacaattttgatgtgacctggagttaagaaagttagagagcatctacatatttaaggaaaatgtctgggcatttttgaagagtagtaatcgtggaggaggagaaacgtaaccagagagcaaggcaagacatgtgaaaaaaatacacattaatgatactataggaataattgaatcttcaaacacaaattttgattttattacgggagcattgaaactacaatttttttttttttttttttttttttgagacagagccttgctctgttgctcaggctggagtgcaatggcgtgatcttggctcactgcaacctccacctcctgggttcaagcaattctccctgtctcagcctcccaagtggctgggtttacaggtgcccagcaacttgcccggctaatttttgtatttttagtagagccggggttgcacaatgttggccaggctgatctccaatttgtgacctcaagtgatcagtctgccttggtctcccagagtgctgagattacaggtgtgagccaccgcgcctggcctagagtacgatgtatcttgtaacaaaacacaatataaaacaaaatgctagtggatttttctttttgttctttaaaaatgattgttttctaatcattctcctatatggtggttgggagtaaaaacctcaccttagaagaagagcacaattatcaaattgttaactgtttttttttgtttttgtttttgtttttttgagacagagtgtcctgctttgttgcccagcctggagggcagtggcgtgatcttggctcactgcaatctccacctcccaggttcaagcagttctcctgctgcctcagcctccccattagctagaattataggtatgtgtcaccacgcccggctgatttttgtatttttagtggtgacagggcttcaccatgttggccaggctagcctcgaactcctgacctcaggtgatccgcctgcctgtgcctcccgaagtgcttggattataggcatgagccactgcggccagtcaaattcttaacttttaacttaaaaagttattttcccagtctacaacagaaagtgaattggagatgcaatggggaagaaccaatgggtttggtctcttcttgactttttagctggagagtaggctggagactgttagaaatgagcaaagagactttctccgaggttggtttggatcctgagctgtacattgcttcctttgctttcctattgcttctgcaaagggaaacatactaggtcctttttatgtctgggaaaccaagagtagattaaaaggcatcatgcttcacaaaattcatgctaccacaatagcacagagagaaggatgttgacaagctccgaaacagtcttacagagtctccatgctctttggtggagttcggagacagccgcaatggcatggatgtgtcatcagaagaattacaagccttggactgctgcataaaactaaagatacagtgtgaagacaaaagcagcagaaaccagggcatgactgggaagtggacttttttttcctatcttagcctcagctccagtcagaagggagagctgaaaaaacaaattctgaatgtgattaacattaaggttctccagggtattaagattaaaatccgttacaggaatctttattttttataattagttcagttttattttttgaaaaatacatggtttttaattgatatgtttatatctctttgaatgagtgccaagtaattctaataatagaattataatgctttaataataattagaataattattagtatcataattaaattttgtgatgctattaggatgtgacacatttagagtagtagaaaaagccaaattctctagaaattatgttgtattattttatggatttaacatattttatccttgaatcatagttgtttttttaaaccaaaggtcagtggtatgataatatttttaattgtatgaactttattttaaatattttaccatgtgtacctctcttttctctgtaattgcttacaagcattttgttttgttttcattctaaagcaattaataaattttgtaaatagcttttcagctgtttactaaaactcaccttcctgagttatgtataataaaagtaaatggcatttataagacgtgattatgtggaaattgacttttaatacaaattgcttctttatttttacacctcaatggctaatgttgatagtaaagttgtatatacaagttaaataaaattttggctctgtttattgtacccctggtaaagaagcatggtgtttgacccatagtgagtactcaataaatgtaaattgaaatcgataaatttcaaagctattaaaatacgtgtaataccatgcactcataaaaaggaatgagatcatgtcttttgctatgtcatggatgaagctggaagccatcatcctcggcaaactaacacaggaacagaaaaccaaacaccacatgttctcactcataagtgggagctgaacaatgagaacacatgggcacagggagggaacaacacacaccagggcttgttagcgggtggcgagtgaggggaaggaacttagaggatgggtcaataggtgtagcaaaccaccatggcacaggtatatctgtgtaacaaaccaccatggcacccatatacctatgtaacaaacctgcacattctgcacatgtatcctgaaacttaaagcaaaagaaaaaaaaaatcctggctttggaagttgtaattataatttctctgatattgcttaatgtaaaaattatgaatatccagtatgatagcaacaacagatcctactgtataaccaacatctttctcactgaaactgaatactgccacacgcaggattcacatagtatacttgtcatttctagttgaatgttattgccacttcagataaagttgccaagcttggcataaagaaaagggggaggtaaagggactgctagtaggacacaactaggcagtgtccacaccccagagtaccaaggtagctgtgcaagaagaatacattctattctatgatgcctcacgctgaacagagggctaattgatcacttacctcttgctgtgtggtctgattcagacagcagcaaagagggactcagtggatgtcagtcctggagtggtgattctcgtatccttcttgtctatcataagggaagaagtgctgaccagcgcccatgggaacggtaatctttgtgaacagctgtgaaaggaccacagcttaagaaactcaagggtggtactaaaaccaggaaatgtggaagaagctttgtttcctgccatgcttcaggtgggatttgaaccagaaaaaaacattatactactagttatcgctaccacatttattatactctcagacggttttcatataaccattatctgtctgggagcagtggctcatgcctgtaatcctagcactttgggaggccgaggtgcgcagatcgcttgagttgagaaattcaaaactagcctgggccacatagtggaacttgaactctacaaaaactacagaaataaaattagccgggtgtgggggcatgtgcctgtggtcctagctactcgggaagttgaggaataactatttattatcttatgagttggcattgttaaggacgaaaacacagactgaagtaagttttctcacctcattttgtgttgcatggctcaatatcaactttaaaatgctccaactggggggaaaagctgattttctatcaccacaagactacaattttgaaatatgtattttctatttcttgtgaaaattgatgcacgcgtggatatttgtgctttcttttaaacatgatttatactcttactttgtctagttttgcagagcatcttcagttctgccaacctctacatttataattttattataatagtgtgccatggcttgaaaatgtcttattggtcagtgaaggtagacatatggaggtttttacttatgctataatcaacgaaaataagacttgaatgaatcttaagatgagaaaagctataaaagattgagtcctgaaatggagatcagaaaattaattttaaaccttcattgccatctaaattattgtagtctacttatgcaacttcgagtaacctggctatttctcatttcaaactaaataggaaagcctagatgagcagttcttgactaccttttccagctattaaatatggtgtgtgtgtgtgtgtgtgtgtgtgtgtgtgtatatgtgtatacatatatacacatatatttttatgctagataatattcatgagcatgagagacttccatggggcaaggaaatgtatgtaggaaagtgagtaaaagtgttaggattacactatttccctgtttgatatatttttctagagcaaacaattgtgacagcaatacattattgttagtaaagacctacaacgaatcctaccacacttttatgatttagctctactggaatatctggtctctcttatcttacccagttctagaattccgtgattctgatctacttctttaatgaaggtttgtccctaagccaagtatttaagctactcctagaaattagtgccatagggaatgacattttctcattcaacaccctgtctgtgtatttaatgcatctatcataagcaataatgaaatattcagttgccaaaatccaatgagggttttgggagtttgacaactaaagtctataaactgctttaaatatttaaggagacatttattctcttaaattcatccctgtgaggatagatgcattgttttatgtgccatgttggtgaaaattagactctttaaatagaattttattaatgtctttggttcttattattctacttgtcagtttaaaaaatcttctaagggaaataccattaaacatgttctcccatcccactccccactatttatgtattaaattaataggaagtattcttaggttatgaagtcaccctattgcaaattcaagtgtaacccaacagcataaggtagataacataactgaggttgctacaactgagtgatgactgcaggtttttaatttatattaggctatttaaagaaatccccattgaagaattatgacccttttgtctccttgaaaaactaggagtcatccatttatctgcatctccggtttaggctgtcaacatttctcaccttgattattgcaaagtcctcttaactggtgtctcaacaccagcctatcactcacctaatctgacattcacactgcagccaggggattagactgaagacacatatacttactctgcataaaatgattgagtggctgcatgggaaaaaccacctcactagtatctaacatccttcctgatttaggctttgcctaactctacagtcccagtgatgttcaccattttctctactacagccagaccgagtagaggagatcccacaaatgtatcacatactttattctgaagatctggggtgtggggggaccaaatggccctgcaaactggtaaaaagcacggtccctggacattcaccataggtttgcatcttatccatgctgccaactaactgtgctgcttggacgcattttgaactctctgtgttactgtttcctcgtctctgaagtggtaattaagcagtgcctacttgatagtttatgcatgtaaagtgggtagaatcctgcctggcatatagtaggcactatgtaattatcgatactgttgtttcccttattctggaccactgtttgacactccccaggctagttctaactttttaaatggtttctttagctctcattttaaatatcattcacgtgtgcttgcgcttgcacgtgctctctctcgctttcttgtgagttctctcgctcgctcgctcgctcttgctctctctctcttggcttcccatgtagattgagtttttttttttttatgtgttacctctacttctcatactgtatggcaaggcacatttttacttagctgcctttcctaacaaattctaaacttgtaaacacagagattgcgtttatcttggtcgttatgatattgccactgcccagtacagtgcctgaaatgtatgagatcataatatttacgacaaaaagaataattagtgattttattaatagcagatgtttaacttattgaaaaacaatgtgaacatacataagcactctaagtgtatgaatatacggttgggtaaactgctggtgaatttgtgtgcatgtgtgcgtgtgtgtgtatgagagtgaaacacatgcaaatagcaaatgttttcaaaatttccaagttcacctgatacatgaagacaggagttaataaagatttttaaagtaacgtctaaacaagtaagaaaaataactttgaagggctgaggcacattatcgaattttttggaaacataaaaaatgctgtcaggaaagtgtcttgctgaaaatatgtattacttagcttttgttctatctctgaagtgtcccacaaaattcttcagaattaatctattacattttttgaataaaaataaaaattacttctgagaaattcagatgcttattggtaatagtaatatattcgagtagaaaataaattttaagtttagaggtataatacaccctctccaagttaaagaaatactatacctgtgtgcgcacgcatacataataattcacacactcacataaacacacacacctggtttgctgaggactttcaatcgttgcaggtgtgcgtgtgaaaaatgttactttccttgtaatcattctccaaatgtgctgtgtcatcatctcctttcctgctaatcagcggtatccaaaatgacatgaccagattgtgtaatttcttgtcacttttttcttatctaacagcctctttcgtattcttatgattcagttcagtttattttaaaattgtaatttcaccctcttcgaaaaccctactctgccccatcaaaactgcccatgacagctgtctgtggtttgcacttcactcaaacttttttccttttgctctcttaatgagtgctacctcctctggtattagggaagaaaggaagcagaaggaaagtaccagtgttgccaccacgtcctatagtttttttcttagtaggcttgacttgctgatctagatgattgtcttgcatgtgggctcactgtagataggtgctggctatagtgtgatgatggagttctggtaggcttctcctatgagctttagcaatccccttagagatttggcccccagagggtggctgcaaggcttacttctctgatatgcaccccaaacagaagctgtccaagcaaattcttacttacaatgtcatactctgcacgagcaagaggatgtgtccagaatcacatttctattaggaactgagaattccagaagaatattcctggaccctggcaactagatcacctgcctctgtgtcaactctctccaattttctctctctctttccagtagtatcactgggaagtgttatcaagccctttgacttaataaccttcattttaaaaattacattctagctgctgcttttagacttgtccagtagttaccattctttctttagacctgttttcttggctatggggaggagaaacaattccaaaaacagaaagggcaggtggaaaggaaagaagatggaaaagaaaaaaagtggaagggaaatttaagagttcctcttgtagtctttcataggtacctcatagatggtagtaggagagggctcagggagttggtgtttcatggtgggacacattctcttaggttaggctactcagggagccttacagaatggccattgaccccagctgggagtggttccctgaatatagaatgtgacacacttgaaattcttgatcctcagcttataagtttagctgcagttttagaatattagaaaagacccaactcaataccatgctatgcttgtagctgtaactccagttacagatctcagagagaggatggacatttgacaagctttcgacagacagctgtgtcaaaattgaaaaacattaaagtctaattttatgggcatcatagcattttgataggaagcacagacttatagccagatggctagatgcactaccaatcttacagtcctttgtaaaataaagataataagaatgattatacagagtcatggtacggattcaatgacttctgtaaagcatcaagaacagtgtctgatatatgggcatttctccttttttaagttcagggatatgtgtgcaggatatgaaggtttgttacataggtaaagtgtgacatgggggtttgttgcacagattctttcatcacccaggtattaagccttgtatccactagttatttttgctcatcctctccctcctcccaccatccactctcctctaagccccagtgtgtgttgttcccctctatatgtccatgtgttctcatcatttatctcccacttataagtgagaacatgccatatttggttttctcttcctgtggtagtttgctaaggataaaggcttccagctccacctgtgtccctgcagaaaaaaaaaaaagatctcatcctttttcatagctgcatagcattccatgttgtatatgcatcacattttgaaaaagtcagtctatcattgatgagcatttaggttgattccctgtctttgctattgtgaatagtgctgcaatggacatatgcaatcatgtgtttttatattataatagaacaatttatattcctttgggtatatatccaataatgggcttgctgggtcaaatggtatttctgtctttaggtctttgaggaatccccacactgttttccacaatggttgaactaatttacactcacaccaacagtgtacaagcattcctttttctccacaactttgtcagcatctgttattttttgacttcttaagcatagccattctaactgatgtgagatggcatctcattgtggttttgatttgcatttctctaatcatcagtgatattgagcatttttttcctgtgattgctggctgcatatatgccttcttttgagaagcaattgtttaagcccttggcccaccttttgatggtttttttttcttgtaaacatgtttaggttccttatagatgctcgattttagacctttgtcagatgagaagtttgcaaaatttttctcccgttatgtaggttgcctgttcactctgttgatagtttcttttgctttgaagaagctctttgctttagttagatctatgtgggcatttcttctgtttgttttttattttgttggttgcttgtcactccccatgtttgccctgctcccaagatctactaactcttcacacagaacctctggttgcctttgtgaaagctgcaaataccaggatgcaatcactcttgtcagacccaaacgaattgcagctgaaaaagcacaaagtagaggaactcatgcttacatgtctgagacaaggattgtctcgaggcttttctaaaataaccccacaaaaaatcccttctttaggactgcagcaattcagataagatgctttctaaagaacacttgcctaataacaccatcttctccagtgaattgacagcaaccttagctttgaacctctgaaaccaatgaattctgtttccaagaagcttatataaacttcccctttttgcccttgctctgagctttctcttacccttccatctttgggtagatctgtggcttgccatggatgtgcatactggattatgatccttcttgattattcccaaataaattcattatattaggaggcatttttctggttttgttttgttttgttttgttttgttttgtttcaggctgacactagggatgcctcttcagtgtcctttgctcagagcaaatcactctattgttcatcctactaactaattgttggagtaaacattgcttcatgtcctaaatttctctgaataattattgactaactagtgctaaatgagtacaatctagtaggatagtcactttaatagagagtaaacccataactccaagttgaaatctcgcccatcagtactgggtgagggaatggatttttgtagatttctgagaatttttaaatcccagcactaaagaagtcatctgtgggaggggcccagtgttatcctaaggttatagatagattttggtaaaagagtaaaaaaatgcaggctgggtgcggtggctcacacctgtaatcctagcactttgggaggccgaggagggcagattgcctgagctcggcagttcgagaccagcctgggcaacatggtgaaaccctgtttctgctaaaatataaaagatattagctgggcatggtggtgggcacctgtaatcccagccacttgggaggctgaggtaggagagttgctttaacctgggaggtggaggttgcagtgagctgagattgtgccccactgccctccagcctgtcgacagagcaaaactctgtctcaaataaaaaattaaaatagaaacagataaatctaaatggaaattctttaaaattcaagtgttttatattaatgggaggaaaacgagagaaggcacatagcccctgcagttgttatatgggtactaaattgtgactctgtcaacaagtagttgtgttaccttagtatatcatttcatttccttgcaaaaaggaaacaattgtatctgacttgttactctctagagctgtgtaatattagataatatgtgagaaaatactttgaaaaatacaaaattctctatagatattatgattttcactaccatcatctcagaactctgagagtgtttgtagatgccactcttgtctcatttctgccttccagcgatgttgtaattttcgaatgggataatatgtaaaactatgaagtgtccaacatgtaataaatagttaattattacttgctattcatattgtgatttataattattgattttattacataattttcatgctagaccatgagttcttattactctgttttactcagccctgcaccactggtgctcagaatatcttaaagatttaatatatgattgttgaattaattggctagttattgttaattacatcaataccatagactacaacataaaaacgaaaacattaagtatcacagtggagcaatagagaaggtaaaaattcagaagccacctggtgataaaaagctaaaactaacacagaaataaatagactacatgctttttgtcacattatgggatttttccaagaaatacatttctttctcataggcccctcaccaggcctctgcagtcactgcatggtgttctggcacatgtgaaaagcctgctgcaataaaatttcaagggcttctgcctataaaattttatatactgcagactttgaatctgcattactttgcagaaacaatggattttcgtttcataatttggtagtcgttaagaaaaaagaacttaagaaaaacatatgtaacaaacctgcacgttgtgcccatataccctagaacttaaagtataattaaaaaaaaattagtaagttctttaacttgccactgtggaaaaataaatctatacaacaaagtatgaaacacaaatcattacaaaggaaaatttattactgaaataaaagtgtgataaattaaggaattctgcagtatataaaatcttaaggccctcggatcttcttgtatgctaatcacactgcttaaagctttcccctaacatgcaagggtgttgctaggttattaaaatatgtatatgacatgtttgactacacttttagaaactcaaactcattatcaagctaaaaatgttgttatatttctatctcctactcaataactatttttaaaataaaaacgttctaaatctcagcaaaataagatttttgtgagataaaagtatgttttctgatgttacacaacaataattgatactaatccaccagaagtactaggcaaaaatttgcttattgaattccaaaatgaattatgttttattggccgtcgctcagacaggagaaaataatgtatcttgttttctctaattatcttctctgtttaacttatctcagagacctaaaagctaccaatggtgaatgcctttacatgttcatgggagctgtttttattatagccatctgagataatgtttgtccttgtccttctgatccaaaggacaagaatgtaactaacaatggaacattttctaccacatgagcagtttgaggatgttgatttctgaaccagccggtcaagtttacagcatttatctcttagttaatacatgaccttgatattttggggcacatatggcaacatgcagtctcatgctgatctagttacttttgcaataagaataacttaactgtgtttttgtcttctcactctgaagctattattcactagttccactaaacaaaaagatttcaaagtccacattaaaaatctagattacatttcttaaaaataggttttcctcgttgttcaaaactgtttattttattctacatccttctttttccagaaatgggatgggttggtgattacagtataaatacgtgtatgtacctatgtgtaaacattttcgtactgatttttatgtgtctgttgacttttttcaaaaatccatttatcatcaacctcatgacctcgcaattaccaaaagcttactgttttctaaacataccaaacaccttttcattaccgcttttgccctttttattggtaaaacatggattctccttggtactctcgaaaaaatcagatttccaactattatgcttctactgaagcactttatttctgcttcatacactcacagccctttgtctttatgatttttgatacttatatgtttttatttctattatttgggtacatttgactctcacaaaataagtacaaattatgtaaataattgttgaataagttatatcactacacacacacattataaaagtattttaaagtggttccctcaatattcagcgaatttctgaatattgcttttctacaaaagaacttaactacctggttaagtagcaagtaagttttttataaaagaaaagagaagttaaaacataagctaaaaccactaggcaaaaaatgttacaaagaaggattatatactctaatatatatatatgattcaaatatatggctacacaaaacaatcattgcaacatatgtttaaaaaatacttattcctggatgatggacacatgaatctaaatctctccactaattattttccccagacatccaggaaggaatgcgaacgggaaacatatgtaatcaagaaagtcagcacttatacgagaaagaaaatgccatgaatttcaaattaactctaaacagaaaattacacacaaaatcacatcagtgctttgaccagagctccaatggccactgcaaaacctgtgagtgtgggagggaagggaaagagaatccatgaaaaatgggagaggatagtgaaaagtttagagtatagagaaagttatctgtaaaaggataaagtccttttagaaagaggtaaattaatgcacagagttctgtggcatggtggcacagcgccaactacagtaaagaaataaattactaggtgtccacatgagaagaatacaaataaaatgttaaagtaattaaaggcatataaacaaccaagagaaattaagatatataacctttttttgtattccattccaaccactgtctctttgaccacattttttattgtatctgctattcactctctctctctctatatatatatataaaattccataaatatacatatttatttatatatttcttttaaatatatatataaaatatatgcattttatatatacttatatatgtcttctatatataggaaatacatatacacacatatataggaaatatatatatgtatatacttataggaaatatatataagtacatataacctctatatagggaatatatataaatattttatatatagggaatatatatatatataaagagattatatgtacatagtaagaatatatgttccttaaaaagggtgaaattaaaactagagacaagcctcattttatcgcactctgctttattatactgtggagataccttgtgctttacaaattgaaggttgtgataaccctgccacaaacaagcttaccagtaccattttcaaacagcatgtgttcactctacctttatatcacattttggtaattctcacaatattccaaactttattattaatattatgtctcttaaggagatctttgatcagggatctttgatgttactattgtaatttttttgagttgccacagactgcacccatataagactgtaaaaattgctgaacactgcatgtgttctgactgctccactgcaggccactttttcctgtccctctccctgtccttggccttccttattccctaagagacaacactattgaaattaggtcagttaagaaccctaccgtggcctctaagtgttcaaattgaaagaaacagttacacttctctcacattaaatcaaaagctagaaatgattacacttaggcgggcatggcgaaagccaagataacctgaaagctaggcctcttgcatcaaaccttagccaggctgtgagtgcaaaggaaatgcttttgaggaaaattaaaagtgctactccagtgaacatacaaataataagaaagtgaaacagctgcattcctgatgtagagacagtttgagtggtctggagagaagatgaaaccagctacgacattcccttaagctaaagcttaatcctaattctcttcaattctttgaatcctgagagagatgaggaagatgaagcttagtacctagcaaaagttgattcataaggtttaaagaaaaaagccatcttcaaaacacaaaaatgaaagatgaagcagaaagtgctgatgtagaaactgtagcaagttatctgggacatctatctaagatcatggacaaaactatctgaaaaaacaaattttcaatatagatgaaacagccttttactagaagaagatgccatctgggactttaatagctagagaggagaaatcgatgcctggcttcaaagcttcaaggcccaggttgactttcaacctgtattgttaagttgtaatgcacctgatgattgtaaattgaagccagtgctcatataccattccaaaatcctggacctcttaaaagttaggctaaatctattcttcctctgctctgtaaatgaaattacaaagtgtggatgacagcacatctgtttatagcatggtttactgaatattttaagcccactgtcgagatttaatgctcagaaaaaaagactcatttcaaaacatgacggctcattgacagcatccctggttacccaaaggctctgatggagatgcacaaggtgatgaattctattttcatgcctattacacaacatccattccatgaatcttgaatgttcttaatggcatctagagtggtgaatccttatcagaaggtttttaccttactttgcccaggaatattagaagaatcaccggctgtagctgtatggcagctatagtcttatgcaacatatttcttaataaaacttcaaaatcaaaattactccttgatccatagcctgtgattctgctgatgttcttatgcaaagtaaattaaaaaccttttgataaggattcaccactctagatgccattaagaacattcaagattcatggaaggaggtcaaaatagcaacattaacaagagtttagaagttgatttcaatcattatgagtgacttcagtggaagaagtaactgaagatgtaaaaatatcaagaactagaattagaagtggagtctgaggatgtgactgaattgctacaatctcatgataaaacttgaacggatgaagagttgcttattattggtgagaaagaatgcagttccttgaaatggaatctactcctggtgaagatgctgtgaacatggatgaaaccactacaaagtctttataatattatataaatttagttaataaagcagtggtagtgtttgaaagattgattccaattctgaaagatgccttacagtgagtaaaatgctatcaaacagcatagcattctacactactaagaatttttttgtgaaaggaagagacaaacatgtcgcaaacttcactgttgtcttattctgagaaattgccgcagccactgcgttgttcagcaaccgtgaacctgatcagtcagtagctgtccacatcgaggcaaggcccaccagcagcaaaagatgaccatttgtggaaggcttagatgatagcattttttaacaatgaagtattttttaattaaggtatttacattttttagatgaatgctactgtatgcttagtggactaaagtaaagtgtaaacatgaattttataagcactggatgccaaaaaatttttgtggctgtattgcaatatacacttcattgcagttgtctagaactaaacccacaataattcccaggtacacctataattatgttcatttataatttaataaagctttctagaaatgatcccttagatctatatattgaaaaactacacttctgtagtttacctgaaacgattaactccaaaacatatcttagtgaaactattaaattttaaagataatttaaaaatatccttagaatcctctaggaaaagagattaaattataacagtgagaaaattagactggctgtagacttctcaggaataactcacaaagcaaggagttaatggagtggaatttcaggaaacacaaaaaagggtaagccaagcattttaggtctaggcaaaaaattttcttcaagaatcaagtgtacagaaaaagaatatgcaagaaccaaggaacattatatacacaaattgtttatgaataatctatcatataatgagtttcatctaaataaaatgtcctggtgaaacttcagtaagggaattgatgattagcattaatatatttatttcttgaaatatgacttaaaaggggtgaggatatgagtgggtgaacaatatgtaagttttatacattctggcaaaataaagtattcaagtgtaaaatgaaaagagaagagagataagtgaaaatagaaagatattaattgtggggtacgtcataggtgagtcaaagaatactactaaaaatgaaagccagttagtacaatgctaaaaatatgaggcaggggtgggaggaagcagctttagggaaatggggactatataaactataaatacaaaaataatccatagaacaaacttgtaaacttttctaaataccaaagtaattttttaaaaggagacaatacattgagaaacacagtaaacaaaatataattcaaacagaaagtataccaaaaaatgaaagcaccaaacccaaacacatccgttctgtgtaataggttgaactcacctattacaataaaaagattttaaaattggcacataaaaccaaaatctatgttgtatgccagacccatctaaaatacagtcattccaaaaagttaaatgaatggaaaaaacacatcagtcaaatggaaacaataagacaacaaacctaatatgagaggaagtagaatttaggccaaaagcattagatgagacaaacggtgttgtttcatgttgctcatagccacagttcataagttacataaaacattactgatatctgtgcactaaaaaatacaaccacacacatacagaacataaacttcagttggtgcagggaaatataaagacaaaataacactaacaatagtgttgccttttattctgttgaattgtcttattgatctggaagtatttgttatttattaacatataattccatggttgatttcatgtattgtaaatattatctatatgactacatgactagtatttttacttctacagtagtatattttgataataaaagtttctaattttattgaatccaatttttttattgttagtacttctctatcatgtttcagaaatctcccttcaccgcagctcataaagatattgccctgtgttattttatggaaactttcctgttccaccttgcactttttcatctagtctccacctcatatcatgtatcatttgaggtaggaattaagttttatgttttccatatggatatgcaactaatccagtactatttcttgaaaagattgtcttttcctcaccaagtttcattgccttctttgtcacattttaagtgcacatatatgcaaaaataaatttatagatttttaattttgttccattggtttatttgtatatcgttgtgccaatatcatactgccttggttattgtgcctttataataaatctttttacttggttggccactttccaaaatgttcttcttcaaaatcattttgcctgatctgggtaatttgcattttcataaaaattgtaaaagtttgccagttttcacacacaaaaagaatgaggtttgtttgggagtacattgagtctatatatgaatttggaagataactgttttaaaataatgagtctcctagtatatagtgtatttctcttttacattatttgtcttactgtagtcagtaatgctttcttaaaaatctatttctaattggaaattttaaaaattatatatttatggtgtacgtgatgttttgatacatgtttatacacacactgtggaatggctacaccaacctaattaacatatgtagtatctcacatactatttttttggtgacggaaacaatacttaaattgtactcttctagcaaatttcaaatatacagtatattaactgtagtcatcatgaggtataatacatatcttgaccttaacttctcataagtgaaattttgtttcctctactcaacatattcccatgccccaacccccgtctggtaaccacactttcactccctgtttctatgagtttgacttctttagattctgcatgtaaatgagatcatgtggtatttcacctactatgcctgtgagtcaataatgctttatagttttctatcgaaaagtctagcacatcttctgtgaaacctttttctaggtattcagtgattttcactataccatatatactttttaaaactcatttttgttttatttctggaatgtagatataaaataatatgggttattgaatacatgtattatgataatactaagtccacttaacaactgtaattatgtaattgtacaaagttaaaatccttctcttccaatcttactttgtgtgcattcattcattcattcattcatgccttattgcactggctagaactgccattataatattgcataaaaatgctgatagcagatacgcttttcctctttctgaatctttgttaatgttagttcttggtttcttttcacacaccttttataagattgataaaacttttacattcccagattcctaagttttgcatcatggataggtgctaaatatctattgtttttgttagcttagtgttttattctagaaatttgtccatttcaaataattttcgtatgtcttgtcataaaactattaatatcctttcctgttatttcatatctgagggatctatattgatgattctattttggttcttgatatgaatttatatcttctctttctctttttttccattggtgattcttcaaaaattttagtaattgttggaaaaaacaaatttttgctttattgatctcttttctatgtaattgatttcaatagtattaatgtctgctcttattttttattttttagtttattatttttgtaatttaaacatgtttttgagagttgatttttaatcttttttctaaggtatgtatttaaacataaattttctttgaagtatagtttagctgcatctaacaaatttttctcacatttttgtcataatttcaatttttttccattttcattataattttttctttaacatgtgggtacttagaaatacattgtcaaatttcaagtgattactttctatgttttttctattgctttaaggctttgatttactctgtttagagagatacattgttttaatctattgttatcgagaatatggaaaattttagtaaataatgtgtttactattacaattagaaaataatgtgtaccatagttgctgagtacagtctttcatatatgtcacttaggtcatattgttgaaatatgctgtttaaatcttcccttctgattttctttctatttgcttcttccattaagagagaaagtaaaaaatattccactgttgttgtcaatttatctattatttttgtcaatttcagctttatatattctgagattacataatttgataaacactaatttaaaattattttatcttcttgtttaacagttgtctaataaaaggtctctctatttctggtaatcttgcttacttgaagtcttgtctgatagcatagataagcaagctttctttggtcagtgttcacatggtgaataatttcatctttgattttcaagctgtgttatattttgatgcctctcttgtgtgttgttttcattttcaaggctgacggtccttgcattttaatatattttctgtttaatttcctactgaaatacttggattcaaatcatctacattttatgttttactatttgtatcttgtatactccttttttccttcttcatgtaaattattttggattgaagttctttttaaataataattacctctattcccacttcatagtttattagtcatatatgcctttactattcttttacagataaccctgaagagcttaaaatatacatccttgactctttgaaagaacaaaaagaatttgtacagtgaccatatttcaaacaaatgttggaacacttttccattcattccacctgtgtatatatatatatgtgccattgtttccatgtattttattatgtatatatcttttaatctgcaaatggctttgttaacatggttttatacagtcattacttgaatagattgacccaccaatttatccactgctctctattccttcctgcgtctctaatgcttatttagagtcatttttattctgttgacagaaatttctttaggatttttaatggaactgctgttgatgaatcttcttttttttgtctaaaataagtttatttttattttgaatttttttctgtggttaggtagagaatttcggtttctttttgcttccttttattttctatattagttctttgatacagttcttgaatttgctcttttaagttagtagcaaacaaacatcatttttaaaacaaccatataactttttaattagaatatttaattatgttttcctaacccacaaatgcttttgcaatgccgttatttaaagttttttttccggaacttttatctctcacatatgctttcactgtaatgcatataagcttagagagattattgtgattttcttggctttttgggtttcgggtgtatattttcggggactttaggtgtcaacagacctaaaagcaaagagaaagtgtgggctgtcttcccactgtggccagtaatggagagcttgtggactgctggtctccttctagaatcatacagtttcccatttccaaaaactagaggacacagctcattggttcagagccttcttggtatcctgagatgtgaacctttattttgccagccaaattcttcccaggatcctcactccacagctcaaatgctggcctgctttttctctgcccaaaggtgaacaactttctcaccaattatttctgctcagactctcacagaaactgagttctcagaaaccacttaactcaggagatgtagatatactgacactgtcagtctacgtgaagagctctattcaggctctagaatcctcatagttatttatacaagaagaacttgaaggttaatgtacttacgtatctaccattcaaattcttcaattgttgttttgtacactgttatttagttgggtattataacagaaacgaaagaaaagaatgtactgacctgcccagttggcaaattgcacccaagaacccctcaacccacagagacgcttaatattatattaacaaggtcaatataatacctctcagtgtactggaactgtaatttactaagtaattagatgtctgacaatacaatattctgggtaaacataaagtagtttagtagccactgaatttgcctcattgtatgtaaaatcttcttaaaaatgttttgaagtaattttctagatagttaatttgctacttacccaactttaactgtcccagttcttatcttacagtgcctctcaaaggtcaaggccagaaggcacacattgaattttcaaaatgctcacttagccatactttatgggctgtagctcattctaattgctcaagttacatagtagttacttcatggtattcttccttaggctttatgaaaatgaatactacatttaggtggctcagtgataattgataccactagagacacagattatagggaacataagattctgctgcctttatgtacctgtacatttctcctaaaatatattcagttacttgcaaaagtcttggtaatatgtcttgatgtagcatattgtatttcaacaaaagtgaaagtagattcaggtgctggttctgtcctgtgacatgataggaatcaaattatattcccagtctttttttgcatcaattctcatgcctatatttaatatttagaagcatatgcttggtcagcagcattctgaactacagctttgaataatcctctgattagttattttccagatttccaggagctgtaagatggatttaagtaatatgttgattggttagtaaactacttgttttataaatcagcagtggattccctttgcgatatattcaccctggttatttatttcttacttgaagaatctacaaataacgcagatgagttaaaggaaacagagtagtcatatagtaaatcagcaaaacaaaaaatctgaaataaatgtatttagttttaataaatgcagacagcatcttgctatgttgcccaggccggtcttgaactcttagccttaagtgagtttcccatctcggtctcccaaagtgctgggattacaggtgtgaagccatcatgcccagccaagaaatttatttagaagacaaacaaacaaaaaaacacacttcagggactacttgaagtcagccaaagaacacaaagttattttgaacatgaattatttacaaagtcttacaacaggtgaggttgggataagtaaattggtgtaatcctcctttcaaggagtttaatgctaagtaaggagtcaatcgtgtaaactactctatgtgacaggtagaaagatggaaatttttttttccacagtgttttttaactttttattattattttgtcttcatcttttaagtccagaaatacatttccaggatgtgcggttttgttacataggtaaacatgtgtcatggtgctacacagtcatcccatcaccgaggtattaatcccagcattcattagctattcttcttgatgctctcccttctccccgccaccctctgacaggccccagtgtgtgttttccctctctacacgttaatgtattctcatgatttagcattcacttataggtgagaacatgcagtatttggtttactgttcctgggttagtttgctaaggataattgcctacatttcaatccatgtccccgcaaacaacatgatctcattcctttttatggctgtagagtattccatggtatatatgtaccatattttctttatcctgtctgtcattgatgggcatttaggttatttcacgtcttttctattgtgaatagtgctctaatgaatacacacatgcatgcatctttataatagtactatttgtattacttttggaatatacccagtagtgggattgctggatcaaatggtatttctgcttctaggtttctgagaaatcgccacactgtcttccacaatgggttgaactaatttacactcctgccaacaaggtaaaagcattcctgagggccgggcgtggtggctcacgcctgtaatcccagcatttagggaggccaaggcgggcagatcacaaggtcaggagatcgagaccatcctggctaacacagtgaaaccccgtctctactaaaaatacaaaaaattagctgggcgtggtggtgggcgcctgtagtcccagctgcttgggaggctgaggcaggagaatagcgtgaacccgggaggtggagcttgcagtgagccgaggtcgcgccactgcactctaccctgggcgacagagtgagactcctcaaaaaagaaaaaaaaaaaaaaaaaaaaaaggcattcctttctctccacaacctcagcagcatctgttacttttttttgacattttaataatcaccattctaactggtgtgagatggtatctcattgtggttttgatttgcatttctgtaattatcagtgttgttgggctttttttcatatatttcctggccacatgtatgtcttgttttgagaggtgtctcttcatgtcctttggccacttttcaatggggttctttgctttttcttgtagattttttaagttccttgtaaagtctggatattactcctttgtcagatgaacagattgcaaaatttttctcccattctgtaggttgtttgatcactgtgtttgatagtttattttgctgtccagaagatctttagtttaattagatcccatttgtcaatttttgcttttgttgagattgcttttggcatctttgtcatgaaatctttgcccatgcctatgtcctgaatgatactgcctagttttcatctagggtttttatagttttgggttttacatctaagtctttaattcatcttgagttaatttttgtatatggtgtaaggaaggggtccaatttcaattttctgcatatggctagccagttctcccagcactacttattaagtagggaatcctttccccattgcttgtttttgcctggttcatcaaagatcagatggttattggtatgtggctttagttttgggttctctattctgttccattggtctatgtgcctgttctttcaccagtaccatgctattttggttactgtagtcttatagtatagtttgaagttgggtaacatgatgcctccagctttgttttgttgttgttgttcttgttttgtttctttgtttgcttaggattgccatggctatctggctattcgggctctttcttggttccttataatttttaagatagttttctctttttctaattctgtgaagaatgtccatggcagtttaatgagaatagcatttaatctctaaattgctttagtcagttcggccattttaaaaaaactgattcttcctatctatgatcatggaatgtttttctacttgtttgtgtcatctctaatttctctgagcaagcagtcatttgtagttctccttgaagaggtccttcacatccctcgttagctgtattcataggtattttattcttttatgtctctgccaggtttggatattaggatgatgatggcctcatagaacgagttagggaggattccttccttctcaatttttttggaatagtttcagtagaaatgataacaactcttttttgtacatctggtacaattcagctctcagcctgtctggtcttgggatttttttggttggtaggcaatttattaccaccttaatttcagaactcattttggtctactcagggatttagtttctttcttgtccagtcttgggagggtgtatgtatctagtaatttattcttttcttctagattttcttgttacttacataaaagtgtttataatagtctctgatgacttttggtatttctgtgaggtcagtagtaatatggccattattgtttctgattgtgtttatatgaatcttctcttcttctttattagtctagcttgcagtctatcttaattttttcaaaaaaaaaaccagcacctggatttgttggtttttttgaagagtgtttatgtctctgtcttctttaactcagctctgatctttatttcttgtcttctgctagctttggggtttctttgctcttggttctctagtttgtttagttgtgatgttaggttgttaacttgagatctttctagctttttaatgtgggcttttattgcagtaaatttccctcttaacactgtggtagctgtgtcccagagtttctgatgcattgtatctttgttttttattattttcaaataacttcctgatttgtgccttaatattgttatttacccaaaagtcattcaggagcaggttgtttgattttcatgtagttgtataattttgagtgaatttcttaatcttgagttctaatttgattgcactgtggtctaagcaactgtttgttatgatttcagttcttttgcattttctgaggagtcttttacttctgaatatgtgaacagtttttttagtaagtgccatgtggtgatgagaagaatgtatattctgttcttgggtgcagagtttgtagatatctgtcggatccacttgatccagagctgagttcaggtcctgaatagttttgtaaattttctgtctcgatgatctgtctgatattggcagtggtgtgttagtctcccactattattgtgtgggagtctaagtctctttgaaggtctctaataatttgctttatgaatctgggtgctcctgtattgggtgcatatatatttaggatagttagttcttgttgaattgaaccctttaccatttgtaatgcccttctttgtcttttctgatctttcttggtttagtgtctgtattgtcagaaactagaattgcaacccctgcttttttaggttttccatttgcttggtaaattttcctctttctctttattttcggcctatgtgtgtctttgcatgtgagataggtctcttgaagacagcatatgaatggttcgtggttctttatccaacgtgccactctgtgtcttttaattggggcatttagcccatttacattcaaggttattgttatgtgtggatttgattctgtcatcatgatgctagctggctagtttacagacttgtttatgtagttgcttcatagtgtcactgttctatgtatttcagtgtgtttttgtagtggctggtaatggtttttcttttccgtgtttagtgcttccttaggagcacttgtaacaccggtctggtggtgacagtttcccgcagcatttgtgaaaaaggactttatttctccttcacttacaaagcttggttttgcaagatatgatattcagggttgaaatttcttttctttaataatattgaatatttgccctcaatctcttctggtttgtaaggtttccactgagaggtccactgttaatctgttgggcttcccttttttcatgacctgacctctttctctctggcatccctcaatattttttcttttattccatcagtgaaatgtttttatagtcaaataattttgcaaaacatttttttcataattcacaaaacaaatgcgtattttaagtgttcctatagtaaaggagaatcctttaatctgatatgacaccaattttgattgactatagtataccctaaactcatttttattccaaaaaatttattgatatcattagaatagtacacatttgtgggacacttaagtttgtaattataatagctgggagaaagggttacagccaataaatcctgattgtggaatcaagacagcttcacagagttggtgattgggcgtggaagaatgaaagcaatatttaaataggttaatctaaaacaggaagtacatataaaaatttgaagaaaaaattttcaagctgtaaaaattacataagcaagcagttgaaacatttctgcaataagatgtaaatatgtacttctagctatttttgaaagtaatgtagtcttcaaagaaaaacattaaaaactgagtacatgtgtgttttcagtacctgtgtgcacagcacagaaaatacaaatatatttaaggctcatttttggcatcagagaggaaataatagtctttaaataatattactacaatggaattatagctaaattattccaattaaaaaattcctttctgtatggagcttagagtttgtttttaaaacaaacaattatagaaataaatgtgaaattatgatacatagtacaaaagaagttacaacctgtgatgattgtaagggttttaaaggaggaggtatttgaattgaggggttgaaggatgagaagctgatgaggtaaaggttatgaaatgaggcatgacaagcagagggcacacaggcccagtggaccgtgaaacatggggtcttcaagggtggatagagtaatggacagtagagctgggacaatagaggatagtgagagacatggagtctctgcaaacataatacccaaattgagtagttgacaagaaaaacaaattttatttctgaaatagaaataccaatatgtcagtgggattttgacagacgagattgtttctttgatttataataatgtgacgtgtatgtttttagaatggataaaaattgacaacatgaaagttcagcttaactcaacaagtattcattgaatcaggttccaaaggtaggtaaatgaatatgatacattccctattgatgaaggagatagaaacataaatatgtgcatgtatctaagatgcctaaaaggccttttgagtgagaggaagtctgagctgatacataatgtataaacattcagatcttgaatctgagatcagacgggtgattcagatagaaggaattgcataaacagacacgtgaggcttaagcaaataatgttgccgagaaccataagtactttgatgttgttggaatgtaaaatgtgagaaaggaagaaaaggcagagaaagctagaaaaaaaaaacatgaaatatatcacaatacggctctgaagccaatacggctcatgaagccaaagacttagagttcgtgctatacttcagggctgtgcaaacttcagacagtgagccaaatctggcttattgccattatttggtgagtaggcattggaactcagccaaaattatttatttaatgttatctatggctgttcccacatttcattgtcagagctgagtagttgcaacagagtgtgtgtagtacacaaaggcaaaaataagtatcatgtagcctttacagaaaaaaagtgctgaccctgctatacataatatgccaagcacagtcttcaagtaagtgagtaacagttttagactttttcaaactaaaatacgtagtcaccacttttttattattatttcactttaagttctgggacacatgtgcagaatatgcaggtttgttacttaggtatacacgtgccatggtggtttgctgcacctatcaacctgtcatctacattaggtatttctcctaatgctatccctccccgagccccccaccccctggcagtcagcagtgtgtgatgttcctctccctgtgcccatatgttctcgttgttcaacttctacttatataagagtgagaacatgcggtgtttggttttctgttcctgaggtaccactttgtaagtatctaatatatgttaaacaccagactagatgatttactcacatgaactgcgtctcaaaaccattcttcctggtagatatcaaaattccccattttactgataaatatagagattaaggaaggttaggtgcctttccaaggccccataattttgacatttttgaatcaaatttaaactcagttctgtcgaacacaaaatacattacttttttacagtctggtagcatattacaaaaatgaatactagaatcaaatgaagtctaattgtgaggaatttgttgcagaaatcccaccaattcatgatctgtatctaaattaggtagaagggtaatagagagaaattccagagtttagtatggaaaataagtagatcatctagaatgacttctttattcttgacagattgggtgactaagtcagggaagcaacttcccactttctgttttgggtggttagaagaaagatatattcatttctagatacagggaatctaggacagcaagcaggcccacaagcagggtagcattgatgagtgatgttttgtacagtgtgtatattttcaaatgtctgaattagatccatgtgaagatagacaccagggtgttgcctgcaaaaggctaaaactcagagacatgggatacaagttggagattattcagctttagcatagagttaagaagtagcagaagctgacttttatacaattttaggaatgagtataaaatattttatatatcttatagaaatccattagatttagaaagaggcactggattatggtgcttaagaacactaagggccaggcacggtggctgacacctgtaatcccagcgctttgggaggcctaggtgagaggaggtttgagaccaacctgggcaacgtaggaacatagactccatctctacaaaataaataaacaaataaataaatagaaagaaagcgaaaaaataaaactctgtaaaagctgacaacctgagttcaaatcttacttctactaattttctataaccttatgcaaattactagatttacttgtgctttggaaacctcttctataaaatgtctattactaacactaaaagcacttaccttgtagggttgttaggaggattaaatgagttaatacatacaaaagttttaaaataatacttgtatatggtaagcaccatatagatgtttacctgtatttattaatttaaaaatattttttacatttcatatatttaattaggatttttcaacatagttttctcactacctcatataccaatgtttattctaaactgaaaagggatgtataagggtctataaaagagggctgacctgaatccaatattttctttatacctgtatatcagccataagcctggagcattgtgtgaggttaaaatgaatgaagtgctttaaagatatgtttgccacaatagagcttccttacatgtctatgaggaatattataaccaagcatactctcacagagtttaaactcaaatcatgaacatttaaattaagtttttccttattttgcctatacccatttttatctttcattgtcatttttgtttgacagagtatgatgagatagagtatttttatttggaaagtcctcagcaagacaaattagccaaaagcaataatggttcagattaaacagagtggaattgatctaatccccaggctcaactaaggaacagtcactatctgggtgtttgattttagactatagataagttgagatgttgtaatatttatggaggaattggctatgtcagttatgggatgaagactagtagtacaagtaccatcagtagtcattcttttttttttttaactttttactaaactaatacagttagatatttccactctatcatgattatattttttatgacagaaagaaaacagttccatgtttttataaatagtctctgcagagatttcagatgatgttattggtatcttggtttggcagtgtccgaaaaattgtgattgcctttaaagtgtttgtgctacttttagttaagtaaacccacactgtgtaagacccaggctggttccaagtaatatcaaggtttctatgcacataatagtttacaaagaacttaagtttaaagactatggattaaaaacaaacaacaacaacaacaaaagtgctttacagaaccaaacaaaccctctcttgatgggaatgtcaaaaaggacacatgagtcaactggaaactcttaaaggccaaagctgggacaatttgagcaatccaaaaaaatagtatgaattaatatccaaagtataaaataaatgtccttgagtccctactgatacaaataaataattgaataagtaaatgagggagaagggaaaatctcctatgcagaatttcaaataaattatgtagctgttcaacgcttaaagaaatacaacataactcttctgtgtgttgtacatagtgactttcttcccaagaatagagtgtggagaaggatggggttggggagagagaaaaagagggggagagagagagagagaaactttacagcctatgttcagtgatcaaggtcatcatcaacagtgataaatcatgctgatactatgtacgcctaatatgatgctttgagaatggcaccttaactcccaaaaacccaaaattcataaaattaattattaaaacatcagaaaatttcaagatactctacagaaaatgtgattagtgctccaagaagctttcaaaatcatcaaaaacaatgagtggctgagaaactgtcacagacaagaggatcctaaggagatgtgttgaataatgtaaaatgggatcttgaaaaaaaagtaacattagagaaaattagggaaatctgaataaagtatgaactttaatgaatattaatctatcaatatagattcactaagttttacaaatataccttaatataaggtatcgataatactagaaaccaagtgtggggtgtatgggaattgtatgtactatcttttaaatttttctgaaatctaaacctattgttaaaaagcttataaaacaaactaaacagccagtcatatgatttaaaagcaatcatggggaccctgattacaatttaacattctccttccttactagcttagtattcatattagtctcttcagctatgcaactaatttgtttttcctaaatagcaaaaaggaaaattgaacattaaccgtttcgacgactgttttactgaacgtttttcattatttgcacagtttagtttatatgttagtgtttttttttttaacttctgaaataagatttttttttactacgtatttcctatccccttaattcattgttgtagtagccaccaaaatctcggagttttccaaagtattttacattattcagtgtattttctgtttaacagaaatacattattcaagtattacattacattattcaatattatattattcaaatattttctgtttaacagaaaaataaagataagaatattacttgtaatttgattatttaaaatgtctagagaagagaagaaagctataaaggggaaatactcactaaaaaccgtattctaaaaatattcccagagatttaaaaccctggaatccctttgtaataaattatatttattttgagtccctaactgtgttttcatgaatattcacaatgttattagcttatttatctcctttttgggtcaaatgcatttactgactgtagttgcatgcttatggtgacagaggcaatactttaacactacctgcagagtcgcacattatatgttaacacttctaaaatatatttcctataccaactgttccaacttttgaacacattgtttcagtaattgcatggtagtattgcctgacaaaccaatactcccattttgttttaatttatacagaagtgtctttacaattaactaaatacttgttacattttcccacatcataaaattagggggaaaatagaaaaatgaaattactgattcttgtaatactataatcacaatcatgaaagtattctaaagagcaaagctgtgaatcttgatttctattaggtactgattaaataagtagtatagacagtgtgggaagcataaaaacacaaaaacataaaaaaaaaaaaaaacttgattctgaggagagtttccaaagagggagctactcttgtgagcataaaaattaaaacttttttttcctgaataaatgcaaagagaagttcatagggacataacatggttaataaaggtagatcatggtatatctttcatgaagagaaggaagataacgttcaattttcttctcaccaagatttgaaaatatgtagtaaagccatttcttgttcatgtcgtgatgattttcctgaacaatttcttacaaaagcaaatccttttagtatttcctaagcaatgacactttaaaattaactaagaaaattaaatttgaggtaaaattcaagatacaacatttgctacttatatttaatgtttaatttgtgtttctaatgcttttaaaattaacatctaaaaaactttttaaaaaatctaaaagtatatgtcctaatttgagtttttatcactctttaatatctacagtaaaataactttctttataacacacatatctcaaatttctcttcaaatattatgcattgaggtatcatgtaagacttccagattttattatggatgaaaatgggatctacttgtacttgaaaaagtaatgaataaacaatactctgattttttatctataaaactgaatcactacaaaggctagggataagccagtgatgtgcctagcgaagtattaagtgtatataaatcatctattgttaaaattactcactttctaagtgtttccactttaagttcaagaaaactaaccattgttagatcatgggatgcatttgaagagctttaaacacctcactaccacctttagtgtacactctaaccccataaagagctcattattgtcttccttttctcttattcctgtggcctttatttataaatctagctactttatttctgctaactttacataataggtccctattgctaagacctcacagcatttcacaattacttgattacacttaaaagttgtgcttcattccactgagagcactttgcaaaccctaacacagcagcctggcacatattgggtaaatgaatgaatatatgaatacatgaatacatgattattccatttaataccaatttgatattggcctccatggttccacaggtatcatcatgaaaatgtatagcaccactatatcttgccaaaaagaataaagttaatccaaaagagttgccaaatttacccagagaaaaacactttttaatttcttctctttaaaacgttataacatcataatgttctaatggagcaagttttctttgggactgaatgttaaatattatgttttgggaagcagaattagtaatctcttaaagtagagtactcggtcatttccatccatgattctatgatcacacaacttgatagtgaaaataactttgccaatcctgagtgtgaaatgctacgtttatgaaatataaaacgcatttagggcaattaaatatatcagcattttctttactgaaaactgatcaatgcagaatatttaggaaattacatttagacaaggcaaggctatgcagacatacattacatgattttgttcaatgtctccatttttatctcacctagctctaaaaggtggttaggcagatattagcaggttgactgaaaaatcaagtacttagtgaccttgtttaatttttgttcttatgcttcacatttcaaaaataataaaagccttaattttgtcatgaaatgcagcaatggtggccgagtaacggtaaaagaaatacaatgagaaagaagaaatgagcaggtgagatttattctgtattaaatggctactgtcctggtcctatctacacaaggaatagcaatttcatgctattgttcatacaatgcatggaagcagactttgtcaaaaggcagagagtgggggtgcatggaggataaggcttcaataagatttgctgtaattctcccctttgattacctcccccaaaatgagtatcaaaatgttctaccttccatcttggcagaaagggaagaagacatagggcaggtggtttttgtaactactagcagcaatgatgacaggaaaataaaagttttcattactgagaatgaagtgaaatatctatttaaggaccatcttattttcttaaaatatgtccattaatttatacattcatttattgtacaagcatttttaaacacaatacctatgtgctgattcactgaagggcatatggaaatcaaaagcaaagtcttgttcttcttcttcagtagatacaaatagaaatcagccaaacaacagataaagaatgcaaatgagcttcataaggaaatagggactagagtaaagtgtaaagtggaagagatggaacctgagaaatcatctcagaaagctgagtttggagaaaagtcctaggaaaaaagtagttatttttgaatactatgagtaagagattattgatataaccatctattttttcaataggtaatagaatacaagctggtcttgtagaatatgaagagaagagttcattagttttgggattctgacttattcccaaatatccagatgtttttcaaagtgatataaatattagatatatttaatggaacaaaataaaaataattttatgtatgaaagtgaagcattctgaatttgaattcagatgatcaaattgtatatgtgttatcctattctgtttaaaaaatgaagtcatagttcctatatatttttaaaatattatctccaatagaaataaatagaaaatgtttaattttcatttttattttgatctttcctataataaacctgtactgctttcaactaagaaaataattttttaaaactctacatttagaattgttctctgactatcacaaagtctgttagagtaactatgaagatgattcatagattctgctgcctttggctcttctttctctttgacttggcctttaacattgctttattcatattgagctattttactcctaatttcttcatacagttatgtctgattctactgtgaaaaagcattccaaattgcttaataccaattaatttgtgacattaacaagaggccaaggaacccagtcacagtccttatttatttactgcatttttgtgagtttttgttaatcagtgagtatatttaagttatatagttattaatagagataactctccttattagacaaaagctcacaaaaactaccttatcaagaagaagatattatgcaaatgcaggtggaataaatctaattttccatttttatgcacaagttatttgcagccccagtttattgtaaatgttgcagcacctacctaaccatatttttaaggtacatatttcatatgggtagcaaggggctaataataatgaaaaatttggacatatgaagtattcttttctgttactagccttgtcaccaaccgaacacacagccttgtttgtagctcactttcccattttcaacctattggcaataaaatatcaggtgttaaaaaatgaataaaatgttgtaaagtacttcagtggataatgtttcatatatttaataatggcaggcttattagtatcactagacataggattaaaatgtaattattatcataatcagttttgttataatatttagattctttttctaattgaaaactagatgcatactaactcattctcctgacattttgctgtcttcaacaataaatatttcaaaattggatcatattcactccagcagcatttaagcactacttatcaatatttttcaggatacttacatatatgaaagcccattcttgtgtctttatatccaagatgtttgatgttagcatttgagttaattcaggaatcctccagaagatccatctgtttcctattcagtgttgaaatattggtttgaaaagctgtttactaaggataaaagtaggaatcatctctccaggaaagaagaaatactctcatttatttttgtttgtgagatagcctctagaaaggatctaattaatgaagtatataaggatgaagtgtgttgaaactttctttcccttttaaaataaagatacttcgatacactgagggaatgtataaacgtcgcatgaagatgtataggatgttttaataggacacaggaagaatttttcttctatataataaatgaaaatgtcaacttcaagcactagctctataactcttactttaaaatcctttaaaaatgttaatgattgcgtatttataatctttgagttttgatttttaagttttaatttcctgagtgttttttataaaaccaaatacatatcaaaggtatttggggtttttttttttttttttgcttgttttatgacagtgtgcttgctttctaatcaagattaaaacaagccatactgatgcagattaaattatctagaggttgagttttgttaagtttctttcacttcttacatggactgaagtgatatatatcttcctgtcaaatgatctttatatcttgataatgttttcattgcataaatgtttctatgaatagtagtaatatataataaaaatacttgtcatttcttcagtgcttagtatctcctaagcactgaataaaattatttatatgtaatcttcacaatagtcttacgaggtaagtgttactgtttctgttttgaagatgaggaaatttgtaaatccgaaagtttaagaagtgcacctaaatttacactgctaccaagtggtcaaatcacaattaaaatttagttctgtttgattacaaaagccacagacatatctaatgacatgttctattagttcaatatgatgcttatattgataagatttcaacatatgaagttattggccattggttaatttgatcatttaacacagatatatagcatttgagtaactctactggatctcattcaactatcattagatccaaacaacgttgaaatttcgttgctagaaattatagtgcatgagctatataaaatgtatgatatataagaaatgattaatgcataggattgtaggtagagtaagaatgagaataaataatctgaaacaagttgtgatggatttataggacattgtagtgaactgcttaagcaccataataaatgaaggcaataaataattatatgtgtgtatatatatatatgtgtgtgtgtgtatgtgtgtgtgtgtatacatacacccatatgcatgtatattaataaactcatatggttttctggcccccagtgactgaccccattcataactctgagttctatactgttttgtgcaacatttccagaagagtcaatattccatcccagactgggaatccaccaggtattcacataggaacttactaagtgccaagttaaatcacacaggaacttattaaatgccacgttaaatgattacaaaattgatatgaattggaggtaaaaattaaaagccatgttgacttttaatttttttcttttaatttaaaaagtgagttttgtgaatagacttaagttgtgcactctacaactcagattagtgtggttcctagatgaaggttacaaaaaccaaacaaattgagctatgttttggtctgcaagataaaaatatatatgaaatactagaaatgttttgtccttttactatcaaatgttaataaagattctaaatgtgtgtaataagtttattataatacaaaaaagagaacccgattttatctcaaatacatattaatcatgaaatgtttactacgtacctactacatttaaaatattaaatactatcactatcttttatctatatatgcattctatatatccctgtaggtatacactactctctagaattcattatacttttgaagatgaaatacatctgttttcacagaggaaaaatgaggagtaaaaaaataaaaaatgcgaaagttatccccaagtgaagaatttcctctttgtcatcagtgactgagtctttcccagaagatagcatgtttattttctttaaaatgtttttatgttgcccgggaattcttcgttatagagcatctggcattccaataattatttccaaataacacagtcatttggactccgttagatttagcctgtgaatctgcttttggcattacctgtggtttattttggaaaaagctaataagtcaacaacaaaaaattagctgtatcttccaatatcttctggcttcattaactgcccactttacagctgtcacccagaagtgtatacgaatctctgttgaacacatacatattcttattctgtcctcttttctagaagattgtgctttattattgtattatttatataaaacagtactccctttataagtccttctgatttacagagatttcttcaaggcctagtgttcctagaatgtggtcactgaatccagatatgctctaagaagagttactgaaatttctcaaattttactcatagtgttacctttctccattaccagctgaagactcctgaatttttcattcccttttcctacagaaaagactccatgcctacatgcccctgataaattcactgatacaactacagaggtgattgtgtgtatactcaaattcttacagtattgaatatatttattctgtacttggttggttattagaatcctgattcacttaagcaagtattaggcctaatttttttacttttgtcaggtttgcttgttctagagcaactcatttttgttgataaacagcttaccaaaaagaaatgcagttgtttataaaaccatgagacagcatatttagaggttagaaaggggaaggactctttaggacctgggaagtgtactttagcaggaaaacagaatgcagaaagaggagcaggggcgatgggtttgaaaaacagtttttaattatttttgaacagagactgtggagctggtactgtgctagatgatgagattacatagtcctgatcctcaagtgtcaggatcctcacaatctaataaggaatacagaccagtgttatacactagaataacagaaaactacccaactagagcagagtgttgggatagctcagacaagctgaaccatcaccagggtggagagagacgccatcaaacttttccaaagagaagactcttaaaaatatatattaatcatttgttaaatatttaataactgagctctgttggcttatggggattaacataaagagtaatgataatagcaaagtttattttattactgtgtggctagtgctgctatcaataaaagagggactagatacagaagggggaacaaatctgatgagagcagttggttgggtttcacaagtgtgcataggtggaaatgcatcctacatattgggagatgttgataatgaggctgcctgtattatacagaactttataaaaggcacacttttagaacttaatctcacatgtaagcaattaattttattaaaatatgttccctactctattatatgtataacagtcttcataggtgggtttaagtcatttaaaatattatctaataagaattaaaaattcatagatggtagcttaatagctttcttattcttttacttggcagatatatcagcatttggaaacaccataggaaactgcccatttaagacattaactaagtcactctcactatctcttttacaaaataagaccaattccctctcattaattaaatctcttgatttaaaattcccattttctaaatttgtatgtggtgtcgtcagaaactatttttctctcttgggtagaagtcacttttaaacaatatacctactaatgatgtatcaacattcttacgagtgaattctatctatcttttaatttttttcttgcctgtggaagacttctacactctacttaactgacctttttaatgaccaaaagacagaggtgttcttcctatcataatcaaatgttgatttatttgtgtctggtcttttttttttttttaagctataaggatatggattaagtatgcagactctagtgtaatcagagtagtttgaagttcacaaagtgtaatcctgtgctatatatctcaattaatcttgcagactatggctaatcacattcccaccaggcaggatcacacaactcacagagccaggattattaaaatccatatttcacgttaatagccatgtgggtgagattagtttctaagtggtaatgcacctgccataaattcctcctctctgttatcttctgaaatactgctctgtcagaagatgaaaagtacatgatgtgcattcagaatcagtttatggtctttttttttctattggtcaagtaaaatatatcttcatccctcactgatttcaaatgcactggagaagataaacactatttaatattcctctgtgacatgtcataaaggccaaagtgttcaagtttcattacaaatcttagtaagtcttttcattttaacatattgtcctaaactaacctaaaaaaataataattaacaaatacaccttcaaagaactattccccatttgattatctaaattaattttccttccaacattattgcaaattaaaagctcctgaatagcctacacatttacttgtgcattaattcgtaaaaaaatgaattacactggagtgaagataataacaaactaaaaatcaaaatatctaggtcttagcccaggctctgttgttaattgaataatttagagatagccacatagtctcattgtttttcacaggacttgagtcaaatttacatttggctttgttgtcttcaatttgaaagctaattctctagaagaaaatgaagaatgaaacttaatctttattaacctgagtaagaaatatgcttatatgagagataccagaaaacatttattctccttgttaaaatgtttagccttcccatataatctctcagcaatcatacctgaaatatgctctattataatatctaatataaaataatatttttaaatgtccccctttttgtccaaaatgggaaacctattttatcattattaatagaataataacacacataaatactttaaaaggtataaagcacttccatgagtgcttttaagagaggttttgaaatgtgtcctggataggtctgcagatattattaatatacttacttgatcactaaattgctctgtatctttgttttaaaaagttgaaatatggacatgagcgaccttcagaggtcaaaccttaaaagccagagaacaacttgtgacctagaccactattcttgatgatgatcttcccctggcttggtataaaattcacatttttcctcctatgggaaatacagggaaaatattacagctatgaaaaataaatcctgctgcagaatttaaattttcagaccttttaagaaaatagatgttaatgctttctgttgagttgctatagtttcacattcatatattagagatgcattaaataagtttacctgtttaataatttaaatgctttaaatacatgcatttgacgtttgcatgacaaagacaaatacattcataccactttgtaatgtcacagtcaatcagtcaacatgaaactggaagattcaaagaccaaagtaaataaaaatataaaagtcgacagatgcattaactttcccttctgtacatattgtttataataagatactttcaaaactcaaattagatatatgaaaaaggcaccattctgatctactagtgcctaagcattgccaagcagtcaaatctaactaaacgttctatcctcctccatttttcttcgatgcctactgatgcctactttcttttctcactgtggggtgaatgcatctactacttgcagctaaaggacaaagagtcccagcctcccttctgccagagacaccaacattcttacactcaatggggctgaaaatcctagagtcatttttgatcatccttctcattttctttattcagagttacgaatcctgtccaacttggcttatatcctaagtttgtccatcctctctttcccttatactagtcctgtcccctctacacagtttagaatttactgtcagatttgataagaatctcctcactaatacctatgtatccattcacattcatcttccttgctaatccattggttttgttttccaaacgcaaagctgtttttgccatctcttcctcttcacatttttactgttgtctaaaattttctaaatgacatgcaaatttcttatgtagctaagctcattagcacatcatctttctggcacaagattactacaacattctgagctactttatttgtttaaaatgttccctgtgaattcctttcatgcaactatgatggcaactttgttcttaacaaaatgtctttgtttaaatgaacgtaagattcagatcacacacttttttttctaaaatattaatcaacatctactgtatgattgccactaagttaaaagaattgaacaatattactaaaattaggttaaataatgtcaagattttgcactgaattgttcagtggaactttacattgaaagtctcagtctgtttaagtcatgtgtctgaactctagagagtgaaattgtttaagaattacataaataccccatgtgtgcacatgcacgtaattacatttgtaaaaataaagacacatatgcatatatacatatgtgcataattgtatatataaacctcaccagaacaacagatatatttctggaaaatagtttataaatttcacatttctaaattgggtagtaattccatcaaactagaacaattgcaaattaacaggtttttaataagtaaataatgccatctagtttatgttttgggtaaattttaatagaagtttgaaaaggattcattaaggtatataataagttatttgagtttgcattcattggtgttttattaaggcaaagatattgaggtaattcaagccattgagggttttccctgagaaaaggaattagaggagagcccttaggtttagagttttaaattaaaaaaagatctaatgaaagttcattgctgaaaagttgatttttatttggtgtttgagtttatatcagtgattaaagtacatttgtgatttctgcataagctgtgtctttacacagttcattctgcctgccttcctcttccagaaatgtttcctgccatattctgcttttattgtgctattagtatttttttgttctaaaagcaaagaacgcacctgctaggcagagttgctaattttatccctgaactcactcatagatgccacaagcacttcccagtcgatacggttccatgtatcaggcaccttctatagtcccattctagggtcaccgctgttgttgtatttatcatcactgcccagcatctttaccctgcgtcaagaatcctatgcactgcacgttcctccatagaaccttgccccattcattcctcttgtcataacactccaggatataagtgaattcagactttctacaaacccttttgttctaaataatctcataaaactactacagccatactgttgtagcattaagtgagttaagggtgtgtgtctgttgttgttgtcgttcctgttgttgcatctgaatctgttggaaacaaagggaggatggtaagactgaatagttcatgcaaggggcatggcccctactgcagagttcctgctctagattgtgtgtgtgtgtgtgtgcatgtgtgtgtgtgtgtgtgtgtgtgtgtgtgtgtgtatgtatgtatgtatgtttgagtaataaaggtccacatcccaaatctgacatttttttttagatacgcaatctcacatgttggggagtaaaaaaatgactacacagttcaatattaaaggactattaatgcctccaaattggtgagatattctgcacatttgaaagggaatagggatgttcatcaaaggatgagagaaaaggcagagattaataattttgaatagttataaaatcctttagaagtaaattttatgtatcaacttagttactaaaacatatttagaacataactaaaagataagcaggaatttggagttgctacgcaaaatgcagaatgcccaattaaatttgattttcaaatatgcaaaggaaaattttttagtattaatgtgtcccacatattgcatactgcatacttattcaaaggagtactttattcatcagttctggagattctaattgtacataacctatataataacttctaaatttcccgacagaatcgtttcaaaacatttttgattgttccttcaccttacaaaaaaatccctgattttaaaaaagtcaccctttaataaacttttgtgtagaaaggtaatgttggtcaaagcaactctatagagatagatgatatttataaatttcctgtcttaccttttagaatttctgtagtatattcttttagagaaaagtaacacataactgttaagtggtgatgtttttggtgattgtattgttattcatggtttaatcacagctatattacctaacttacttttacttagaatttagcaaaagtataataaaataatattagttttataaagtatttttcttccagactgaatattttttactctcttatacatcgtttgaagacacagttttttttattatactttaagttctggggtacatatgcataatgtgcaggttcgttacataggtatacacgtgtcatggtggtttgctgcactcatcagcccatcattcacgttaggtatttctcctaatgctctccctcccctagccccccaccccttgacaggtgctggtgtgtgatgtccccttccctgtgtccatgtattctcactgttaaactcccacttatgagtgagaccatgcggtgtttggtttactgttcttgtgttagtttgctgagaatcatggtttccagctttttccatgtccctgcaaaggacatgaactcatccttttttaaggctgcgtagtatcccatgttgtgtctgtgccacattttctgtatccagtctatcattgatgggtatttgggctggttccaagtctttgctattgtgaatcgtgctgcagtaaacatatgtgtgcatgtgtctttatggtaaaatgatttataatcctttgggtatatacccagtaatataatggctaggtcaaatggtacttctagttccacattcttaaggaatcaccacactgtcttccacaatggttgaactaatttacactcccaccaacagtgtaaagcgttcgtatttctccacgtcctctccagcatctgttgtttcttgactttaatgatcgccattctaactggtgtaagatggtatctcattgtggttttcatttgcatttctctaatgaccagtgatgatgagcattctttcatatgtttttttggccacaaaatgtattctttagagaagtgtctgttcacatcctttgcccactttttgatggggttgtttttgttttcttgtaaatttgattaagttctttgtagattctggatattagccctttgtcagacggatagactgcaaaaattttctcccattctgtaggttgcctgttcactttgctgatagtttcttttgctgtgcagtagctctttagtttaattatatcccatttgtctattttggcttttgttgtcattgtttttggtgttttagtcatgaagtctttgcccatgcctacatcctgaatggtattgcctaggttttcttctagggtttttatggttttaggttttaggtttaagtctttaatccattttgagttaatttttgtataaggtgtaaggaagggatctagtttcagctttctgcatatggctagccagtttccccaatactatttattaaatagagaatcctttccctattgcttgtttttgtcacgttttttaaagatcagatggttcttgatgtgtggtattatttctgaggtctctgttctgctccatcggtctatatatctgttgtggtactagtaccgtgctgttttggttactgtagccttgtagtatagtttgaagtaaggtagagtgatgtctccagctttttctttttgcttaggattgtcttggctaggtgggctcttttttttgtttccaaatgaaattaaagtagttttgtttttgccaattctgtgaagaaagtcagccgtagtttgatggggatagcattgaatctataaattacttcgggcaatgttgccattttcacggtattacttttatcctatccatgagcatggaatggctttccatttgtttgtgtcctctttgatttccttgagcagtggtttgtagttctccttgaagaggtccttcacatcccttgtaagtcggattcctaggcattttattatctttgtagcaattgtgaatgggagttcattcatgatttggctctctgttttttgttgttgttgttgttattggtgtataggaaggcttgtgatttttgcacattgactttgtatcctgagactttgctgaagttgcttatcagcttaaggagattttgggttcagatgatggggttttctaaatacacaatcacgtcatctgcaaacagagagaatttgacttcctcttttcctaattgaataccctttatttctttgtcttatctgattgccctagccagaatttccttaagcccatcctctatgcaagatgctggggtaaattgcagaaaaaattgttggagtggaaattgctttcagtatcataaatatgtatgtatgtttacaaatagaaatatggaacccaatgtgctgttaactattaagacttcgtctcttttttaccaggcatatacattttcggaactaggaaaacaatagaaatacttgcacttttaagtttgaatgtggtcaaacctggggcattttattgtagaaagtaaattgattttttcccttcatttaaagaatgcattagtgaagaaagaatccttgctgtttgtgtatgttataaaggaacaaaagctggagaattaaattatctgcatagctgagcaaaaaatagtttttctgtgtttgataagagtcagatattcttaatagaattcttagatttcgtgagcagaatggggaccatgcatggcattgaaattttccgcagacacaaaataacttgtattacagctgaactatagctctttggggacttgtttctttttattcatagaggttaagaatggtgcattatattatccatttaaagatgctacttgcatttctgaacttcaaatacaatcatgattttaatattatcaagtaaatatattttaatatggctacacagaaatgatttcattaacatttatagaacccttggtatcagtagctctgtagtattttaccaagtggaagcgttatatttcattgtatatttcttgtgttcctctataaatcacctgtgcatatacatcccagaaaaaatgagtatagcaagctacatagcattgaattaagctttaattttcactggctgcttacagaagaaaataacttgtatagcatttagaattttgagtaggaccatcctcatcatctcatgctgtgtattacaaaaggagtctacctaatgaagcatagggtctggatggtttaacttattttttggataagagaaagaagaaagaaaataatacttagttgctgccttccaaggattctgtgccatgctggttttttaacatgcattatcttaagaatatttctcatttaaatatagattttattatacatttttaaagacaaagaaatgaaggttcacagttacagcgaatagcctaaggtcacaccaaggaataacgaggttcaagccaaaagccaagtaccttttaatttacaaatcccatgttcaccatattctgcctaattgaaaagggattatcatttgtttgatggaaatataattatacatactattaatatatcaaaccacttagcctgtttgaacttcagctcatgtggaaaaaaaaaaaaccttgaagctgtctaacttctagagactatttttggtaatgtaaagcactattgagagtgcttaaacgtaagggttgtggtgttggaaagctagcatttgaatatgcgctctagtattaattactctttttatgccttcgttttctcattggtaaactagagctaataatagtacctaacttaggagtgtgttaggaatgaacaagatgatgtaaaacactttttgtgacgtgtaataaatgttcaataaatatttgctagctgatttgtataggaaattttatttgtaatagcagaggaaaggaaagagcattagagaagaagctgaataaaagagagtgaaatagaataactcttggagtttcgcaattacatagtgaaagtctgtagtgggagaacttatttttttaagacattttacataaaatctgagtaacagcagcagaactcctctaaatctagctcacagaggcaatggtgaggccatccttcccacctcttcatggaatctagagccttccagtactctgaagataggcaacttgagaccaccaagagagcagaatagttgacatctttctttagtggtggcattgatgaggctccttcaacattcgagcaggccatgaatgtttgccaggggaatgagaggaagaacaggaaacagagtgaaccccaaagtctgttttatggcctgtatagtttcaagagcctcacatactccccaaaatgtctaggatgatgttgcaaggagtaataaacaaaaagaaagatcaggaattttttatttatcatttataacatggtatatcatcatctctttatcctgggaagatctaaaagcatttgatagattttaatatttatgttatgtttatacacaaatttacataaatagatatacttgactcatgatctctttattcttcatattcatgaattattcctttccctgccaaaaaaatgtctaatatattgggaaaggaaattgtattaagcaaaggtttatctaaatgacagaaccattgatttccatatattatttttatgttgttagaaataaagaggagagtatatccttagaacaagaatataaatttatttcccaaaataatcaaaaaattattacttttcagctttcgactttagtcatctaatttaaaaaaaagtttggaagattttcttagagaaatgttttcgagatgtgtttgctttcatacttggtatcttacaatttgatagtctattgtaatcactaatatgtctcatattttcttttgttctttctttagttgtgaactcttaggtcagcaataatatcgtgtatccctttgaaccccttaacaattcctgttggagtactgtgcccaaggaaacctctttaaatattaaaaattgataaagatactttccaatttttcttttctcttcttcctagacttcggcatgttaaatcgatgactacttctaacaattctctccttctttattgaagcaacctctcttggcttcaataatattctagcttcttctttgtctcctactcctctgctactcctcagtatcctgaatgagctcgtcttcctctctccacctctggtcagacccttgtctggatgttgacattaatcaccttcttttcatgctgctcccatgcagtcccataagacaactaaccttaacacatcctgcctagtctcatcagcttcaacctctgcctcatccttcatcagtgtattctctatctcaaactacatgcagctcttagaaattgtaataaatctcttaccctcagcatccacagaattaatattgcaaccagcttttgtatgggggtaaggatagagctctcaatatttttaagtaatttgttttaaatagtttaagttctctaactctaaggacataatatattccaagaatatgttagtagaatgcctaaaattgtgttttggatagtcattcattcaacagtgttttaaaacgaaagtattttatgttcaagcattatgctaagtgcagtgtgtgctggagaaaatagaaaatgtttaagatatagtttcatactcaaggagtataccaggggagcaactaagtgaatcaactatgctttcattttctttctttcttttttatttagtagcgttggtgaaattacaattgggcattcagtattccaattgtttttccttttgctttttactctatagaatcggaacccacaaattgtatattgtatatacagtatattttatttgctattttcagatgttttgccaattatttttctgtccttttgtaataatgcttgcaaacctgtagtatttgtagtttcattttttaaccttgctatatctgttgatttgaactttcaagagaatatgttaatccaagattgttactattcttttaaacaaattaaggaaagtcttatatacagtatagattaataatgatcacagacacattgtttctatttaaaatgtcataataaattttcaaaagagttgtacctgcttatagaaagaaaagcgtagggaagttattgctaggagttacgagtgtgcactaccaataaaattctatcagtaatataaaaaaagataaaaaataagagtatagtatttccattgtgtcttttggatggggaagagatgtgtttgcatgtgtgtgtgtttgttcagttttgattgtttaaattttttaattaaacaggtgttccgaatcaagcattttttaatcaacactttttaagccacatttgtgtaattaaatggaggtaaatcagaggtaacatatggatgtctccataatctgtttcaaaaaatgaattatagcaagatgatagaaaaatgtaataccaaaatccaggtcaggtgttcttcaaatgcatatagagggaaaaagtaccataacttacatggcacataaatactttaaatattattctgaacagaatgcttatcaaaaatattcagaatgatacacaattaaaaccttattattcaaagaagattatagttagagaaagtgatttaagttgcatagatccaactcagccatgacaatacttagcacccccctaaaaccttaccacttcgtcctgcaggcgtttcattgcgaatttcaactcaggtttacttcctacattttaattataaattgcctcattctgaaatgccaaactttgctgaagaatatcatataactctccttaatagaattctacttggtcatgccaatacgctctaattggaaccttacacatcttcaggaattatttatttctttttaataacctcactctttatgattgttattctaagccttttgcattgccttctattatgtgttcactaatacatttgttaaaccaaaaatatttgttaatcactcactgtgtcagacactgttctttgcacagtggcaagaaaagcattaaaaatgcactttttgactaacttgttcataatatatattgttatcctacaaatttgtcttagcagcagcataacagatcctgttttcagagattttaattcagtccatctggaagagggtctaggaaaagttcctgagtgattctgatatatggccaatttgggaaccaaatatagacaagtaaaacatgtttgaaacttgaaaaagacacttgggaaacatcagcttggagatgcttcttgtggctctgtgaaagggaaggaaaaactgaaagacagtttaaaggaaaaataaactatgttaggagcacacatctaaattggtcagaaacttgagaagaacagaatatgaggatggtaatctatagcatcaaatgctatagttagcaagatgagagaaaaaaattttagtctctatttactgacatcttactatgtaccaaacactttgctaagtgtcacaaacaccatatttaactctaaaataccacagctaaataggaaaataaagttcatagactttaagtaacttttagaacttaaaggtcctgtagtagtaaggccaggtttcaattctatctactgtactttcaatgtatttattatttgagcattattctcctcaaggattttcaccggtaatagaaagggcttttatattcaagataaagaaaaaatgatagagtgatgttccaagaaaaagtaaggaataatattaagaccataacagagagcgggtgtggtgtctcacgcctgtaattccagcactttgggaggccgaagcaggtggatcacttgaggccaggagttcgagaccacctggacaacattaatgaaaccccatctctagtaagaatacaaaaattagctgggtgtggtggcacacacttctagtcccagctactcaggaggctgatgcatgaaaatcatctgaaccccagagataaaaggttgcagtgagctgagatcacgccactgtactcctgcttgggcgagagaatgagactttgtcgggaaaaagaaaatggaacatagtaacataatagaggatcttatttaagaaggccactctttccttaggagcttatgtgaggatatatgtgtaaaaatgttttcataggagtaaaatgtatgcaaatttaatatatgctttctataaaataatacagtgaagaggaaacaaaggatgaagatgaagcaagattttgaggcaatgaattagaaattcaactaaggtaggattaaggggaaatttatagcactaaatgcttacatcaaaaagttacaaagatctcaaattaacaacctaacttcacaactgaaagaattagagatgcaagaacaaatcaacctcaaagctaccagaacacaagaaataacaaaaatccgagctgaactgaaggaaatcgagacacaaaacttcaagagatcaacaaattcgtgagttgttttttgaaaaaaataataggccactagctaaactaattgaaaagaaaagagagactatctaaataaacacatttagaaatgacaaaggaaatgttattactgaccctacagaaataaaagcacccatcagaaactactatgaacacctctacacacacaaactagaaaacctagaagatattgataaattactggacacatacactctcctaagactgagctaggtagaaatcaattccctgaatagacccaataacaagttgcaaaattagtaataaatagcctaccgacaacaacaaaaaaaaccctgggacctgatgagttcatagctgaattctaccagatgtacaaagaagatctggtactatagaaactatttcaaaaaattgaggaggagggactcctccactctatctatgaggccagcatcatcttgctaccaaaacctggcagagccatagcaacaacaacaaagaaagacttcaggccaatatccttggtaaacttcaatgcaaaaatcctcaacaaaatacttgcaaaccaaatctagcagcaccataatcaagtaggcttccccctaggatgcaaagttggctcaacatatttaaatcagtaaatatgattcattacataaacagaactaaagacaaaaaacacatgattatttcaatagatgtagaaaatgcttttgataaaattcatcatcacttcatgttaaaaactctcaataaactaggtattgaaagaacgtaactcaaaaagccttctatgacaaacccctggccaacattatactgaatgggcaaaagttggaagcattccccttgaaaatctgtacaagacaaggatgccctctcttaccactcctattcaacatagtattggacatcctagacagatcaatcaggcaagacaaataaaggaatcgaaatgggaagagaggaagccaaactatttcattttgcaggtgacatgattctatagcaggaaaacccagtagtcttggacaaaagctccttcagtggataaacttcagcaaagttgcaagataaaaaatgaatgtgctgaagttattaacattcctatataccaacaaaaccaaaaggcaaaccaaagggcatatcagagaagcaatcccattcacaattgccacaaaaagaatgaaatacttaggtatacatctaaccagggtgaaagatctctacaacgagaattaaaatagactcctcaaagaagacaaaaacaaatggaaaaacatcctattttcatggaaaggaataatcagtatcattaaaatggccgtactgcccaaagcaatttacagattcaatgctactcctgtcaaattaccatcagaattcttcacagaactagagaaaattattttaaaattcatatggaaccaaaaagagcccgagtagccaacgccttcctaagcaaaagggacaaagcttttggcatcatgctattctacttcaaaatagactacaaggctacagtaatcaaaacaacatggtagtggtggaaaaacaggcacatagagcaacagaataaatagaccagaaataaggccacacatatatgtccatctgatcttttacaaaactgacaaaaacaagcaatggggaaaagaccccctattgaataaatggtgcttggatgactggctagccatatgcagaagatggaagctggaccccttccttacaccatatacagaagtcaactctagttggattaaagacttaaatgtaaaaccccaagctataaaaaccctggaagacaacctaggcagtaccatcctgggcataggaaccaacaaagatttcatgatgaagacaccaaaagcaatcgtaacaaaagtaaaaattgacaagcgggatctacttaaacttaagagtttctgcaaaacaaaagaaactatcaacagagtaaatagacaacctacagaatgggaggaaatatttctaaactatgcctctgacaaaggtccaatatccagcattgataaggaacttgaacacatttacaaaagaaaaacatacaaccccatttaaaaagtgggcaaacaacatgaacaaacacttctcaaaggaagacatacatgtagccaacaaacatatggaaaaaagctcaatgtcactgatagttagataaatgcaaatcaaaaccacaatgagatagcatctcgcacctgtcagaatggctattcttaaaaagctaataacagatgctggtggggttgctgagaaaaggggacacttgtacactgttggtgggaatgtaaattagttcacccattgtgggaaagcagtatagcaattcctgaaagagctaaaagtggaactatcattcaatccagcaatcccattactgatatataccatgacaaatataaatcattaatccataaagatatatgcatgtgaatgttcactgcagtattattgaaagtagcaaagatgtggaatcaacctaaatttccatcagtgacagattacataaagaaaatgtggtacatatacactgtggaatgctatgcagccataacaaggaatgagatcatgtcttttgcaggaatgggaatggagctggaggcaattattcttagaaaatgaatgcaggacagaaaaccaaataccacttgttctcacttgtgagtgggagctaaatgatgagaacttatgaacacaaagacgaaaatagacactggggtctacttcttggggagggtgaaaggagggagaggagcagaaaacataactactgggtactgtgcttaatacctgggtaattaaataatatctacaacaaatccctgtgacacaagttttcctatataaccttcacatgtaccccccaaacctaaaataaaagttaaacaaaaataatttaaggaagttctagtcaaccctaatcttctaaaaaatacaaggtacagtcaaattgctaagatttgtcagagaattttgctagagtattctgggtgttcctggtaagaccctgtcttttactgagcccacaactctccccatatggggagatatagcccatatgggttatatattatgtatatggggcctccactcccaaccccatatacataatgtatacctcaactctccgggaatcccagtcgtgtcatcaatcatccttgcactctcatttcctcagacacttatttccattgtcacttcatagatgttgtcattaccaataagttaaaccagtttccaacaacactatttttttttcagctcatgcactctagtgtttcaacaccagctatatttagactccatggggatctacaatctactgttcctaacatgttttctctttacctattgttatttctatgctcatacttactcccttaattaggaattctatgacctggtatataattgattctgtgcatattcctcaactcccttcctcccttcctccctttattatcgattccactttgggaaaaaaaaatccacattagccaaacttgtatttcttccatggttcctctcggacaaatgtacatggctggagaaaaaaattagaccatgctgcctggtctcattaaatgtaagatccctactgcaagtggccctttagtgtttctaggcaagcacactatattcccctagtacttttcatctcccattctcctatatgatcatttaatgcctttgcatctctactccaacctccagatgactctgcttcctatttccctgataaaatagaaaccaacgtagacaattttaataaacttctaccaccacacctatcttgcatttatactctgttttatttttctccaaagcatttactgccatctaatatgttacatattttccttaagaatttggtttattgtgcattcttccccctcctctgccactgtaagtttgaaaataacaatgttattttctattttgttatttttgtctttgcagtacctgcagcaatgcctgataagtaaaggatgcagtaaattgtgtgtgtgtatgtgtgtgtgcatgcgtgtgcatgcgcacgcgtgtgtgttttgtttaaataatgttatgggatagatcttataatcttccttttacaaatgatgaaactgaggctcagataattttagtcacattctaagggccagttagcaatcaaatagtggagccagaattccagcccaagtcagtctaatctaaagcttaagcatgtaccaaattaagtttaaactattcattctactagtctgaattcttgggtttgtgtctcagaatatcttcccaggcttatcttgttctaccttattacacacacgtactcttcaatcaaactagaaacttcctgtctttcagcatgtccctagctggtcctgcacagtcattcatgtgaacaggctcctcttcagtgcctggagcatgttccgtcttatgcctattgaaatcctgcttgttcttcaggatctatatactctctctttgtttttttctaagacatttcaagtgggattttctgttctctgcttttaactcttaccaatgtcacacatctatcttagagcacttatttaaattacaaagtggagagagacgttgtatccatgtctcaagttcttccagactccctggcagatcatcagctcctttgagtatgtgttcatttttatatattccatatagcaacaccactacacgattttcacttgacaattataacagtcttggagtgctcaatgccaaacattgttctaagccattacatatgttaattaattcaatcctcaaaatcctgtgaggacaggtactattattatccccaaatttagaatgagaaagcgaagaacagaaaacttgtcaaagtcacacagttagtgattatttgaactgagacttgaatccagacagcctggttccagaggacttgactaagagatactaccttttagttatcggtaaatgcaccataaatattggttgaattcaggaagctgaataacagtatctgacaaaaaaaaattacaaaaacacagcaggaagactaaaggagtgaatgtccccttgtgttatctggctgtttgatgacaaaagtaggttactatactacaagctgttatatatgttgcctattaagaaaaaaatgtaaaggactcagtaaggctaattgtatgatatcaaaacagaatttacatttcacatcacaagataaaagattttttgcgccaatgctaagttttctaaactttgcttttgagattaagtagaagacttgattgtttagaaataaactgtaagtctattgtgaagtctcaaaatggcccagcaaaagggaaaatacatctgaattttctagttgtgtaattatctgtgtaattagatgtgaaacttctctttcacagtcttccctcatcatctgggatggcctcaggaaacagttatcatcctcccttcagacttacatgagatgcactgggatttttataagacactgtttaaacttcaagaataaaaagcaacaatgagataaagtgaaattatgcgtaggtatggattttttgtttttgaaaggagaaggtagatataatttgaaaactatgatagagagcgattttcaaagtatctctatgaagatactatttttaacttttcacaaagagaaattttcttccattaattatattaaatttttattttaataatttttatatatatgcattgtaggcaaagttttgatccaatacagaagtgttttataaaaatcatcatgagttaagtaaatattcagcattttaatctttgccttgcctttgtaacgttttcttctcttaattccttggaagaatgaagaaaggaatatgtgtgttaaaaactaaatatgtttagtaaatctaaattcattacttcaaaaaagatattatttttatatttcgtaaacatatgtattcttagaacagattcctgtagtgtatctgcatgtccttcaggctctgctgttgaacattttcctttcaggtcattagttgtgccctgctcttctgccattttgaatggtccagtggtaaatttgtaccagctttattaaacacaagcaatacactgcagattttgatgaccaggctttctgtaatgtggccttttaaatctgagggctcagaggcattctccaaatcctctccattagtctttttaaagatacaagctacttcagaatagccaaataagaatattattattagaatattgtcatgcaagtcttacttatttggctattctgaagtagccaactctaaggcacactccatgagcctcaaggaaatgagaagttctctttaagtataattccctcttggatatgatgtcagtggtatctcctctccctctatctctggggccacatccaccatcacttatgactacacttaggagaactgaagaggaaacctacatcctccccaaagagtcctaagacagtagcgagcagtggaaacagaacaggaagttacttgtctgggagatctgatgtgtagtctgtgctttttgtatgtgtgccagagtaaaaagcaattaatagcaaagtattttataaaagctttttctgtaatctatggctctgttatgtttaccccattgttgctttatctttttttgtttagagtgtacatttagtgtctgaagcaaggagagtttgatagctcaccgaaattactacatgttttctactagcaaaacgaaatagaacaatttgcttgagaattactgtggattatttactgtaagctaaactctatgtaataataatcgctgacacttatttcttacttcaggcaatattctaagtatttttatatattatctaatttaatctaacaacaaatcctaaaaaataggaaactatcgtctccattttacatatgacaattctacaatacagcagattaagttaatttttcaagatgatacgagcagcaagtagtgaagttaagatttggacacaggctattattttagacatttaggagaatgtcagattcttccggcaggtcatataaccactgcacaataccactctccgccccatctttaagtatagtgcttttccacctcatcaaaaaatttgtgatgatatcctgtaaattctatccttaaaagaaccataaaaatatgtattagacaccgacttgaaaaaaatttacataaaagataatagaaactatcttagtctagtttttgttctacaatcaacatttgtttttataaatctctataaaattccagggcatggccgggcgcggtggctcacgcctgtaatcccagcactttgggaggccgaggctggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaattccagggcattgtgctgctattgtgtgttattagaatattgttatgaaataaacaatgataagcccgatctgtctcctaaaatctcttttgtttctgatatgacaagatagagcatgtcacaaacccaaaccttatcactaaatataattttcatagttattatattatcccatccttaattgtttcatagttgtaagcatcaaattttcctggaactctatatttcccatttccaagtagaacttaaattactattgtcctttaatgaaaaaaatcaattaagggaaggaaattacacatttttcaaacctcccaccagaaaaacaaaaacagctgtggaaaaaaatgaagagatatatgggttcactgatattgactgaaaatactcacacttagtgccatccacatacataagttaatataaaatagaacaccataaagtcattttaaaactgtcatatttattgtgtttttgcccattttaaatattagctcgtgcttatctagtactaagggcttcatatttattaacttatttaatctgcacaattatccatcactgtctctattttacataaaaaaaattgagtcacagagagtttaaatcatttgtctgaggtttcgaatgcattcagattgattacttaaccactatggtaattcgtctctgacaatcaactaaatcaatcattttattcattcaagatcaatggaatcagaagtgaaaacatttaaggactcacctgtatattagaatcagtagggaaaagtgatggatttttaaaaagaaatatgttaagagtacgttgcaaaaaatgtagatttcaatatatgtttagaaaaatatagaggagtctgatcatacatgagagagagagagggaaagacagagaaggcatagatattgagcaggaagaaaaataatgtgtacaatatttgtgagtgacttgaggtattttaaaggataaatcttaaggccttgatattagaactcaaaccatgcaaatattgcaactctggtaaattccagcttaaattaaccaaatatactatattctgagagaatcattaaacggtaacaaagacaagagtagctctttgttgttgttgttttagcagttactgatgataatatttaaatatactcaatgtttctaaatttttcagggtctatctaactgaatgaaggtgctttttagaaataaatagataacgatctgctgtcaaaggtattgctttcctttattagcagcctcatagtgatgtagaacaaagttgtcgggatagaaacctgcttaggttgcttgttctcctcagatggtaaccccaggaagggtagatgagacagttcaccctaaaagacggtgagtagtgaccatgagtcaccaaaattggagttggccttggatgtcagctttgctgaaggggagcaaaaagtctgaggtctgaggagttaaaaaaaacagtcagcagtcactggtcacttccagcaggtgagaaaggaaagaagcattttgagcatacagtagagccagagctaacctcataacttaggaacacaggttaaggagcatccaggtatgttgtacacctcaaggtacaacataacttttcatcttaatgagcataggttcttgagccataccatctggatcttcagtagagtgatttcaacattaataggagcatgtcctctggggtgctaagtaagggaggttcaacggtgaacaagacctcttcctgctcctcaaagaatctctattgcagtagaaagataggcatctttatgtctttacataaaatgaagatgaaagagttataaataaggtataacattcacgtgggtatttagaaggatgagataaattccatttgggggaaaagtgggtgatgggggtgccttcagagaaggcatagatattgggcaggaaggaaaattcaatgctcactattaaactgacataacatttttttacctttaggtttgtgggcacatgttaaggtttgttatataggtaaactcatgtcacgggggttcgttgtacggattatttcatcacccatgcattaagcctagtacccaatagttatttttttctgctcctctcctcccatcctgcaccctcaagtaggccccagtgtctgttgttcccttctttgtaacacattattttgaattagtatagctatctgtatgcttcttcactcaagctattagaaactagagggctggttctagatctttaaggaatcatcacatggtcttccacaatggtagaagtaattcacagtggcggagacaaggaaccaacccaatgtctatcagtgatagactggataaagaaaatatggtacatacacaccatggaatactatgcagccataaaaaggagtgagatcatgtcctgtgcagggacatggatggagctggaagccattatcctcagcaaactaacacaggaacaaaaaacaaacactgcatgttctcacttataagtgggagctgaacaatgagaacacatggacacggggaggggaacaacacacattggggcctgtgggggtggtggtggtacagagagggagagcattaggaaaaataggtaattcatgctgggcttaatacctaggtgatgggttgagaggttaacgtgtgccatagtggtttgctgcacctgtgtaacaaagctgtacaccctgcacatgtatcccagaagtaaaagttgaatttaattaaatgagagggctaagatccctccttgttcccatgcactccccacacctagcacatacctgccatccagtacttacttatattgtgaataactattaattaaacagaattaaatatgacctagctgctgtgttctattccctagaaggaggcagaattctgctggaactggcttctgattctagcagagcagggctggattctctagaagaaagggtgtgataatgcagaagcatctaagtagtaacagtaaacctaaaatgcaaacatcacttttacctgattggttttactttacaaagagaagacggagagaatactatattaacttcgtaaataaagatctgttcaagactatattggatgaaaaccatcaaagataaacacctcaatattttatgccatcttagggctgccggttatctactattagacatttacaaaatcattcaatgagtattggtaatacttgtagaagcaagtttatggttatgtttggggcattgagatttttaatgttacttcttttgaattgataaatggttatattattgtttaattataatctgttcttcaataacaaatgagtattttaaaaaattattttactaatacataacatttctacatatttacggaaacgtgatgatgcatgcatacaatgtataatggtcaaatcagggtatttaggatatctatcacctcaaacatttataatttatttgtgttgggaacattttaagttttctattttgagatacacaatatattgtttttaactgtagtcactctgctgtgctagagaacactagatcctattccttctacctaagtgtatgcatgtacccattaaccaaccacacttcatcctccttttccccaccatttcccagcctctggtaactatagttgtactctctacctccatgagatagcttaggtagctcccatatatgagtagaaacacatcctcaaaacttagaaagattacaaaactagaaggggacaagcagctatataacctggaaatcagcattttttttttcttttttttttgagacggagtcttgctctgtcgcccaggctggagtgcagtggcgcgatctcggctcactgcaagctccgcttccgggttcacgccattctcctgcctcagcctcccgagtagctgggactacaggcgcccgccaccatgcctggctaattttttttttgtatttttagtagagacggggtttcactgtgttagccaggatggtcttgatctcctgacctcgtgatccacctaagagtttatcttttcttacaacttcttttatactgaaaagaagctctttagttaactctctttgtcatggagttagaagtcaagtgctattccttgttttaaagatgattgcagtcttggcatgttatcaaaatgcaaatactttacccttaaattaagcccttatttagagactcaaaattccctggagagaggaggatagcagtgctatatcagaaatatatttttttaacatacagagttgactgaagttgtttttattaaaaatgggcatttctaatcctgtccacaccaccatcctcagtatctcacctccaatttaatgacaatttcattctgaccttaggtgaagtccttctttctaagaaatatgttctgtaatcccccagactagagtagatgccttagaactttctatactcccttagttacttaaatatatcttaagggctagactgcaaattggcaccacatcacttctcccacattctgttgttaagtatagcacaaggctagcccagattcaaaggagaaaaactccttctcttgaggggaagggacatatgcatgctagaacaataggaggaattattggtgtccatatttagatataatgtatataaatgcccatttgagattagaatcataattttaatgtcagcatagtctttgtaattttcccactttttttatttactaggatgtagatacaaagaagacaaatagttgaattcatccagcatttgagtttcatcaggcaaggtaaacaagtcctgataggcaaaggatttaaaaggtttatgcaaagaagttgttagacgcagagccaaggaaagaaaggagatagtgaataatgaaaaactgcatttgaggttgttttaaagaattaatggaatggaagtaatagagttagtgagctggaatgatatcaggggtgatgagaggtcagattatagaactgtgtagttattactgataataagtttagaagggagaacatggaagcagaaatacattttaaaaacaaggctcagtataataactgagtacttgtataataactcagtataataactgagtactcagtataataactgagtacattgtacagttctaaaaataagccttaaatttagaacaaagacagtgatcatcgtaagctgaaatggaatggaaatattccatgagagaggtgagaattgagtggaatattggagacaggtaaagcatcagctaaagaaggatgctggagaaggcctggcggacttggcagcaccatttgcatagagtgcttcagcttagcgcttaagcccatgttgagcttccacactgtccaataaggagtttagggtttgatttatgtaaagtgggaatcactgaaaacattttagtaagaaagggatgttattaaaataatagaggaagattaactgacatgaggaatagtatgaaagattagtgggactgaaagcgaccagttaagatgctggtggaataacccattgtgatgaagcatttttaaaaacatgcatgtattagatgtatagaaataaaagatatgccttttattgacatctttgattggtgtgtcaggcataaaaaaagcagagggctcttaggaattttttcagcgtatgatgaaaagcatgtgatctgctggtgaccctggaacagtgaaagtccttggccgggcgcggtggctcacgcctgtcatccctgcattttgggaggccgaggtgcatggatcacaaggtcaggagttcgagacaagcccggtcaagatggtgaaacctcgtctctactaagaatacaaaaaaagccgagcatggtgaggggtgcctgtaatcccatctacttgggaggctgaggcagagaactgcttgaacctgggaggcggaggttgcagtgagccgagatcgtgccactgcactccagcctgagcgacagagagagattctgtctcaaaaaaaaaaaaaaaaagccttaatgtggccattttctggggcgcctcctgctggtttcactatgtctcattgctcatgatgttttctccacaaagttcttgaaggctgtttagaacatggtttggaagctagttgagcaaaaatgaaaagataactgggagggtctatggaaactgaataaaggtggtagctatggcagtaactttgccctcttcaaccaagtgttgtttgtctccacaattgcttttctaatatgggtattatccccaaaatacttaatggtgggcattgtctccaaaatacttgtttttaaagatgcaaggtgctgtagttgtattgaacctgtgagaatcaaatcagcctgctggtgctaactctgatggagggcggtgaggggacagaggtcataataacacagtcgccaattaagtgcttacaaattctggtttattatgaggctttcacacaccaacaatcatgcaaatatgtttaacacacaagcagtgataaaaaggagcgagtagctccagagaccagcctactgacttatgaactggcaggtccagttttcctaagagagccagttcacccaggagaagggcctcactgctttttttccccagcagagctctggcacctgcagctgaaggaaggaggccccagagttctcaccagcagaaatgctataggcttcttactgtggtcagcttctttgtggtgtttggagtcttccaaagaagtatacatggccactatcttcagctgccttttaggagagaattttatgagtacatagtagatgtatacatttatggggtacgtgagaaattttgatatgggcatacactgcgtaataatcatatcagagtcaatggagtatccatcaccttaaacatttatccttccattgtgttataaacaatccaattatattcttactgtaacatgtgcaataaattattgttgactgtagtcaccctgttgggctgtcaaatactagatcttattcattctatctaactgtattttgtaagcattagcaatcctatcacttcactttcttgtcaggcctcagaggtacctggccatgttaggtgtcatcgtatcatctcaggccaccataagtgtttttatcactcagaggggtcagcaatttcactgaagctgagtcatttgtcataagtgactccattttgagacattcaggattacaaaacattattatatatcatactgattttacaactcacattactagattcttaatttgcctcaaaaacagacttctaaaaggcattgattttgttttccatacgtagtcgtttttgatgatccccagccaaagagggtgtgtccctatttacattgttgattattacactgattttttttttttttgcctgcttcctactggaagggaataatccctaattcctacatccagttgctgggtccggggaaaagctacctatacaatagtctctttaaaagttgggtaaccccgtgaaaccccgtctctactaaaaatacaaaaaattagcccggtgcagtggcaggcgcctgtagtcccagctactagggaggctgaggcaagagaatggcgtgaagccgggaggcggagcttgcagtgagccgagatagcaccactgcagtccgccctgggggaaagagcgagactccgtctcaaaacaaaaacaaaaacaaaagttctgtaacccactgtgttataatagaaagtgaattaagaagtcaacatcttaggttcatttatttttttctacatgtattattcgtacctactatgtactaggcattgttgtaagatcctgtccttatggagcttaccttttagaagagattacgttctaaggtgtgttagttaaacaaattatctcctgaaaatcccaatgaaggatttttatcagaattcaccttcctgtaaaacataaagtaaattatgtcccagttcctccagttgtcttgagtttaactcctctactttgatattttcttacatattttctcaatagtaaaacttgaggtacaaaattttaaaaagtagaaggtatatgtttattttgtacagcaacacatagactatttcaccaattttggttaaaatttcctatgaatgctgtggaccataagaagattgaacaatgaagattgaatttattgactcactattttttgatcaggagatcaaaattgtttgatacctactatgtgttagaattgatactgaataaaaacaattaaatattattttagtagaataagccaaatttctggataaacgggaagcctactgaaatagcttcttccttcctctcatctttactgaggtataattgacaaacagacgttatatacgtttaagttgtacaacttgatgtattgatatataccttgtgtatcaccagaaactaacatattcatcacctcatacggttaccatcgtttgtgtgtgtagagaacataaaatccacctgctgagtggatttcaggtatacaatacggtattgttaactacagtcacgttgctgtactttagatttccagatcttgcaaaactgaaactttgtacaccttgaccaccgtctcctcattcatcctcccccagcccctgacaaccaccgttctgctctgcttctacgaactgaatagctcctcttgatttctttttctttctcttttttttctctctttctttttctttctctttctctgtccctctctctctttctttttcatatttaagtgctgaaattacgagattggtagatttaagatttcttttgagcgtgggacaaaacacagacacttgaatagatggaaagcagaactctattacttgcagctttcaacaaagttgcagggctagacagaggttgcacctatgaacagtgtaacagcaagcttatctgtggtaagcagggtggggttagctaggtttctcagacttactgtggattggctaatttgaataattttgacaggatctggagcctaggagctgttccttttagtgtggaacctaggcctggggcaatgagggctggtgtagaggagcccagaatgtaagggtctgatgaagaaggggttggagtgtgaacttcatcagctgcccaagaaggggaacagattggcctccagtcaaggcctcaaaatggggtcaaaacagcatttttaaacagctgtgttagacgattgtatctaatgtgtttaatctatctctgtaacatatagttttcttacatccaagatctagcaggggtaaatgtattacttgtttcaagctcaggaaacaataccagttaaccatgtatgtgagatcataattatcgaagtgtgaaattaatagtagaaggatacattgacggtgatatttataccaaaaattttaaatatactgcagtaggcctatctatatgtatctatatctataaaatagagacaatacctactcaaagtaattatgtattaaataagatacagtcttatttatatataaaatatagccttgtatacagttctttctatcacctttcacaataaacagatggatcagctgtggggaattacaaagtttgtgatcacttacaccaaaatacataagaaaatcataaaagcctgggaaattaaggaattaaacagcagtgttcccaagcacagtgaacttagcaagtctcatattttgactaataatgccttctgtcgtcaagtttcagaatagtctccacgttttgccctctttttttacttttgtcaaagggaaaaaactctttaaccaccctgtaacacacatgcacacacacacaaacacacacacacacacacgcacacgcacacacagtctttcaataaacctttcaaagtccaactcaagttgtgctcttaccatgaatttctttaccaccttctcaatcaacttactctaaataacttatcatattcttcgtatttattgttctcctgaagctcctgtaattatcttccagtttaaacgttcttatagtccaaggtggaatacaagtgttacattactgttgataaaaaatatataaccatgaagcaatacaacatcttctttctgaccagtgaattaagaagattagaactacattccaggtagtttgaaaaagtggatagatatctagactcagaatcagaatttatttcttggtgtctgctttttcaatttctttatttctggtctctgttttgcagtttattagttctgaaacatagggaaagcactgaaaaaataatccaagcatatgggttctaatctttggattctttccaaataactgtaatttgaatatatattttctatgaggcataatttattctatttaaaattggtgtaattccaaacttcccatttcacacaagagttatgaagataaattaatccttgaattcaaaaactatttcctgagtccctaatgtagatttgttactcgactaagccttcaggatagaacgagtacagtgttttaccaatcagaagatgcatctttttcactttttaacgtcactaaaataaaatatcataccatcggtgatgtccagtgattaccatgaactatattttcatagcataaaatctttgaaattgtgatgcatccttagtgaaatatatttatacttcttcaagtttagttgaggaaacaaagttcatagaactaaacagaaaacgtctatgcagtatcgttagagaaatactatgagatcacagaaaaggaggcacacaaattagtttagatggtcttaaggactgaattatgcctcccgacttcaaatcatatgttgacatcttaaccccaagtacctcagaatgtgactgagtttggagatagagcctttaaagtgatgattaagatgaggtcattaggatgggccctaatccagtctgactggtatcttataagagagggaagtttggatactcagacacagtgaggaggtggccacccacaagctaagcagagaggtttcagaagaaaccaaacctgtcaacatcttgatcttaaatttctagtctccagaacgatgagaaaataaacttttattgtttaagccacccagtctgtggtatttggctatagtagctctaggaaattgaaataggtggtccaagagagcttttagacaaattgatgtccagttcatttcaggataagttggaatttaccagctgaagaaataatagaaggaaagtgctgaaagcagaaaaaataacccagaaaaggcaggctataaaaatgatacattcataagacagtaacgtgtgtgtgtgtgtgtgtgtgtgtgtatgtgtgtgtagaacctggagtgtagaaagtgagcttactaaaggaagaaatgttgagtgagaaatgaagctgaagaggtattcaaatgccacaggacctggggcttgaaattcaggcaaaggaactcgtactctatcccataggcagtagagggggttttaggcatgtagaaggaatgtaaataataaggtggctttttaaaaaatgtatgtcaaaagtttttttctattgtcatgaagcaaaatattagaatcacctctagcttacgcttgttatacttatgagaataaattgtatgtgtatgtgtatgtatttgtggataagggaccagataccttacaaggcccagatgtaataaatatagacgatagattaagagttcaaacatctgagtcttctggggcctagtacccttctgtcttttattttgaccaccttgttctgtgttgctcactttgatttagactttgctgtctttatagctgttctccaaacattcctcttactgcacttaccacatagagcataattgttattcccttatgaactttaaaagtttatttataataatataaatttggaaactaaaataacctaaagctcaagttgcccgtcttaaaatatgggtagttcctttatcaagatggttcatatgaggaagtggtgaaaatgatagggttgacactcaattattaaatatataaaatctagcttttactttaaagaagtacatagtagggaaagtgtgaaatttaacttcaagacagattgtattttttcggaatcttttacacctccgatttgcctttacgttatctgaaacaaagatcaggcttaaaaaacataaatattaaaatattcatccattttgaaggaataagtaaataaaacacatctctctgaaaaattctgggattccatttgacctgaacatgtatcttattactagagaagatggaaaggtggaggggcttggagatgggagaaaaaactaaagtgctatgaatgattatacaacagtgccccctgatgggaagaatggggtctgaaattcagatgagatttcttaccaagtcaattacatgacttattcttcgtttttgcttccatttaaagagatttttgtagcgatgcatcagttttactatagaatctgacatacagtatgcactgaaaatatatgagtaaatcgaactgaagcattaagtctaggcaaggagcttttaaaaactttagctggcacaagggactaggtgtgttaaatatgaccataaccttgagttgtctgtagggtaaaatacattgatctttatatgttaagcttttggcaagtgctatttcccctactaatttacccacacttggtgataaatctatcttcgatctcaaaacattatcaaatactataatattatttcaaaattttaacagtataattagttcagatttaaataatcttgaggaagaatgatttcaattttaaagcaaaagtgtttttcaaataaccaaaagaaaatagttttgctttattttttgttattaactaggcatattaatgtggtcaataagaactgtagcttttccttctctaaaggggtgtaggaatggaaagcaatgagtactgaaaaggtaagaaaaatttgtacaatctagggtttgaattcaaaccccagagtagttgcatggaacaaatttactcatcttaataattgtcatgggtgcatggtaaataaaaggagaacttgtttgttaagaatgaggcattatcatagtattggtaatgcattctataaataagatttatgttttgagaaactcaagtaagaaagcaggaatggaattatccgtttttgaagtgaaagagaagaaatgtggagagactgtgtgtgttaggtctgcatctggctcctagggagatttgaatgaattagaaggaggcttcctttcctcttgatgtttgtagtcctgacttggtaagtagacacaggctggattgcaggccctagccacaccctcagcaggcatcaggtataattatcaacctgcaccatcagaggttgcagcaactcattcagtgatacatatttgctggatatgcatgaaacactctagtgaatttgaacatttttaactgaagaaatatggatatctagcattcattatagataatctcccttgacacccttctaaaaaattcatgaacccgtaggaagtagcatctcactgccttactgaacatggtaagtatgctgttaaatctaactatctgcttatgttttctgctcagcttaaatgctctttattttatattactactatttatttttgccaattcaaactttacctattttattgtttgcatcttgaatcccacattttctagaaacactttagctcagaatattatctttgtctttggaattctgatttcaaagtaatgtgttgtctggaacatttatgttttcttactatctaagtctgaatcagcaaggcaggtattcagtgagataaaagaataataatatcatataacattgtttaaattattgggattctaattagaacgactaacagtttgcaccaatcaaaacttacataaaccattaatttcaatattttggaatttaacattgaatggtaatgtttctttaagtagctacggaactatatttgtccaattcagttgcacctttttattctttttgtatttccaaattctgagattcagtatgttactaacacctcctgtctcataatctatttagtgtgccttaaggtaagataggctgcttaaggatgctttgaatttacaggaaagggatatctctgtggtaccagaatttatttgagaaaaaacaacttcaaatgtagttttcaaactgtgcagactgtcaccttactgacatcagtaagcaaatgttcttaaacttgtatcaagtatctgaatagtcacttacttaactgttcaatgaagttaaccactaggagacaagtttgccctaagcttaacccagacaggagatttcaccttctagagttaatttacagcttaagaacaagcccttcaaaatctttctactaattgttttactcaatttagaaagttcatttaaatgagaattcttttttatctaccttaaggcaggttaagtatttttttccattacatttacatatcatgtcttgccgctatgtttggtgttatacattattatatagacatgtgaacagttttgcataaatatgcccagtaaggttgtaagtactaatttccccctgatttcctccattaagggtgcaacattttactaacaagaagaaaagtatcttaatttcatgattcacaagtgaggaaaatcagatttttcaacactgaaaattagaatctataaaagagaaataggggaaatgtaactactaaatgttatgtgcaagcaacaacataaagattagtccatgtaattataacacaaccaatggaattcagcaagtactttactacttaaagtaggaggaagtgtaaagacggatggacagtccaagtcccagctcagtctcttgtgaatgtggataagtcagtttaaattctaagttcactgattctgtgttctctcctgcaaaaagtcagaatggcaatgcttatcatgtagaaagattggcatttaaacaattgttttgtaaattctagagtatattctaaatatgagttacatcagattgtacttaacacgtaagattttctaataagactggaatggaaagaaggaaaccttggttcagtaaccaatcatttgtgctcctttgtcaaatcatttaatatttttgaatgacagctttaagtgggattgtgtgagctttaaatagagttgtggtaagaaggaggaaaaaacaatctcttgggctttttctagctctaaaacactttaattctgtcatttatagctttgtttttaaaagcaagtcagatggtttaatatttatagattcatacactatattcaagaaagtattagagacttgtgcaagattccatgacaagtcagcagctgtgttgagataagaaatttacgctggatcctaaaatctgtcatcctgcctagcgttccttctactgaaactctctgccttgatagtaatacttctagttactataatctaattgaatctcttcatgtagatcattctagaaaatattgatatgttgggcatacttccagtcaatgttttagagcctgtgctaatgcatcagaataattagaaacacaaggcaaagcttctgccttcagaaagctcacagtctcacagaggactttacctactgacatgtttatcttagcttgtgtggctaaactcagcaacatgcaacatgctttgaatagttaaaattggacagctactctcaacattagccatgaagcacttcaaatgaagggataagaaaaattcattgctttgctcatttaacagtatgataaggaaggaggaggagagagatatatcatgttgaaagaacaatgaagaatctcaattatatcaggaatttgtacattagatgtgtcgttttaaaatcctatgcctgattatgcatacacaaataacaagtataaatcatcctcttcatacacattttttgtttaatctttaatacaaacccatgggaaagatttatcctactatcacaaatgatgaatctaatgttcagatattaggaagcataattttgctatttgtcttcctcattaaattgtgaattcctgggaggaagtgtgtaatagtagaaccaacttacttatgctgaattcactgtcccataaaaactgtgtgtcgcctgaacaagttattaaccctcctgaatctcagtttctttacctataaattgcaattacatgaagtacatataaagtcgttaagggcctgatatgtattagctaagtaatgagtgtttcttacaccatcatacatagcagagtccatgaatagactctctgtaactgtggaggagggatgtcatccagtcatactttacagggagacttctaatacaggtggcctcttagtacgtgtaaaaagtcaaacctatttagaagcccattgtaaaatcataaatgtaaataactccctaatgataaaggcaagtcatttcaatagctcagtgaaatcttaagagattcttgactaaatatagataagtattaaggtcgtccacttccacagattttctctaataatttaattcttctcatcttattacttaaacccatataacatagttattcagaagcagtaaatgttgaatagaacttaaactaaagcacaaaaatgagaaatgttttttaccctgacttttgtacccccatcaaaaccagtatgcaatgtgaaaaatttcaacccttaaaaagaaaaatttacatgttgccatattggaaatgggggagggggaagacatatacttccaaagaaggacctctgagttgattaaggccatatcaccagaatagtgcttccagaccagagcattcaggttcatttaatttctctttgtaaacaaagcaaccaattttcagttctattgcaaatatctaactgtcctctttttcacagaggagagacaagtattaactgctcttcaaaagaaagttactctgatttacagagattgtaaacctctggcccccacaaacaaacaaacaaacaaacagaaagaaaacacagagcaacaagtctcttaaggacgtaagacacctaggagatagtgttcccactaaacaatgttgggactgggccctgtggctcatgcctgtaatctcagcactttggagggtgaggcaactggatcacttgagcccaggagttagcgaccgattgggcaacatagcaaaaccccgtctctacaaaaagttaaaaaaaaaaaaaaaaaaaaaaaaaaaaaagctgggtgtagtggtagctgcctgcagttccagctactcaggggactgtgatgggaggattggttgagcccaggaggtctagactgcagtgagcagtgattgtgccactgcactacagcctgggcaacagggtaagaccctgtctcagaaaaaaaaaaaaaaaaaagttggaggtgcttataacagctataattgtgatgtggagatgctaaccctgtactcagaaagactgcgactctttaagcacagaagaagtaaagcacatactatgtagggaaagagaagaatagttggcttatctgccaatgccatagctgcatattaagacctaaattccaaaactgtaaggcaggcgttatttttagcgttctattccttcatttcccctactattcgatatcacaattacaaagatcagtccttccaagtagttgattgattgtcatcattgatcttgtacacagaaggtgggaaaaaagcacacgtaagtcttgcttggcatttcagcaaatttcctccattaagcgtttttattggcagacctaaaatatatgttcttggtttggaaacgattccctgatgggcatggattgctgcttttacctccctgctcacccttataaatttctgaattagaacaatggtaaaacagaattgaagaaaagaaggtacaactttttaaatgctggaagaaaaaaataaagcttcactaaggtcaatgtaaactgactctacacttctgtaaccctcccagaaatatcagtaaacatttttatcccaaatttattttgtcttcttttccaaaggctcggtgttcatttatctacagatactcttactagggtatattggttttataagttaaaactggggctaaggatggaaaatagtagtactaccatgctcagctaatgagttttttgctctgccagcttatatggcagccttgtaaatagctttcattttatgtaagcttcttttgatagcacctttctctgttaaaaggattttatttaggcttagatgcaaaaaatgatgattgatactttatttttactactgtggatcccaaaggggccagcaacataaatttcaaatatttgcttttcttattcctgccaaccttagttaagccttgtatatgacctgaagacatttttttttttcaattcaatagttaattcattgaaaatttttattgctttgttaggcacatgtgacacaaacatttaaaaagatgggcactgattctaaggcacttataaatagtaaggaagacagtcaaataaacaaatacaatatagtgtgatgattgaaagaatagggctatactcaggttgtagaactagccaagaagaccagtgatgaaattggacttccattggtggaggtgacaaatatgttcagggaagtattaccaaaaaagtaacactaaaaggattttgaaaggttaagaagtcttggctcttttaagatcagatgtgaccactaccacatcaaggttgcctgcaagtattttagtttctatttaaaagaacaactgtgcatttggggtcatactaaaaaaatccttgcccaaaccaatggcaagaatatttttttccctacattttcttctagtgcttttacaatttcaggacttccatttgtctttagcaaattttgatttgatttttgtatatagtgtgagacacagttctgatttcatttttctgcttgtggatatctagttttcccaacaaaaattgaagagactctgtttctcagtgtgtgttcttggcaatttatcaaatttcaactgacagtaaatgcttagatttatttccagactctctattgtgatccactagtctacatgaagggtcctccacccccagtcacagaccactactggtccatggactgttaggaactgggcagcacagcaggaggtgagcagcagacaagcaagcattactgcctgatctccacctcctgccagatgtgtggctgcatgcattagattctcacaggagcagagccctattgtgaactgagcatgtgagggatctaggttgtgcactccttatgagaatctaatgcctgatggtctagggtggaatagtttcatcctgaaaccatctccactgccctacgccctcttcttgctgtctgtggaaaaattgtcttcgacgaaaccagccctgtgtggctggggactgctggtctacatgactgtttctgtgtcggtaccatgatgttttgttaattatagtgtcatagtaatcttgaaatcaagtagtgtgatggcttagctttgttcttttacttaagattactttggctattcaggttcttttgtggttctatataaattttaagattatttttctatagctgtggaaaatagcattggaattttgatagggattgcattgaatctgtagatagttttggatagtacagacattgcaacaatattcattcttcaatccataaatatgagatatcctttcatttatttgtgcctttttcaatttctttcatcaatgtattgtagtttcagtgtacagatattttgcccccttagttaaatttattcctgtgattcttttgatgatgtgattataaaaaatattgccttctttatttcattttctataacttgttgttagtgtatagaagtactactgatttttgtatgttgattttgtatcctgcaactttactaatttttaatcagttataacagtttttggtggagtctttgcagttttctaaaaataagataaagtaatctgtaaacagatacaattttacttcttttccaattcgaatatatttatttcttttccttgcctagcctggctgagatttcccatactatattgaatagaagtcagcatcctttttttttttttttttttttttgagacagagtcttgctctgtagcccaggctggagtgcagtggcacgatccctgctcactgcaagctctgcctcccgggtttaccccattctcctgactcagcctccctctcgagtaggtgggactacaggcgcctgctaccatgcctggctaacttttttttgtattttttagtagagacgaggtttcactgtgttagccaggatggttcgatctcctgaccttgtgatccacccgcctcggcctcccaaagtgctgggattacaggcatgagccacggcacccggccggccagcattcttgtcttgttcctgatcatagatgaaaatagtttttcatcattgagtgtgatattagatttgggctggtcatatatggctttattatgttaaggtgcatttcttctctatatctaattgtttgagagttgttaatcataaaagaatgttgaattttgtcaaatgctttttatctattgatactatcacatgatttttattcttcattttattaatgtggtgtatcacatttattgatttgtgtttgttgagtcatccttgcatcccaggtctaaatcccatccaatcatagtgaattatccttttaatgtgctgctgaattgagtttgctagtttttttgttgaggatttttgcatctgaatttttcagggatatattgccctatgcttctcttgtattcttatctggctttggtatgagggtaatgttagtcttgtacaatgagtttgtaagcattccctcctctttaattttagggagagtttgagaaatattgggattaattattcattaattcaaatgttgggttgaattcaactcgaagccatcaaatcctgggcttatctttgttgggaagtttaagactactgattcaatctttgtattagtcagtctccagcagaacaatccatagagagagagagagtgagagagacagcgtgttaaaaaggggatttataataagaattaactcatggaattctggagtccagaaagttctacaatatgctctgtgcaagctggagaactagaaaagccaatgtataattaaatgagagtccaaaggcctgagaaccaggggacccaatactgtaccttttagcccagttcaaaaggcctgagaacttgagtggggtggagtgctcactttggagtcccagagtctgaaggtctgagaacctggaacaattatattcgaggacagaaaaagatgaatgtcctagctccagaagaaagactgagtttgccctttctctacttttttgttctatccaggtcctcaatggcctgcatgatgcccatttacactggtaaaggcaaatcttctttactcactctactgattcaaatggtaatctcttctggaaacttccttacagacatgcctagagataatattttaccagccatctgagtatctcttaggccagtcaagttgacacattaaatttaccatcacagtctccttactcattattggtttcttcagattttccatttcttcataattcagtctttccagaggtggaattcaccttgcttatcattagcatgtgtattcagtcaacattcaggcatgatggtgatgtcagaaaactacagattatccacatgggtggctgagatagtgatactttggcttactgatggttcagtgtatacaaactttgtttcaaactttgcattccaaaatctaaaataaaaaatactctggtcccaagcattttgggaacagggattctcaacctatattcagagagagggggattaaaaaaaagaaaaaagaatggggaaaaaagatgtaaaaaacacagtaagaaacatttcatctctctgattctcaatcttctaacctttaatatgatagtacctacttcaaaggatccttgtaaagattaagttagttactatatgaaaaacccttagaacaatgcttggcacattatatagtctcagtaaatattatctggcattgaaatattttaaaatcaaatattagatattctttttaaatactttaaattaaaaagagcacctgacacctcagtggcccagtcttaggatttcagataaatttcccctggaatactttcagtttgagtctagttgttttcaaaatccagtaaaagactttaatgaatgtaaaatgctatctgaatctggacattactgttttaattccaatagaattttctcatgtgggttaaaaggacaatcagcttatatttcctactatattttcatctagcacaactcttaaagcaagtctattttagttatatattattttatcatggttcctggaaggtaagattggtggccaccacattcagtctccttcacagctaagtgtagccacataactatgctttggccacggggatatgaatgctactactaattttttcccttgaaacaatgggatgttgactttcttgctcccttcctccttactgcttattgggagatggcagaaactgtcccatctaccattcatgtataagttaaaaccaaaagtgaactacagcatagccacttagcctaaaaatgttggctcgtctgtggattgatatatgagagaaaaataaactctgattcttgtgtctgttataatagctagcctgtatgtgaataaataccttctttttaaatttttgaggaattaaatctccatattatgtgtaaatctacattaaattaatataccttgagatgtttttctctctatatttcatgtcttttcatcacaaaagatttgaagcttttaacataagatttaatatctatcttacctctaaataagaaatgtttctttgacagtttggaaagagaatttcagtgattatagtcttatacctcaactactaattcattttacttgtagagcaccaaactataagcatccattatagcaatattgtaactacatcagattgatatatctctaacaagttttatgaattccaggaataatgtgtttaaagtttaagaaatttgaatatgttcctttctatctgagagctaagatagaagagtggtagctaaaaaaaaaagctaccactcttacctcctctgtaaggggaaaaaaaaaagataataaattttgttttcccaggaagacagagtaaatgttgccagaatctaactaaatatactgtggagctcttccttaagagacagaagaattagaaataccacatgcaataagtgaaattaagtttgagcatttatacttatcacacgaacaatatctttctaaacataatctttgagaatattccctcttaaagcatcagagataaggtgcaatttatattgatacttttccatctcattagaatcttttgtgagcaatctatagcctggagcatctgtttctgcttctagtggtgtggttagaaagcagatttaactattttggctttggagtttgctttaaagctaatataggcaaaagtcacgtggtctttcaattaattaaccaactgaagtgttaacctcatctccttcagtgtgaaggaagtgagatgttcatccctcacgattataacttaagggtgcagtggctcacgcctatgatcccagcactttgggaggctgaggcaggtcgattgtctaaggtcaggagttcgagaacagcctgaccaacatagtgaaatctcgtctctactaaaaattcaaaaacttcctgggtgtggcggtgggtgcctgcaatcctagctactcaggaggctaaggcaagagaattgcttgaacttgtgaggcgaaggttgcagtgagctaagactgtgccattgcactccagcctgggcaacaggagtgaaactccatctcaaaaaataaattaattaattcaaaaataaaaaataaggcttacatgggacaagattacagtttgactgaacaacttagttcccagtccccaaaagagagagaagtatttaaatgggaaatacagaaagtaccaaatttaaaattatattatttgacaatttattcaataatttatattttcacccaaaggagaatttacccacctctctctatataaattcaatgataaaacattccgtgcatagtacagtttaaagtcccagcactcctaatttttcacagtaatatgtcagattattatcatctggacatgttatttgctctgtaataatataggctgccttttaattactggtgtaaatatttttgaattttttctataagccaagttcagttgtcataggctatagtttgaatgttcacgttgccttcaaacttcatgttgaaacataatccccaaggaaacagcattcaaatgtggggtctttacaagctgattaggtcaggaagactcctcccttatgaatgggattataaaagaggcttcacatagcatttggctttttgccctgctgtccctgctgccatgtgaggacacaacattcatcctctccttaggatgtagtcttcaaagtgccatcttgtaagcagagagaactatccctcaccagacaccaaatccactggtaccttgattttggacttccagccttcagaactgtaagaaaaaaaaaaatctgatctttgtaaattactcagactaagttatttcattatagcagcacagaattagaaaccgtatgtaattgctccctctctgcctacaggaatacattaaaattttctgttttgtgtatttaaaggtgatccaatgacagcctttattgaggaagcgctttgtttttcagaaagttggaagaggcgaattcatttaaaatatcttacccatttctctatgatgtacctaggacattgctgaacttttctcttgctatcctctagaggagatttaaattgctagctaaaatgtcattagcaaactactctggtgattgggatgaataactgaataaatgaaaagataaattggtcagtagattaacagacaatccagtgtgacttaaaaaatgccatcaaacattcttggaatgttaggtaattatttaaagaggaaaataagtgataaaataagaaaccataaatgaagtaaatgttataatttgtgttttgtatataggttcttgacttactaactatattcactgttttccattcatgttattactaaaaacgatgttttaaggtttgagtttattatttatagttttctacataaataaagggcttcattaaaattctgatttcataattaacctctacaaacacaggccccatggtattataaaacaattgccactttagaatttttgaaaagcattatccggtagaaaaaagtaactgctttatttgagttaaattaaggctcttaaaatcaaatcttagctatgccgtagccacacagtttcagtaagagtgcagcatgaggtcacaggaagaatagaatatacaagtgattatccaagaaatgaagagagtctgtagttgtctgtcctggggaaagtcacctttacattcatttgctttttgactataacctataggaaggcacaaactataaaaaataagtcttgtttatcgtagggactcaacaatatgtaacaattgaagaatgtgtgggtctgagatcctttaaggatttataacattttaagccatatttgctttttttttttttttttttttgagatggagtctcgctttgtcgcccaggctggagtacggtggcgagatctcgactcactgcaagcgctgccttccgtgttcatgccattctcctgcctcagcctcccgagtagctgggactacaggtgcccgccaccatgcccggctaattttttgtatttttagtagagatggggtttcaccgtgttagccaggatggtctcgatctcctgacctcgtgattcacccgcctcagcctcccaaagtgctgggattacagacgtgagccaccgcgcccggcctgctttttgtcattatagttttcaccctaaacactgcgaaaggaagggctaaaatatcctgcatatgggcataaaataagatctaaatgtcccatatttctccctgtctcacattatcaggatctcctttggcttctgcttgcactagtttatcagcttgtggccccactaaactatctcagcagctcacagttttaagcagatgtgagtctctgtccaaatttttactgaaaaaaaaaaaaaaaaaacaggtaaaaagaaatcacttcctttttttttttttttgagacagagtctcagtccatcacccaggcttgggtgcagtgtcatgatctcggctcactgcaacctccacctctgggttcatgcaattctcatgcctcagcctcccaagtggctgggattacaggtgtgtgccaccacacccaactaatttttgtatttttagtagaaatggggttttgctatgttggctaggctggtcttgaactcctaagctcaagtgatctgcccgcctcagccccccaaagttctgggattacaggcctgagccacggcaccctgccaaaaaaaaaaaataaataacaacaacaaaaaaacaaaaaaacaccttctgatacaacacatttatgtgtgacagtctgagggtaaattcagggctatcgtttaggtcataggtagtggtgtaaggccaaactggctttatggctgttgtccatttgattgcttagcgtgtgtatcttcattgatgattgtccatgctatatgacttgttaaatgttttaaatattagtgctggttgtggtaagatgagagtaaagatggagatccttaacagttcatgaatacaaacaccttctaaaaggaatatacacatttctgtcttaaaagctccttagctactcctccaccatttagctcacatactgcagtcttttccctctcaaactattttttattcttctctccttcacccttacattctgaacatttataatgttgaaaagttttagccatctctcttatttgctgatttttctcaactcatgccttaagggttcaacttgtactcctaaaagtttacacatttattttcttaaacagagacaattacctcctaagagaagttgtggtataagttataaggatcatattttgtttattttttaatttaaatagactgtttcttaaagcagttctatgttcacagcaaaattaagtggaaggtagaagagtactcatttacttcctgccttctctgccacacagagcctccctatcattgacatccctgaaccagagtggtacacttgttacagtctgtgagccacatttgacacatacttattaccccagatcagtagtttacattagggttcactcttggtgatgcacattctatgggttttgacaaatgtaaaataacatctacccaccattatagtatcatgcagagtagttttaatgccttaaaaatattctatactggaactgttcattcccctctgcccccaagccctggcaatcattgatcatgttattatttccacagttttgccttttccagaatgtattatagttggaatcatacagtaggtagtattttctggttaacttctttgacttagtaatactcatttaaggcttgatagctcatttcttgttagcaatgaaaaatactccattatctggatatgcctcacttgcggaatgacatcttggtggtttccaaacggtgttaattatgaatgaaactgttataaacagctgtgtacagattttcgcatggataagtctttagctcatttaggtaaataccaaggagtgcaattgttgaattgtatggtaagagtatgttaactttgtaacaattgacagactgtcttccaaagtgactgtaccattttgcactcctgtcagcaacgaatgaaataattcctgttgcttcacattctcaacagcatttagtgttgtcagtgttctagattttgggcattgtaaaaggtatgtagttgcgtcccattgttgttttactttgtaattccctaatgaagtattattttgaacatttttatatgcttatttgccatctgtatatcttttttagtgaattcttttgagatttttttctgttttttaattgggattttttttattaacatttaaatgttctttgtacattttggatgacagttcctttgtaagatatgtttttgcaaatattttcttccagtctgtggtttatattctcactttcctgcaagtgtctttcatagctttttcattctgttatggttgtgttatagtatctgtaatgggaattagagaccctgaaagaagtttaatagattacttctaagctgccttcctactcttaactccttaagaagtatatttttatactgaagaagtatatttttcaagtgacattttaatattaaaacctatcacaaggtatgattatgaataaaagctggcaaactcatttagaaatattcaatagcttttgcttttaaaaagattttgttttaactaatgttaataaaatcaaaggaaatatccctcccccatatattaattattactatatccttgcatacatttaactggaaggtagaaaagttgactaacaagagtctgggctaaataaagcctatgatttgacagatcattattttttcaggttgtctattaaagtatgagaaacaagaatactatgaataaaatcagattctcctgtttagtttcttaaatgtttcctttatggtgaggaagtattgcctatgtctaagaacagcagaatagaccttgtaaagatagcctgggaaataaagattggaagaaaagttacgatcaattatgggtttctttagtaagatctctacctatgtttttttataggtcccttctaagtatatgattgcagtccagaggtatagtcacatcaattgtgtattatttgcatagattagcattgccttttcacagacaattttctgttattttcctgccaatataaataccaaagactattaaagtaagaagaagtttcaggaaaggtagattgcatcttgtcacaaatcgaagcacaatgagtaagctgatgtgacttttccctgctaagatcactagaaatcagagttgtctcattaaatacacactcaaagaatggaatgattgccagacttgctgtggtaagatctttgaacatttacaaagatgcttaggtaaattttagccttgtcacccattctcaagttatttaaactttacaattttgcagatcttatagatgtactttcactaactctttcttgcatattcttgttatataagaaagaaatgaggcttaaaataccaattataaaagaatgagttattttaaataagagatttggaattatttaagccatgtattatataaaaagaaataacttttaaaaaattctaaaacttaatatagccagaagtaatatagaaaacaatagagggttttttttttttttcctgagaaacatttgactaaaacaacatgtgctaatgccaaactttctggcaataacgtctttttatacatgtgtcatatatatcacaatatgtgtagtttccaaggattgtcataacaaattagcacaaaccagatgagttaaaaagtctcagatcaaggagtcagcagggtcgtgttgtctctgaaggcactagggcaaaatgtgatccattcgtttctcttagcttctggtattgtcaacaatccatggtgtgttttcacttgaagatgcatcactccaatatcttccttcattttcacatggggctctttctgtgtggctctgtttctatattttctctccttataaggacctatactataagtgccccaccctaattaattataagttcattttaacttgattctatttataaagacctcttccttcatcttcacatggagctctttctgtgtagctctgtttctatattttctgtccttataaggacccatactataagtgccccactctaattataacttcattttaacttgattatatctacaaatacctcttccttcatcttcacatggagctgtgtggctcagtctgtttctgttttctctccttataaggacccatactataagtgccccaccctaagtaagtatgatctcgttttaacttgattatatctacagagaccctatttccaaataaggtcgtactctaaggttccaggaagaacatgaattttggggagggtattactctcaacccaatacacaatatcttatgtaaactttggatacagaacaatctgagcttgaattccgactctgctacttagtagctatgtaagctaagacaagttagttaatctttctggttatatattagttcctttatatataaaagtatgataaatcccactttgttttaaagtttagaaatgatatttgtgaattaaccagaaagtatctgccgcacagaaggttctaaaaatagtaactgttattattttatgattattatacagaattacagcagcttctttcttttataaacattttgcttaattgtagaagcagtattttagaaacaaaatactaatctttaccaaacgtttggacaatttagtgaaagtgttgtcatactgttgctttgatgttaaggtataataactttgctttagctttgctagcagtatatttctccaagtccagccatctttctgagtattatgcagaaaaacactgtcctcaaggttgaccttaatgacaacattgtggttcataccacttcaaaccctccctttttttgctccttgtaagtttctttttttatttaattgttcaaccaatcaacagctatttataacctatatggaaagtattatattaggaattatgaaaaacagaagtattatatgatcctgcttacaaagaacttatactttatttgtcagaccagactaacgtataacatataaagcattattaggaaaatgaattgaaatttaataagaaatctgcctttttagcaaatattattccagtctttaaaatgggccaggcagtacacagaatatgcaaagatgattgaaatgatttgttcttcaagatggtctcagatgaatgagagatgaatgaaaagataattttcatagaatgtgataaatttaattataatcttatgagagtgttgtgtaacacagaaaagaatacttagattaaaagagaagggcttcagggcttctaggagaaggtgacatgaattgattactaaatgactagcagtagaaagtatattggggaaagaacagaagacaggataaggaattttgaggaagaggaaatagtatttgtgagaaaatgcacaggagcaaaaattatgcaagcattttgaggttattcataattcatagtataagattaaaaggcagtattgagaaaaacatgtaataaatctggagtaaaaagcagaagcagatcttaaaatggtttcaatatatggtattttgttccgtattacctgtgtggacaaagagaattgcaatagtattccaaaagaatatgatgaaggctggagaactgaggaaattaacacttatactagctttctattttaagtcggtacaagttgcttttatatgcattgtcccatgcaatccacatagcaactctataaggtgggtgttctccccattatgcagaagaaagaagtagatcaaaggtgttaagaaatttgccctaggttacacaacagataaatggccatgtctgtatttgttcaaaatgatgacatcatgaggggaaggtgtgtgttatggccgagcataagtcctgtgaggaaacacttagaaatttttacaatgaaattcaggtgatagatttacagattagccttttctcacagtacttattttcagccatgacacctaccttcccctcatgagttcatcatttaaaacaaattcagacattgccatttatctgctgaaacaaatctatattatatagggggcaatgaaattatgaaggcacgtaaactgaagcctacagcacagtttcaaagagggtgaaaattgttaggaagctagtgaaattaacatcaattttaggtttgtttcagctacttgagatatgaccccaagaatttaccaaggaaatggttatattaattcaggtgtgaagtcataaccccagatctagggtcagatgacgaatgctagggagggtgtttgccggtagtcagactaagaaagatagcataagaaaaagggagggagggagggaaagagagaaggagagggaaagagagaaggagagggagggaggcagagagagagcaagagaaagcatttaaaagaaagaaagcatttaaaagaaagaaaacttaatgtaaaaaagtatttaagttcaaaattggttggctattggaacatgaagaacacgtgaaatatttagggtaagcaaggcaatagtcatgtaactgacagagaaactgtgctggaggagtctaatttagtgaggcctatgggggtggagtgaaatgatacttcagtttcagacacacagagtttgagatgacagtgaaatatccaaacagcacatccattaatctctagatattgcacacgaaccagaatatgtagtagtgagatgaaacatgcatgtgagattgtgtctccttttttctccaatccttttttgatagttggaaatcctaacagacagaatctgtgctaaataagcaggtggtgtgaagtgtcagaggagtctgatttatttttcttaacagttagttaaaaatagaaagtgtatttgaaaaacatagatttttgttcagtgacctgtgtcacagaactgtcacaattacgctaattctgtagtcctttttggaggagcgtctgagaggatctgggggccatgggctacaagctaggttactttacctctctatatggtgacttcagagaatgatttcaaaataggatatatgttctaaaactggactgtgctgattgcacaactctgtacatttactaaaaataatggaatcatacactttgggtgaattttttgttacgttatacattcatgaagctgttaaagaataaaataaaataatgctatgtttttatttcttgctaaaaatggttatggattagttctgagtgaataccattgtaaatgacttgatttttaaaactgctgcctaataaaattccaatttatatgcaaaatatagtattaaatacacatgaatactgactctcttaaagtaatataattaataacagctttgtttactttatgttatactgtttttcttgtcatattcctaactatgtctggttcatataaaaatccaaattataagttaagaataaatagtgaaatattactatttattacacacacacacagaggtttgttttgtatcatgttgactacaacttggcaacagacacctgagaacatcactgtatataattttttctgtgttgcaaattttcaaaagaaaaaaacgttttctaatgatgtgggttatttgttttattgtaaattgtttaatcattgtctcatagttcttgaattcattaatagggaactgtactgggggctgtgatgaaagataagttaaaaatggttcatattctcagtgaacgttcctgtatgacaaggatgatatatgtgtagaaggtaattataatttgggtaaaacgtgataagaacagtagtaattattattttaaggctgttcagagttgaaggaggttgcctttaggtatatggatcaaagtaaatcttcaggtaaagtttctgtattagtttttttttaagtgtttttttcttttattattatactttaagttttagggtacgtgtgcacattgtgcaggtttgttacgtatgtatacatgtgccatgctggtgcgctgcacccactaacttgtcatctagcattaggtatatctcccaatgctatccatccccctcccaccaccccacaacagtccccagagtgtgatgttccccttcgtgtgtccatgtggtctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatcagtctatcattgttggacatttggcttgtttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgacttcttaatgattgccattctaactggtgtgagatggtatctcattgtggttttgatttgcatttctctgatggccagtgatgatgggcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctgtgtcctgaatggtaatgcctagattttcttttagggtttttatggttttaggtctaacgtttaagtctttaatccatcttgaattgatttttgtataaggtgtaaggaagggatccagtttcagctttctccatatggctagccaattttcccagcaccatttattaaatagggaatcctttccccattgcttgtttttctcaggtttgtcaaagatcagatagttgtagatatgcggcgttatttctgagggctctgttctgttccattgatcaatatctctgttttggtaccagtaccatgctgttttggttactgtagccttgtagtacagtttgaaggattctgtataagttaaatggaaataacaacaaatgtgttctcatttgtttattcaatgagacaggaaggaaaccattctaggaatatgttcttcaaatttaatgtctgtatccctatagtacacaaatactttcaaagtggtaggcagacagaaagttttaaagattaattttccacatccttaagattcttatgaattcttttcttgtgaattcatgggaacacttctgatgtaaaagcttcatgcattccccattgagtctccctatcacagtctcccaataaacacatgtgactttgacatccttatttgatagcccaaatctatgccagtgtttcctaaattttattgatccatgtatcactgctacgattttccatctctctgtatcaaaacataacacattttctgatttctgtcatattcatatactttactgtatcaacaatgttttctctgaatttttcatatttacttaaatgtatttgtaattatttgaaatgtgtatcagtttttcacttgtcagatatagaatataatgatacacataaatacatttccctttatcaaagaaaacacactgtagtccatcctttaccatacagagatgcaacacccaagaggggaaaacagtcaaaacaccaaacaaaaggataatcataaatattaatgtggatggtggaaagtaaaaattctaactcatgtaagctgtaactgacttgattttagcaatttatctttttaatattaaaagagaatcttttttgctgataaattaataattttattgtggataatgtagttttggaatataactcagaagaagtttaaagtattaagtaacattgttacaacaaagccttttctattcccatctactcagtatctgaacatgtttttaaatgcgtgtagtcaaaaactagaaaataggtacacccacctcattaagagacagagttctaatacaattttacattcgatttaagcatattgtatattaatttaagcagctgcttacaaaaaagattatattgataacttaatcctaaagaaaaagaagatttttagtcttgtgatctgcattttaaaaattggtttatatgaattgtgtgtgtagagaaatagaacaaccgtaaaaaatctcaagcataaccatatattaaattgaaaaaaattctatgggcaaaatagaatgagaatgttagttcagtaagataaagggacaatatgaaatttctgactcctaaaaagagcttgttcacatatttttaaaatgaattattgtggatttcaaataaccatgatatttatattattttttttccaaaagaatgatacagtagtatactggaaatgatatcattagcaattatttacatttctgttgtaaaaatttagatatcaatctacaaatatgtgatagtatatatgattttaaaaattatagactatatgagcagaaaattttgaagaccactgttgtagaataaaggcctagatgtacaaaaccttaaaaactttgatatatctagtagttcaattatttgatgagtaggacaaggcttggaacacaaatttgaaaagactgaggtgctcctggaaggctaatgctaccaaataggaaaacaagttgggtgactcatggaatttcacattttctcctagtcagccacattaaaaaaaaataaagaagaaacactggaaatcaattttttgttggtttgtttttgttttttgtttttgagatggagtttcactcctgttgtccaggctggagtacaatggcgtgatcttggctcactgcaacctccacctcccagattcaagggattctcctgcctccgccttcccaagtagctgggattataggcatgcaccaccatacctggctaattttgcatttttagtagagttggggtttcttcatgttggtcaggctagtcttgaactcccgatctcaggtgatccgcctgcctcagcctcccaaagtgatgaaatcaatttttaaaaaccatttatttaatgcaatacattcaacatctcatttaacgtataatcaatataaaaaatagaatttggaatctggtgtgtattttacacctatagatcatctcaacttggactatccagatttcacgtgcctagtaaacgcatatggctgtagcatccttatttgatagctcaagtctgggccagtgtttcctaaattttattcattaatgtactgctcctataattttccgtatctctgtatcacatcataaataaattttctttctgtcatagtcacatatatctactgtatcaacaattttctctgaatttttcatcctttttacttaagtttacctatattaatttggaaagtgtagcagttttttacttgttagatatggaagataatggtgtgaataaatagaatataaaatattattacatgtcaaatactttttgacccaagaaactgagcctgagtccagtttctctattagaaagactaagaaacagttgtttaagtgggatataaagtatattcaattttttctaaaaataattgggattaaagaaaaatagtaaatatcactatgttacttactctaaagtccacctgaaaccatatatatatatacatatatacaccatcagcatcatgtgtttcactcactggggactaaatctcagtatgaaacacatactgagtatgagatttagtcactggggaacatttgcaggtctttagtagggatcataagacacaactatatttcataagttaatcaggctaatctatagtactagaatttgatttgatatagaagattaaaaactcagaacattattttaatttctgtacccttcttacattttatatatttctttgtagtaaggaacttcatcatattttattggggtcattgagacatatctaactttttagcctttcagatgatctagaatgctgttacaaaaaaagaagctaaggaatgctggaatttttaatgtcaaagacaactatagaagagtctacaccttttttgttgtttctgttgttaatggtgagatatgagtcctagagaagccctctagaagggtacacaaaaggaagttatgaaaatgactgatctctacttgtttatagtcaattagatatgaagaacatggatctgtattctggtgacattaaataagagtagcctagagtcaaataatacaatcacataatataaagataaaattgttaaagcacatttatatctgtcaaagagcaacctctaggcttctaagtttttattactctaaataattttactagcatcttgaatatcatctgtgattagagaacatgaatattttctctggtaatcaaatgttattgcaaataatatcgtacttcctactgacacaatattattttattatgatttagctattagataaacatgtttttggaaattttaacttcatagctatacatcgtatgataaacgtttatttaaactagaagcaatttcaaaaggtatttctggaagttgccttgattggaatgcaaacatatttatctgtagaataaaacaggccttcactgtcccaagcacagagaagacattcagaaatatattttgaatgaatgaacaattccatttccattagtagccctttctactaatggagcaagatagaaagttttatgtgctgtgtgatttcctaagtaaaataaatggaggaatgaattccactagatggtaacaacagtgctataggcttgggaagattatggataactctattttatgttcctctttcttagaatgaaatactattattttatactgaaaactaatataaagttctaaaagactaccccttatcaaaagagaatataggttgagttacttcaagagtttgagaccacactgtttgccaaacgtcattccatattttcttaacacttttattaatacccccatcgctgctgttaacttattttttcatcatttccctgtcaaatttatctgtggaactggatttaatatgctttaaagcagattttttatgctcaagttatgcctattttaacaagcattttaaaaacttgcatttgttaattattttcaaatataaatgacatagtcaagagcatttcacttgactgggaaaaaaaagaactgactatgagctcttctagattatctcagattacaacgatatcagctttaaaaaagacaggttgtgttttggcatccttcttaatcttcagatatttgcttatcactccatgtcatatggcctgacatcctttctgtggcttgctatcctctgaatcattcctcgccttctcttgactattctgccaaatgcagctgttttctaagagatttcacaaaggttttatctgtgccgtgggacaaaatatgtctgcatctctctctctctttctctacttctatctctatatctatcatgtatctgtttatttatttattctgcatgtataacatatatgcaccactataacatacattcactttacaaaattgtgttaaaaaatattgataaaaaagaaatcacttgtaaaactaatgccaagtggtaattattaaatcagagagagagagagagacagactatgtagaactgtgatagaggaagcattttctttatgtttgagtcttatctgttaaggtaacttaatttcaaacaactactcaaaaagaaagctggtgtcaacacagcatatattttaatgtgttaaatatcacaagattagtgaattcataaacagtctaagtaatggtattcaatttcctatagcatatgtgttttgtaagagatagtggataaaatagtacatgcccacatttgatatgcaaataagatttttttggaaaagcttcttattttcccattgattactattaattttaagtttttaaaccaaaaaaaaaaaaacccatcagatcaaggaatgtgaagtttaatattctctggctgatcatgctttttgtttgcttctaaagacctggacctaagtactctctaaccttctctttatcttgctgagaaaggcagtgacgttacagcaaataaagactacatgaattcttattaaatactgttatttccacttctataataaaatgaataatttctgtttcagtacagaattgtcatttctcctatgttttttattttaaatattttcaaaacaaaaaagtaaaatgaacacccatataaatactcacgtagctcagggatcttcaaactagagtttcatggacaatttcagcttgtcatctgcttctatcagtagttttattggaacaaatctatgcccatttatttatgtattgtctatggctgcttttgcactgcaagactgagttgagtagttgtgacagagaccatatggaccaaaacctaaaatatctaccatctgtccttgtagaaaaagtttgtcaaaccttgatttagattcaccagttattaaaattttgctacatctgttttttctatctttgtaattatagataggtagattatattaatagttatatacatccacagattttatggatgtatatgtacacaaatatgcttttttctgaactatttaaaaataagtgtctgatattataatacttcagcatgtatctcctaagaagaacatcgtcctatatctcctacatgatcacaacattataatacgcgaagtatttaacaatggtacagtaatattgtctcatagacagtccatattcagatgtcttcagttgcctgactcagcatccagtcaaggagtatgcattgccattgatactttatctcttgacccttctttagtctataattctcctttgatttaactttcatgacatttccattttcacaaaatccaagacaatggtcttgagtcatacaatttggatttacgtgatgatttcctcttgaatttattaactattttgataaaaaatgttatgcagacaatgatacacacttcccattttatcatacagaaggactcacaatgccagtttgtcctataattggtgacactaagtttgagtcacttggataagataggatctgccagacttatttattctagtgatatatttaaattccatgttattgataagtagtaatgtccagtgatatcttgaaactatgtaaatattatgctactccacagttttatataatggatttaacatctattgatgatccttgcctgagtcaattattatactatagaacacaaaataaaaactttctaattacatcattccttctatgtttatgacctggcattcctctgtttaaaagttcttttctcttttctatcttttcatttcttaaaaaattattttaatattatggactcatggatttttatgtattcaatgtgaaattatacattacttgcaatattctttttgatacttaaattatataaactggctgttgaaaaccacttcaaactggcaactttgacctgttgtcttctttattccttcatgactgccttaaattctgaagcaacaaaatactcagggcccactttctgattcctctgccctaaaccttgtatgtactattctttaaggattcctagtttagtaagaaagataccaagatctgagtatgagatatgctcattgctagtggtgatttaacacaaaaactagggaatacataatcttagttacttttttcttattcataaattcttacctctaattcaaattcagtgatatatggtttttcctcacctctctcactctataacttgatctcccatttcctgtaatgagaatcatgactccccaaaattcagtatatgtacttatttgatttgccttacatatagatgaagtaaattaagaatcatgatactcactttgggaggctgaagagggcgaatagcttgagctgaagagttggagagcagcctgggaaacatagcgaaacccccagccaggtgtggtggtgcttgcctgtaatcccagctacttcggaggctgaggtgggagaattgctttaacccaggaggcagaagttgcgctgagcttcaacatctcgccactgcactccagactgggcaatagagtgagaccccgtctcaaaaaaaaaaaaaacaatctgatttaagattgttgactgtaatcagctcaagtctaatatggtatagacaaacagccttatcaactcttgtcaactattgcaatgcagtgtgatacaggttaagtctggaatgtatgtaagttggtgttatttgttttacatttttttgttttattttctaaaggaaatcacaatatcagtatcactacctaaaatctatttagaaaagttcaaggattttttgttttctctttctgttcctggaacaggagtgtttgctgtcagctaaatctttttaaaatttacttgaatttgttctttattttctgtgtgataatgctaaaaaagtcacattgagttagtttaatttgcttatattagcatataatattaaggtttgctttatcttttctcttaaatttagtttttaaaaaatataaaaacatttacatggttcacaagtcaaaactatacaaaggtacattcaaagaagtctcattcttatatctgttcctttcaacttgttaacacatcctcataagagatcattttcattagcatataatttatgattctgtgatcctttaaaaaaagaaaagcgtatacatgtgtgcatttaataaagttagtatgttattaatatacttcattttgctttaacatgttctggaataacttagtgtctgtatatagtgaacaggtttttctgtttttctcaattgcttaacactcaattatgtcaatatctcatagttttttcaagtttcctatgtattatgtctttatttgtgtctttttgaatttctttcatcaatgtcttagtttgtaatgcacagatctttcataaccttagtcaaatttttctctaaatattttattttttgatgctattgtaaatgggatttgttttcttactatccaaagtgatctacaagtttaatgcaaaccctataaaaatttcaatggattttttacagttattagaaaaaatcataaaatttgtatggaaacataaaatattctaaatagccaaagcaattttgagaaaaaagagcaaagctggaggcatcacagctttatgatttgaaggtgtatcacaaagctataataatcaaaagagtatggtactggcataaaaactgaacacacaacagagatcccagaggtaaactcatacatttatggtcaaactaatctttgagaagggcatgaagaatatagaatggagaaaggataaactctttagtaaatggtgtagaggaacctggactttcacatacagaatatcatatcatttcatacctgaattaatataaccattttcttgttaaattcttggggtcacatctcaagtagctgaaacaaactggactttcacatacagaagaatccagcaatcttctgtgtatatacccaaaagagaaaaagtcagtatgctgaagacatagctatactactgtgttcattgcagcatcattcaccatagcaaagacaccgaaataacctaaatgcccatcaactgatgaatgaataaagtaaacgtgaaataaatacatatatgtacatacatacatatacacacatatatgtatataccagacacatttacatatatgtatatgtatttacacacaatgaaatattatttggccataacaagcaagaaattctggcatttgtgatgagattaatgaaactggaggatattatgttaggcaaaattagcaagacaaggaaagacaaatgctgcataatctcactatatgtagaatctaaaaaagtgaacttggaaaagcagagaatagaatggtggttaccattagctggcggtgggggaaatgaggagacgttggtcagaagttacatataatcaattagaagatgaccacattctggggatttaatatacagcatgtcaagtaaggttaataatgccgtattgtaaacttgaaatttgctaagatggtagatcttaagtgttgtcaccataaaatgatggcaactgcgtgaggtgatagatatacattgagtagcttcctttatgtgttgggaaaattcctaaagaaagggaaatggtgtgaactttactgtatattatatacacaaattttatacaagtatgctttacccatgagtgtctgggagaaaaaaaaacctgaaaaaaatgtctctaataaaaaatatgggcactgagggagtctataaaagaaagtacaaatgctttgtgacaactgaaccttagaaacttctgaggtatttttttttttttatcaacaatggagtgctctttctgaagaatcacattggacattgtgagaaaaatttttctactacatcaattacttcatttttttttttgccatgtgctaagacactgttttagtcattgagggtacaaagataggtgatttaagattgttgactgtaatcagctcaagattaatatagtgtagtcaaacatccacaccagctattgcaatgtagtgtgatacaggttaagtccggaatgtatgtaaggtggcgttatttgttttacatttttcttgttttattttctagaggaaatgacacttaactgccatgaattacttctgtgaacatttgttactcatgttacaacaaggtgtcttggatttgctcctgacatattcctgtaaaaatccccattgatttttagggttgattcacttgatgtggctgttatgtaatgtgtacccttcctgtttcactgatactgcagctcacttggtcaaagaaaacagccttgtctaataaaggacaactttgattctaaccaaatctcaagatacttttgaaggtgaacttgttttgctaaataaatatttttctttttcatttcaacatgtcataatacattttaaataatagattacctctgaagttgaacagggagttgtattccctgatatgcaacctataaaagtttaataatggttttataagagagaatggggaagaaaagggcagtacttccagtctttatctgtggcacacatacacacacccacagaggcagaaagctggatgggattgtagatcatgtagtttgaaaataattcagtctttgtcctattggttttgtattgtctaagtcagaattttagattttttttcagtatttgtaaataagcagccacatagaggtataatatacacataatgtataacttacttattatgcacaggtggtaaattgccataagtgaacataactgtggaaccaacaaccagattaggaaatggaacattatcagtattcaaaaagaccctcttgtgcttctgcaagccactgcccccaactccctcagggaaaccactacataagtcaacctgaattttaatttgcgttcaagtagagcatagattgcaatatttatcaaagataacaaggttaaaagatgttggcctgaggaaaattctaggtatccatgtctaaacaccagtgcaaatccccaaagaaattatctgtttttatatagttctaaaaattattggtgataacattttcaattagagtttagttgcattacttaaatgtataagcttaaagatcttgttcatatttttgtggttttttctgctttataaaaactattagaaatcccttcttggacattatcacagtctttggtttttaaggtcatttgtactgtgtatgtatttaaatactaacctagggtatgttagactgcaaattaatttttgaagaatttttattgaaataatacccatgaccacttagccttacacataggaaaaaaaatggtcattttaatgtataattttattgtcttcatacaatgtaaaaattagcaataattttttaaagtgataatagtaatattatatttctcatcaatattaatgccaattaaatgcgaacgtttaaagttgctatctgagtatgattttccttgtaaaactccttaactgatgaccctgagtcgaccattggctggaattcaagttcatgagcgtgacacacaaggcccttcgtgagatgatccctgtcttcctttggaccttacaccactgctcttgtttatattacaaaaaataacaaactactagtggtttcctagcaactattgcagcttttcatgcctatgtaagtgcttatcctgctgaatacaattttcaccttttgtatgatataaagttccattcatctctcaaaaccccactctgattcttccttctcttagtctttatggactgtgatcaccaattttaatctcctttttaagtttgttgcttcttccttgacattttttccaagttctagaatggtttaagttttcgaaccacccctataacattatgagtttctaaggaaggagcaggaactatttcttaattaactctgtctagtacattgcagatgctcatcaaatacttgtttgtgggtaaatcttcccaacacttatcagagtgataaaaaaaaaaaaccaagtaatttagtgattgttaaatgattagctttagaaaacttcaggttttttttttgggggggtgggtgttaaatttattttgccctgtaaaaggagttaatctgattcctccccttttgtttataaagtttgtgtgtctcatgagatcttaaagatagaaacaactttaatcgagcccaatttttttaagaaattcataggagaagtaaaaaaaaaaaaatgctctgttacagaaacaagttaaaaacagactaccttgtatcccttaatgagagctaggaggcctacattgtctctccaactgtcttccaagggcctgaggtccttcatggggtctacagacttgaaggcagttctcgggctcatcgtttttatcccgttgttgcctccagttacttatttgctttattctgtcctgttacttcaaatgttttgaaacagcttcttctcttagaatgtatgaatgagcaatgtttcagttccgttagaaacatgactcttttctggctacccataataaatccgctctccagttttgttcttttctactacattaaagccattataacaaaatattaaaaaaaaattttctttcaaaaaaccagtaacccaagtatctatttcttagtgatttggctgcatttataggatattttatttggatctattttataatcacttgaaagcgtcactttggtttggttcaggtctgtggacctgaataaattgaccatgctttggcagagccatcagaagagtattgtggccaatcctttaaatctctgcagatgctctatagctaagtcaatccaaactgatcatcattgtggccatactgagtggtttttactctgccatgggcgtgatgcttagccataaaaagatttacctttgagtgataatatttttgtattttctgctagcgtagtttcccatttccaatgacattgggaagtaaaatatcttgcttttttaatacggtcattttcatttatgcttttttattgttccttaacaatgaaaaataatgtaaaatgatataaaacctctgagatgcagatttcctggggataaatggttggactgattaaatatctgttcatgacactgttcagaatgagtcttcatgtcattttggaaatgaaggttaatatctaatccagttaaatataaaaatatattgtgattaatgtctcatctactgaagagctttggtcaaacaaaaacctcataactttaaaaaacaaatgagagaaagaaagaaacaggtagataattactggaaaaataatctaaaactattcttaaaattatttaaggcactcatattttaagttttcttcgggcatatgcaaaactattggatgtattagataatctctgtatcacatgctctctctctatgtatatttacctctgtgtgctataagtagaattttgtactcacgttatgataataatgctaagcattaatatattttaagtgaagtttccactttatatacgatcttgattgattatcaagtatttttacgttagcgttcccatttaaaaaaattatcaagaaagaaggaaaagaaaaactccttaataacgttaaatataggttaataaataaagacattagaatatgtgttggttgtaaataatttacatcctctatgcttagagtaatttggagaaaattcaatagttctttatagtcatatcttttcatagaatttatatttgtattgctaatttggtattctaggtaaaatttatttctgcccttgaaatgattttcattttcattagtcacttggtcatttattgaatacatgtttattgagtaaacactctgtgctaggcattgctagcataatgaatgagaagaggaccgtgactttatggggttaaattcagtagagccctagagcatgtgactaactatattatgctgcagaagccacacacacagcatcctgtaggagtacagagaaggcagaaactaactcttaaggagaggtagaaatgtcaggagagcttttcagtaggtggggatgtttaatttacattttaaagaaatcgatttcaaaattaatacccaatttcaacacaccatttatagaaaaaatttctctaaaagcattgctttcctatcattatcaatttttttttaattttcctaggccatttttgggaaaagaaagtggctattaatgacttacataactcatactgagcttaaaatatatatattgaaatcttcatttaaaagtagaatgttattctcagtgttctttccataactttctccgtctctgtggccccatctttgttttgatgagactcaaaaacattgatcctgttaacttttattttcaactttcaatggcctagtggtgcttgcataaatatacagcagtgctctctacgggacagaagctaatcaactcatgtggaacacgctttattactgggtatgaaggatggatatcttataggaaactcaatgacaattaaaaaaaaaactattcaaaagcgactgcaaagaataataccacattttaacttgaaatatttacaagactacttaaacctctttctagcaactggtaaagttcaggaccagccccagctccaatgtgaacatgagatgcaagcaaactttctgctttctctaagaaattatgttattttaaaaatgtcattttttcatttctaaccaaaatgttatattgagttttttcatttgatttacttttacaatgttcttcttcagtggaacagcaaatattctacttcccaagtagccatatttgattattattataactttaaagaaattaagttgaacagatgtttattatggtgaatattacattcactgaaatatattcatgattttgacaatttactattcaaaaaaagtagtgtttacagtaagacaaaaataccttttgaagttcacatgtatcttttaaaatagcgcaatgacatgctgcccatggatattgaaatttttgaccatgattacaaatgttgtgcatctcatcaaagaaataaaagcactgttcttctgttcaggttgttttttgcatttagttataaaagttaattctaggcaaattggtctggcaaaataaatcacgaatgtataaatgcaaaattaagagagtaaacgatgctaacacaatgtctcaatttcaaaaataacatgtttggaatttagtcttccactgaacttttccactataaaaactaatttttaattacttgaaagcaattttatataaggtcaatcaaaaagtgttaattctcaagataaaaaaaattgttcttgacagtttttttctgttagactagtaaatgtgtggttgccaagggtatatttctaaattgaaagcttcaaattcctattttttgagtgctccgcaaacctcaggtgtaacagagttgatttttaatgccaaaacatttcaaattgagtaacaataatagtgctaattatacaattccacttttacatgatattttatagtttatggattactttcacatacatatgtacgattttacctaatcactccatccacagttgttatacagattatatataatactacatgtgaaagcagtttaactgacaaccccattaaacacaggaagaagaaatggtaattgggtattctgtgatattgtttaacagccataataggcgtacccttacactagctttatctctgaatattttaggttatataaccatatatgactccattttttaattcagattgagttgaattttttttcaacttatcttaccagatgcactgttcacatcctctgtagtgtttaagccttgttctctattaaaacaatctctttcataaaactactgaagtcaaaggcaaaaactttgtgatggattcccaaaaacattctttaggtatgtcctgcttggatacacaactcaggttttcagacttgttcagctgactctattaaagactgagaagtgttgtcatcttgatcaatattgagcaatgattaggtgtaggtctatgacatcaccttactctaaaaccacagttaaactgttttgtgtttagactgtatgctttaaaaatccttatttctgagtatctaacaggattttcttaactattatatgctttttaaaaattaatgtatattagaatagatggataaaagctcttattcctctattctgtggggaattggttcttattccccatcaaattgtggaaacaagtacgtgccctgttgaatcctgtctaaataaattaatctcatagtcattgtgattatgtgtcaggaagagatggccaaatgaaagttcatcataggttaaagccctaattgagaaagcaaccagatactttattatgcatcctaagatcttctccaaggacaagtaataaactaaaaaaaaatcaatgtattaatattatcatcactatgattattttggtaagaaataaaaagtgagttcaaaaactatatcaataaaatattcaccatttctgaatttaattgaaattaatatcaacaatttttctctatttgtgttaaatttataaaagaatatggtaaattaatttcatagcattttattacatcattctcaaataattctatataagtaggtgtgttgtttttctcaatgtccaggtgaactggagagattatatagtgttttattttaaacacaacaatactaccattttatacctcatcagaaaatttttaaaaagacacccattattttctaattaatacaatttcttgaaacatttccttaatctatagacattttaatatcatattatgaatactttataaacatttgcatatttaggaggaaaaacagttttcataaatgatttctgtatttctaaatttgtagaaatttttctctacaagtttgtagaattttaggcaagaaaaaattcagaagaaataaaataattaaatgtataactctcatcaaggcatttattcattttctgtaatcaggctgaattcagatatggaaatagaatttttaatgtatttcaagcaaagtagttataaaatttgactctcttgtgaatacaacactaagactttcaaagtcttctacttgtagagccaaatagactgacaatcattctttgattacatttacttagaatatgtgatacaaaatcttgttaactttccagaagactggtaaatttccagcttcccttagaataattgtaatgatagctgaggtttcttacttgttttctgtgtgccaagtattagtccttgtacaagggctttacatgaagaatttcttcaaattctaacagtaacactatgaggaatagggttatgattcttactatattgacaaggaaattgaggcattgaaagaataagtaacttaaaaaagtatcttgtagcaatgtttaaactctgtttactgctcaaaggaagttcttattacatcagtttgtggccaacaacaaatcccttgcatataactaagaaatcataatatgcagaactataagttctcagtggctgtgcaatccacctagaccccatgatctgctcccttcaattgcaccaggcaattcagatgccacccttgtagtcaggactcctactacatcttagagtggaatgttccatggcgcaatgatcctttccacactcaaattgtccatagtttcttgatacgtatacgtgaagagggagcatgttgttgttcagcatagaaggagtctggacatggatattatatagagactgtcatgatccttaaaaatgttttggcaacgttgcctcttctcttgcctagcagataaactactggtagtttctgttactgttatcaagtcctccttcttagtttttttcccccccttcagattaattaagccttttgcatgcagtcctctgcagaaataagtattactatttcatacgttagtatatttacaagcaagtgtgtgaataatatagattatcaatgctgaagaagatcagggtaagaggagaatatggctaatacaagattattactacttaattatcagtatagaagattagaaatttgcttagaaaataattttgaatttagctgggaggaaagaaaagacattataacgacactttaaatgagaaatgaatgaataaaggtcgggttgagaataaataagtgaattggattttaagagtgagattctcaacttagcaaagcactcaaaagggcaagtaagcttgaaccaacacaacagatgggagatcagagtgtagtccaagagagtttattacaaggattagctctaaaatctaatggacaatattaaaattttaagaacagtttgcatttccatttcacagtatgtttacttttgttataaaaatacttcaaagtgtttaatccttaccttcaaatctagagtaaaattacgctttataaaattgtgtggttttttgtttgtttgatgttatgacatagaggaacacactgtgccacactgtcaataaatgagttttaaaagtgcaacttcaaggaaaatgtgttaagatcacagtgggagaaaatgagagagaatccttggtaaatcaggtgggcttaatttatagataactttgtagatcaggaagggaaagggaagctgctggaaacacacgtggcatcttaggaaatttgaacacacaatgtttcatgttcccataaaaatattggtagatgctaattgatcatgttgtctttgtatttactcctgcaaattccaaatttagtcttagttctggcagaattgtgtctgcttgataggatattttagtttataccacatttaagaatcaaatagcacacacacattcagaaaatgtgaaatattcaagagtaaaataaattgttaactgcctgaaacatgagctgtgtcctttcattgttgcagtccccacacaaggttttagatatatgtattgctcaactcaacaggtattgctcaactcaacagtggagtaacagatggcacttatattttgtgaaatgacttattttcatgtttcttggcatatgtgactcaatgcattatttaaggtggaattgtaatatttgtaccttaataataacttcttaagaatgagaagtggccaagctcctctcatactaagtgatatattgaagttagcatcttcatgaatgtcttcttaaccccttatcttgtagctactataccatttatttttgcattgccttgtattttagtgaatatatgcacatgcttaccctctcctgaccctatttgcaagttcttgtaatcttactgagttggaacgctgaccatagctcctacacccagcaggtactcaatgaacaattatgggtttcaattcgatcaacatactttaagcattcaagaacgttccatgtctgtaagcaagtgtttgaaaaatctcaatagatgcagaaaaggcctttgacaaaattcaacaacccttcatgctaaaaactctcaataaattagggattgatgggacgtatctcaaaataataagagctatctatgacaaacgcacagccaatatcatactgaatgggcaaaaactggaagcattctctttgaaaactggcagaagacagggatgccctctctcaccactcctattcaacatagtgttggaagttctggccagggcaattaggcaggagaaggaaataaaaggtattcaattaggaaaagaggaagtcaaattgtccctgtttgcagacgacatgattgtatatctagaaaaccccatcgtctcagcccaaaatctccttaagctgataagcaacttcagcaaagtctcaggatagaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaagtaaaagaggatacaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttcaagttcatatggaaccaaaaaagagcccgcattgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataacgccgcatatccacaactatctgatctttgacaaacctgagaaaaacaagcaatggggaaaggattccctatttaataaatggacatgggaaaactggctagccatatgtagaaagctgaaactggatcccttccttacaccttatacaaaaatcaattcaagatggattaaagacttaaacgttagacctaaaaccacaaaaaccctagaagaaaacctaggcattaccattcaggacataggcatgggcaaggactccatgtctaaaacaccaaaagcaatggcaacaaaagacaaaattgacaaatgggatctaattaaagagcttctgcacagcaaaagaaactaccatcagagtgaacaggcaacctacaaaatgggagaaaattttcgcaacctactcatctgacaaagggctaatatctagaatctacaatgaactcaaacaaatttacaagaaaaaaacaaccccatcaaaaagtgggcgaaggacatgaacagacacttctcaaaagaagacatttatgcagccaaaaaacacatgaaaaaatgcccatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactaccgcaagaacaaaaacccaaacaccgcatattctcactcataggtgggaattgaacagtgagatcacatggacacaggaaggggaatatcacactctggggactgttgtggggtgggtggagtggggagggattgcattgggagatatacctaatgctagatgacgagttagtgggtgcagtgcaccagcatggcacatgtatacatatgtaactaacctgcacaatgtgcacatgtaccctaaaatgtaaagtataataaaaaaaaaagtatgaaatacctagctgtttttgtgtggtcctgactactttaaaagctgtgtgccttgatactctagtcactactcaaatgtatgtacacatagtattttgcagatgatttcagaagatgaacaaaatccctgaaagtcatcagtcaacccaggttcagaactttttactattattattatactttaagttctgggatacatgtgcagaatgcgcaggtttgttacttaggtatacatgtgccatggtggtttgctccacccatcaacccgtcatctacattacattaggtatttctcctaatgctatccctcccttagccccccacccccacataggcccaggtgtgtgatgttcccctccctgtgtccatgtgttctcatttttcacctcccatttatgagtgagaacatgcggtgtttggtgtatgttcctgtgttaatttgctgagaatgatggtttccatcttcatccatgtccctgcaaaggacatgaacccatccttgggttggttccaagtctttcctattgtgaatagtgctgcaataaacatatgtgtgcatgtgtctttatagtaaaataatttttaatcctttgggtatatacccagtcataggattgctgggtcaaatggtatttctggttctagatccctgaagaattgccacactgtcttccgcaacggttgaactgatttacactcccaccaacagtgtaaaagcattccaatttctccacatcctctccagcatctgttgtttcctgactttttaatgattgccattctaactggtgtgagatggtatctcattgtgttttttttttttttttttttttgagatggggtcttgctttgttgcccaggttggagtacagtgacgcgatctcgactcactgcaacctccgcctcccaggttcacgccattcttctgcctcagcctcccaaataggtgagactacaggtgcctaccatcacacctggctaattttttgtatttttagtagagacagggtttcaccatgttagccaggatgatctctatctcctgacctcgtgatccgcctgcctccgcctgcctccacctgcctatgcctcccaaagtgctgggattacaggcgtgagccaccgcaccctgcccttattgtggttttgatttgcatttctctaatgactggtgatgattagctttgtttcatatgtttattggccacataaatgtcttcttttgagaaatgtctgtttgtatccttcgcccacattttgatgggattttttttcttgtaaatttgtttatgttctttgtagattatggatattagccctttgtcagatggatagatagcaaaaattttctcccattctgtaggttgtctgttcactctgatgatagtttcttttgctgtgcagaagctctttagtttaattagatcccatttgacaatttttccttttgttaccattgcttttggtgttttaggtatgaagtctttgcccatgcgtatgtcctgaatgatattgcctaggttttcatccttataccaaaacctagcagagacccaacaaagaaaatttcaggccgatattcctgatgaacatcgacgcaaatatcctcaataaaatcactagcaaactgaatctagcagcacattgaaaagcttatccaccaccaccttatcaagtcgacttcacccctgggttacaagactggttcaacatatacaaatcaataaacataatctatcataaacataaacagaaccaatgacagaaaccgcctgattttctcaatagatgtagaaaaagcctttgataaaattcagcaccccttcatgctaaaaactctaaataaagtaggtattgatgggacatatctcaaaataataagagctatttatgacaaactcacagccaatattatactgaatgggcaaaagctggaggcattccctttgaaagccggcacaagacaaggatgctgtctctcaccactcctattcagcactgtattggaagttttggcaagggcaatcaggcaagagaaagaaataaagggcattgaaataggaagagaggaagtcaaattgtgtctgtttgcagatcacatgattgtatctttagaaaaccccgtcgtctcagccccaaatctccttaagctgataagcaacttcagcaaagtctcacgatacaaaatcaatgtgcaaaaatcaaaagaattcctatacaccaataatagacaaacagggagcctaatcattagtgaactcccattcacaactgctacaaagagaataaaatacctaggaatccaacttacaagggatgtgaaggacctcttcaaggagaactacaaaccgctgctcaaggaaattggaggacacaaacaaatggaaaaacattccatgcccatggataggaagaatcaatatcgcaaaaatggccacaccccccaaagtaatttatagattcaatgctattcccatcaagctaccatgtactttcttcacagaattagaaaaaaactactttaaatttcatatggaaccaagaaagagcccatatagccaagacaatcctaagcaaaaagaacaaagctggaggcattaagctacctgacttcaaactatactacaaagctgcattaatggaaacagcatggtactggtaccaaaacagacatatagaccaatggaacagaacagagacctcagaaataacactacacatctacaaccatctgatctttgacaaacctgaccaaaaccagaaatggagaaaggattccctatttagtaaatgatgttgggaaagtggctagccatatgcagaaaactgaaactggaccccttccttacacgttatacaaaaattaactgaagatggattagagatttaaacgtaagaactttcattcagtttacctcagaatgccaaaaaagttaagagaatcgatacgctatttgctagacaaattcttatttagataacttcttagaaacatttagatgtaaccaaatgagttttctgattcggtgattattggcaagtatgttcggatatgaattttaaatgtatggaatgatagtttttcatttgcttctgaaactacatgttttttttttgttttttatttatttatttattattattattatactttaagttttagggtacatgtgcacctgcacgttttggctttaagaggatgatcttcttaaccagggaagaaatacagaagaaaaatgagtagagtgaagaatgtatgtaaatgcactttagaaagaggagagaatgtgttatatttaaccaaaaacagtatttttaaattatcatttaagagacagtgatcatgaaattaggacctgttcaactcttaacataaatgttatatattttccatattaaaaatctttatttaaaatattttttaaaacattacttataaggtataatattaaacttatatttttagcagtgagaatgtatttgaggttttgtcttcaagctttagttgcaaagagaaaagtagtttttacccagaaaaaaaaaaatggccaaggaatgattcaacatcctatagtggcacgaagccaactcttctaatcaataagttgtcattgccagtaagctgaagaagaaaagaacagaaatggtttacaattggatatttccaattatttcaaagaagaaaaatatgttaccagatatgagtcaagatgacataaagtacatgatttgtctctattaactttgaccagaaccagaaaaaaatatatcagacatgtgctatacatataattaagccattaatacacaacttaaaatctctcgtgacctcattctataaggcttaaattcctgaaaaatttctccttataccattgccaaaacatgtagctaaccagaccatatacggatctgattccaatcactgtttatctcattttaatgtggtttctttaattataatgccattataatttcaggtcaattaagaatggtgtgtaaatcatacagcatttactaaaatcctaacatgacttgattaaactttctttgtgttcttggcacccctcacattcatgatcaaaagaatacaaaatctcccatggctttgcttcgttctattttcaggtgatctcttccagtttgtacactttttctgtatcttcctcatatagaaagtttttacgattttccgtgatgttacctatttttagtttcttaacttcaacatcttcctctctgaattcctccattaatgaatactgtctattcctcaagtttaattgcctcttattatcatgaataagtttccttgttaataacatataggctgtggagggcatttcaaaaaattgaagttaaaaactgtcttgggcaataaaagccagtagctcttagaggtgaacacgctcaaagacaggacttatttcggtatataaatttttgtatacctatagaaacatctcattaatttattgtgtagctcataaacacattatttttatgtcattcccttttgtaatgagaaatgatgaaaaatagattttagatttctgttttgttcagcaatacttgttcagtactgaccccatacaagtcacagtgataggccttctagaagttgatgcaactttttacattattgcagcagataacaactttattatatatgcagagtgtgctaaagatgcctgtaaggaaacacatatgataaccatcactaggaaatgtacctattaaaatttttactccatcacctcttggccagattaaatttctcctcactagagatagtaaaaaacttagttgtatcgtgtgtatattttcattgttcaattctgaaaaaatctattttatatacggggaatgctttttattaagggggctcaatttcagatttcatcagcacagctctttcaacagtctgtgttagctgactttctgaaaaaacgtttccaataagagcctctcaaaatctagtagcttaatattttatttctaaaccttttattaaaattatattgtaaaaatctaacatctccccaaaaccgtgctcattaactctgggaatctctactgttctaagaaacaaacaaaaaaaaattataagaaatagtcctatgttactttgaagaatcagtagttgcatatcaaactgattttattttaaagctgttgtagcaatattagatataaaaacaatacaaattatgattatgaaacaatttgtagacttcccattttgtaccagacaatgtactcaaaaattcatacatattttctcaatattcagaacagccacagtgaagtagttactattatcctgattttacagattagagagattaagtaacttctctaatgtaagacagataatgaacaacagaactggggtttaaacttgaggaaaataagttttaagaaatcagaaattaagtctttggagataatttttcatgttataatggaaattataaatggaataaactgcaataaactatcatggaataaactgacaaaatattgcataccttactgtagatgtaatgggcaattgaataattatcacttagcttcctttgcttccatcagctgtataggattccttccaggtttgatataattcttaaaacattgcttcctgttattgtattttagaatatgttctttcactgtttgaaatactacatcattttaagtttttctctcttaaatcttgtcttccacccatgaagttatctccttaaccaaaatagaacatgattccttgattgagatgagaaaattttttatttcatttttgtttagattcatgggatatatgcgcaggtttgttacatggttatattgcgtgatgctgaggtttatggtacaattgatcccatcatccaggtagtgggcatactacccaatagctagtttttcaactctttctctatctccctgcttctctcctttagtaatctgaagtgtcttttgttgccatctttatgtccttgagtacccagtgtttagctcccacttataagtaagaaaatgcagtttttggttttctgttgctgtgttaattcacttaagataatggcctccagctggatctgtgtttctgcaaaactgaataatttgaaagacatgatttcattattttctatggctgcatagtattctatggtgtacatgtgccacattttcttttttaaaatttttattttaggttcaggggtacatgtgcaggtttgttgtagaagtaaattgtgtttcataggagtttggtttacagattattcctccacccaggtaataagcatagtaataggtaatttttgatcctcacccttctctctccttccacctcaagtagaccttagtgtcttttgctcccttctttgtgtccagatgtactcaatgtttagctcctacttgtaagaccatgctgtatttggttttctgttccagcattagttggcttaggataatggcctccagctccatccacattgctacaaaagacatagtaacatacttttttattgcagcttagtgttctatagcgtgtgtgtatcacattttctttacccagtctaccattcatgggaatttaggttgactccgtgtctttaatattgtgaatattgctatgatgaatatacacatgcatgtgtttttatggtagaatgatttagattccctggagtatatacccaataatgggatttctaggtcacatggtaattctgctttgagttctctgagaaattgtcaaacaagttttcacaatgctgaactaagttacattcccactagcaacatataagccatccctttttctgcaacctcgccagcatgttatttttttgacattttattaattgccattttgactgttgtcttattctgcttttgatttgcatttctctaatgactagtaatattgaacagtttaatatcctttttggccacatatatgtcttcttttgaaaagtgtctgtttatgacctttgcccaccttttaatggggttgttactgcttattactttttcagtttcttatagattattagaccttagtcagatgcatagtttgcaaatattttctcccattctctgtgttgtttactttgttgatagtttttttttttcctgtgtagaagcttaagtttaagtagatctcatttataaatttttgcttttgttgcaattgattttgggggtcttagtcatgaactctttctccattcttatgttcagcatggtatttcctaggttatcttccagggttttaataattttaggttttgcatttaaatctttgacccatcttgagttgcttcttgtatattttataagaaaggggtccagttttgaccttctgcatatggctagcaggttattccaacatcatttattgaatagggagactttccccgtcacttatttttgtctactgtgtcaaagagcagatggttgcaggtgcatggcattatttttggtctctctattttcttctattcatctatgtgtgtgtatttataacagtagcatgctgttttgaagttgggtcacgtgatgcctccaggtttgtcctctttacttaggattgccttggctattcaagctctttttaggttttataagaatttttaaatagtgtttttgaattctgagaagaatgtaattgaaagtttgatacagacagcagtgaatctgtagattgctttgggcagtttggcatttttaacaatcttgattattcctataagagtggaatatttttctatttgtcttttctgatttcttagagcagtgttttgtagttgcattttagagatctttcacctccctggttagctgtattcctaggtattttattccttttgtggtcatagtaaatggatttttgctcttgttttggctctcagattggatcttgttgatgtataggaatgttactgatttttgaacatttaatttgtatcctgaaactttgctaacattgtttgtcaaaggcttttggtggggtctttagggctttataggtatagaatcattttatcagtgaagatagctagttttgacaacttttcctgtcaggatgcgttttttatttttttctcttgcctgtttgctttggccaggatctccaatactatgtttaataggaatggtgaaaatggtcactctttcctcgttccagttctcaaggggcatgctttcaatgtttgcctattcagtatgatgttgactgtgggtttgtcagagatgacttattattttgaagtatgtttcttcaatgcctaatttcttgagagtttttaataggaagggatgttgaaatttatcaaaagccttttctgtatctattgagatcaaatggtttttgtttttagttccttttttgagatgaataatttattgatttgcatatgttgaacccaccttacttgactgtggtgggctaggtttttgatgtgctgctggatatggatatggtttgctagtattttgttgagaatttttgaatctatgattattgaggatattggcctgaagaggggtgtgtgtgtgtgtgtgtgtgtgtgtgtgtgtgtgtgtctgtctgtctgtctgtctgtctgcaaggttttggtattaagatgatgctggcctcatggaatgaggtaggagggagtccctacaactcaaccttttggagtagtttcattggaatggtagcagctcagcagctcctctttatacatctggcagaattaagctgtgaatctgcctggtcctgggcattctctggttggtaggcttttcttactgtttcaaatgcagaactctttattgttctgttcagggattcactgtcttcctgattcagtcttgggtggttgtatgtttccaggaacttatctgtttcttttaggttttgtagcttgtgtgcatgcaggtgttcatagtagtctctgagagttttttgtatttctgtgaagtcagtggtaacatcccctttgggatatctgatagtgtttatttggatcttccctcttttatttttttgcctgtattagtctactagcagtctatctatcttattaatttttttttttttcgacacagtctcactctgtcgcccaggctggagtgcagtggcgcaatctcggctcactgcaacctcttcctcccaggttcacgccattctcctgcctcagcctcccgagtagctggggctacaggcacctgccaccacgcccaactaatgttttgtatttttagtagagacggggtttcaccgtgttagccaggatggtctccatctcctgacctcgtgatccacctgcctcggcctcccaaagtgctgggattacaggcgtgagccactgtgcccggctctatcttcttaattttttaaaataatcagcttctgggtttattaatcttctgtatggtttttcacatctcagtgtccttcatttcagctctgattttatttcttgtcttccgctagatttgggggtgatttgctgttgtacttctagttcctctagttgataatttgagatcttgctaaatttttcagggatgtgtttcatttttataagcttccctcttaacactgctttgtatgtgtcccagagattattgtatgctatattttgtttttcattactttcaaaaaattccttgatttctgtcttaatttcatcatttgcccagaagtcgctcaggagcagctgcttaattttcatgtaatttgattgtttgcatgattctcttagtattgatttctatttttatttagctgtggtataagagtgtggttgatttcaatttataaaaaaataatttaggattgtttatgaattatttttggtccattttggagtgtgtggcatgtgcacatgagaagaatacataatctattgtttttgtatggagagttctgtagatgcctattagttccattaactcaagtgttgagttcagctcctgaatatctttgttagttttctgcctcgatgatctgtctaatacagtcagtggtgtgttgtagtcttccattattattatgtggttatctgcatctctccataggtctctaagagcttgcttttgaatctgggtgctcctgtgctgggtacatagatatttaggatagataggtctttttgttgaattgaaccatttactgtaaggtaatgtccttctttgtctttttttttttttttaatcttcgtaggcttacagccttttttgtctgaaattagaatagcaatcattgcttttttttctgttttccattttcttggtagattttcctccatccctttactgtgaaagtatgggtgtcactgcatgtgagatgggtcttttgagacagcatactatttggttttccttgtttatccaactttccattctgtgccttttattggggcattttgcctgtttacattcatgattagtattgatatgtgtggatttaatcctgtcatcgtgtttgttagctgggttattttgcaaacttgtttatgtggttgctttatagtgtcactggtctgtatacttaagtgtgcttttgttgtggctgtaatggtctttcctttccatatttagcactccttcaggatgttttgtaaggcagatcttttggtaacaaatttccttagcatttacttatctgtaaagaatcttatttttcctttgtttatgatgcttagtttggctggatatgaacttcttggttggaaattattttctttaaccatgctgaatataggctccctatgttttctggcttgtatggtttctgtggaaaggcccactgttagcctggtgggactccctttgtagatgacctatcctttcttgctagctccacttacctttttttctttcattgaactttggagaatctgatgactatgtgtctttgagatggctgtcctgtataatatcttgcaggggttctctgcatttcctgaatttgaatgttagcctctattgcaaggttaaggaaattttaatggaggatatcctcaaatatgtttttcaagttacttgctttctctgtctctttttaagggatgccagtgaatcatagatttgctttctatacataatcccatatttcatggaggtattgttcattcttcttcattcttttttctttatttttgtctgactacattctgttagagttggtttttgagctgagagattctgccctcagtttgatcagttctgctgttaacacttgtgattgtattatgatatatttgaagtgagtttttcagctctagcagatcagtttgattcttaaaatggcatttttgtcttttgtcttctgtatcattttattgtattccttagagtttttggattgggttttgactttctcctgaatctcagtgatctttattcctatccatattctgaattgtttttctgtcatttcagccatttcagcctgattaagaatcattttctggggaactagcatgatcatttggatataaggagaactctgccttagtgagttgccagatatgttgtgctggttgtttcttatctatgtgagctaatgttctttcaatcgctgaagctgttatcctttagatctttttttttttttgtatttatcttccttgtgttctttaaatcatagacattgttaccctttggatctttttttaaaaaaattatcttctttggtgtctttggggctttgagtgtggtattagatggattcactcaactgtcttcatttctggtagattttatggggtctcagactcggctcaggactcctgggctgcatgttgtaaccctgagagcagttatgaggtcactgacttagttatctgatccattgaggttaggaacttgcagttctaaggtatttttggaccaccgatcacaacactctgttgaatgtgccagccaaagtgcttcatcaggcagtttcagtgggatctgtcctcattcccacatgccagcagcaatgctagagggtggagtgcatgtgcattagctggggtggggcactggcaggtgtggggtgttggcttctatacagatgtttgtagcagtgatggtggcaatgcaatgtgggtggggggcagggccactggcatctgtgcactcaatcacactgctagcagtgttggcatggggacatggtacttgcaggtacagagctggcagtatttgtgtgcacgttcacttcagtagcaatggcagtgcagggttggggacaggtctgctggaatctctgggcacatttgcaccagcaatggtggcacagtcagggagtggcagggtgtgctccagccggcactcatagcgtggtggagtgcatacacacatgtacatccattggggaggggaggtgatgtccacctgtatgcatgtgtgctggcaaagtgataggggggtagccataggcaagtgtatgctggcaaagttgcacagggaaggatatggtggggggtaagtgcgagtgacctggtgcacttcacaaatggctgctctgctggagctgtccgatggtcaggtgcagtctgccagcatatgagctatgatacgggcccccagaaggcactctggctgggcatctgaggctgcactgtaagcaggcacagccagactgaaactccaggtgaggccagcagacagggggctgctctggtagaactggtcctatctcggggcaggatcaatctgctcttttcaggtccactagctctcctagggctcaagtctcctagggaaacccagcaaggcttggaggatggacatccctggctgagcttcactgcagacactcctgtgccaaatcctctgggtgctacactggctgggtttttttcccctactacatctctaagcagctctccctgacaactcaagtgtctctggaggtcgtgtggtcttctgctgccaggattccaggggtcagttgtgagggcaggctgctcctcacctgctcaattcactccatccctaggagtctttgggtgccaggaatgagtcccagggcaccctagcttcatgcaggattccccatgtcctccctcttctgcctgacatctgtgtcctgggcccttggtggcagatatccctcctggctacatctagtcagccatcttgacactgtatcacatttcttaatgcaatccaccatcgatgtgcagttaagttgattccacgcctttgctattctgtgtactactgtgatgaacataggagtgcaggcgtaatttttgtaaaatgatctattttcctttggatatgtatccagtaatgggactgataggtggaatggtagttctggtttaagttatttgagaaatctccaaactgtttttcacgttggctgagcaaatttacatacctgccaatagtgtataagtgttccctttacactgcagccttgccagcaaactttaagaagccaaaaaacgttaagaaatcacttttttgaatctgtaataactgccattctgacttgtgtgagatggtgtttcactgtggttttgattagcatttctatgatgatgaatgatgtgaagcattttttcaggcttcttggccacttgtatgtcttcttttgagaagtgtctgttcatgtcctttgcccactttgtaatgggcttatttgttttttgcttgttaatctgttttaagtacttaaaaattttagatattagatcttcatcaggtgcatttttttgtgagtattttctcccgttctgcaggttgtttactctgctggtttattttgctgtgaagaatcgctttagtttaattaggtcccacttgtcaatttttgtgtgtgttggaataggattttttaaagttaaaacgaatgacttttattataatttattattttgtcattaatttgtgaaattataaattgtaccacaataaaataaaatcatttaaaaatatagcctctgcctgtttatctttttttaaaaaatatttactgaatttttattttacgttcaaggatacctgtgcatgtttgttacataggaaaacttgtgtcatggaggtttgttgtacaaatgattttgtcactcatgtattaagcttagtacacattagttatttttcctgatcctttccctcctcctaccctaccccgtctgataggccctagtatatgtttttccctcaatgtgtccatgtgttctcatcatttggatcccacttacaagttagaagatgcggcatttggttttctgttcttgcattggtttgcttaggataagcaatccatgttcctgcccaatccatgttcctgcaaaagaaatgatctcattcttttctatggtagaattgcatttaaggacatagtgataaattgttcctcaagtctactgtccagaacagtgttttcttctaggattcttgtaatttggtgttttgcattaaaatttttatctatcttgaattaatttttataaatggtgaaagatcaagggtccaggtcattcttctgcgtacagttagacagctatcccagcatcattttttgaacaggaggtcctttttctactgcttgtttttgttgactttgttgaagattagatggctatgggtatttggtgttatttctgggctctctattctgttccattgatttgtgtgtctgtttttacatcagtaccatggagctgttttgagtactgtacctttatagtttgaagtcaggtattgtggtgcctccagttttgttctttttgcttgtgattgctttggctatttgagctcttctttggttctatatgaattttaaaataatttgttctagctctgtgaagaatgatgtttgtacgttcgtaggaatagcattgaatttgcagcttgctctgggcagtatggccattttaatgatactgatttttccgattaatgagcatggaatgtttttccatttgtttgtgtcatctatgatttctcttagcagcatttggtagttctctttgtagagatcttttatctccttggttagagatattcctaggtattttatttttcatgtagctactgtagatgagattatgttcttgttatggtcttagcttgactgttattagtatatagaaatgttactgatttttgtacattaattttgtacctgaatcttcactaaggtcatttatcagttcctgaagccttggggtttctatgtatagaatcatattattggcaaagagaggtaatgtcacttcacctttttctatttcagtgccttttatttcttccttctgcttgattactctggctagcacttccagtattatgttaaataggagtggtgagaatggcgcatccttattttatctcagttctcaaggggaatgcttctagtttttggctgttcagtatggtgttagctgtaggtttgtcataaatggcttttattatcttgatgtatgttcattcaatgccttgtttctgagagtttttatcatgaagcaaggccggattttatcaaatgctcttccttgtcttttgagatcatcatgtcgtttttgtttttaattctgttcatgtggtgaacatttactgatttgtgtaagctgaacccaccttgcatcctaggaatgaagtctacttgatcatgaagaattaactttttgataagctgtaggatttggtttgctagtgttttgttgaggatttttgcatatatgtttatcagggatattggcatgtaattttctttttttgttgtgtttttgtcaggctttggtaacttgggttgatgctgcctttgtagaatgagttagggagaagcccctcctcttgaattttttggaaaaaattgggtagaattggtaccagctcttctttgtatatcttgtggaatttggctgtgaatccatctgctctgggcttattttggttggtgggtttgctattactaattccatgtcagaaattgatattagtctgttgagggtttccatttctctctgattcaattttgagatattatgtgttttccaggaatttatgcattccctctaggttttctagttcttgttattctagttcctctatctggtatgttacattgtttctgtttttttctaactttttatgatagatatttagtgtaataaactttgtttttaacgctgctgtttttgcatcccagagattttggtatgttgtgtcagtgttttcatttatttcatagaagttttatatttctgctttaatttcattgtttacttaaaagtcattcaggagaaaattgtctaatacttggttttgagaggacttcttggtattgatttctatttttattctgttctctgagaatatggttgctataatttcatttagttaacttactgagacttgcattatgacccagcatgtagttgatgttgaagtatgtttcatgtgtagatgtgaagaatttatactctgcgattcatatgtggaatattctgtagatgtcaattaggtccatttgttcaactgttaggtctgggatttctttgttagttttgggccttgatgatctgtctgatgctgtcagtagagtgttaaattcctccactattatcatgtagctgcctaagtctatcagaggtctaaaagtacttcttttatgactaaaagtgctctaatgtttgatgaatagttgagtcttcttgttaaattgaactttttatcattatgtaatgcatttctttgtccctttttttactgctgttggtttaaagtatgtttttatgtaaaaataatgtttcttttttattttctaattgtttaaccgatcttccttaagtcttttacactgaacctgtgggtgttgtttcatgtgggatggttcttttgaagacagctggcagatgggttgtctttttttattttattcaaattgccactctgttccttttaagtacagcatttagaccttctgtcttcaagattaatattgatatgtgaagttttgatactgtcatgaagttgttaactgatagttttgaaggttttattgtgtggttgctttatagtttctgtgggttatgtacttaagtgtgcttctgcagtagcaagtatgttttgttttgtttttctcatttccgtgttattactaccgtaagagcctcttacaaggctggcctagtgctaatgaattcccttagggcttgctcgtctgcaaaagattttattatgtttcatgtatgaagttcagtttggtgagatatgaaattcttagttacaatttttattctttaagaatgctgaaaataggcctccagtctctcctggcttgtaatgtttctgctgagaagtctgcagttaatctgatgaggtcctctttgtatgtaatctaacatgtttctctagctgcctttaatttttttccttagcattgactttggacagtgtgattactatatagcttggagatgttcattttctgtagtatcttgcagttgttctctggatttcttgtatgtggatgtctacctttccaagactattagcaacattttcttgaattactctcttaaatatgttttccagataatttacattttctccttttctttcaggaatgcaaataattcataagtttggttgctttatgtgattccatatttcttgacaactttttttaactcttttttaaatttatgtttttgtctcactggcttatttgaaaagatcggtttaagctgtgaaattctttcttgtgcttggtgcagtctattgataaatatttcaattctattttgaaattccttaagtaagtttcaattcaagaagctctgatatttttttaaagatgtttatctcttccttctattcctgtattgctttagtagtttctctgtgttgattttcaaccttctctttggatatctttggactttcttgcaatccatgctttgaaattcttacctgtccttggcatgtgaatgcccccaaagcattcatattttttatggtgccagaattctggagctgattccttctcatctggagatactgggatttctaatatttgtaatttgtgcattagggttttctcttcgttttcccacaatattattgttttgtttttaattttccttttcttgttctccacccagggtgtatgactgtagagaatattgagtagaattttttgtctgttcttctatagacctatatttttctgtcaacacgttttaaattgggctgttcagtttgacctacaggcctgtagtttgtgctatgggtaagagacagttacagctaacatactgggtagctacttgatcctggtttattaggagattgtctctgctgcctcagggaatgagctgatttgtggagtacacagttttctgaactgcctgattaactctggagggtagggggaaagatgtgcttgtccaaaccaggaaggctcacctacatgtcccctaatggcaggcaagggactgccattaatagtgccgtttgcaagggagaaaccactgggtggccaccaagtgcccagaggtgtgcctcagcatggagctgtgaaaccttctcagttccatgttctatgtacaaggttggagtcgggggttggaaggaaacctaaactcctaatctaggaaagtgactgttcaagaggcctggaggtctgcctgtgcattgactgtagaggccttgctgtgccacagtctgcacagggatgacagggtgactcagcctgcttatccaggcagataggttctgtgaatgcctggagacctacctggacatgccatgcagaggggtcccctgcaccgggatctcttcacaaaagagatggggtgactcaggaagctgttccaggtgagtaggtactccaaatgcttggaaatatgcctgaatgtggagtggagagggctctaatgcaacaccatctatgcacaggaaaggtggcatggctcaggctgccaatcctggtgagccggtgttttgaacacctggagacctgcctaggcatggagtggagagggtcctgctgcaccacagtctgtgttcaggaagggtgtggaggctcaagctggtgatccaggtgaatggatattccaaatgtctgaagatctgcctgggcatagagcaaatagtgcccccctgcaccatgatctgtgtccagaaaggacggggtggttcaggctgttgacccaggtgagcagctgctgaaaatgcatggagatcttcctgagcatggagtagagagggccctgctgcaccacgatctcaagggagtcagttggaacacccagcaatgatacccagatgagttccagttcaccgagctggccctggctgcaggtcttgttaccctggagaaaccacagctgtagtagctcttctcccaccctaggcctgtgatgagggacagcataattccagtgccttttcataattctgactggaggtccttaccctactttagagcaggtgacccaagctctggcccaggactaaaatgcctgtgcagccacactgctgggtcactaaagaattactgactttgtatgtgcccagattaaaaatggcatcctgctcttggtcctgagtttgggaaaatgcccacagtttttgctggtgtcttttcctgacagtgtctactgttttggacaagggagaacactatgttgctcctagatcctctccgtaaattagctctctaagttagccccagggcataggagaaacaaagtgccctcccttttcctgggtttcttggattccattggaaaggtgaatcacagagggtggctgtatgtttctctcatgtgctggggtttcacttacttttatgagctacgtcccgttacagtgctctcttccctgagatctgagttgtccttcacttttctggtggatttctgttttccttcttgaattaaagctcacagaattgatctttacgaactcttgctctttccaagtggctgagacatcttaaaattctctaatctaccatcttgggtttttaaaaatgagatgaaaaactatgagtaaactcttagtggggtctttaaagtcttttttgtttgtttgttttataaaaatgtaatgacagcacatgtcagaaaatactcaagtacaaaatgcccaaatcttctactttttataccaaaaggctggtggttttcagtcaatatagttacagtatactgaataaaaataatttataaaattaaatatgaataataatgtgttttacaatatggtagatacatttatttggaaaaagttacttgataagttgattaaaggaaagtcatttaccaaatgtgtaccctagcttgcaaaatgtgtttcctagattactacttacagagaaaaccttaatgtcaactcagtcagttaacaaaaacataatgtgatatttaggaatagtgcaagttgtcttttaaaaaattagatttttaaaccattttactcttcaaaattactttctgaactctaactttatactgaacatgtcaatcccctcaattctattagttcacctaaagccatgagtctacaatacggtataatttttgagatagaaaaaaaaaaactcagtaaagtatgatattacatttaattttatttttataatcttataaataccttcaaatataattcttacatctttgcaaagtaaaattctttacataagccccttaatcgttagctaatatggcagaaactcttaatatggaaggaatagaatattttaaagatataataaaaataaatgtatatactaaatgtgtttgagtctatgtttatagatagaagtacatcttacagaatatggtaaaatgatttatgaattttactttttaaataactattttatatgtatatacatataaaatatatacacatatatattatacatatatatgagaaaaaccaccaacattacatttttataaaatattcagtgcttcatgatggaacatataacaggattagaaaaatagcaagttcaaaggctgaaaacaaaacatggcctcatctatttgagaaaccataggtaactgtttattgaggaattaaagtctgagagaaaacaggaaatggaatatataaatttcgacaaagagagtctttctcagaagaaaattgtgctttggtttaaaggtttgaaagaataagtgcagtattttggtcaggcctgtaacatgatcagaaacattactttcatggaattgtggagtatagactggaaggatctgggcaaaaattaggaaaacatagttaactagagcagtgctaatgggtatagagaagatagaacttggaacttctggaggttgggttaaatttaccaatgtctgtggaacatccgggtgtttcacctaggcaattacataaaaaagcccgaaggtcagaggagagatctgagctatttttacagaaaaccgaaacaatcaacctatgtctataaacctttgtttatatagagaaaaaaattagaaatattgtttgtcatcatgaaggcaaactaacttgttaattgaactattttcagctagttgttttggcagctgtagacacagccttgcaatcactactcattagggtattggaactatagctccccaccctccaggggaagtagtgtgctttcataaaccatggtgaccaaggaatgaacactttcaatatgatataattaaacattacgggaaagaatgaattagggttctttgtgacatttggctaaacatgctagcaagcaaaaatacacaaatgaaggtcacatttgcaattattatacaagtgtctacattttaattaggtagctgataaatgtcattgagccttagccactgaccaactgtcattttctaaaaggagaggaaaaatgtcacctaaaaagccagaattttttgcattgtcatgaaattaaaaattgtaaccacagtacagtgtgttcagcactaagctgttaaatgggcttagggacaatctcaaaatgtagtaaagaaatatttggacagcatgtgaggtgtcactagtaatacacattttcaagcattgtttctttaaagcattgtgtctttattgtaaaaccacatagagccacattagccttgaacgtctcttctcagagagtacaagtgaacttttttttctttgcctgcagatttgacttaaattcattccttattaatttggactaaatattcactgactttctccctccaatgacaaactaatcttcttaagctcacacagtattgtacctgacctaagaataaaataaattggtatctcatctcttagatattctttattttttggaattttacatagtatttacttgaaaattatttgtccttatcccctaaaaaaataaatgaagtgtgtcagctaatatgaatcccccactaaatttacttataaaagtgccatggaagaaagtaaatatataaatactatgtatgtgagtgagtgtgtgtgtgtattgtctttagagttattctgactgatatttctgaatccattttttttaacttttaataagaaaattcaaaagacaaaataggtcgtgtgcagtggctcatggctgtaatcctagcaccctgggaggctgaggtgggcagatcatgaggtcaggagttcaagaccagcttggccaacatggtgaaaccctgtctctgctaaaaatacgaaaattagtcaggtgtggtggcgcgcacctctaatcccagctacttgggaggctgaggcaggagaatcccttgaacctgggaggcagaggtggcagtgagccaagattgtgctactgcattccagcctgggcgacagagcaagactcttcccccaccccctgcaaaaaaaaaaaaaaatagatacattagatacataaatacataaataaatcaatcataaaatgatcaattagttcttgcaagataacaatgtaaaccttttcttcagagtatgctattatcaaattggaagcaaaacactacggtaaatgaaatccttaatcatcagtgtataaagtgcttttaagaatcaaggaaaacaaatcagaactcaataggataaaagaaaatatttgatatataatttaatgatgaaatatgtatacatggaaaaatatgtgtctaataaagtgcaaatctaatgaaatatgatttccactataatatttgtagaaagtaaaaaaaagataatagatcttagccatcatctaataaaatggtatgcaaaataacataaagaaaatattgctcttttatgatgctaacaggagtctaaatattaagtcaaaaattctagaaaacagttttagcagtagctattttcacttcagaaattctgcttctctgatattcctaggaaattacagtaatagtcacaaagatttatgtacaggggtattcctgtttggttatatatgacagataaattcatctatagggatagggttgaagaagttttaacaaaacacataattgaaatatataattaattaaatgcttctgaaggacatttgtaacagagttacataattataatttatatatatgtgtgtgtgttttaagatggagcctcactctgttgcccaggcaggagtgcagtgacctgatcttggttcactgcaaccaccacctcccagttgaagtaattctcctgtctcagcctcctaaatagctggtattacaggcatgcactaccatgcccagccacaatataatattaaataaaaattagaaaattacgtgtacaaactgattccagttttcttcaaacaaaacaaaaagtctgcctgtgtctctgttggcatatctctccataaatcaaatgaagataaatccaagtttgtttttgcagagtattctgtttctggatatcaagatcagagatgattttgttctgtagtgcgcatatatttgtttataatgagaatatttaaaactagaattcagaggactcttcaggtaccaccgttttggatctgaaccctgtaacttattccctaagggaaagaattaggcgtagggaccttctgtgaccctgaaggcaacaccaagagaaatacatgttagctgattctcataccgatttggaagggtactatactgctttgaattgaattcatttgtaaaacttttgacttgagaagtagtagaatttgtgatgcatacataacttagccaagaaacagcagttccacagctggaagttgctttctgacattaaggttttgttgaatattgtgcaaatactatggatgaggcaaatgtgtggacactgatgatgagagtgacatattaaatcaggctgcaatattttagcccacttgatgtctttgtttcaatttaagtaactggacttaaatgtgctgtcagttgaggctacaaaaatcacaaccacagcagatgagtgaatttaaatggacttttacaggtatttaatctgttaaatgaaaactcacctaacttagctaaaaatgtcattgggaaattttcttttgatatcttttctttgaagaaattgctgttagttgcacagtttcccatttactcctgcatgtgcctcagtaacctgtaattcctagggtcaaagctgtaggtctgcttttgaagaaaaattgccatagaaaaaaatcactcggggacttcaataactaactcaccttgcagggattcctaggcaactttttcacgtgctgggtagcaaaataaaaaccataaacatatttccaatatccatattcccatttgtgagaaatcgccaaagctcgattcaaatttcacctctactgccaagcactttttcttggtatcagctgcttcttactagatgctccaacatgagttagcttgaacagtaatcctattatgcacctattcctctctcccttttaagattgtgccttgtgacttgagcatcacagtgagcctgtgatcactggaaagacagtaacggacagctaaagattataagcatagggttttctttaatggtaaaatataaagaagtttatttgctcagagcagctacacaagcaggagccagtgtacccacacaagtaggaagacacaacttcctttgtccctaccatcttgtttacagacacacatctgcccaagatagtacccatgtggagtgaggactcccccaggcccgggaaaaatttttgtttactctatgggggagaatgatgtcagaccctcttaatgctatatgcttctattaagtgtaaaaataaattcacttatagccccaatttgaaaacaactaagccttttcgctaaaacaaattgtgagtatagttttatctgagtggctctgttgctaagttttgttgaaattccatgattataaagtgatctccttgaggtttattttttttctcttagtttataagaactccttgaaggcaaagattgtatgttttattatactttttaaaaatttccatagttaccttttaatgtgggatatataataatcatttcacgttaaataaattttaaatcctatattgcattatttgtgtctatgtccaaaaatgtcataattatttttggccatctaggattccattatataattagccatcttgaattccattcctaaatccagaattgaatgagtacacccaccttttacagattctatgttctacacggcaccataggaaacactgaacttgatactgaacataatgaaacacatgtttatttttaatataactgcatatgtaaaagcacaacttgcccacagaattgtttctaaaattgggaggaaatacattttgtgtaattattttctaattgctaagcaatgctagctttttttgatttgttataaaatactgtctgatctatcttaaacacacagagaataggaaagtaaaagctaatataatcattacagttaaaactttactgaaatctttaattatccaaaacaagagggaattctttaatcactaaattaatttggttatatttctcaactagctcctgcctttgctaatttcctcagtgattcatattcatattgtgagggaaatattaatttaatgcaaccatatattatgctcttggtgatttaaaaagatagcatcataacactataggtttttaaaaacttaacagccatgaaaaaatacaaaacaagaaaactgttagaatctcctttttggcaataaaagtctataatacccagtttaatttgtaacaatgttcatgctctatctgtgaatacaactaagaatttactatttagaaaagacaaagttatccaaatcttacataattatgactacaaatatttacagcatacctgagtatcagttgtagaaataatttcaaatcacgcttcttttcccttgtaaatatgtctattttttcagtcttatgcaaggaataccaggaatgcagtgccgttaactttttttcttgtatcttggaactatcaaagtttaaatgcctgactccagtgctttaaaaatcgtgtatttcatcctctgcatatgctttttgctcttgaagctacaacactgtaaactttacacataatacatttcttggagaaagtgctgagttgagacatagagtacatctgatttgggctatttcaaactctcatatgccatagatgcagacaaccaaattgaaatgatgcacattatttgtaaattattaaccatttctaaatattctccacacgactggctttgctgaggtgtttcatccatccttgcaagcttcataaaacagtagcaggccaaaattgcagagttaacattaattctcatcaaagagaggacagccttagcaattactttgaaaaaggtcaggtatcagatttctttatgctgactttgatgccaaatggagtcacactgcaggcttggatattgtatgtcttctgtttttttctgtatactctgtcatgaatacatagtgccactctttgctgtctgacatataagttgatgatggaatattctcaagaatattatgctctcaagagcatcacacatcatttggtactataatttatttatatttttacacaagagcctaaacagacatttaaaatcaaacttcaaaagtagggaatacatgatttatatgaatatctgtcatttcatgacttgtgggtgttgctcactcttctgtaccagtaaaacttaacagcattgtgtcgggagtcgatagaaaagattcagatacagagtccaatagtgataatacagttttatcaatcaatattttaggagcggtaaattttcttgtaaacatacctctcatatttagggacggaaatagaattctgaagttttattggtgtcagaaaattcaggaatattttgatgatagcaagtgattaaatactttaaaatatatttttatcatattgacattttattttatcttcttcataaatattgccataaagaattttagttctgcatattctaatccattattttgttaatattttatttataatatttatattttaatattataactattatatttataatattaatattttgttaatattatttacattggatggcaatgttatgatctctaaaatgaccttttatttaatggaaaagaatgctattagttccaaggactgaaagtggtggcaatgtcattctgacttaatggagtacagttttattaaataatgcaagttcagttgtcccagggtcattatattaggaaatatttaatgaaggtattaatatttactcctacccaacctccagctggaatttcatggtgtgagagcaccaggttaattgagttttatcacaaaatctctgggccactttagaaataactttaacacatgctccctaaggtctaacctacaaaaagtgagaaaatagaaaaagaaatgattaacatgtaactagatttagctgacatcttcagcatagttatttattaaaagactgagcaactgatgaaaatttttctctgaaaagaaaaaggtatgggtttgaggagagtgggtaagatgctaattatccgtcctgtatgatgggagaataaatggaccaggaaagtgaagtagtatttcttggaaactcaaaaggcctactggaagtcagttatcacacactgagttcttcctttcaaaccctgaacaggaatatggagaaaagatgggtacatgttgctctagccaatagaatcacaagaatatatacttgtggagttttctgtagatatatagagtctattcatatccaaaacttttcttttagaatttgtttttgggaatacacctgttaggaaaataaaaaatgtaatcatttcctttctgctcttcactttttcagttcctcagggtaaaatgaatatgacaattcggtattcatattctcattttgtgacccagtcaaagctggaaagggtaaactcagtattcagttatacccacaagagtggtacaggataataactaaactctagataataataacaaaaaataatatagaaaatgtattgagttcttactatcaggcaagcatagtttcaactgttttctgtatattactttatttgatctttacaacaatctatgagggaattcctgttgttatcctcaatctaaagtcaaggaagctaaatcacagagctattcctctcttgctcaaaggcacagagatattacgatgtggaatctagatttgaattcatgccatctgactttggaacctctattgcaaacagatttactgacagagctaatctcacccaaaaatttcattcagtaaaatgcgtggccaagatggaggaggaggatatatgcatcgtagccaagcgtggagcttttattcccaggaactgagcgatgatggcggtactgtaagaatacaagatgttggcaagttttcattcaaaggcactctgctttttttttctcctttatgtttattacatgtattatagttcttggttttataaatttttagaataattttgtttgtttaatgttcctctactaatattttaccaactggtaaaatcttaccaatttaccaattggtaaaatcctccaccaatactcccagattgtaaattccacaagtcaggtatcatttgtggtttattcatggccatatcacctgttcctaacccatcgtaggcattcattaaaaagttattgaaaaaatatcagtgaaggttgaatgagaaaacttggaaaaaagaatgttagaggttgctgaaagaatgcgagggattatgtgtacaaggagtctggtccagaccccatcagagcatcactcaatatttctatttcactgagcctctgaattctgagcctaaaatttagatcaaacctactctgctatttctttaagtgacagctcttggggtgatgaataaaaacagtttctgaatcctgagtatgatttaccaaatggtctatcttagaagacacctttccatgacagaagtgtggaaattgttaggatctgaagcaaaaccacaaaaagagagtagagaggtttttgttttgttttgttttgttttactaaaagtaggagtttaaaagagcataggaaaatattggaatatcaaagacagaagtgagttcaagtaactgagactaaagatgaaattcctctgggagggagttgatcatttaaagggtactttagatagagaaaaatgtttcctagggtgtgccaacattgaggagacaaagaactagaaaaggagataaaaagtttccagtgaaatagggataaagacataaggttgtggtatcttggaattacataaagacaatattcaaaggaaaaagaaataactgtgtcatacactcctaataggtttaatgtagcaaaaaatggtccttaaacttagcaatatcttggtaatttttatctttaaagagagacattgtggaatgatataagcaagagatcttataaaagttcaagggaagaaggggggataataattgaatacttttaccatatacagcacttctaaggagtcttgttgtaataaaaattaggtgagagaaatgataaggtcatgataattttatttaaaagagaactttttatatagttatgagaacattctaacaagcatacaaaaaattgatgctgaaagagagacagaaggaatcatctggagagatgtccttgaacagtgaagatggaatggaattcaacatacacaaatacagggattggcctttaagagatgtacagacatcattcatgtgactcagctcatattaatgaaacaaggctgagtgtatgcgtgtacaggcagatggtgggagcatgtgagggactgtctcttctgattgcctctattttcttaataaaatagaaagcagcaccatcaagaaggtcagaaaggtatgggtttgaggagagaggctaagatgttaattatccatcctgtattatgggagagtaaatggaccaggaaaatgaagtagtgtttcttggaatctcacaaagcccactggaagtcagttatcacacattgagttctttcagcatgatactgtattctttggctacagagtgtgtcgacagttggacttaaattagcaggggagagagttagcctgggaaaaaaacagtccagggtgaagagcagtgtgcctgaaggtgcattgaaggaattgagtaaggttacgaattatgaactttaacctggaaatggagggagttgaggaaatgagagcagggtgaaagagagtgaaagagtgttaggatcagtagattgtaggtcttgaagtagttgagatgccaaacagaaagagatgaaattatgtattagtctgtctccaccctgctatagagaacgtctccaaactgagtgattataagggagagatttaattgactcacagctccatgtggctagcgtggcctcaggaaacttacaatcatgatggaaggcaaaggggaggcaggcaccttcttcacaaggtggcagtagagagaattgactgaaggtggatcttgacaaacacttataaaaccatcagctctcatgagaactcactatcacaagaacagcacgggggaaactgcccccctgactcatttacctccgtttggtttctgccttcacacctggggattatgaggattacggagattataattcaagatgggatttgggtggggacacaaagtctaaccatattaaataatataagatgtacagaaaaacacacttaaatgtagcaaggggatgcagctatattccaccctcaacagatttctgcatttgttaatttaatttagtctcacaaagttgagcgttagataaagtcctatcaatgaaacaacatttcccacttatttatgctaatatattttcagagatgagaatcctcagaactaagactgaggagtggggaaactctgaggatatgtcatagaaaagggctgggcagctaagagggcaccaagttggagagttaaaaatatccctgagagaggaggagaccccacaatactgtaaatcagttgcactaagaccatacgactgatgaaagccactttctaaggactgggcttatttgtcaaatagaatggaaatggtaatgcagggggttccagaccatgtccagatcttgaaaaggcctcttcatcccttatgtctgaactcacttttactgaaatctgtgtgcagtgccctgtgtggagcaggcaggaagctatgatactgctgtgtgcacaccctctgcaggaccatcttctccacacctaatccacttgaattgatttaacaaaagtgggtctctgttgaggatgaaacataactgaatccactttctctgttgaaattcaagtattggcatttctgtctatttcatcttattattccatctctttttgtctaggatcccaactccttcaatacttaaaatagactgattttaacaccctttcagtttctgcaccttgcatctatttcttcaattccctccctcaccgggttagagtccgtggtccataacattattcacttccttcagtgagccttcaactacactgcccttcaccatcaattattttaacagactaacctctctaacccccaatttaaattcaactattaatagactatagctagagaacactgatcttcaaaactattgaatgcttccttgtctgtattgaaagactttcgcttcctttcactttgtgacattccactttcctacttttttccttccctttccagattcgagtagctctgcttttcttcaaaaaaaatgctaatgttggtcaaaattccattttcaacaccctatttcttatttcacatacttccttggcaagcttgtctattctcagtttcaataaccatctatttggttaccatttcataatctctctgacgaacctgcgtcttccttacgtctgcagaatcttaacatcaacatgaatgtcctggaggcaccataggctctccatgtgtctaaaactgaattcatgagcctttacctcaagctcttgccttttccttcattcttacctatcttctagtggaggcaaccttgcctgatttttcacttttctttagtgcctccaatcaaataaaccaataatcttatttactattcccatacgtattatctccccatttctgaccaatctttgcctatattacagctttagacccttgagtcatctttatttggtcttgttcaaatatggcactacagccagagtgatctagaacttacgttgctctcctttcaaagctgtaccagtttaacatgacatgctagacgtttcatcatcggcaccttgtttacttattcagccttacatgtcctcccacctctctccctcataataccctgcgctcctattttaatccaccaagcaggccatggtgcctttactttcaaggtttttatatattttcttccctgtctagagtatctttctttccctactgaagacttgactgagctaatcactaatgaactttcaggactcagtttagatagaatatccactggaaagcattttctgatgacttaaagctgaatgagagttttctctacccatgcggggagcccataggtccttgaatttacttttatatcacatgatactaacattgtatgaatactgccttttttccccactagatcgtagctccttgagggctagggcaggattattcacttttgtttccctagcatttggcacctactaagttgttatcacatgtttgttgaatgaatgcttgaatgaatgaatgaatcaattgccacatttctagtaacagctttgcgttcacattaattgatgaaaagggaatctttactgcaacagataaaactgattacataacaaaggaagacctggcgtagtgcgcttagccaaattagcatttggctcatctctgtatggagtggcacaagcccatttgtgtaccacttagtatttggttaaaatatgtataagatttatagccacaatgatgttcctggcctttttaaaccttactatggcctttctacttttcaagtttttcattgattattcttatctggctttaagaactataaaccacattatcatacttcactgtaattgttaatactagtctgggatagttttttttttttttttttttttttcctttataaatgagcagggcagagagttaaaacacaaagcaatagattgcactgagaaatgaatacgttcagaaactacaactacaaactaccttaaaggaaaactcattcacttttcattaccttacacctctaggtgccaaaacttgcatttaattccatgttttaaaggagactttatgtctacccataatctgttcacatatagtttgcccaagggaggttaactcttttcagttaaaattgatccaccttcatcagacttgtggttgaccagcaaagagtcaaggacatgaatctcttaacacctcctgatggtcttgggctacacatatcatgctcattttaagtgtggaaaacatctaaaaatatactttttagagtttcagagaaatcatatttacagcttcacagaacagaaaatattaaacttaatttgatgcttaacacctaaagtgttattttcaaatcatagaaaaatgctttttgcattctaaaatatctctgtaagacagcataattattctaaataattttaattaattatgagaaagcttacttacagtgatactttttttaatcaaaaatttagttagcaatgattattaagtttaaaggccagatactctgaacaaaactaccttttttttttttgagacagggtcttgccctgttgccagtctggagtacagtggcatgatcgcagctcactacagcctaaacctcccaggctcaagcaatcctcccagctcagcttccccagtaactggagctacaggcatgtgccaccacatgtggctaactttttgtactttttgtgtagatggggtctcactttattgcttttgctggttttaaacacctagctgaagtcattctcccacctcggcttccctgagtgctgggattaaaggcatgagccgacgtgcctggccacaaactgccagagtcttagaagtatttccaagatcagcaaattgtccagcttaattgatactgtacatataaaaaatttccaattccttatttctctttagagttcatcataattagtttgtatttttaaaaatttgatccatatactaaacttattgtttcttatggacataaaggaaagttagttcaatccattttaggcaggatgctcaacctttctaaccaaacaccttaggaattaaaatatgaaatttatcaataatcaataaaaatgaaaatttcatcattgtttccccacttaatagtattaatctgtacacattagataataaaacctagaaaataaatttcattcatttttttatgtaccagagtgaatttgactacttttcaagaacatgaggtattacttagagcctagttaaaacacatgtgctacattgaacacacctcatactacataataaattttagtaaatgaagttcctatctatgtttgtagaatataagtgaaatgttggtttcctcactgcattttaataataaggaaagaactgatctatgtgaatgggtattgtaatattaaggtaaacttttaaaagttaatttacaaattttcctgacaaagtataaagcttgggcttttgactgtcttcccttctttcctacttacctctctctctctacttgctttcttccttcccttctgccatcatttttccttttccctctcctctcctccccttccctcccctctcctcccctcccctcccctcccctcctttccttaatattatagctagtagaattttcagaaaatattaaaaaatataaaagtaacattttttcacactctcactgtaatctgaatttgcttgcagctccaaagaaggtttttagtaatgtcttcaaagaaacaatcttcataagaaaaaaataaactagtttcctcaaaattcagattttattatattttttctcttacagagtattcaaaatctcttcctggtctctccacttcatatgctgctttgttaagaattaagaagagttcatcttcatctctctttggttccaaaaccagaccacgatacagcagcccttcattaggaacactgagtgcttcttcacccagctggctaggggcagctcagaattattattcccccatcaatctttatcattcctcagatgccttcaaacaagatggtaagtgtcaaaggaaaatggctccagatagaataaaggaggcaaagaagacttatttaatactgttgcaacagagatcaagactattccagtaggagagagtgattgaactcaactctgctaaaaatgaaagcaggagagtttttaaagctggggtgagctagtagaaaactggaggatgttaggggagatactggtaaatgtgactaggccatctgtgtttattgattggtgcttgttgaagttaggctactaccttttcatagagactgggagatagagaacctgtttcttgatggtttcatttcaaatggagagctcccaggccttgagacagacactactgggttataaaaatgacaagagcctgtgttggttgtaagttagtcttcttttctaaacatctttaaaggatttgtatgcattattatgtaattgcactctataccaattataatttaggattaagactaaatactctcgtagaatgaaagtaaaaatagacatttttggaaggccaatttgacagtgaatatcggaaacataaaacagacctatccttcaatccagtggttttatttctggaagtgtattctgtgtaagaaaataataaagagagcacgcaaagataagtatatacttagcattacttatgaatggaaaataagaaaaaatctatatatccaacactaagatatcagttaaattaaagactgctctacagctattggctttatagtttgaataacattttctagatgttgtctacctttgtcatttttggatccatcgacaaaataatgcctggttcattaacagcaggatgaacggcacctgttattactagtctctatccagtctattttatatagatatgccattcagttttctcaacacatatgtgaagtagatattgttactgccttctatagaaatgaaaactctgggacagataagtatttttcacaaggtcacactgctaataggtatcatagctaattttcattcacatcaacaatgattttaagactagtacacttaggctgcatttcatttatgactgatgaaagaataaacattcaaagatacatctcgaaggaactaagatattggaaagattctgggaatgtcaattattaggttgtggtgccaggtgcaggcaaacttatcctttgtgattataccaattgttgccatgtgcagcattgtctcgtagtgttggcatctaagttgtatgtaagcatgatgttagaactccagaaatgttttattttccaaagtacttacatttaatataagtttttaactttctattaccttaagcctaatatgaaacatattttctttaggcattattatcttgtggagtggcattaaggtagaaaatcaagtgatcagaactgtgatctacttgtatagtcggtataattttcagccaactagtgttctgcctctttgttctcttgtatcaaatggaagttaaggtagtcacaatggtcaatataagtatgaattcaaatccatgaaaatgatgagaacaataaatattgggacataagatggagccagctgtgacaacaattcaaggtgtctactattaatgcttgtacacctactgtgagctgatcctattttgggtaattagcagacagaaaagaaagaaaatctggtcagttacatatttcacagtatttcaaatattaaaatagaattgttattcagtaaaagcacaactctctgacactttgattagacaattttttttttctggaagatcatcattaggagtttattattcgatataatggcaagtgacctgaacattacttttactgtacccataataatgagtttcatctgtttcaataaaggcagatgaaacccaaacagaaacaacaaaatgagaagtagtaattctctaaaactgtgctcctcaatctttacagataaaaccctcattaaaataagaccccccttcaaagattgaggtagggcaagagaataccacttacaaaaagctcccaggtgatggtgatggtgctgatctgtggatgatacttactgagtggcaaggctctaggctggtaaccaatttaatatcatttggtcctctgctaatctagtttaatccatattttagagtataaggaagaatggataatctgagtattttccaagtaatcttccataactactgttttctcttctgagcattttataaatcttagctagatgtgactttgagttctttttctctgacaagagtctgacgtatggcttttgtcaggtaattccctttagccttaatagagagtaaagctgaggttgacatgctcttacgaaaaatgagaaaagtaacagagcctgaatagaaagtcatcccactcctgttcagagttaagccaagaagtaccccagacagagcaaagatttttatgaaaaatataaagactcagcttacagagcaatttggggaagcaattctacttccggatatacaacttggagaaaccttcccatacaagtacgaggaaataaaacgcatcttcaccacaatatgtttaagagtaaaggttggaaacagatgtccatcagaaggggaatggatacgttgtattatttttatttaatggagaactaaaactgttaaagtgaatagaaagaaaatggatagacctcaaaatagagagtgaacatggtaagttatggagtattatatataatatgatatcacttatgtaaaacaatggaaaaatatatcctatttatggatacacataagtggtataattttaaaacatgaacttgagatagcaggttgactgcagtgcttaccactgcggacaaagggagaatgagagcaggaaataagtaccaggagagggtatatacattatctcaacttactgatactttatttcttgaaagaaaaaatctgaaataaatataactcctgtagtgactagacactaaaatgtctcacagtaattctcacttggcatttacaatgtaatctctcactttatctgttggctatggctattaacttgcctctggagaatagattataaataaagtaatgggatatgactcccaacaatgggttacaaaagccactggcttccatcttgtttgtcttttttgctttctggcttgctcatattaatggaagtcagctcgtgctgagagctgtcctattgacaggcccactgggagtggcctctggccaacagcccaagagtaagtgaaggactcagttcaacacccctaaggaatttgaatcctatgagtagtcacgtgagtgagtttacacgtgtatccgtacctattcgaacattgggatgagacagcctcccaccttttgaaagacacagagcaagggttgagccacacctgcttccctgacccacgaaggctgtgaggtaataaacacataatctttgttcattttctgggtttcctttctactattttaactgtaattctatatttctgcagaaaatcattctcatagtttcatagctttaaagtttcctttatatgtttcatctattttaagttgctgtgtcatcttgtgattatctcaacaggttggtattcttttctaggaagccagttcctacattcagcccagatttgtttattcaggtcttgattatgcattcttctttgttctcctttatattttctacaaggcctactttttagtcctgtttgttatataaacagatgctacagagaaaatctgaaaaaaaaaggcaaatgctgcaattagaagagatataattccaattgtcctactattttaagtgctcatagtttatattaaatgtattattctttattcattacattagaaattgtcaaatattgaaaacataaaggaaataataatttcatgaaagtgtcttgtgactatatattaagtttattaaactttaatatttttccaaatttgtttcagtattttttgacataaaattaaatttgagagttcttgagtattttgcttggattgtgtctcacactttctccactcttagaggaattactatacttattttgtcatttacatgcatatatttatatttctatatgtgtgaagcctataaagtacatgtactgttctttaaaatttttgtgtcaatgatactgtgtatatcagtcatgatccaccttttctggatcaacattatatcctagagattcatgtatcttggtatcttcagttctaagttcatttcatttcctgtaaagcataccacactaggactcaattacagtttctttattcattccctttttgtaaatatttaggttgttttaattttacattgttacatgtcaaatggattttttcatgcctcattggtaattgtattataagtattttaggagtgcaatttttatataaaagcattgtaacatttccagatactgtcaaattgctttccaaagtgattgacacttctaccaacattattgtataggtgttcgtatttctccacattgtcaccaacataaaatttttttggcaatctcttgagtatagtataccattttattgtggtttagtttgcattttcttgactagtgaggttgaaatttcatgtaaatattggacattctggttttttctaatgcatatttcttattcatatatgttgactgttatttctgttagaatattttacttacatttaactgtaggaaatttacaaatcagttggtcactggttaaatgcattgcggatatattttctcagaatgtaacttaactttttactttgtcagtagtaccttttgttaaacagaattttttgattttgtgtaatgagatatagcaatattttcctttgtagtctgtgcttttcatgtcctaaaaaaaaccctttttaccttaaatttttatttccttccaaatttaaattttgattttcatatttaggtgtttaaaccacatgaaattatttttgtatgtaatatgaagtaattacctgattttatttgttttccatttttggagtggtatgtattaaccaatgtcagtgatctccactgatttgtgaaaccactcacttatatatgttaaaaatatactttaaatccttcagtaacatggtttaattttttggaaaacatttttcacatctttaagcttattcctagatctcatacagtttttgtctcctcgaaaataataatatagtaagaatagcatagtgtttgttaagttggtatatagagccctatcaatctgttactgttgtctgttatttctgttagttcttgctcatatggcgttgtctaatagtatgtgttagatactatatttggaaaaattgcttgtaaaaatagtttgtaaaaattgcttgtgtgcttaggaggaaaacagaaaaggtttggttaaaagtagccagtatctgccagactctttaatttctttaggatgttttcgcttttcccttgctttacattagatagactgttttctatatgtaattcctctctcttgtattttttttgcatcatatgcctatttcttttgtgattaccattaacttagtctatagtgattatcactaatgaaattaagaaatttctcaagtataacattatttgataattttgttgtttcaaacatatgcgtcctttagtgttttctcttttactaattttaccttattcacaaaaatatgtttaaaaatcaatacttaattatattttctgtaacatcactatctatagtcataatttcttataatttttctctgtgttcactttttggatgaagcatattttgtggtaaaaaggatatcactgtgacaaactatcttagtctttatctgtctgaaaatatattttgccattactcttgagtgatagatggttttggaaagtgtaaaatttctaggttgatagttatgttccctttgtactttaagtatctgctggcctcttttgtagcgggcaagtttatcaatctagttgttatttcctttgttaatagacttccctgtggaagttatttttttctaatgcttgccattttgtacctttactatgtactttctaaaagtaaatttatttttgcttattcacccagcacttaagagacaattcaaaagaaaatataatatagaaatgttataatttcagagaaaatacaacatctttcttttcaaatgtgcaaaatccagctctttttctgattcgtctgttcttcatttctacacttttttgtgttatatatgcttacttagtttaaggaagtccattcctgaatttgtactttggagtatcgtaagcatatttattttaaagtcctgatagatataagtgtattttatctgggataagttcttattcctattattgactttggcttttttttgcaatatagaattttttatctatgttgtaatttttggttttctttgcaagtacatgtggaaaggaagtatttttattatgtcttataatgtctttaaaatgtcttataatgacattttgaggcattacagttctgttggggctattgagattcagtcactttccctgggaatagcttaactaagttcacagtcaagaagctatatctgccttctttcatctttgcaagtccacacctttcaatgtactgtagcctcacatgctcacagaaacagacacacatacgtacacacaaaaggcatccaacctgttgttataggtatcatgacagaggtacagtattatttggtaacatagaatagaggcatcaaatttaacctgtgttgtatgatcgggtgaagcaaaattgaggaagtgatactggatctaaaatatattgcatgtgtagaagtacattatagataaaagaaatcatgtgttcaatggcaaaggggtaagagagaacactcctatgtttaaggaaactgcacgttatatattatagttgtagcaaagtatgaatggctgcaatgaaattataaataggcttcttattaaggagtctaaaaattttatctgtgttaacagcaagcctccattaatcagtggaatctttttagcagcagttgcctgtgagacctctgagcatgcagatttaaaataataataaagtctctctcatgggaggaaggaagtaagggggggatcagaaagatgctttcacatttataaaggaaaaaactgataattatttcaaggaaagcagtagtagcagagataaagagaaaataatagttcatcaccctgtattctactagagtctctccacatagatatatttggtcagagcagctgtgttcattggttttttgctttttgttttgttttgtttttgtttgttttaatgcgagacagggcttcactctgtggcccaggctggagtgcaatggcctgatcttggctcactgcaatctctgcctccagggttcaagcgattctctaacgtcagcctctctggtagctggaactacaggcacacactaccacactcagctaatttttgtgttttttggtagagatagggtttcaccatgttgtccaggctggtctcgagctcctgagctcaggcgatccacgcaccttgacctcccaaagtgctgggattacaagcatgagccactgtgcccagcccattcattggttctttttaagttttattatgtctaattgtcttctgtgtgtcctgaaatgttttcagcattataacagcaatagcctgaatccattatagaattccaaccatgtgggactaaattaaaaggtaaaatttaaaacaagactagactaaattgttagagtaaattccagaagaaacatgagcagcatatagtgataacacatatttttgttaggtctgttttggcccagaaacattttcatagagacaaagtgtatatctgtaataacttacacatagctttgtttccaatattttaacaaatatttttagaggcttattaacagattggctctaaaaagtagcttgaatggctcctttatacaattactttacctctctatagtataatgttaacagtaatcagaatgctttctgaatgtttgtgacgcaaatttttacgcagctctctcgactatttttctttgatcggtcaataacatatgtagaataggattactactgtgaacataaaacactatctgtacaagtttattaaacagagatgtactttttacattttttctgtaggagatattggccatctactgtgtgcaagctgtacattaactcatcacaagagagttattgttttaatctctaaagttttgaaagtatttgataagtatgattgtatagcacattcatatgtattatactttctatttgaaatagaataaaataataatagttatatagatcttcagagatatgtacaatgattttggtcaagtactaaatcagtaatgtgaatagctcattataagagtaatttgtgaaaaaaaactttatgagcctttatataatggctactgcttctttgtaaactaatgatagcattctgtcttagtccattttgtgattctgttacagtatgccacaggctgggtaatttaaaatgaacagaaatgtgttggctcacaattctggaggcagagaagtctgatacaaagtgctagaatctggtggggacattcgtgctgtgtcatcatatggtgaagatggaagggcagagacagtgagagcaagaatggataatgcaattgcaacaataatggcctaaccacctcttaaagtcccacctcttaatgctgttacaatatcaattaacttttaatataaattttaaagggaagcaccttgaaatcatagccgataccctatgctattttattaaatagaaagttaattatcaatgaatatgaaatagtttttgtttacacatgcataatcatggaagcttttatccaaatttaagtaagatacatggaaaactgaaagaacctttcatatattattttactacactcaagagaatttacattattaaaatcatgtatctttatcttcagtggtcatgttgatgatgtattttagtcacagatattaaatttgattatagtagttgtcttaaacaatgacaaatcccatctaaatgtgagcttttgtataaaatattcccatattcatggaatgtatctgtacttgctatattctatttccagcgagaattagaaaacatcatgtctgatttcactttattatttatcatagtagttagatcattttagcaacaaaagctattccatttagagcaaatttagtgattatgttgtgatgtttaaaaagtgtgatttacaaaaaaaataaggaagcttttggttatattttaattagctctgttcttttgaagatattccctggtgatatacttaaagaagcatcaaaatttttagtgatctgaaatgatgaaaatacatattctaatctacttaaaaatatttggatagaggttaatctcataatttgctatacatatgtccacatttaggaagtacagaaaaaggctgcattcagaattactgtgttgcatgacgatgaaaacatggttgtgaatattgtggactggtccatactaggcagagaattcacatcacatgttatactttggtcatccccaggctttatgtttgaaaataatcaagaaaggcacagtagtcagtcactgatacttgattgaggtgaagagatacacatagtcaatgaataaaaacttctgagctagtctcataaaataaagaagagaaatggagcagtacctggaaaggtgagtgctgctcattggcgttgagcaaccagaaaagtcctcagtatctactctgttttcaacccgatactgttattttggataatagctttgatctcttgaaattgtgtcaatgcaaatgtttcatagacctaagaggtataatgtggtttaaaaaggaacaactgagttgttaataattactctaaagtagttatttgagtacaaagagtgacatttaagtgatttaaaaaattgaccaaggtttaaagtaaaaatatgcaaggtaacataggttaattgaaagctcttatgagttaacacctcagacacatgcaggatatatgctttcgggggacataggcaaggattattaaccagagctgacactatacctgttcctccctctataaatataaactgatccttgatttcatctgtttttattgttgttatgattttagtaggagtaaacttaattaagtgtagggtgcatttcattcttctatttgtgatgagatggttaggttaagatattttatttttgcagagaggcagtctggattaggagtgattcaaattagataggtcaaacttttttcgggggcggggagcatgttcttctgtttgtcctgattcagagactacagtgctgtttttgatggcggaaatggtggtccttagaggaagcaaattatttttctactaaggctaagcacataattttgctctctttaattccctcaatggtaaacacaatctgcactttataaaccctctgtgtctacgcaagcttttaaaatttttagcactgtcttctgacaattggatgattcctgcatttacaaatttgtggccttatgtcttcagtacttttggctaaattttatcatgaacatgatttattaacagatttgacttggcacatgggcaatggcatcctgactcaaagcaacccctttggtgacaattttctgttgtttcctcaaaatactctttgctgataaattgtttgagagacacaagcacaaaatgtgatcttttatgaaaataagaattctctcttggagggggaaattgtattttatttggatgacacacttctaaataaaatacatcatgtcagtttccccaatttaaaaattgagaccatattctaataataactttacagtcttatgaccattcatcaaaactttatgactttattctgctattgtagtcttaattttaaagccatttattattttatacttaaatgcttttttaccaatttaagtatatgtggtgtgagcaaataccatttcatagtctcctctttattctctttcagcacttacagcagtgcaaggttactgggagcttaacaaatattaaataagcaggaacctatttgaggactgcttcatttttcttgaaatctataggctgaatttctataccatgatagtatatttactaaatatttttgaacacaatagtggattttggattataaatggaaaggagaaagaataatgtccaccttcaacaagatgacctattggtttggcatcctgtgaatcttaggttggtgtaaatggaattgaggtttcggaccatgaattttaaatcatgataactaggttccaatacatctttattaatcaaaataggaacccacacatttttgctaatgaaaaataaatttgtttattcctctaacataataatccatgcttcaggattcagcaaactcttggaaagcattttctgcatcctcctggttgtggaagtgtttttcctgcaaaaagttgttgagatgcttaacgaagtggtagttggttggcaaaaggtcagatgaatatagagaatgaggcaaaatttcatagctcaattcgttcaactttcgaagtattgcttgtgtgacatgcagtcaggcattgtggtggagaagaatttggccctttctgttgaccagtgccggctgttggcgttgcagtttttggtgcagctcatccatttgctgagcatacttttcagatgtaatggtatcaccaagattcagaaagctatagcggatccaactggcagcagactgccagtgaccataacttttttttttggtgcaaatttggcttaaggaagtgctttgcagcttctctgttcaaccactaagctggtcatcatcagttgtcttataaaatccacttctcattgcatgtcacaatgtgatcgagaagtggttgattgttgttgcatagaataagagaatatgatacttcaaaatgttattttttttaattttgagtcagctcatgaggcacctacctactaaggtttttcacctttccaatttgcttcaaatgctaaatgactagaatggtggacattgagttcttcagcaacttctcgtgtagtcagaagaggatcagctttcatgattgctctcatttggttgttgtcaacttccaatggccaaccactgagttccttatcttcaagttccttgtctcctttgcaaaacttcttgaaccaccactgtgctgtacattcattagcagttactgcacaaaatgtgttgctgatgttatgagttgtctccgctgctttatgacccattttggactcgagtaagaaaactgcttgaatttgctttttgtctaacatcatttccatagtctaaaaaaaaatcaagtaataagtcattagcaaaaaagcaagaaatgcccattaaaatgatatataacataaccacatttaacaatgcattccaatatccaatggcaaatcccaacgaggcaaaaactgtaattacattggcatcaacctaacacatggagttggtgcactttgattgttatcataagtgataatattactgcatcctctgacctctcttttatatctgtacgaaagtgacaaaaaacctattagactttaacttatgttgtgtgtacaacgaaatgctacactacccatgaaacattcatcaatatgcttgttaataaatcgttctcttcaattcttagaaatccttgaaggttttatagtttatacttgtttaagtttcataaacttcatttcaatgttgaaaggcaacttaaagttaaaagaagatttggacaatttttttaagaattcatctaagatacttggtgcaaaaatttttctcaccttgtaactatgtcatcataaaatataatttctagttaacacttcaaaatttcttgaaattgtcacataaagtatactaatgatcattaaaatggcatttcttaaaattttattgggcatgataggctgctatttcctttatattatattactgagacacttagtttacattacatgaataagctagtcacagacataaattacagctaaccagcaggcagaacagttgcagcctggcattagatgtaatccctgagaaaaataagcacagaagttgatgtagatgtaatccctgagaaaaataagcacagaagttgatgttaaaaagaggatttaagcctgaaaggcagatttagaattgagggagacatgataatgttgggtcatgatccaataaaacaatcgaaacagtgatccaaaaccaaaaagcaatcctttctgagaacctggctgcaggagtctcagatggatgatacttaaaatgtcttgatatgaaggaagttataaagttagtatctgggtagcctatcagtaagtggcagaagtttcagaaggagctagagaggaccggacactaacttgatcctaggacaggactctataaaggaaactattgtctccataacaagataatatacagacaatccctaatttaaggtagtttgatttagaattttttaactttatgatggtgtgaaagtgatatgcattcagtagaaaccatactctgagaacccatacaaccaatctgtttcttactttcagtagagtgttcagtaaattacatgagatgataaaactatattataaaataatctttgtgttagatgactttgcttaactggagactaatgtgagtgttctgaacaactttaaagtaggctaggataaactctgatgttcagtatattagttgaattaaatgcatttttgaattataatattttaaatttaggaatacgtttgttgaggtgcaatcttattgtaaactgaagagcatctgtactactgctcctagaaactccacttggagataggtagatggggcttccagagtcataatttataatagaacttgatcatcctgttcaagaccctcttgtagaagactcttgccaacaccaggctaactttaggcagccattgtctcctgtttcttgctctagctcagtgattcccagttgctgtgtcgcttccttcttcgtgtttcagacatttgtgggggtagtctcagttattcaaggatgtaactttcatttaggtagtagagaccaggaattccaaatgtcctataattgcaaagcacaggactcttaagtgtcctgacaggcatttttgtgagtgaaaattctcttcatagttatctggtaaaataatctgactggatatttcattacctatgtggtatttttaaatatagtggatattttaatgcaaacactgtatgaattgcaagattacacttagttttgttcagaacttaaccagaggttgttgtccatttagaatacctactacctaacactggtgcctctcatgacacttgggtcaccaattgtagacacctggattagtttgcgtttgtagatgctgcattcacggggatttttatgaacaaaaactcttgattgcttctttatgttgtctattataattctgaaaacttacatattgaaaatttattgaattaaatattgttttaggctgggcacagtggcttatgcctgtaattgcagcactttgggaggctaaggtagaaagattggtttagcccaggaggttgcggctgcagtgagccatgattgtgccagcctggatgacggagcaagaccttgtttcaagaaaagaaaagaccaaaccacaattttacagcaaacgattgcacttttatttgtccttttaaaatcatttttaaaagaattacccgtaggtagttagaatattcattaatttcatttgacaatcacaaaggaagagcataaaatagttatgatttaaaaactttgagaactgctagatggatgtaaggtactttttctccattccatattgtttttctcaacttgctgagactaagatagatggggttactactaaggctcagggataacaaaagagtaagggaaaaacaggaatacatatatatgattttataatttacaagtttagtttaaacatctctgatttatgctactctagatgactgcctccacagtcaagaccatcttgccctagccatttatttgataccttgttttcctaatgtaaagctgagagaaagctatccagagtaattcaggagtttcccttcttatatgtctaccttccatgtttcagttaactgtttgaagacctattgcttccatgatgcaaactcctttcaaaaagtttatgttcccctccaaggagactctgtcctttacccagattattgagtcctactttgctgtacgtggttgccctgtggcgggtaagatcagtaccatcactacctaaaattggttcagatgcagaaactgatgatgacgcatatgttcaaaaagggtatgaagagatttattcttcgtaacatgaggctttctgagaagacacattggtatgaaaacagcctgagtgaaaaaaggaatgaatgacttggatttttaactgtggttgtgaggtagggttgggatgagggttcctatgtgggccagggtttgtgtggtgtaaacttctccactggagtcagggcaggaggtgcccaacttctgaccttgcccagaggtgaggcaatagggaaaaggcaaataatgtggcttgaaagctgtcagcagtcaaagagctgacataatgtcagactcttaattacatgagtctatagtgaatgtcagtcactttaaaatccaaaacaagaaccacagcagcacccatacaacataaatgtgtacgtaatagcactgggccttctagaagggttaacataggatttaggaatggaaacatatggatgaaaacccattttcagaatatggccatgtgaagaaggcttggagctcaagaattaagtagaaagctaatttaaaaaactggagcactataactggtcaagctaaatacatggttgactggttaaatacctcctgtcataggccctaggcctggaaatacatgctagctaagtagtaagcaatcaagtggtctgaactagagaagatggtttatcagcaagactatgtaatattgttataggaaagaggtccggatacagaccccaagagagggttgttggatcttatgcaagaaagaatttagggcaagtccgtaaagtgaaagcaagtttattaagaaagtaaagaaataaaagaatggctactccatagacagtccaaagggctgctggttacccattttaatggttattccttgattatatgctaaacaaggggtggtttgttcatgcctccccttgttttttttttttttaatttttctttttttttaattatactttaagttctagggtacatgtgcgcaacgtgcaggtttgttacatatgtatacatgtgccatgttggtgtgctgcacccattaactcgtcacttacattaggtatatctcctaatgctatccctcccccctcccccaacccccgacaggccctggtgtgtgatgttccccaccctgtgtcgaagtgttctcattgttcaattcctacctatgagtgagaacatgcggtgtttggttttttgtccttgcgatagtttgctgagaatgatggtttccagcttcatccatgtccctacaaaggacataaactcatccttttttatggctgcacagtattccatggtgtatatgtgccacattttcttaatccagtctatcattgatggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccttgaggaatcgccacactgtcttccacaatggttgaactagtttacagtctcaccaacagtgtaaaagcattcctatttctccacatcctctccagcacctgttgtttcctgactttttaatgattgccattctaactggtgtgagatggtatcacattgtggttcatgactctcctttttagaccatatagggtaaattcctgactttgccatggaatttgtaaaatgtcatggtgctggtgggagtgtagcagtgaagatgaccagaggtcactctcatggctgtttttgttttggtggattttggctggctgctttactttagcctgttttatcagcaaggtctttatgacttgtatcttgtgcttacctcctgtcttatttgtgactgagaatgtcttaaccatctgggaatgcagctcagtaggtctcagtctcatttttcccagcctctgttcacgatggagttgctctgtttcaaatgtttctgatgatgatatacagttcaatgaactttgtttcttaatgaaattacatcttctttaatagtttaaaatgattttattttaatgtaatattagccaacatcagaaactctggacactataacaaattacttcttaacacattaacatgtttcttttgtattcacatcacattctgcttagttgttgaatgaagtgctctccatacagaaagttttggaaccactttcagttgatctaatatctttgatatcttttaaagccttactggcatcttctgctcctttacctttagaaaactgacaaataggagaggataaaagattgtgcatgacttttttttgtatctagtcctgtattttacatacatttcagtctagaactaagtcacatggccccatgtcaaacctaaaaaaggccaagaaagtgtcccagtgttcctaggaaaaggaaatgggattagggagcatctagccagtacttgccacacatgagtaaaaaaaaaaaaaaaaaaaacctatcaaatatcacatgtgataatgatgacattaaaattacactaatataattttaacatcaagaataaagtgggctcttaggaaatactttattgagtgattatgattaaaattatttaaggtcagttctatgggttatatagaaacagctttgttttagtaaaagctaaaagtaaaaaaacttcatttttgttaatttctcatttttcataatattttattagagggacttagggtatccttagtagaaacttcaaattttaatcttaaaatatgaagtttataaaatacagaaaatatgtcaatttctataagttaaatagttatattaacatgcaggtaaatgtaactaccagaaaatcttgagtaaagtatgtctattatggagtagaattgggtaaaaaactgtcctcatctaggatacaaatttacggttttaattttaagatgaactttatcttcagacaataatctgttatgacctcatgtattactggatgtaaccaagctaagactggatatagatcccacagatatttttggaaatgatgcctgaaatgaatcgttcttcttccagttctgaaagcttatggccctatgatagcataaaaatcaaacatctatcaagtatttttattttctccagtatcactctttgtaaatgatacttctatctcttattttttgttttttcatcttttatttttaaaataattttctcacaattaatatagggagaggaaaaatggtttattagttacctattcctatatttaaaaaatcctcaaaacttagcaatttaaaacaacaatcaagcattttctcttcaagtctgaaatctgagtaccttagctgggaggttctggctctaggtctttcatgaggctgcagtcatgctgtcagttatagctccattctcatttgaaaactttacaaagggaggatccacttaacaattcacctatgtgattgttgttaggcctcagtttcttgctgccttttggccaagccaggtatttcagttccttaccatgtcggcctctccacagcctgaaaaaatttcctttggatatgcaatggtcttcttcttgagggagtgacccacgaggaaagtgtaccccagaaggaagttgcattacttagtattagaagtaatatagtatgccttttgcttttagctagaaataagtcattaagtcaagctgacactcacggggaaagaaattaagctcaactccttgaagggagggttatcaaaaaagttgtggacatatcttttaaactaacccaagtaggtttggaaaaattcttcacaagtaggtttggaaaaattcttcacaagttaattggtctaaagatgatataaaaggcatgtttactttatatcattattttgaaatacaattaaaacaaacaagattaaaaaggaggcatgaaaaggttactttcattgaaacaaggaaaaaaggcttgaaaataatgaggaaagaaatatccgacaattgcctttgtcgtcagacttcaagacaaatatcagtttacctaatggtaagtcaccagcccttaaaagaaatgtgtactcaattgttcattaataaaggtaaaataatcgggtgaagtctgtgtgaaagtggacaaatgactcaggatacttcagaacatatcgaaggaggcagtgaaataagaactactatgacaagcgttttatatatatatatttttttcaatctaagtttttgtatgggaggaccattgaagttgaggcagagggaaggaggcaagagattgagaaaccgtcagattatagtcaaactcctaacctaaggattttccctgtgaaccacgcagatgtccttaaaaaggaaatagggttaatacagacatataacatctatgcatttagatattactgataatcacattactaagaacagttaaaagaagcaatataagaaaccaaagtagatataagataatagaatatgatatgtaagttttggagctcgggaaacaaatggaagagagaaaaaatgattaaagagttgaaactcttagtagtagtaatatatttgcacctaattagatagtaatacagcaaccaaactcaacaaagtcaaacaaaaaagaagataaaccattacacagtttatggagagaactttttttctttttaaagaaaaacaaggtatgcctaactggtatgaggggaatagagcaaatgagaaataaattttcctgaaaaagaaagtcataagactgaaagttaaaaaggccaactgagtcacagaaaaaaaaatcgtacaagatgactacaccaagacatatccctcaaaattattgatattcacgggtgagtaaagaatcctgtgggtgtccatgcataaaatctggtcacttaaaaatgatgacagttaggccggagtcagactacttcaccatggtaatgtccattgttaccagagggtggaaaaatacacgcaaaatcatttagttaaattagtagtgaacgtgtaatttgatacctgccaagttgtctcttaatgataaagaaagaatacatacatcttaactatgcaaaaaggaatacagcatacaagagcttgtttttggtaaaaaataaggaacttagaaatggaaaaaccatgggaagatacataagtatctagtctcataataagaactatgaataagaaactttgtaaaatatgcttatcaaacaattgagaaaatttaagaagtatacttgagaagtccatcattcttcgtagcagagaataaacagattatttccaaattgaaacaattcttttctaagaaaaaaaaaagcctcttgagtatgaccctggcatttcacagacaataaccactgacgttgtatgttcagccaactacagatacctagcagtttgttaataagagatctgatagaggaaaaaaacacagaaaaccattgcttttatgagacgttaacattgtgtgtgatgacatctgcccattacacaaatgtgtcgaaggcttctacttggttgaagagtttaattaattggctatcaagatctttgtgataatttgctattatacagcatttgaagtgttatctccaacaagttatagattccatcaagcaaaagagtgcagaatgtaagtatatggatttaaacagtggatcattatgaccagaagataaaattcactgctacagcagaatgaataaaaaatgtatctcagtatatctataatctctttacagtagaaacatcactgattatctttgctggggactgggaagctgtacgtagacatgtttcttttcccccccttaacatgaattttacttctaagatgaaaaaaggaagggaagggagccactgtttaacttggcatttgaaatactttctttttcacatttctatttactgtcatttatgttgacgcactggcttaacagcaacaaaataaatgatggagtcactgaatagggctaagatgctttgggaactaacaatgaacagcaaagagatgtctcacaaagtatgggcagtaataataaaatatatgttcagattagtcccttattatttagcctataatttaccaaatcttacttctctagttttccccagccggaccatattttatttctcttgtcctgttttcacaattttcagaacataaaatttggaaccagagaatcttaaaatcaactgtcttcttatacggctaactttgcaggagtctcctctaagaagcttggagttttcagcttgcaattagaaatgactatgatactgagctgagataattagataatatatatacatatataaaatcatgctttataaatgttagcacataagtataataagagtgagaaaaaggggaggaggaggaaaagaagcagcagaagcagcagaagcagcatcagcagaagaggaggaggagaatgaaggagaaggagaatgaagaaggaggaagagaatgacaagaatgaaaaataagaagaaataatagtcatggtagtagtaagcagtttcaagaattcaatagccttagatttatattccaggtttgacatttatatatatatatatatatgtggtgtgtgtgtatatatgtgtgtatatatatatacacacacacacacacatatatatacacacatatatacacatacatatacatatatatatattttttttttatggagtttcactcttgttgcccagacaggagtgcagtggagcgatctcagctcgctgcaacttccacctccattgttcaagcgattctcctgcctcagcctctgaagtagctggaattacaggcatgcaccccacgcaccaccacgcccagctaattttgtatgtttagtacagatagggtttcaccgtgttggccaggcttctctcaaactactgacctcagatgatgcacccacctcagcctcccaaagtggtgaaagtacaggtgtaagccaccacacccgggtatttcctttctagatttagctaattgttttctgtctcagttttgtcatctctaagataaaaggactgattattgccaatggtgattgtgagtgtttcgtgatattatgcatgagaagtattcagcataatgtctggcatatagtaattatactacaagtaaatattagttattaatcacaatttattcagtgcttgcaatatacaaggtatttgcaaatgttaataacaactgatattcctactaatactgtaaagtaggcattattatccacaaataatacttgagtagcagataatcaaagatgtttggttcatggctaaaaaatactactactagaatttgaacttacatgtgtccaactctaaagctcaggagttgtctataacacttattatatgtgaattttatgcagcatagctatttttaatgtttaagtcatagttttaatgtgtaaagatcagaaagggttttttttcccacagcgtaattctgcaagttaattcttaaaatttgatttataaaagttgtgatttataaaaatttatagaagttttccaattttttataaactcataatgcaacaacaaatacaaaattttgacaattttctctagttatttattaaatcatttatttttcttttccttattgaataaaagttttaattgacagcaatataatttggtacagtgagacatattctggttattttggtgtagtattttgctcgtagctcaaaaaaagtgcagctaggccagtcgaggtggttcacttctgcattcccagcactttgggaggcctaggcgggcggattacttgaggttaggagtgtgagaccagcctggccaacatggcaaaaacctgtctctactaaaaatacaaaaattagctaggcatggtggctgtaattgcagctactcaggtggctgtggcaggataattgcttgaacctaggaggcagaggttgcagtgagccaagatcgtgccactgctctctagacagagtgggagtgagactctctcaaaaacaaacaaacaaaaaacttgcatctaggttatctaggattcaaagaaaatactcgtcagtacatgctcatagtgactgctcaatttttatttggtttagaatactgtgaaaacttttgttttacttcgccaagacaaaatatttaaagaaatatatttaaagaaagcaaatcattttactccaaatttgttcttctaaatataaggtgtacatcttttcccagaatttttttttagctcaaatttcctggaacatttatttttatactttttttctgaatattttcttgtgattatctgcaaaagatataaacttctgtttaatacatatattggaactatgtctttactgaaataatttctctttatctgtagcagtagtttttaacaagggtcattttgatcctagagcacatataacaatgtctggataccttttttattattacacattggagagagatgctactggaatctagtgggtagaggccacggatgctgctaaccattctacaatgcacaggacagccccgcctcaacagaaagatctgtcccaaaacatcaatggtacagagactgagaaacctgatctagggctattatgtgatcaaattcatgatcaatgaaaattaagcaaaaaaagctttactttttcacaaattcacaattcactatgctatagatcttagatacgcacacgatgctctgaatgcttacgtaactgtgggctgacataacttgtattatcctctgtacatttgctcatcatttctccagctgacttggtctaaaactcaagtccaagttgacatttgaagtccatttttagtttcactttcttcatgaaattttcattagcttcaaattacttttatcacacacagaatttctctgagtattagctaactaaaatagaatcgagtgtctggtatatagtaggcaataaatttatgtgctcttcccactggcctccacttccttttatgccttttgtcttctgatcttattgactatttagttgtataaagttttgccattttaattaagttgtctttttttgaaagcatgtcttatttattccatgaaaatacctttatgcatgttacatcatttttttacaccccagaattgttagcactaaatgtagtgcttcagtgaattaatgaagaatataaaaaaatgcaagaggactaatattttcatacctgtagcacctaagtagtgacacaatattaatatattacttttgcgtgtgtattatttttaacattctaagaattttacaaactttcaggttttttaagatattgtttatgcttaatattattatccttcagtctgattttgaaaaatgaaaacaaagatatatatttaaaatataaatgtctgaggtttgttttttatgtattacacgtttaacagcatttttagttgattaaaaattatatttggttctttacaatttaataaaacaatgcagttttctagctattccttcttttgggaatttacctgttgattacaagaaaagagcaagaattttgaatataagtaagatggaaaagaaaaaaacacaaaatatcttgctagtttaaggaaatttaaaatgtgtctgttttgtctttacagaaagtgtggactatgggccagtttttgtgcaagaaccagatgatattatttttccaactgattctgatgaaaagaaggtagcattgaattgtgaagttcgtggcaatccagttcccagttacaggtaggaattcactgttaatcatttttcttaagccttaaaaactttccatcaatgatattctgacactctcagggaggattatacatatttgtcttctgattttttcctaagatggcttcgaaatggaacagaaatagatctggaaagtgattatcgctacagtttgatagatggcaccttcattataagcaatccaagtgaagcaaaggattctggtcattatcagtgtttagcaaccaacactgtggggagtattcttagtagagaagctacactgcagtttgcctgtgagtaaaatatatgatttttctatatatatgtatatagtgtgtatatacagtatggatttttaaaatttagttcaggaaagaaaagcctaagatctcaaatcttttttttttttttttttttttttgaggcggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgtttcagccgggatggtgtcgatctcctgacctcgtgatccgcccgcctcggcctcccaaagtgctgggattacaggcgtgagccaccgcgcccggcccttcttgggatattttgaaattttctaaaagatttgctgtcctcaaaataaacttgataaactagcctgacaggttgaagtccttttcatgaaagtagataaagttttagaattcataacagtctattttgaaacccaccactttttatgtgttattttcaagtctttgagttcaaattaagcttcctatgagaaaaaaaaatgataatccaaatttcttttgaaatcggattctctccatctcctttttaagatatctataattctactaactactatagtcaccatttgctatggatttctaagaatataagatagcatattctaaaacttctgcttatagccaggtaacaaaaaatacctctgaaatgctaatattttagattttgactatatctcctagatgtcccagttttcgtattgcaaaaaagatattgtatgtggctatacggacatagacacacacacacacacacacacacacacacacgaatataaacatttctaaagtagataatacacctgattaaatgaaaattagccaggtgaggcagcaggtgcctgtagacacagctacctgggaggctgaggcaggagaattgcttgaacctgggaggtggaggttgtagtgagccgagattgcgccaccacactccagcctgggcgacagagtgaggatctgtctcaaaaaaaaaaaaaaaaaaaaaaagaagtgtgtatatataattaactaaatatgttcttaaaaactcttgaaattattttacttataatgagagcttacaataaattaaaaataggctaataggtaaaaccttttattattattccttaataagtaatcctacttgaaattaagttcttgaggatagaatctctaaaaaatactgagaaagactaggaatctttatattaataattaaagtgtaattgtagtggctacataagagatcatgaaatgatttttaaattaaagttacacctggaagaatgtaataattgatatttctctatgtaatctttcccaggtatcatttctaattaacccagaattcagacaccctattaaagaagtgtgaaatagaaaaggaaagaataaagaattgataataaatacagtttgaagagtaccgagataggtcctagaaaaatgtaaatatcatattttaaagtagatttgcctaaggaattcagataggtacatttacataggccaaagacaccaagatagcagcctaaatagattcttttttattttggaaaatattatgtggtgtatcacagaacctaatactttacattatgcacaattaatcaagtagcctaataaactaaataaataaccctcataatagctcctttattcaatagtcttttcaagatagatgcagaatatcaagaaaatatgctatacaaatattagtggcttataccttacagtttggtctacagtatttgatacaaggtataccagttagctatagcctgtatgtcagttgtttttccctttgtggaagcaaatcatgccaacttttttctgcatgcgtttagagcagaaagctatttattttacatatccatatgactgtcctaggttttctggaaagaccaaacatagttgtcaaatacactcatctgaagtgatgactttggcagcagcgtttacaattcaatgaccaggcatgggaaatactgtttatctaaagtatcttacctatttagcatgaagctgtcttcaacttgatttagagcaatatctgcttatttttaacttaagcattatgggcttacataggtattcagtggtagcaccttatgactctgcccctctctactttccaccaaactcaggtcattggctacatacgcataaaaacccacaaggtacctggttaaagcagacagttacccagggaagaccaattctgcctcaaaattgtttctccacctagatgccattatgcttattcctatgatattgaaacaatgaagtcccatagatgtagtttcatctatttttccagtttatctttgaaaataaatgcaaatatgggcagtagggagaaaagatgaagatttgattaacctaccagtatacctggatgggagtttgggtgctataggattcggggactcagaatcgttcaaagattagggagagaaactgaggtaggaagttggggagaaaaaagaaaaggggttcctgaaatgaagtgaaagaacacaaaggcaaggtgaaacttgaaaaattagtccgcaggctgggcgcggtggctcacgcccataaccccagcattttgggcagccgaggcgggcggatcacgagttcaggagttcgagaccatcctggcgaacacggtgaaacccatctctactaaaaatacaaaaaattagccgggcctggtggcacatgcctgtagtcccagctactagggagactgaggcaggagatcgcttgaacccgggaggcggagcttgcagtgagccgagatcacaccactgcactccagcctgggcgacaaagcgagactccttctcaaaacaaaacaaaacaaacaaaaaattcggttggcaactttcctttacattgagattttctgaagaccaggcttgtaggtcaatatatttaatagaatatactcactgttgctggagtgtttaatgtctgaaaggatttttgtggaggaatgcttattacttttgtcacattttaaagctaaaatattttatatctaccaggctttatttatctaaaaatataaatattcattatacaactaatatttcaaaattaatatatttaatcgactgagataatgattaaagcatatttaatccaattttgttaaacatttattaaatattgaatatgagtcttaaatttattaaatgttttaaaatcagactaaatttataaatcgtcaaaatgattgcaaaacttttcactgatacagtacttataattccactttgtagctattcttgaggcatatttgcatatgttactcagtttataatagttttattgaatacttatttttaccttttacactttaattttatcatatgttgtaaaatacctttttagattatttttatgctgggctagtgctatcaggatcttctaaagtcaaacatgaaggaggactgtattacccaattcaaagtctatttttgaggtaccaaccaaatgagttttgattgcctctttcaaattcgagatctgtttaacagaccagttcactttggtgattaaccattattattgttatatcaatgatactttctaaatcttcaccttttactttttgccttttaaaatttgacaactttgcttgaaattgtgtgattctataacttgttgaacagtgtttaataaacgtaggatggggctctcctaattatattcataaaaaaggtactaatttgtattttataataggtatatacttaattgaagaattaagttatccatatactaacataatatcaaattatccatatactaacaattattatacatatttattgtgataagataaatattaaatataataaaatgtaaagatatatcatcgaagttttctttcttttgcatgaaaattacatattttcaaagaaaactttgatttttagtatcattaaagtcacatggctttttgcagattcaacatatatatatatatgcataattagtatatatatacacatatgcataattagtatactgacactcccttaatgctaggagtactcttattaaccagaaatatattttaaaatgttctgcctttccactaataacagcttgccttcctgctcccaaccccttgtcaggcatagatttacctgcttttcaatgagtgtaatgtcatagagactaaaatctaggtgctgcaggtgcatattagatagcaccaaataagttctggtggtaggtaggataacattattgctaaaccagatagtaaaaaatattttttaaaaataggttttgaatgtctcaagctcacattgacagcttgtatttactgaatgcttttgttgcagacgatgctctgtttcaaatacattaactcattttatcctcataaccaacatacgatttgttcatgttgtaaaatgtaaattcatttttcagatgataactctaatttaaccctaatagtactcaatctttccctattccagtataaatgtgtattggatttcttttttgacttagccaatttgacttcagaagttctttttctaaactttaattaaattggaatctttttaaaaatcttacatgcttgcttcctcagtcatcattttagaatttattaacacctatgtaacaaaaattaatattagtaatgaaaataagcatgcaatcatagtgttctgcatttcttctcattgttcagatttagtttaaaaccacttatttaattttccttacagaagtttaacagtttaggagacattgagtttctttccagatctggaattttgggcttatagtaattttgatgtgtaatcactctttcttactaacatattttttcttttaataaaaccttttcctcataatttatttattgaataacatacagtgaggacctagaaagctacattttctaaatgaatttgagacaggacaaagataactgcagctattgtcaaaagctgatatcatcataggtcctagctttcgcagaaaatgatgacaaggaactgagtattgacaccttttattaatatctggtgatgtagcaaaaataaaattatatatagcatttggaaaaattaagcaagtataaagcaaattaaattgtttttaaagtttcatttctattcatttgtcacccaatatatttacaaatatgaaatagcaaatgtatgcttgtataataatgttactttattaacatatttaatgtttacctctttcgaaaggtgatttttttttacttgctgtgtaagatatatgctcaagatacatgtgtaataaagtaaatatagtcctaggaaaaaatgtaccttataacaggtcaaggtagtacagaccataaagtgaaacaaatatttccctggtggtcagagcaaaagaaagaaagaaaaacatgtaaaggaatctaacagaatctatttcccctgcacacccaacacttcctcaaagaaacaaatctactcttgacaaattttcataaaaattttttgtttgaggctttttattgcaacccctacagcatccctacttcaattcaatagcaagtttaattagcttgacataaagccaaaaatttccttaaccggaactagaatttaatcatgaagccattcactttattcactgattaatttttttttctaattttgatttggacaactaacagatttagcagctgctctgtagtggttcatccacccccaacctgcctcatgggcttaaatgtctacccatgaggaacttcattttaaattctcccataaataaatatttatatataaacatggttcagcttagttagtgttaacacttagtttagcattaataaacctaaccctcacaagggtgtagtaaaaattaatgaggtggagaagctgtgttaatgaactggtttttaaggttaaaattaaaaacataagcgcaaagctggagtgatttcctagggatgattattactgattatcaatgagattatttttgacaaaagatattttattcctgaagcttatgtttgtcatgaggataatttcctcagctactgtagtgatttctcttcagtgacaagcaagaatacaccatataaaactttgtcactctcacactttgcaaacatccttcagaaatccaaagctcgtagcagtttctccacagttgggatttttagaaataattgatgccagaaagtcaaacatataatgaatcaggaataaaatctccttatgctgtctcttacttcaaaaatacctttatatgcaattcttggtaaattgatagttcctatctaaatttgaacatactgcttttcagcgcatttagtgatttagatccagaatattccattagttttccttgaagcagttgattaaaataacctacttaactctttgagagattatatgactttttaggctttggatttaagccctttaatttaacctttcattttcatataaaactcaaaaattacttctctggcttttttcataactttttctcctaaggtaaaattgaccttagagtttaaaaccacattttactagtagtgtttaatacctaataaaatgatttgaataatcccaaactccacagtatatgcaaagctttatttcattagtctctgaggcttagcctataataactttattaaatcatttgaatattaatctgaatgagtcagattgacatggatgaatttactagttgtaaaattattagatgttattacaaaataaattagtgtttgtaactttatcttccatatacaaatgactctttttttaaggaaatcacaactcacaataaaataatgtttaagtgtttctttaaaagtataattactttggtcataatagatacagtaactgtgagtgtgtaatcccttggcaaaatacagtatggattattggattaagttcagaggaaacaatttaaaaatcaaaaatacataattttatgatttactttaaaatactgtatagatggtgtctagctatttgcccaggctggtcttgagctcgtggtttcaagtgatcctcttgcctcaatcttccaaaatgctgggattagaggcatgagccaagatacccagcctaattttatacttttaaagcaaattatgaagagtgaataaaagttgaaatctgttttagactaccctcacactcttatttcttttacataaatcataaatttgcaagtttttttaattcaagtacaaccaaacaggtactttcattatgtatgaaaatcatgaataactctgtctttatgtgacagatgacctgcaacaaaatggttccattttcctggcttggcacagggtatattttatcatagtgctcttttgttttgcttttaggaattcacaaagtcagttcttcattcaagttgtaaagtaacaaggatcagggactgtatacatcttctgacctttaatgctcaagcacatttacttaattaattgtccttaatccttagtagagtgtttgtggagacctttcccaagcataggagattccaaagcactaaagaacaatagacattttaaatttcacttaattgtgtcaggttaacatgataaaatagcaacatatcatgataaaacagcaaaatatcaggatgacttatgatcttcttgagtataaagacaccaatatagtacaaaaaagtatcaacaaaggggcagtataaataaaggggcagatagagactattctaagatcatttcattccacagtaaaatatttcactgagggacaagtcagaacagaatatgtagtaccccggagatcttgcagacttaattacacctgagtcaaagaaacaacaattattatgcattgactttattccacaccaagtgctaaatgttgctatgtttcatgtgtaacgaatagatagacggataattgatacttacatagatatacatagagctatagatgtgtgtgtgaatatatatatgtagcaggtatgtgtgtatatgtaatatatatacgtatatatattatttgtatatatatatttttttgagacggagttttactcttgttaccgaggctggagcacaatggtgcattctcggctcactgcaacctccgcctcccaggttcaagcgattctcctgcctcagcctcctgagtagttgagattacaggcatgcgccaccatgcctggctaattttttgtatttttagtagagacggggtttctccatgttggtcagcctggtctggaactcccaactttaggtgatcctcctgggattacaggcctgagccactgcacccggctttatatatattttaaaataacatggtaatagtaaaatttattgaacatttaaattgtaggccaactgctaaacatatttgatgcaccaccaccccctttaatcctcacatcaatttgatgaaggaagttctattattgacctaatgtataagtggagaaaaaaaaaatgaagctgagggaagtcaaggtatttcttcagccacacagctagtaagtaataaaacagtagctccaaatcaaatctaacatcaaacttcctacttaaaatctttataatactgccttgttcaactcaaaacatactttgcattacatttttgttttgcatgtctgtaattaatgtatgcatgtagaatttactcattatctgatccctctaggacattgttctgggtgttagcctatagtgagcaatggacatattaatagtgcttgaggctagcaaaatcagtacaaaccattctatttcatataaatttccttgcctacctggaatacctgaccactttttctatttcctaacatttttcttctttactccagccccactatactccctctgtattgcttattggaattatctatgcaaaacacaattctgactaggttacccctacataaatctttgatggcttacattaattgcatggaagtttgtaatttgccctacgggtatacagaggacaccaaagaataagaatgttgccttaggaatatgtatccagagaactctgtagggaaagtcacattaggaggtcattttaatattccaggtaaaaagggcttgaattctccctctgtgggaggcttgaaaataaacgagaatttgtaagtgaatgaataggtggtggtgggagtataaaaacatatggaggagttagaatgacatcaagattctgagcttgatcaattctattgaacaatttataatgccagtacataatcaagtcacacagataaggaatgtaggtttctgggagaataagtaagtttagtctgagatagatttattctgactttcaggagaaaatacccaacatttaaaaatatttgttggtgctcaggaaaggcagatgggaactggccacaaaacatgttgagagactcaataaaaccatggaaatgtttcaccaacgacaatttgtgctaggaaaaaagacaacagacctaaacttcaggaatatatgtgtttctctcacagagacaaaataaaggtagaaagaaagaagctagtgaaagagagaagaaaggatgatgcaataaaatagagtataatacaaatgatgttcaaagtttaaagtggggactgatatcacatgctaaagtaactctcaaaaaagacctttgggccaggtgctgtggctcacacctctagttgcagcactttgagaggctgaggcaggaagatcacttgaggctaggagttcaagaccagcctgggcaatatggcaagccctcatctctaccaaaagtacaaaaatcagccagacgtggcagtttgtgactatggtcccagttacttgggaggctaaggtgggatgatctgttgagcccgggagtactaggtgagctatgatcactctactgcactgtagcctgtgcagtagagtgaactctttctcagaaaaacaaaagcaaacaaacaacaacaacaacaaaactttgggttttgagacctttaaaggccaagttcagtatgatagaaacagaaatcataatccaaggcaaaccattttccagctttctctgtaattatgaggctatcctaaactctatatagtcctcaaattaaagtactaggtatcataatgaatattgattttggccataacaggaatgaagatgtgaacaacacagcttcatggacatgacatgagactgaaaccatggtggtctttagtagtagaaagaagagagtccatctagaggatgaggctgaaattagaaaacagagtctgattagtgaaatgaatttctcctttccaagtaaggtatctagatcctctagattttcttcttccagggaaatattctgccatatggaatatagtcagcattgtaaatattatgtcaaactagaaaaatttagagtctgcactctcacatcttgacctataagcttaaactaagtaaaccatttttatatcagccaggaaggtatacaatttctagaaatattttcttcattctttagaactaattttcatttcatatccttagaatttttttcaataaaatacaactattatcataataaaactagaaaccaatatactctttccataattctctaacatccagtgaaaaagtctcatgatggttaggctaaactgataattttcccattttaaaaaatgcagagagaagtaagaggataacaattctttctaagaaggctcactaattacctacgtgttgtgcagaagggctttagcacctgtgaattcatggcctcagttcctaggtgagctttctgcagtgttctgttttgtttttgttttgagtctaattcagtattttgggcaatttctagggctacagctggaatttctcccggtaaattctaacaagtcatcttctgctttttacagagcttttttaaagttcaagtcctcttcagctaactgcagtgtcagccttggttcaaattataaatgatgctgtatgagtctgtgtagagaggctcagattagatacaccttatctttcacaactttcttagaataccctcagacagtggactttcaatctattctacaagaagttgtttaaaatggtacccctggaagttatgtttgtggtgcctatagtctaagtgtagcctcagatgtgatcagagtaacttctgtatgccagagagatgttctgctcattccatgggacttaaggggcaagtatggagtagcactgtgcactttattcttgaatctgttggaagactaaatatttgagaacacattgatcacatagtgctctttgggtcggaaaagctaaaacaatgaaaaatattagctctttgtctaaatctattcatatccatagggacagggttaatggcttatgaaatggttaccataccccaataaagttcacactcctacaaatggcctcaagaccatttattatttggactctgtcatttttccagatttctctataattattaggctgtcgtaaactatatatatagtcctaaaagtatttcatgctcatttatgatatcatgtctttatatcatgttttctctgcctgctgggcaactgttcaataacccacgtctctctgactgtcttcctctccctgttactccctccctccttccctccttccctctctctctatctatctctatctccctctctctctccctccctccctctctccctccctccctctcttcctctctctctgtctctgtctttctgtctgtctctccctttgtctcatatgattcctttatttatttctggtgacatttcattacaactatttaaaacaatggctgaagccattccaagcacaccactgactttattagactataaactcattgagggcagatttcatgtcttttttatttctttattttagtttaataacctacctctaacatgtaagatcatagtcaacacttggtgaatgctggcgtgataagtgaattaataaaatatcctccagtaccacagtagccactaccctcaaaaagaattcccttatgacacctatgagaagaatgatttcttaggaggaacatacagagccatctttaacaattgcaatagagaatcaaatcatacaatttatgcagaaatacttcatcgattataaggcccccaaatagatgatagtcaaataattgctacattgaaaatgaatattaataactatgttgaatagaattaatgttaatatcaatacaaatgttaataaccattttaatgcagtaataatatttgtactcataattttgcatactattggtaatatcttacatatcatattcgatgtctgaagcaaactaagatacccccgaaaaatataggaaagttacctttttaaaaaaactgattttagatgtgatcctaagtgcagagagaagaaaactctctgactttcctttttaaatatagttctataattctagcaatatctctttattgatctccgtggcaataaaagtttcctatccgtttcatagtgtcattgggttgtaaacttaggatatagtgacagaatttatcaaaccaagcaacaaaacgtgttaagttttttgaaaatgtatgtgcaaatgttattctgtttgaattgccagtgcttaaagtgtctacccagtgccactgccataattcatgtcaaaatatccagcaaaaaaaaagttacctctttcagtcaggtttttaaagatcttgttttccaggcaattataagaaaaaaatgaaagtgtttatgtcacgcctcttaataggtggatgaatttagagaattgtctttcctagctcacaggaaattaaatagcattttcaaaggatcacatctgtcacaacagaataaccaaaaatgtgtctataaactgtcagtaaagagcatcacgaggtcatttatatcaattctgttttcataaacatagtaaatcatccacctaagaaatcacaaccattacagacttatttaaattataattcatggaatttttgaacagtcattaaattaccaaaataaaaaattgtataatgtctggtatggaactaggatgtttattaaagaaaatctctatgtctctgtgcaccaatatgcaagcaggcctagtaacttgacctctatttcctaaattccattataagaatactaacagttgccaaagctatcaatgtttccctatcctccatttatttaaaaccctcatgagaaatagaataaatgtgcttacctttagaaagattctgtggcaaaagttttattcatctaatttagtgatattgtgttttcgagagtttttttaaagttatttcttaagatgttataaaaatattttaattgatttacctcattttagaaatgaaaaaaaaaggctttgctcataaaatagaagctacaataaaatattattaccaacttgcacgatttttaaaaatgtcagacatttagattaaatttaaacattaatgacaatgctaataataattgataagatttattgagtgattattatgttctagacactcaggtgaatgttttgcatttaccttcatttgaacttcaaaaaatcctacaaattaggcattatttacatttctaaacatttgaacattaggaaactgtgcctgaaggaggtaaccaacttgctcaaagtagcatagttaaatggagatgaaacaaacatttatctttctttacctgactctgtgtctagatctcttaagaaactaaaagataaaatctcctaatgtttgtagatgttatgcatgtgattgatctctaaatcatctgaaccatcctgagattatgcttagtattctcacaatctctaattttgagatcagactattgaactgaaaaggatcatatatcctctttatggtcacacggctcagattactgaacttaacgtatgtaatatatctgatgtacatatgcacatttaggccatccttttttattttcaattgattatttttattttctcccaactcttattttagattcagtggtttatgtgcaggtttgttacctgggtacattgcatgatgctgaggtttgggttacgggtggtcccatcacccagttacttagcatggaacccagtagttagtttctcagccttccccccaaccccacttaatagtttctagtttctgtttttgccctctttgtatccacatgtacccattatttatctcgtacttacaggtgagaacgtgtggtatttgattttctgttcctgcattaatttgcttaggataatggcctccagctgcatccatgttgcttcaaagacatctttcattcttttttatagttatgtagtattccatagtatatgtgtaccatatttctttatccactccactgttgatgggcacctaggttgattccacgtctttgctattgtgaatagtgcttcagtgaacatgtgagtgcatgggtctttttggtagaactgtttgttttattttggttatatacccagtaatgagattgctgggtagaatggtaattctaagttctttgagaaatctctaaactactttcctcagtggctgaatggatttacattcccatcaacagtgtacaagttgttttcttttctcaaaagtctcgccaacatctgttgtttttgatattttagtaatagccattctgactggtgtgagatggtatttcattgtgattttgatttgcatttctctgatgattagtgatgtggagtacttcttccatatgtttattggctgcttgtttgtattcttttgagaaatgtctgttcatgtatttcactcatttttaatggggttatagattctgaatattaggcctttgtctgaggtgtagtatacagatattttctctgactctgtaggttttctactcttttgacagtttctttttttttgttgaggatttttagtttagttaggtgtaacttgtcaattttagcttatgttgcatttgcttttgaggacttaatcataaattctttcctgaggccagtgtccagaatggtgtttcataggttttcttttaggattcttatagctataggtcttacatttaagtctttaatctttcttgagttgttgtttgtatatggtgaaatgtagaggtccaatttcattcttctgcctatagctagacagttatcccagcatcatttattggttagtaaatcctttcctcattgcttaattttgtcaactttgttgaagatctgatggctgtggatgtgcagctttatttctgtgttctctattctgttccattggtctgattttgtaccagtaccatgctgtttggttaccatagccttatagtgtagtttgaagtcaagtactgtgatacctccagctttgttatttttgctcaggattgcttcggctatttgaatgtttttcttgttgttgttacatatgaattttagaatttttttttagttatgtgaaaaatgataccaatagtttgataggaatagtgttgaatctgtagattactttgggcagtgtgggcattttaatgatattgattcttctattccattaacatggaatatgtcttcatttttttttttttttttttttttgagacggagtctcgctctgtcgcccaggctggagtgcagtggcgcaatctcatctcactgcaaactgcgcctcccaggttcacgccattctctggcctcagcctcctgagtaggtaggactacaggcgccaaccaccaagcctggctaattttttttgcatttttagtacagacagggttccactgtattagccaggatggtctcaatctcctgacctcgtgatccgccagcctcagcctcccaaagtgttgggattacaggcgtgagccaccacacctggcccttcatttgtttatgtcatctggagatttctatcagcagtgttgcatagttctccttggagagatctttcaccttcttggttagatgtattccgaagtattttttgtaggtcatgctttcttaaaatctattcaacagtgtattcacacaaggctggtggtaaacttaagcacactgattatgccgatacaatgatacaaagagaagatgcatgccaactttcatgcatgactttcatttgaatttttttttccaataattcaagcaatatgtagtttcatattatgttgaggacttcatattggttttattatgtgtaggtaaaactcaaaatagtcctaattacaggtgatataaaataaatagaattcatgtaatttgactataaatattatcaggtcatacatgattaaggggaacatcaagactgtggaagtctcagtaatgaagtcgcagtaatgtaatttaacttggttttagcttctaaaataagcacaatccagcctattgtgattgttgtactcaccttaaaagaaggcttacctttagaaattagggatattcaaatattctactttacttcaaactattttctagcatcaaaaatttatacctactgttgttgtgagcataaactaaaataaattgaatacctagtaataagtatttttctaatttcacagttaaagtttagaagccaagctttaactgtaattcaaactttattatctgagctttcaaaatttaggaatactagaaatataaaatttataatcttaatctaattacatacaatattttttccagcataacttgtatgctatagtaaatatggataagactaaatgaatatttaaatacaaaacatacaaattaactgtcaacctaaccatgtttacaaccctggcatctctgcatcatatttaatatgatacttcctttcatgttgctaaatacatttcagcatgacaactagctaagggcaaataaaatttaataatacattcacttttacatgatcttttgaacttgaaactttgtccttgcccagggtccattgaaactcttcggccacaaagcgatatccttcatcttcgcttataacagatgttttttttccctggattctgacatggagacaaattaccatcttcctatataactataaaacagaattgcttttctcattcatggattatgtggactttgtaggcctgtctcatttccaaaatgcacagtattgtacaaaggagtagaaaaaacaacaaaacagccatgtatgctgtactaactcctatactaaaatctgactttgttgtctatttcttataaaattcaattaaaatatattttttatttagtttataaagtaattactgattaattattaattatatctaatttttcaaatggtaaatcactggtaaacaatgacaggaaaaacacaaggccaaccagtgattcatcatttacatttgaaaggatcttagtaagagaaaagcagctcattggatatttaattcttgcataaatataatagctcattagagaaactttcacctactaaaacctcatttaataaatgagatgatttttctcaatggcttaataaaggcatgtaaccttcattaatttacattaatgatgataaattgtgagaagtcgatctggggaagtgtatatatatgtgtgtgtttggttgagaggtggctttgattacactaaaaagtataaatagcaatctaggtcatcaacttgtattgctttattataaaatattaatcataataaactttagaaattaacattagctcaagcaaaaactgaggattagtttgctgttggccttctgttgtgttagagaaaataatatctatcctatttatggcctctctcctagtgaagagtaaaatagaaaatacgtgagttgctctttcttccgtcaaactggagcccaatataatgaaagagatggaaaaaagcagatgcttttctctccatagaaggacaaagtcaatgagagataatatagaatgggaagtagacaaactggttagtatagtcgtaggacacaatggagtagagattttcaggtaggaggatttgccagtcacgtcaaattcagctaatttgcagggaaaagggataaaggagcaacatttgtcaattaatagagcacggttgtatataaaagtagcacttccattacaggaatgaggtagaagtatctaggatgtgaggaagtgaatatatagtaagaaaccgggaacatcaagactgtgaaagtctcagtaatgtcatttacctgggttttggcttccaaaataagaacaattcagcctattgtaattaattgttgtactcatcttaaaagaaggcctacctttagaaattagggatattcaaatattctactttagttcaaactattttctagcacctaaaatttatagctactattgctgttgttagcctaaactaaaataagttgaatacctagcaatattaagaagcgttttcctactttcacagttaatgtttagaaagcaagctttaattgcaattcaaattgtatgatctgagctttcaaaaatttgcttctttggaagttaggcaacagatggatagtggaatttacagtaataagtcaagggggtatgaaggtacacagagtgaatcttgggcaggttgttttcttatccgtaattgaggaatgaaagtaatatttatgtcataagaaatatatggggaaagacatgtgagtctaatgcttgatccctgagtctgggatccggacttcgctcacggatgtatctcaagtgctttatatggtgtctggtgcatattgttaatgcatgatatataatagtatgaaaatgttaatattactgaagttaatgttattaatcttaagaatattatagtcacttatatacttgtttttttgtcttctactagtgaaagaaatccatttatccttctaccagatattaactgaacacttagaatgaaagagatactatcctgtagtaatactaacagtaatactaacagattactactccctttctgtgccttctcttcctgccactcactctctgctatcgtcctgccactcactctctgctatcgtcctgcaggtttttggcacgtaatattctaatcttaaccctctccatatcttatttgtgcaccctttttagatgatgtttttacccttggctgccaccttggacttgctatagcactgtagtcttccctcgattccacaaacccacttgcccattagggtcttgttttctcagctgcctggcatgctgattccttggatcttcctatgtttccctctttcaactcaggatctcggctctgataccattttcctcaaagagcccctccctgaactccctaagtaattcattttaaaaatcgacttcttttgataggtgtcatagtgaaattatttgcctcggagtttttggggatttgatattgcattaatgcattagcaaaccgatggaaaaagcaataaaatattttctgtgtttataatcactcacatataaatacatgaaagtgtacattcttctcttgaagcagttttcatataccacgattactgtttgtttccactaaaaggtataaaagcttcaaatactgagataatatttgtgaactgttaagaataaaaacaatcattggcatataataaaatgcattaaattaataagtggatatcagttacatgaagaggaatcagttgcctctgccttaatctatgtaacaaatattaacaaaacacctattttgtgacaggtactggagtaagcatcttccatctctttgtcttgagaccttgtattcattcaaggtttgcatcaaatgtcaacttttcttttgcatcctctctataacctccttccttctgtgcttcaatagcatcataccttgttatattgtagcaatttttatgcagaaaattttcatatgtcttcataagaatataaatgtctgaaagtttgggacgagatctttgaattctcaagaataaagaacagtcactgggacacaataaatgtatatcagattaacaaaaaaaatgccaggaatcagaagaggaattcaaatatatgtgtaatattatctatttttaaaatactatgaaaattataatactatagattttaatcaattttttttattttaccaggaaaaaatcatggcttataaaattattaacaaaatatatatattgaaatgaatatgttatgatataaaataactgccaaatgatatataaattaatgatataactacttgagaaatatattttaagtaatctaaacaattacttacaatgaagggaaaatatcagaatttttagataaaagtggctgagataaattatatttatctcatacttactgaaaatgtttcttctaaagtataaactaaaaagtgttattgcctaagccacatgcaactcttttacaggccattaattaatagtaatgtgtgatttgttaagtttattgcattttccacaactcattaaatttaggcttataagtagctgtaacctggtttggtttcacttgttttaattattttttgatgatttaagacactagccatatggattcaagttttttagtttttattttcctacaccataccatagtagaactattactgttgttatttatattttttaaaaaattcacttgtttttctcgagaatttgtgactgatttttatgttatactgcataattcagtaatttcacacattaacaacatccagggtcatgtgaggatgagttttctagcttctgaaatgttctgaggatgtaattttttaataagaggaaatgtgatctcacagactatttgggtgttttccaagtgacttgtcacgaatggttttgctctctagtgcacttctgagtacagaaaaccaataacccaaacttttttcccccagcactcagagaatttggggaatgacacaactcagtagttattttgaacattttctaaggtacagaatagtggtaacttctcctgggtatttagtattttttttccatttaaaataaaagcttttcttttattaattacttaccttgtgcttggaacattattagatacttatatattttaatttgcaatacaatctgcaagaaagccatttttattgtaatttgctgctgagaaaactgaggctgaaagaagtccaggttctttttcatggtgtggctaaagtcttctcaaaactcagggtatctgctatgcatggtagatttaagtttttgggacacttggtactaaaatatgcatcttgtgactccaagccacttaataacatctttagagctgaagtttaggaactagtgctaaaatgagtcaagtaaaattctactgttgtatgaatctgactcaggattacttatttgctattgtgaccattgtgaggaagtgttgcagggtgctggcacctgctggcttagcccatgggcgctaaggtcagactacatttcagcaccttgggcactcctcccttgtggtcatttctcttcactgagaggcacattatagtcagtacttaccaatccctcttcacccttcccacaacatctttgtatagataggtggtcacctgagagacagacatgcttgggttatttggaattgtatagatagttggaggtttttacaattttaggtgtgtggaaactatataagttaatgcagctgttcacatagactatattgaagaagtcttcaatcccaaagcattgtccagttatttagaagtaaacctggaattccagtcttgatctgagtgacttcaaagcttgtgtcctttcaactaatgctcttgtaaagaaagagcaataaacatgttgcatcttgcagtcaagatcactgttgtccagatttaagacctatctttcccacccttcatattgttttcttcttttcacataggaaagaagcagcataaggatttgttcttaagtaaacatgtatttattgagtacctactatgcgccagtaccatgctggattctatcataagaaccagagtgcatgaggtttctttggctgttgtgacagattatcacaaacgtagaggcttaaacaagagcaaatgtattatcttaaaattttgtttgtcattccaatacgggtcttgcagagcaaaagcaaggtgttggtgggactgcattccattatggaggctccaggagaaaatcaatgttcttagattttccagtttctggctgctgcccacatttcttagcttctgatctttttcttccatcttaaaagctagaaccatagcatctctctgactttgctcccatcatcacatctgtcctgactcttctgcctcccccttctacttttgagggcccttataattacattggcttcacttgtataatccagtagaatctctctattataaggtcaggtgattaacagacttagttacatattcaatgttaattcctttttccatgtagcctaacatagtcaaagatttgaggattcagatgtggacaacgttgaattgttttgcctactacctggaaaaacaggaaattgcccaggttgtgccagatatggtatacaagagacaaaaggcaagaagtgttctacataaaactggccaagcgcggtggctcacacctgtaatcccagctgtttgggaggctgagtcaggcggattacctgaggtcaggagttcgagaccagcctgaccaacatggagaaaccctgtgtctactaaaaatacaaaaaattagctgggcgtggtggcatatgcctataatcccagctactcgggaagatgaggcaggagaatcacttgaacccaggaggcggaggttgtgatgagctgagaacgtgccgctgcactccagcctgggcaacaagaacaaaactccatctcataaaaaaaaaaaaacaaaaaattgtattctacataaaacaatcagagaacaaagcattgtataagaaaatatgcaacaacaataacaataattgtaaacagagcttaagccaacatttgttgaaaatttgttgtatgccagttactgtgcttattgctttgtatacaatagttgttttaattttcaaaacaacttgtaaagataagccatcctcattttgtgttgataaagataaataggctaaggcttggccaaggtttcctgggtaacaagtaggaaaatgagatttaaacttaggtttctgatttcaaagactgtgctccatttcgcaaactattcatatagtaaaacagggtttagaacaaaatgatttcaagttggttcccaactttgaagagtgcatccagcatgttgtcaacaggaatatgctgaaagaggcgaaaagggagtgaatggaagtaggaagtggtaaacagcatggtgtgtagtaaggaagattgactgttggagagtgttggagtttgtgctgggaagtcagggagataaatactattaggaaaaatgagggcgttttagctggtctttaatctcttgagtctgcacattcatcagcaaataagaggggacacgtataggtttttaaatgatgaaaccatgttttaggtacattagtctgacagcagtgggaagaatgggaaagaaaagaagtagaacaagttttaaaatgctgacaggcaatagcagtgatttcaaacaccaattaagttggaacgttcagacccaagctcctgtgactggtaatcacccctacagtgtcttctgattcagccccacttattatatttatcaacgtctcaaaacttaatctttttaaaaaataaaactcgttttacctaataaaacattatgtttcagataactttaaaaggatcatttcctccgtagatttttgttaggtttaggtctttgaatgtttataaagtgttctcacatacattttcatacctgggcctgtgaatttggtgaagcacatagactcacatgggatacacagaggaaattaaaactccaagaaattgtgaattgtcaaaatcaagagtaacaatttcaatccagaactcatctcaaagatatggccctttgtgttatagattgttgggtagtagataaatatatataaaatttaacattttgaatatatcttacattaaagagaccctaacttttgtttatttttatgaaactggtataattttaaactgagattacttaagaattttagcaaacatgcaaatgacctcttcaactatccactgcctaaatgtcctttccatcacccaaacggcaatcatagtcacttctacttccgctgtatattgtaaatatatagcagaaacatactcatttcttcagattacacaccaaaaaacacagtcaccagctgcaactttctgacaggccaaaatatgaagaattgttaatatatgatcaattgatctggatcgagcagagtgcagcttactgtatgacatgttgcttttcatagacgttatctctgttcaatttgcttctgcatttaagatattaaattcagatctatgtggcaaagatgattagaaaaaggtaactcctcccttagggatctattttaaaatgtcaaaattaaaattttccagaaagttttgagcagttttagcctcctggctgatgcaatatattgagtagcactgttagcttaaggatgctgtctggaaatggaaatgctgatttacccttcccccctgccatgccacctaattaaaaggcaccactctcagtggtaggcacactaatacatgattttgctagtggaactgggaatagcataataaatgtgttgtgattgaggatatatgctgtgcctatatttggaaagaggaaaatgtttaattgctctttaaacaaatttgattgcacaaatgtagcatgaagaagaagaaagacgtgatttttttttaactgaaggcaaaaggtatactcattttacctccaggttgataattctcctgtgacagtgtgaaagtaattttgtccaaggaaaaaacaatggtttccaaacagccactgtcacttcactcttccactccttacacgttccaaccccactttaccatcaatatatttgacaataatataatataaataatagcaaggaagcttttctgttagagtaggccatgtatggatataaatgtcatttttatgtcataactagacatgataaaatataaataaactgatatagtatttaaacataatgacaaggtcacaaatacatctttttttactgtgtaagccaaccaaactaacaatttcaattataagtttagtcagaagtaaacattctaccatcaatggtagacatagacctctgggtcagaaaattaaatttacatttaaaatagcaatgttttccctagcttttctttgtaattacggacaatttgaaagctgccttaggaattaaaaaggcagtgatctcaccaaaaccttcatcatatttcccctctccttaaaggatgaaaacagaagtgagttatatgttaatctcatatactttggaagaggttcaatgattttgttacatttgagaggttttgtctgatttctcagacttttgagtttcatagcaataacatacattgaaagcgaatatatttatagccattatttaggttccatatggccgattgtatttcttgggaggcgtgacctaactatagttagagctagcatatattgccttaaaaacatgggaacactgggtaaaatgcctaatttatttgtaagtagcaatttactaataatagaatcaaaccaatcttagttattgaatttaagaaactacaaaatttcacagttacatgttattactattgttgatcccctgagagtagaactaagggaaatataatcactaagccctaggtaataaaatcagttcttgtagaaaatatgaccacaaaagagaattttcagtgtatagaaaaatattaagcgaaaattataaactagtagacatttaaataatcagagctctacaattttttaatgagcaatgaagattgattaaaatacagaccctggttaatataatcattattcagatgatcttaacattagtgagcctaatctggattgtttaaattgcaaataattgctgccttaattgctattaacttggaaaaaatgattttcttctttcaagattaatcatcaggctggtgttaacagctgtaatttggatcatgatgataacaaacacaaaggcagttctcttgaaactccaactatccagcatgtgtttaatgtcaggtactgggaaaacgtgatttatatacatttatggcttagaaaacaacaaaaggacataaagttgaagggaggaaaaatatgatgaatatttttgtggatccattgtcttttttctagcacagcttttgatttgtccacaaattttaaaaaagctggaaaaaatcctgctgaaatgtaaagttgattttgtcaccaagaagtctatgtttaaatgcctgatggtacaatgtttacttctgattaaatctagtgattgaaattattagtttggttggtttacacagtaacataatagatatagttctgatctagccatgatgcatattggctatatgcattctttatatatttatatataaatataatattgtaacaaatgccacattaatattgttaaatttattaaagaaaaacatagcccttagagaaaaataaatggaaacaatggttatgcacagtaaaacaaaacaacttttttaaaggacatatttatgaacactgtattctttattgaccattgcctgtcatctgcgggtcacaatagtagcaatacttttgaaatatatcaaacaaaacattttgttgtatccaaagtgtccacctgtttttataacaagtgattctaggattcatcacaaaattaacacattaatacactatgaaatgaaaaaaaatttgaaattggcttttgtttctttgctttactggaaatatattttgtggtgaattcatctgagttattttttacttccagaaagatgattaccatatgtattttatttataaatttcggttctgattccaaaaacacaatatttaatgaaaatgcatagaacaaagccttgagatgaaaagtctttaatattaaaatattaaacacctatgtggaaggaagtttcttgcctcattccctaaggacagcagttggctaaacaagtataagtgaaagaattacaattgaagataccctgcagaagagaaaagaaaagtcctgccacccggtactctgaagacaaaaatctgtatctgctagcaggagactttgtttgcaagacagcagaggtgattcctagaagccggactttctggtggaaatcatgatttttggtttcatctagtcttccaataacaagcaggttgagtcctgaaaaagcataagcacaagatggcattatatgagtaacatgtaccagtttctcaaaacatttcatttaaagatatctttacttttatgtctgacatactgtccttaatagcaatcttaacacttctgaattttaaattgttacatatttgagattatattttcataaatcatctaaaaaataagaataactctatatagctaaccaaccgtatactaatgaacaatgtggctgagactaataacatattttggtaacaggctgtgtccacttgatgtttatttcatttttacccttataaatgtaatacaagcaaaacagaccacaacaatttttattttttaatgaatcactattacaaacacttttgtaactgccacccaggcaggagctagaatttcggcgatagtttcagtagctgtgccacatcccaatctcagacctctctcactaaccatacataaccatgttcctgaatttaaattgttacttccttgagttaacttagtttgtattacccatgagttcattcctaaagtttgattttgcacattaaaaaaaaaatacgcctttttaaatggcagaaaatatttgaaaatgatgcctcaggataaataattagtattcagaatctataagaactcaacaagaaaaaaactaacaaccccattagaaacgggtcaaaagacatgactacacatttcacacacaaaaaaaggaataaagcagccaaccgataataaaattctcaatatcactaagcatcaaagaaatgcaaattaaaaccacactgtgatatcatcttaacaccagtcagaatggcttttattaagaggtcaacaaacaacagatattggcatggatgcagaaaaaacggaacactcatacactgttggtaggaatgtaaattcaatctttatggaaaacagtatggagatacctcaaagaactaaaaatagaactaccattcaatctagcagtcccactactggctatctacttaaaagaaacgaaattattatattaaaaatatatctgcactcatgtttatcatagcactgtttacaatagcaaaatcttgtagctaacctatatgtctatcaaaggttgaatggacaaagcaaaggtgatacatacatatcagcatggaacacaatgcagccataaaaaaagaatgatatcatatcctttgcagcaacatgaatggagttggaggccattatcctaagtgaactaactctgaagtagcaaatcaaatattgcacattctcacttataagtgggagctaaacaatgggtaaacatggacgtgaagatagaaagaataggctctgggaactctgaaagagggaggaaggaatggggatttgaaaaattacctaccaggtataatgttcactgggtaatggatacactagaagcccaatacctaccatttcacaatacatccatgtgacaaacaagcacatgtagctcccgaagctaaaattaaaataaaaaagatatgtctgtttaattcctattaatctgcagggtcttcctccgttcctttccttttcttaaactcatctgttgaaaacttaagttatttgactgaagaaatccccacagtctggattaggatttttctgattagacacacatggtttagagctcaacatgttgccagaattggtgtatttcccacacattggcagctggatccagaggcttgagcagactcaggttggagccctttgatgatggtgatgaattctttcctcaggagggaatatctagttgtgtttctttttgtgttgttagtagctattgacggataatacctacatccattaacacattaggtttgcaagttggtgatattctaatctatcatttatctttttatttgttagttggaatacttttaaaaggaaatacatcttcgtaatctgctattaaactacctaatggtagatgccataaagaaaagatatatgcttgattcatcccctttgtcagttccaagtcaacaaattgaattatttgaagatgaacaatttacttgataaaaaagtaatttatggatttaaatacattgatagatttgcagttcaataacttgcaatcattattcttttggaagctcaatttttttccttttggccatgggagtcccttcaagtaggctcctggagccgttcacaatgaccctaatagtctgtgccagcttcctctcagtgtgctgtgacaagccacaaagttaaaattcatcatttcttctagaaggtctagtttctttggttgggaaatggtgtttgaagaacacagattactggaggtgctcattgctgtagcgttagtaagaatcaaatatatcaaattatactgatacatataacccaaattgaggattatagttttcttaatcttttctgaacatctgtatccctttacctccacactgaaaatctttgttctaacagttaccaggaatgacagaatagatctctcctaattattctttaacttcatctcacatacacacgtgaatctcagaaaaataatacttcgatcagtgaaaagtaattactgagaatttttcttttcatacgttggtatgatttttatttagttcatagatttgtttgaatctgtttatcataactgggaagttgattattaaaacactcttcatacttaaagtggagcaaaataacaagttatcaattttctttcatttgctttttttctatatgctcctgttattaccactgaataatataggaagctcataaattttcccatagcactaaggtattaaaaattataaaatgtggatgatatgtgtacattcgtagttctgtgtgcactgtattcttttatatagctcctggaaaacttcagcttcctcagatatacctccctaatctctcatattattttgtacagtcctaaagcattccatacccaaacactcgacacatttgtggtaactctttccaaattgtcttgctaaaagtctgtacactctggtgtaccttttttaaaggatatatatatatgaaatacataatagacaatacacatttgcaaaataaatgactcaatgaataaatcagccttcccatattttacataagtgttaaaaatattgacttaattgtataagcactgttatataaggtcatttttgtagtgatttttcacaccataaaaggaaatcacaaaagttcaacagatttttatatgctttaattaacactctaaccctggagagttagaagaactctccaggctggacattgataatttaatactagcacaaaattaggaataatgagtgaaatactacatatcatctcctgctgaaaggcatcaaataagctttctcatttttttccagttttgtgatgcatagttgctactgtctagaatactctgtaactttcactgagctgagctatccctatgccatgcgaccaacatccgtaaggaaactcctcacatttccttatggatggttgttcaggacctgcatctggaaccccatggcttcaaatgttaggccctttttcctaatctgttactgctaacctctgtttctggctttttgcactgtccgctaactatacctttgtactgatatatgcccctgatatctggaaattgatgttctagtcttgatcccaggctcccctcattggttaactgtgttcccttcctacactgcattctccctttgttccaggcaatgcatgagccctatttagcttctttctcatgatccagccgcactatatgtacctggagttgatgttgcattaaggagtacagtggggggtatggtctgaatacatgtacatttattgtactataacacatgaggcattcaagtttcttggtcgagttatcaaatgaataaatgatctttcagagactgccacagaagcatgaataacatagtataaaaattagcatcattttagaacttagcaaactttcttacatgtattatgtcaatgcccctaaaccttgtagcaatcctgaacaaggcagattattcagttttacacttaatgaggctcagatatattaagtgattttctaagttcacactgaatttaggtgagagaatatgattgaactccatcaccttattgctatactaaatgataaatttcattcttgcatcaccaattgtgtaatagtgaccaaacttcttaacttttgtgtgcctcagtttcttttattcttttattcttttaaatgattttctctgtagaagtgagttatctatgtaaattgcttttaaattctagggagaaaaaaagagctgtaggagtgataattagatgccatgatatagatggttttaaatggagttgaaaggttcatggaataaaattctttccatattttcattaatatggatttttaataccctttggaaattaactttaaaagtgttttccatctttgtgaaaaagaaactttatttccattgactataaaattctttataatagaacatgctccagttttatgaaaccccgtaggataaatagtggcttaaatacaccggcagacagatctatctttaattgaactactcagccagatcccattgggagtaaaaatctagtctttcaaagacattggaaattttgtttctgaattcaggtccagtatatcaacagtgacatatgcaagtaggaactggttctgctcatttactctgcctttgaaatttaccaaaaccacattcttggctcctaagtgacagagataagtctctttctatggatcccacagcattaaaaaatctaaacacaaggtaaatttatatctgcatttccaatcaaccattcagatttagtggatttttaagtttatttcttcataatctttagtttaaaaaaaaaataaggaaagtgctgttttaacatgtagaaagggtaattttaacataacagtcttaattgcttaaaattacatgctgtagtaatatacaatactgtgcagctttatacagtactatatctgcatttgcattataggttttcaatcatatgttaagctttcctcataactattaaatctgttcatattgcctattgactttgtaaataatgcataagttttccatgtcagtataataccaatttatttcaccattcactatcaaaagtttttaaaatattcaccacattctcatcttccagtttattgctttgaagggtaggattctgtgagagtgcatggtaatgaacttcatattaagcagtctacttcaatacagtctgccttaattattacttattaagacaccccacaagtttcacaccagctattttctgttaaatatgtagcatacattataactgtaccaaaaaatgatggcatctggaattgtagagcagaaagaaagtttgagattatttcttttaaccttcttattttagaggcaaatgaagttagatctaggaaattaagtcttttctaacatgacagaattgactgttgagagccctggaatcagagtcaaatgtcttggctcccattcttaccttctttttgctttttcttttacactacttcttctgtgtgttttgtcataaaagatatataagttgactttactttgatgaagggaaagctactaatggcatgtgagagaaggactgaagtggggataaatagttattgtacaacttacaattttttcaaattctgaacaacagtgcaaggtagtgatggcatgtgcaataggtgtcatgcacattgtaaaaaaaactacaggtaaaataccattaaaaaacacactctaagaagcaaagcctttctgtcattaatcagtactttggttttgattatttaagatgatacctctggctcacgcctgtaattccagcactttcagaggcccaggcaggcggatcacgaggtcaagagattgagaccaccctggccaacatggtgaaaccccgtctctactagaaatccaaaaattagccgggcgtggtggcgcgtgcctgtagtcccgctactagggaggctgaggcaggggaatcacttgaaccccggaggcagaggttgcagtgagccgagattgggccaatgcactccagcctggcgacagagcgagactccgtctcaaaaaaaataattaataattttttttaaaaaaagatgatactcccaaaaggttctggtgaagatacatgttttgttttttgtttttgtttttctcttgagacggagtctggctctgtcgctcgcgctggagtacagtggtacgatctgatctctgctcactgccacctctgcctcccgggtccaggcgattctcctgcctcagcctcccgattagctgggattacaagcgcgtaccactacgcccagttaatttttgtatttctagtagagatggggtttcaccatgttggccgggctggtctcgaactcttgacatcaggtgatccacccacctcggcctcccaaagtgctgggattacaggcgtgatccaccgtgcctggccagtgaagataatttctggtaagttagtgggaaaaggaaagacctcacaaaatcaaagagtaagggaagccttaaaaagtagaaagggaaaaataaataaacaaaactgcatgaaagcttctcttccctgtcattataaaattaattttttcttagttactgatgatatatatcaccggaccagatagtacacattggtagcttttggaaaaacttggcattttgaaattggacagaacaggtaaacatagaagctcccaaaactatgcagagaatgaaatgctacaggtttaagaaacttctatcgatgttacttctgtctacatcatacctagtgcgaactgtgtttgagtttgggttttttttctgatttgtttcattttgtttttaactgtggctcctaaattttaaaacactgctagctaccgtttattgagttcgtttatgggcagtcctatgtcaaatagtattaacactttattccatgcaatgcttacgacaacttttacacaagctgcttgaaattatataggtttgcaaattatataaaagaaagagattaagaaactggcctaagatcgagagtgtgtggaaactgggatttgactttagtaggtctagcaagaagtctatgtccttaacaactccatagtcctcctgcacactcattttcaggagaagcagtatttatttattaaaatacttttcctccttaaggacaaaaatgtcaacaaaaacaaaattcattgcagtctgtgagaatatctttcaaagtgaggtgggtttccctactagccaaccaggtttttctccccgttcactattcttgaactaatgccagattgaagaagtaaactgtatatagttacatattacattttccctcacatgcatagcgtgtgttcattaatattttgcatatgatcaatgaggcaattgaaaacattttatatcatggaaaatcatgaaaatataaatggacaataaatagcattcatgttgccattgctctgtgtccctcttttcctctcacaataaatgttttgtaattcacagagtggtacatggctaacagttgcttatgcaataatactcatagaataagaaatagtactcatagaataagaaaatagtactcatagaatcagaaaagtaaatacaaatatgaaagagaataactgtttctactccattcattttttttcactcgtggttaatgaaatagaacaaaacaggactggcactgtaaatgaccaactggcgattaaaataagcttcaaaagtttttcggagttgatgaaatccttatttcatgccacaagcagctcccaagagactaatgtttgatgtgcttgctcaattttacaaatacaattgaaattgaaggtgtataaaaaatctgtagacaccaacattttctgtaatactatgaattgcttttgtcctttgcaaaatgttattctctggccttgacaaaaaataatttgtttaaatcaccttctcagtggagaatttcaaggatattattatacaacagtagggtaatagaattgtcatctctatttaggtgtaggaaatattattttggagatagtaaaaactcacctctaccacttcaaccatctatttgtgaggaagcacagggaaatgttatgacttttttaatatttaaaaaaattgtctctctttgaaataaaacttataaagtgtacctaaaaattgtcatggttcattagaagctatccactgagaaaattaaggctaactatggagatagtaattgactttaagagttgcaaactagtttcaattaaaactggcagcaattatttagcacacatctatgatttattggaaattcagacagattgtgcagtagcattaatagaggtatgtttctggattggtacaggtatgatgagtgagatttttttctgtgctgcaggcagtctaggaacaagagctgctggaggacacatttgatctacatactacacactcttgtgaaatacaaaccacagtacatggtttcacaggataggaaacagtttttaagttttgacagttgaattataatgattatacaaaataaaatgcctactcccaacttttgtaaattatagccagaacggagaatgtttttagttccttatgaaatgatttatgtaagtgatatttatgattttacatggggaatgtatggtacatttcctgagaaaagtcactttgattctacattagttatgctttttaaaaattcattgaagtccactattatgaattacagcatcattgttctcatatcagtagcatacaatatgtcaaaagggatttaagggctatttaaacattttaaaaacttgagtcctcaggtagtatatagtgataacaatgttgttatttttaaaataaaataaagggggggagctggcttagtaagtgctgcgtataaactaaatctgccctgaggcaatgattttttactggtacagaagctgctagtgctgggttttcggtcattactatgatttgtagcaaagctagctctccctccagccgtgtatcgcagagcttgcagtttattcagccgactactatctgagagttgcacagtattgtctgataacattctatagcttccaagtaagttactcctatctcatcttgttcatcacagtagatcacagtcttagctattactgttgatcaaatatagcactgaatttaccactactctgctgagcctgaatggggacaacagaagcctgacagataagctcagatagtgtagtttagcactgaaattgtggagaggcatataacctgacacaaagccatctcagcctattttagcaaagatgactgagggactgtgaagctaaaaggcaaaatgctaataaagtcttctgctgaaaataagtttaattgtaaaataatacatagataacacccttaatggtcatggtttatattttatatatgagttttcatcagtaagtgatctagatactcttgtgaagctctcctgttaaaagacttatggttttcataaaagataactattgctggacttgcatgaagtgggatgaatttataagagcacactcactgccagcctatgcacccacccctccaaagaaaaatttttgctaaaaatgaactttgagcagtaaacacccaataaaagagatttggtttaaaagtagacgctgaagtcagttatacattcagtagcctcaagcaagaaccagcagtaaaacattctgagtaaatctgaacacaattttgagaacaagagatctctaaatcactcattttttatttttttaatttaatttttgtgggtacatagtaggtgtatgtgtttatggggtacatgagatatactgatacagacataaaatgcctaataatcatatcatataaaatgaggttatccatcccctttagcatttatcttttgtgttaaaaacaatccaattatatatttttagttatttttaaaatgtgcaattcaattattattcgctatagttagcctgtcgtgctatcaaatagtaagtcttattcattctttctgactactttttttgtgcccattaaccattcccatgtcctctttattccccccacctccattcccagcatctggtaaccatctttgtactctctatcttcatgatttcaattgttttgagttttagatcctacaaataagtgagagcacatgatgtttgtctttctgtgcctggcttatttcacttaacataacaacctctagttccatccatgttgttgcaaatgaaataatctcattcttttttcttttgtggctgaatagtaccccgttgtgtataagtaccacattttcttcattcatctattgatggacacttaggttgctttcaaatcttggctattccaaacagtgctgcaacaaacatcggagtgcagatgtcactttgacatactgatttcttttgggtgtataccaagcagtgggattgttggatcatatggtagctcagtttttagtttttttgaggaacctccaaactgttctccgtagtggctgtactaatttacatttccaccaacagtgtatgagggtccccttttctccctatccttgccggcattcgttatctcctgtcttttggatataagccgttttaacaggggtgagatgatatctcattgtagttttgacttggatttctctgatgagcaatgatgttgagcacctattcatacgcctgttagaaagtcaatttctaaatggaatgattggcatgggcctggcttccttgttaacatgctcatggtgtttactggcagaaagattatgaagagtccctattaaacaaaacaaaacaaaacagtgaaaacaaaaatcccctaatcactcaggatactcctggcctgtcttgataacctattatgtatgaacctggagtttatgtatttataaagtatggctgtctggagagtgagaaaagtcactatcttctatctgttgaattaaatagaaaccaggagagccccaaaactaaatcagctttctttaagaacagcatgtccacacccttttcagactcactatatgttaatcaaaaacaaagcaagtcctgttacagaagataagatattagaagccacgtcttctgcaactcatacttttccagaaaggaatgttaattttctgcatgatattgcttctaccttttaaatcactggtaaaaattcatattggggaatatgtacaattaaagtgattctgttttcacctttagtgttcaaacaagttggaaggtagctgtaacggcccccaaacagaagcacccctgaatcctgagaagcaaatggaagtgctccctggaggaaagatcctgaatctatattcagaaattctatatagacctcagaaattctaaaagttaacatgaactatatatgaaataacaatcaaacatcatcattcataaaggaaaatgttacaacaaatagtaaaagatcaaagagaaaaaatattagatttgtaccctgaaaactaaaataatataatttgtagatacggaatataacataactatgtatgaaatgtttgaagaaaatagtaatttaataaaaataaacaagaactaagacattatccaaattgaccaaagagatttgaaaaataatcaaatataacttttaaaatgaaatatgtttactgaaatatttaaagagtagaatagacattgttgaagcagaagagaacggaaataatagtgaaagaacaaatatttaaagatgcagtggctgagaattctccaaaactcataagaattatgattccacagatattgtaggtacgtatatactgagcaacatgaataataatgaaatccacagttagacacattatagtgaaactgtagaacatatattacagagatgttaaaaacagtaagaaggctgggcacggtggctcacgcctgtaatcccagcactttgggaggttgaggcaggtggatcgcctgaagtcaggaattcaagaacagcctgaccaaaatggtgaaaccccatctctactaaaactacagaaattagctgggtgtgatggcatgtgcttgtagtcccagctactcggttggctgaggcagaagaattgcttgaaccagggaggcagaggttgcagtcagccgatgtagtaccactgcactccaccctcagcgacagagcgacaccccatctcaaaacaaacaaaacagggagaaaaatccaggcgtggtggctcacacctgtaatgacagcactctgggggggtgaggagagtgtatcaccttagcccaggagtttgagaccagcctgtgcaacatggcacaatcctgtctctacaaaaaatacaaagatagcagggcatggtggcatgtgcctatagtcctagctactgggggcgctcaggtgggagagccgtttgagccagggaggtcgagtttccagcaagctgtgatcatgctgctgcactccagcctgggcaagagggcaagatcctgtctcaaaataaaaaaaagaaaaagaaagaaagaaaagagagaaaacaaaagcagtgagaaaagacaaagctgcctacacaataatgacaagtaaactattcagcagcaaccaaagaaaccacacaacttggtgataaagtcctcaaagtgatgaacaaaaaaatagctgtcaacttagaattgtgtcttcagaaaaataatctgtcaaaaatgttatttacaaaattgtaaataagcaaaactgagagtttacaaccaataattataccctcaaggaaggattaaaatttttatctcaggcaaaaataatcctaacaggaacgttttaagatgcagtaagaaatgcttagcaagatattggtgaattgactatccagccaaatacgcatcactgcacataataataacatttttgtagttaataacgtagatatctctagaaagtttggtgagtaataaagagataagacaaaaaatatattaagaatgagaaaaacggcacaactccaagtgtaatagagaattgaaagaagataccatgaatacatttggcaatgaaattgaaaatgttgcaaaaagtcctccaaaagtaaaattttccaaaactgattcaagaggaaattaaagcttaactagaactttgaacattaaaaaattaatcattaacttaaaacatttctacagagaaaatactaatccatttttattgtaaatcaattccatcaaacttgcaaggaaaagatcactaggaaaatgtgtatctacattaaaaaattaagtttatattcaaatataatctctgataactttgagaattaaatgtaaaagtcaaaactataaaacatttagataaaacatatagaaatatctttatgatcttgaactagggaaaactaagatgtttcactgtaatatattcacatattcagttgcattcatattaataactcttatttaaaattcagcataaaaatgtacatactaaaatctgaggaaaaagatctggacatatataactgacaagtgattagtaatcaaaatatataaaggacttctacaaattaaaatatgtgtaagtatgtatatattttatgaaatagtcaatgcatattaataggtatttacctaagggaaaacccatggtaaaacataaatatgctcaaacctaataaatagaaagattcaaagtaagtccatattttataccatttgatgtctaataagtagtcaaaaatgttgaaatttcataatatcaagtattagagaggtgtgggttaagaattcataaacagttgcttgtaaaaacatttgggaaaaccatataccatgagacatataaaagactgttcttagcaggatcggttgtcttaacaaaaatactagtaatgacgctagtgggtatcaatagaaacatggattaaaaaaatacagtacattcagaaaatgaaatatgttaatatgttacagcagtgaaaactaatgaatccaaatgcacgcaatagcatgaagaacccttaaacatagcattgagtgcaagcaagttgcaacctacttcatttttctaaaattcaaatgtaaacaatatattttgtgataagcatatgtgaggaaacttcttttttttaaaaaaggatctataagcgcttatctcaaaatattaggagaggggcaggaggaatataaaagataggaagaaacgagaatacaaaagaccgattatactagtcaggttctgtttcttaaatactgtggctggttcattggtattcattaagttttccataactcaggattatgttacatacatgattttgatgataatattatataattattgtgtggttaaaacattaaatattttatttctttatgttcatgtgagttggacatgcatctgcactttctctcatcctgctttccctaaggcagtcaataacataactgccaagatttccaccgtggttttgaccaatgatgtggtctctgctaatgagacctgagggagaataattcataaagattggcagagatggtaattttttgtaaatgtgaactgagatttataagtcctttaaaactattatttcagcagtaaggaagtgttacataatcattaagaacatggtcaaataaattttatgggatttctagctctgtaatttactagctgaatgtcctagtgtattagtcagggttctctagagggacagaacttataggatagatgtatatatgaaggggagtttattaaggagtattgactcacacaatcacaaggtgaagtcccacaataggccatctgcaaactgagcaaggaagccagtccaagtctcaaaacctcaaaagtaggaaagctgacagtgcagcctttagtctggtctgtggccgaaggcctgaaagcccctggcaaatcactggtgtaagtacacgagtcgaaaagctgaagaacttggagtctgatgtttgagatcaggaagcgtccagcacaggagaaagatgaaactgaaagactaagcaagtgtagttcttccagcttcttccgcctacttcactctagcctagccatgctggtagctcattagttgatgtccacctagattgagggtgggtctgcctctcccagtccactcactcaaatgttaatctcctttggcaacaccctcacagacacacccaggaacaatactttgcatccttcaatccagtcaagttgacactcagtattaaccatcacacctagggagtgttatttatttcctaattctcggttatctcctgttcacaatagcttctacatcataaggctacttttagaactaaaagaggtaatacgtatatagcactgaacacagtccctggcacatatttatgctcattatatgttacgaatcattatcatcgttccatgcacttatctgtcatataagaggtagatgcttactcttctattttcctgaattgctaaggagaagggatgtacagccacagtgcaagcaagttgcaacccacctcacttttacaaaattcaaatgtaaagaatatatattttatgataagcatatgtgacctgaaatgttttcatttttctttgcaattaatactacttgacaaagttgaaatgttgatactactctaacaatatgttaacttagatgactgaaaagagcacagagactcagatgttaaactgtgattgacagtcaactgacaacaggaagtgcctaataagcctatggtactagtgacaacatggcagggtaccatcggggaaacatctggggcatcaagaaagagagctgaaacaggcttatttttatttctaagatcagaaagcctgaagctgaatcacatttgttaggcattgattcattcttggtagtgagctgtcagcaatgggcaacatcccaggaaagaaaacctctgtggcaataacagagagataaagaaaggaaatattaacaggacattatcctcagtgctctcaaaaaatcaaaatcctgagaggtgaggaattacggaacagttgagcttacatactctagtgtaagctggacctgagtttgacacattactgcgtgacgcagggcaaatttaatttctctaagtttacattatgtcatttactaaatgaggaaaatgctcacagttttgagttgtcaagaggaagaattcgtataaaatgcttaacattgtcattagcaaaagggagggttcagttatttaattttcattattgccatcacttaccatcatcatcatcatcataatcatgattaactgacatccgtagaattttacaagtatagagagcaggcaaaatgaaatttgttatccagcaacgatccttattatttaacaaattgagagaataaatagatattgtctaaaatgtcatacaaacatacatatatgggcattgtcataacctgcatatattacatttcctaaaataagaaagactggatgttgtcagcatgggcttatgtcacattctggttcctttctccagagcaggtgtgtgtgtgtgtgtgtgtgtgtgtgtgtgtgtgtgtgtgtgtgtgtgtgtgtgtgtgtgtgtgtatatatatctctccatcatatatatgaaatgtgataattatgagaaagtaaaatacagtattctataaatagtgacacataaaatagattatatagtcctctgtaccattaaaaaaaagtccaacaagctcaaaacattatgtgttatgttgaaaaattccactagacattcttttttttttttttttttcttttgagattgagtttcactcttgttgcccaggctggagtgcagtggtgcaatcttggcttactacatcctctgcctcctgggttcgagcgattctcctgcctcagcctcccgagtagctgggattacaggtgcccactgccacgtccagctaatttttaaaatatttttaatagatactgggtttcaccatcttggccagctgggcaggctggtctcgatctcctgacctcaggtgatctgcctgccttggtctcccagagtgctgggattagaagcatgagccaccatgcctggtctagacattcttatacttccaaaatactattgaggtgtttttgctacagaaaataacttatctaaaaattatttttaaaaattatattctacatactgatttattttatcttcacctcgataagatcacctttttcattgtcacaaaaaggactacaattagagatcttagttaatcacatatgttttctcatagtgcttatttgtcatggaccaaataaattattactcatggacaggaaatcagaaacttatgttgggtttcccctcaatgggcaatatatttgacatgaagaattgaataaaaaagcaataaagtggaagaatgtatgaaagttctcagaaacaacaacaacattccacagtggtgggatatgtcaacaggagccaattgaaagagctcacaatggcagaagctagaacaatgagaaacaaaagaaagtaatattgaattataacacaaaatataaaatatctatgaatcatactgaagtatatatatctcagtatataaagaaatatattccttctctctcttccttatatatatatatcagtatcaattcatagatacttattttatattttgtgtaatattggattatatataagatatattcaatgttgaatatgtacatatgtattcaataatgtaagtctatatacatatatgactgaaacatacatgtatgtatacatacatatatgattgaaatagacatgtgtgtgtgtatatatacatatatgattgaaagaattactaaaaggagagaatagacaaatttcccattcagagttccaaataatttttgaagatactccgccctcatggagacaaaaaccaaaccacccactgcttaagtgtggcatgtacttagagatttccttccaaagaatcagcacggaaaaagggaaaaggaataattttatagaggggaagcctggcaaacacaatctcgactaagggataaaaatcaacatcaacatgtcatggtgataatatgaatcctggataagctgtgtttgaaatggcactttacctctgtgatctttctctctcaaaccaatatccccagtaagataatgggggaaaaaaatcagaccattgccaattgagggacattttgcaaaataactgaccaaaactgcaaataaaagggaagtatgagaaactgtcacaaccaagagaagctgaaaaagacatgacaacaatgtaatatggtcttctggatgggatttgaacagaccagaaaaaatacattaggtcaaaacttaggaaatctgaataaattgtatactttagttaataacaatatataaaattggttgattattgtgacaagtctgccatatttatgtaagataagggaatctggatgtgggtatatggggactttctttactagcttctcaatttctcttacagtctcaaaccattctaaaatgaaaagtttattttttattattttttgatgtcccaatatctttttattattattattatattttaagttctggggcactagttcagaacgtgcagatttgttacataggtatacacgtgccatggtggtttgctgcacccatcaacccatcatctacattaggtatttctcctaatgctatgcctcccctaggcccccaccccccaacaggcccaggtatgtaatgttcccctctctgtgtccatgtgttctcattgctcaactcccacttatgagtgagaacaggcagtgtttggttttctgttcttgtgttagtttgctgagaatgatggtttccagcttcattcatgtccctgcaaaggacatgaactcatccttttttatggctgcgtggtattccttggtgtttatgtgccacattttcttaatccagtctatcattgatgggcatttgggttggttcgaagtctttgctattgtgaatagtgctgcaataaacatacatgtgcatatgtctttttagtacaatgatttataatcctctgggtatatacccagtaatgggattgctgggtcaagtggtatttctagttctagatccttgaggaatcaccacactgtcttccacaatggttgaactaatttacactcccaacaacagtgtaaaagcatttctatctctccacatcctctccagcatctgtcgtttcctgactttttaatgatcgtcattctaactggcctgagatggtatctaatagtggttttgatttgcatttctctaatgtaatgatgagcttttcttcgtatgtttgttggccacataaatatcttctcttgacaagtatctgttcatatccttcgcccactttttgatggggttgtttgctttttttctcgtaaatttgttaagttctttgtaaattctggatattagccctttgtcagaaggatagattgcaaaaattttctttcattctgtaggttgcctgttcactctaatgacagtttcttttgctctgcagaagctctttagtttaattagatcccgtttgtcaattttggcttttgttgccattgcttttggtgttttagtcatgaagtctttgcccatacctatgtcctgaatggtatcacctaggttttcttgaaggatttttatggttttaggtcttacatttaagtctttaatccatcgtgagttaatttttgtataaggtgtaaggaaggggtccagtttcagttttctgcatatggctagccagttttcccaacacattttttaaaatagggaatcctttccccattgcttgtttttgtcaggtttgtcaaagatcaaatggttttagatgtgcagtgttgtttctgaggcctctgttccgttccattggtctatatatctgtgttggtaccagtaccatgctgtttttgttactgtagccttgtagtatagtttaaagtcaggtagccttgaggcctccagctttgttctttttgcttaggattgccttggctatgtgggctcttttttggttccatatgaagtttaaagtagttttttctaattctgtgaagaaagtcaatggtagcctgatggggacagcattgaatctataaataagtttgggcagtatggccattttcacgatattgattcttcctatccatgagcatgaaatgaagcaatataactcctaaatatattgcatgagcattaagtgctctatttggaggaagaatagaatcttttcagctgggagtctcagcaaatgtttccaggaaagattgaggactgagatcaacactgaaatataaaaattaaccactccacaggaatttttcatttagtaggaaaattccagaacatgaaaatgcctttacatcaaaaaggtccacttttaaattttacagtggcatctccaatatgaacaaagaatatcagtgtcattttcttccccaactatgtatcaagacactcttataacaccctaaaaaagcacatgttcttatttgtcattactatcatttaaataaatctgattattattttgagcaaataataggtggacaacttggactaccacatcatgaaagatttttaaatttgttatctgctctcttgctaaaccttaagaaactttagaaaaaaaagtttgcgttcagatagtaattcaataatgtattaatttattagacaaatgtttgttgagcacccactaaatggcagacaggatttcagacacagaaagcacaataatacctaaagcactgcagtctctcacaagctgatgcctctgtgttcatggcaaggatactgcaggaaggatgtagtgagttgtgggcaaagaaaaaaaatcagatcctttttgatttctatttaggttgaatttgattgtctccaattcaatgataatatggtaacatatgttctgataataaaattagcaccattctatccattccttcacattaagctaaccaacatcacattgtctttatctatctatatatgtgtgtatatattaacataagcatatttatatattttgtcatatatttggctagagcaaataatatatagtttttaaaaaattatctggctttgcatagtttaatcatttggggctaaggatcaagagagagagtgagagatagcatttctctttgttttctgatgtttgtgcagctgttgccactgccttgccagggttttttttttccaaaagggagctactggtatccttaatgccagctggtggcattcttttattaagcaagatgaaaataaaattatctcttcctgctgttgctatagtgactgctgtacttaccatctcccgttcccacctagtaggtggtatataggtttttctggagccaaatatattgctcatggtggcatagttcacatttcaacctggtgcttcatttgtccacagactgttccttgtttatgatgcaaatgatctttctcgtcctcactttctaagaagcaaggtttaagttcaatactattaatctctgttaaatgtaaaggcttataaagacaccagagtcctaaatgtgatgtgaatagttctggataaccaaaacctaaataaacaactggagagtttcaaattttataggtttttttttcacaagctatttttgtttaccacctgcaaaaatctaactacaactgaaaaaaaaaaattcccagtatattatgacaggtaccagcagcaaaaaaaaaaaaaaccaaaaaacaaaaaacaaaaacaaaaacaaaaaaaacaaaaccaagcaaaacaaacaaacaaaaaaaccatgaattcacagcagttagatcaataaattttgagaactaaatatttataaacagacaaaaatagggaaatgacttttggttagctgttccttggaaagttttttcaccttactaataaaatatcaatgattatgcagaaaaacaagtgctagctatgataattttgaaatccaaagtcaaattggagaggatttatataaaatgtaagttacgtggttttggatttagaaacatctaaattttaccttatgaagaagattagctctgcttactgaaaaaacataggaagacatattgtccttcctcatggcataccatcaccatcagtgctactgcccaaagtcaccagagtatttttcttgacatgccccaagcatttacaataatttgtagttagcacttcctataaatatataaggcagaaatcaggtaggcctagaaaaggcacatcgcatttgaattatataaccccagtggataaagtgctaaaggtagggcataaggatattaagaaccttggtagcatcagataatagaattgtgatttttgctgctccccatcagttcagtgtcagtactaggcatccaagaggggacaatgtctcaccttagtccagcagagctgtcctagataaatgtctgctagacctgggaatttgaaaagggctagtcaatattgacattccctatagttagttaccatagaagaagacttgatctgtacagtaagtgaaatgaaaacttctcataccctatctggtggcaaatgtcaaatgaagagatatctcctcaagagacagttaagaggtttcagttcaagatggctggctagacccagatagtgccatgcctttctcatggaaaggaaacaaaataacaagtgaatactaacacttcaagtggattatctaagagatcactttgtgattcaccagggaagtgacaggacccacatagagcagagaggaatgaagccatgaagctgaacattaacccacccagaactggtatggagccgaggaaagctccctaagttgggaaagtgagtgggggaagagtgagtgagtaagagtctcccctggggatcacacttctgccatggacttttgtagttcagctcttgactccctcgggcttccagaacagcagagagctatgtggagtctgtgcagaggcactgctcaagcccacatggaaccaaccccacaagcttttggttttctagcagcccggttccagcagccactgccccactgagaaaggagacacagcatttttccgtgtccctagaatagatggcgcatccatagtactaagaagcagctagactccatactgcgtaagtccttgcctctgcagctccttagtaggtgggactcactggcttgggtccccagcacagcctccctgaatttcctgaacactgcagtcatggctctgtttctctgagtgcataactcccagaggtagctaacaggcccttcactatcactgctgccttcactcctcctgtccccaagccagggagggaacaaggaggtggggcacatttgtggacctccagtatggatgtcatagctgacatatggaggaatagtggtaggcttgtgccccacaagtccctgccttcactgctctctgccaaacagggcttgctgcctttcggcccataacacacttactcatcccctggctgatcactgcggtcatggctctgtgttctgagtacataccttccagaagtagctgataggccctctgtgatcacagctgctgctgtctctgcacatgctgctcccagattgagagagactgaagagatgggtcactttcatgtacctccagcatgggactccatagctgagatacagaggagtagcaggcacgtgatgtaccccacaacttcccacctctgttgttccctgccaaacagaactcactgacttccaatctccaatgcagcctttccacccctgcctgatccctacaatcatgggttattcctctaagagcccagtttcctgaggccagcaacaaatattcacaattgttgcttccattgattctgcccctaccacccccaggccagttcaggagcaagaaggcttctcacctttgcatgcttcaaacaatgaaatttagaactccttgtgtgggagggaggttcaagcacacaacatgccccatagctgtcagctgccactgtcccagctgagggttcctgctcttccaatgaagggcccacgtcacagctgccctgccccagcctgaatatttaagctttgacccagagccctgttaaaaacataaaccccacaggcctctgatattcccttgggatcccaccacctaagcattctgcctgccctgacctgaaagttctgccagtgacccgggtaccagcccatccctccccatcatagcgagcatctgaactagactagaccaagtggaagaaagaacttcaatgcgtaaaaactgttcttttgaactagcccagtcagttgcaaataaagaaaaaaatttaaaaaacaaaacctttgagaaataagagattatgtaatgtaactaaacctacaagttattggaattcctaagagagaaaaagaaaaagtaaacaacctggaaaacatttgagaggataaataattaaaaaatattgctagaggtagatattcggatatgaggaaaccagagaacacctatgagataatatacaagataaacattactgaggcatttggttactagactatccaaggttggtgctaaagaaaaaatgttaaaggcggctagagaaaaggttcaaatcatctacaaaggaaaaccaatcagactaacagtggacttctcagcagagaccttacaagccaaaagaggttggtgttgtatttttagcctcctttaaaaaaaaaatgtcagctaagaattttatattactacaaactaagcttcataaatgaaggagaaatactctttcccagacaagcaattactgagacaatttgtcaccactagaccagtcctacaagaaatgctcaaaggaattctaaatgtggaaactaaaggatgatacttggcatcagaaaatgacagatatatacagaactcacagaccctataaagcaactgcgtaattaaaactccaaaacaactagctaacaacactatgtcaggaataaaaacttacatatcaatattaatcttgaatctaaatgacctacataccccacttaaaacatgtagtggcaaattggataaataaataagatctaatgatctgctgtcttcaggagacctatctcacatgtaatgacatccataggctcaaagtaaatggttggagaaatatctgtcacacaaattgaaaacaagaaaaagcaggttgaacaacagcatcaagtcagaaatcaaaataaaaagtttaatgaaaatagcaacataacatacaaaacctcctgaatacagtgaaggcattgctaagaggaaattttatagcattaaatgcctacataaaaaatagaaaaatcttcagctggaaatgtaatgctgcatctcaaagaataagaaaaacaagaacaaatcaaacctaaatgtagcagaagaaaaaatactagagcagaactaaatgagtttgaggccaaaaaatgatacaaaggatcaatgaaataaaaggttggttctttgaaaggataaaggaaattgatagaatgctagctagcctaaggaaaaaaaagagagaagattcaaataagtacaattggaaatgattaaggtgacatcacaactgataccagaaaaacaaaaaaagatcatcagagactagtatgatcaccttgatgtacacaaactagaaaacctgaagacgtaagataaatagcatagttcctgcttcaataagctcacttattcattcactcaatcactgcttctttcaacaaatataaattaaatgcctattatattctagacacaggcactgatgatacagcagtgagaaacaatgaatttgccttttgaagaacactaattgttttcattcattttgttatttaaagaatattcctagaaattatgtattttcattgtgtggtgactaccgtgatttttttttcattttacaatttctgctttatgaaatcttactactttttatctttattctaatgattctctgagtttagcagatatagaaacataacattcccaagtaatgttaaatttatatctcttttaaacaattttatatcctgtatttttctcatttcacctattctactgaattacttagaatttcaagatcaacgtaaagttgcttctttagtggaaatgcctctaatgtttctctattaagtataatatttgtttcaagttagatagaattaatgaaactaagctgttgagatcttaatttggttctcagcttgaacattattagcgtatggaagtgctactgacttttgtatgttgatttttgtatcctgagactttactgaagtcactaatcaggtctaggaatcttctagaagagtctttagggttttctaggtaaacaatcatatcttcagtgaacagagataatttgacatcctttttcccaatttggatgccttttatttctttctcttacgtgatagctctgtttgggacttccagtattatattgaatagaattagttaaagtagccatccttgtcttttcccagttcttagtgaaaatggtttcaacttttccctgttcaatctgatgttgcctgtagtttgtcatgcatggctcttattattttgaagtatgttccatctatgctagtttgttgagggtatttattatgaagagatgttggattttatccagtactgttttttgcatctattgagatgatcatatagttttcattcttatatctgtttatgtggtggatcatgtttattgatttatgtatattgagccatccttgcatcccttgagcgaagcacatttgatcatggcaaattatctttatgatgtattgttggattcagtttgctagtgttttgttgaggagttttgcattgatgttaatcagaaatattgacctataattccttttttattgtcattttgtccttccctgattttggtatcatggtgatacaggatttgtagagtgagttaggaagacattccttctccttgattttttggaatagttttagtaaggttggtaccggcttttctttgtacatctggtaaaatttggctttgaattcatgtggtactaggctttctttttgttaggagattttttcttattactgattcaatttcattactcattgttggtctattcagggtttctatttcttcctagttcaatcctggaagtttgtatgtttacaggactttatccatttcctctaggtgttctagcttgcgttcataaaggtcatcatactagtctctgtatcggttgtgatgtcatcttgatcatttctgattctacttatttgagtcttctctctttttttttcttagcccaactagcgttctatgaattttctttatcctttcaaagaaccaaacttttacttcattaattctttttatctttttttttttggcctcaacctcatttagttctgctgtaatatttgttacttttttctgctacctttcatttgttcttgtttttctagttctttgagatgcaccactaggtttctaattaaaaatcttatattttttgtgtttactgatttatgtatattgagccatccttgcatctctggaaaaaaaacacatttgatcatggtggattatctttttgatgtatttctggattcagtttgatagtattttgttgaagatttaatgctataaactttaatgctataaacattcctcttaccattgcctttgctgtatcccagaggtttttgtatgttacatttctactttcattcattaattttttttttatttctgacttgatgttgttgtttaacatgatcttttttgttttcaatttatgtaatagatatttctacaaccctttactttgaacctatggatgtcattacatgcaatgtgggtatcttgaagaggtcaaatgattagatcttatttatttatccaatttgccactatatgttttaagtggggtatttaggttatttacattcaagattgatattgatacatgatgttttgttcctgacatagtgttgttagctagttgttttggagtttcaaataatttatttacatcttaatactccctttttttcatcactctgtttcccagctagcctcatacatgtctctaaagctttatatgttactatatctttatggtcaaaagatctctacagtgattcagaatgtcggctctggcatcagacatcctacttggaattttgcctctattatttactaattgtgtaacattgggcaaggtacatagcttctctgagcttcagtttctcacaaaagtgtctaactaaaaggatattttaataagaaatgaattaaaacacacatatataaatattcattgtatagtgtgtggcaggtagtgagtattcagtaaatggtagctatcatcatcaccatcttgtctccattgtcaatactttttaaatgttttgggtgagatgacattagaactataaactggtaagattttctgagaacttcttttggtcatacattttctattttttttttcttgaaatggagtctcactttgttggtcaggctggagtgcagcggcacgatcttggctcactgccacctctgcctactgggttcaaatggttctcccacctcagtctctcaagtagctaggattacaggtgtgcaccaccatgccctgctaattttttgtgtatttttaatagaggtgggtttcaccatggtgaccaggctagtctcgaactcctgacctcaagtgacctgcccactttggcctcccaaagtgctgtgattacaggcacgagccaccatgcctgacctggtcatacattttctattcatgagcatagaatggtttatttttttctaaatctaaattcagctcaccactgagatttattcattcaggaatatctattaagtacctaatatggtgcttggcacatatgcatgcaattaatattagtttaataaaggaaaaagctgtgaattaaaaaagaaaactgaactgttatttggtatacatggtgctagatgctggatacaaggatacatatgctacctttttatgttatttaataatggctgtcatttattaagggttcagtgtaagttaaggtctgtttttggataaaatgcaagcgttatcccctgacaatcattttgaggtaggtattgttattcctgttacacaagtaaggaaattgaggtttatctaaggttacatggttaataagtggaagagatgtaattcaaatccatgtctttctgattctagaggtcaagcttttatacattgcagatgtgtaaataacttgacctcccaccacaatgacatgaactggcaatacggaaaagtcattgactttctaatagtagaagattagtaaccttttctactcctgctaattttagtgaaccagagcgtggatctactcctctgtttttgtacagcccgcaagctaaggagtttttttttttttttttaacatttttaaatgtttgaaaaatccgaaagaataacacttcatcacatgttaaaatcatataacagtacctacattataccctcaattttgccttttgccttgcaaagcttcaagtatttactaagtgaccctttctagaaaacatctgcctaaccttgaactagactatttgggatgcccttcagtaatgtgagtaatgcttatgccatagttgatttacagaaaaaaatgtatcactagtaaatagacatattagtcctacacagtttctggaactgttttcttacacttcagtgcaaaagagctagagcaacaacaaaacagaagcaaaaatcaaaagactactagtacattgggctgatgcttcatgtaaaaatgagattcattctctcaagaattaatttatataattaatgaaaaattccacacaaaagtaacctgttaaaaataaatgattttaaatacccttttaaatgtgcagacaataaactgaatccttccttaaacttgagtattacccaaagattattttacatactagttgagcctaaatgaagatcacaaattaaaactttctgaaataattaaaagataggaaagaaagaattgggccaaggacggggagcagatttgctttaaggcaaggcatgaagtttttagccaagatgtaagataagttgaaaattgatcactagtcaactgagttatgaaatgaaacagcttccaacgattttttaaattaaacatggtataaattattcagatagaactgttgagtttatagcttataagagaaaaaatgcaaatctatgttacttgattaaactatacaacagcaaatgagctaagggaatcaagaaagcaagcaatttacttcttcaggtacttgatcaggaggccaggactattgtgagtgctctgcaatacacgaatgaagttgaaaacaaatttggcagagcaaaacactcaagcacacatatgcgaacagcataagaattcctgtaaagggctgtttagatttttactttggttatggtataaccataaccaaaaccgtaaccatagtataatcatggttataccataaccaaactaaaaattcaaaacagtcctttacaggaattcttatgcagtttgggactggattggatttgcaaagggaaaaaaaaactatttctttatgaaaatgcagttatcaggttgaaaagcataatgttatactcacagtcaaactgtcttaaaaatctactcaccagttaattatgtttttctcattggatatgtggaaaagaaataactgtgtcatctagaggggctgttctaagtagagtctagtggaggcaaaaattgcctgaggagttgaaagaaacatagcagagggaaatttctagtagataataactgccatcacccttggtcagaggaacaccgttagctttaaaactatggtagtttccaagaaactctaaatataatttttttagagagaatattttcaaactattcatctgacaaaggattaatatccagaatatccaaggaactgaaataactcaatagcagaaaaacaaataatctgatttacaaatgggcaaatgagctgaatagatacctatcaaaacaagacatgcaaatgggcaccagataaaagtattcaacatcataatcatcagggaaattcaaatcagaccacaatgagacatcatgtcatcccagttagaatggctgttataaaaaaggcaaatataacagatgctggtgaggatgtagagaaaggggaactctttttaatgatatttttgttttcttttattgcttgcaaatattgtatatagttctatcatcatatatagataattttgtatcttatatatgctttttattatacgttaagttcttgaatacatgtacagaatgtgcaggtttgtaacataggtatacacttgctatggtggtttcctgcacccatcaactcatcatctacattaggtatttctcctaatgctatcgctcccctagcacccaacccccctccccaagcccggacaggtcccagtgtgtgatgttcccctccccgtgtccgtgtgttctcattgttcaacttccacttacgagtgagaacctgtggtgtttggttttctgttcctgtgttagtttgctgagagtgatggtttccagcttcatccatgtccctgcaaaggacatgaactcatccttttttacggctgcatagtattccatggggtatatgtgccacattttctgtatccagtctatcattgatgggcatttgagctagttccaagtctttgctactgtgaatagtgctgcagtaaacatacatgtacatgtgtctttatagtagaatgatatataatccttttggtatatacccagtaatgcgattgctgggtcaaatggtatttctggttctagatccctcaggaattgccacactgtcttccacaatggttgaactaatttacactcccaccaacagtgtaaaagcattccaatttctccacatcctctgtagcacctgttgtttcctgaccttttagtgattgccattctaaatggcatgagatggtatctctttgtggttttgatttgcgtttctctaatgaccagcaatgatgagattttcttcatatgtttgtcggctgcataaatgtcttcttttgcaaagtgtctgtgcatatccttcacccactttttgatgggtttgtctgttcttttcttgtaaattagtttaagttctttgtagattcttgatgttggccctttatcagacagatagattgcaaaaatatccctttctgtaggttgtctgttcagtctgatgatagtttcttttgctgtgcagaagctctttagtttaattagatctcatttgtcaattttggcttttgttgtcattgcttttggtgttttagtcatgaagtctttgcccatgcctatgtcccgaatggtattgcctaggttttcttcaagggtttttgtggttttaggtcttacgtttaagtctttaatccaacttgagttaatttttgtataaggtgtaaggaaggggtccagtttcagttttctgcatatggctagccagttttgcaaatagcgtttattaaatagaaaattctttccccatggcttgtttttgtcaggtttctcaaagaccagatggttgtagatgtgtggcattataattgaggcctctgttgtgttccactggtctatatatccgttttggtaccagtaccatgctgttttggttactgtagccttgtagtatagtttaaagtagggtagcatgatgcctccagctttgttcttttttcttaggattgtctttgctgtacgggctcttttttggttccatatgaaatttaaagtaattttttctaaatgtgtgaagaaagttaatggtatcttgatggggatatcattgaatctacacattactttgggcactatggccattttcatgatattgattcttcctatccatgagcatggacgccttttccatttgtttgtgtcctctgttatttccttgagcagtagtttgcagttttccttgaaacggtccttcacatcccttgtgagatatgttcctaggtattttattctctttgtagcaatcgtgaatggaagttcactcatcatttggctctctgtttgtctgttattggtgtataggaatgcttgtgatttttgcacattgattttgtatcctgagagtttgctgaagttgcttattaaggagattttgggctgagacgatagggtttgctatatatacagtcgtgtctcctgcaaacagagacaatttgacttcctctctgcctattcgaatgctctttatttcttcctcatgcctgattgccctctctagaacttccaatatcatgttgaataggagtggtgagagagggcatccttgtcttgtgccggttttcaaagggaatgcttccaccttttgcccattcagtatgatactggctgtgggtttttcataaatagctcttattattttgagataagttccatcagtacctagcttattgagagtttttagcatgaaggggtggggtgttgaattttgttgaaggtcgtttttgcatctattgaggtaatcatgtggtttttgtcactagttctgtttatgtgatggattatgtttattgatttgcatatgttgaaccagccttgaataccagggatgaagctgatctgataagctggtggtggataagctttttgatgtgctgctggatttggtttgccaatgttttattgaggatttccacattgatgttcattaggaatattgggctgaaatttctttttttgttgtgtctctaccaggttttggtatcaggatgatgctgccctcataaaatgagttagagaggagtccctcttttctactttttggaatagtttcagaaggaatggtaccagctcctctttgtaccactggtagaattcggctgtgaatccatctgatcctgggcttttttttggttggtaggctattaattactgcctcaatttcagagtttgttactggtctattcagaggtttgacttctttcttctttagtcttggaagggtgtatatgtccagattttctagtttatttgcatagaggtgtttatagtattctctgatggtagtttgtatttctgtgggatcagtggtgatatccactttgccattttttattgtgtctatttgattcttctctcttttcttctttattaatctggctagtggtctattttgttaatcttttcaaaaaaacagctcctagattcattgaggtttttgaagggttttttgtgtctgtatctccttcagttctgttctgatgttagttatttcttgtcttctgctagcttttgaatttgtttgcttttgcttctctagttcttttaattgtgatgttagagtgtcaactttagatctttccagctttctcctgtgggcatttagtgatattgatagaaataaatttgatttttaacattaggcagagtatccttgaattcatacaatatagaagagtaggcatttaggtatagtgctacttatgctacagctcttcaaactgcagagcaccgtcaggaggttggggtgggtatttttacattatagtcttttctatattcttcaaataaggaacaaaactatgttgtccagttgcctattattttccaaaaagtgtatcctggaatcttagaataatcccctttattgttacgtcttgtaatacaaagattggggctgtatacatatattattaaaaatatttttactttatttaaaaatatatcttttattatatgtcaaacactataaaaggctttaaaatgtaattaattatgatgtgaatataaagtcttctaatgtataatttaatagatatatatgacacattttctcaactgtaatggaagaatattcatttcagcaacttttttctatgttaggtttctgagataaatcatgctaaaattacagaaagttgtaaagttgtaaataagtgggatgaatttttatactgataacattgttttgctcttagagtatcaaatcaattatcaaaatataacatattttacttgctattcattgtaataatgggtattaggaaaattctttcataaatgtgaacctacccattgaactaagttcgaaattataggtaatataaaattacacgttgaaaattgttctgaactgacagtcataggctgtgagttaaaatcatgaagtttttagcatctagagatgtagtcccagtgtgaaaaactatcttgcttcaggctaaatctggctatacaagtgtttttgtttttttacacttgcagtgtaagagcagaataggcagatagtccaatttaacaaaggctgaagttgtgccaggggaataaaatgaagggagaaaggggtaaggagtcatagtagtaggcaagaaagtaattatataaggaaatattatgaaataactgaagagggtagttaagcgtgaaagcttgagagacaatttaatacatctgcaagttataagaattgctatactaaacgattttctggttttactatgacatccttttctcatcataatggatttgtagtactcaaactctctgtgtatgttgtatttatcctttcacatttttctttttaatgcttagctttaaaatttcctaagatttttagtcaattaagactgatctgaatttggaaaaaaatgaacttagaagtaaacaaattaggattattatataattgtttatgtagatgttagaaattttatcaaatgtataaaacctctgccagagttcatagactatattcacattaaacacactgatatacaactttttcattgtagattagttatcatttgtattattcagtgttgaagtagctttttgtaacacatgaaatacaggagaaaagacctaagatcaaaaatatttttatcacattctgtggacagtttatcatttcacaaaagcatttgcaatttactgtttcacttatgatgtaattaaaagtgtctttttcaagggaagcatatgctggttttctttggtttcttttttataatccctttggaggactgattaatgtctgataatatgtaaagtgaaaatggcaagccatagcaagagattactcatctgacctgttatatataaccagagaaaaaacggggctaatgaaagtttcattacaatttgtcattatctttacagattttccttcctctttctccagctgaatcttaattcaattcttatcttcatataatggatgttagtatattttttgagatacctataattagctcaactgatattttggagagacagtttttattaaaagttaacatttcctaaaggtgatatgttgtcccattcataggtgactgataacaaatatttaaaagaattatagcattatcaaatcaaaaccacaatgagataccatctcacaccagttagaatggtgatcattaaaaaatcaggaaacaacaggtgctggagaggatgtggagaaataggaacacttttacactgttggtgggactgtaaaccacttcaaccattgtggaagtcagtgtggcgattcctcagggatctagaagtagaaataccatttgactcaaccatcccattactgggtatatacccaaaggattataaaacatgctgctctaaagacatatacacacgttatgtttattgaggcactattcacaatagcaaagacttggaaccaagccaaatgtccaacaatgatagactggattaagaaaatgtggcacatataaaccatggaatactatgcagccataaaaagtatgagttcatgtcctttgtaaggacatggatgaagctggaagccatcattctcagcaaactatcacaaggacaaaaaacgaaacatcgcatgttctcactcataggtgggaattgaacaatgagaacacatggacacaggaaggggaacatcacacaccggggcctgttgtggggtggggggagaggggagggatagcattaggagatatacctaatattaaatgacgagttactgggtgcagcacaccaacatggcacatgtatacatatgtaacaaacctgcacgttgtgcacatgtaccctaaaacttaaagtataataataataaaaaaagaattgtagcattatatcatgtggtgtaataggaaagtatttaatcaaataattttattgattaaaaacattgtaaaccaagagtatcataatagctctagatttttaaatgctaatttcaaagctgaattagtcactttgaaaactcaaatcttttctgctgtgagttcttattcttgttacctaattttagtgaatgtcagtgtcctaatcataaatggacataataagccctcccatatctgtttacaagttgatcacagacccacaagtttacatttgccaataaaataccaaaaaccttcatttttctatggcttttctgtcaaggtaccattcaacactcacatttttattttaagaactattattaagaatcttatttgctctagagtgtgttatggtagccattctgtgcagacaaatgactatgtattagagaatgctaatttaatttttttctcaaaacatgtgtaagaactgctttttctattcttcctcagaaactggtctttaataagatgtccttattgaagattattttaaaattcctaaaattagtgtggtttaacttccaaacattgaattgcttttgtcctggtatagtttttaaaactttagaatcaatcacattgactttgatttgccaactctattaaatatatgactgcagtgaattttttacttgcttttcacatagaaaaacaggaattagtatctacttccaggaagcctggcatagagtaggtatgttagtagctagtgtaactattttcattcatttccttttctctcttttctcttttctaaacatttagaaggtcaaaaatagtttgtgaatgaagtttgactaatttttattatagggtatttgcatggaatgcaaaaaaatttacagtgacctgaataatcctgatgatagtaacaggaacaatgaatacagccaatggaagacttcaatatgcaatcactttgcaagtgaggcagcaaataccaagtcagtattacaaaacttgtccgttgtttttacagaagtcatagaaattaaagttgaaggcctctcatgttgagaagccagctcagttccttaatctttcatataatatatatgacactcaaatgtaattaatgaaactttataaaatttgtctctgacacttagtctaatataatttgccttttcaatggtctttttgtaaaaagtcaaaatctcaattttataaaaaattttaaaatttgcattaaatcgtatctgtgttcacagcacttttagagaattaattgagaatccttggagcactgatagtctaaaactcattagggccacctacaggataaatgtatagccacgaatacctcagtattggcactccattcctcttcctttttccaaacacacctcctataagctcaacattgccacttattcagaacagacttaagactgggaaacataagtccaggagacaaatcaaccacagcgttttacttctaattgtatagcttttattctcctgtcttgagccttttcctcactcctccccaataactaaaccaagctattatatttaacatacgtaagatacaagatcagtgtccagaatctcttatgtactatctcttttgatagtttcaggtactctatttccctccaacactttaaaataatgctttttagggaataatttttgaaatatttttcaggtgtttgtgtgtgggtacatatagctcacattctacctactcaacatgtctcaggaggttaaaaaaaaaaaaaagaaaaataactttctgagtagtttgccaagtttctctgccaactctattaccacgtgttatctttatgaagtctatgaagtctttcaggagaaatccccttaggattgggtatatctctaccttgttttggctcctcttaagtttagagtcaaatttgtagccaacttccaataatttacaacaatatatagtgtatattcctaaatacttgttttgccctgcagccttctcaccatgcttattttgtcttcacctagaattcctcaactattgttttatttgtttacttattattattgaggcagatacatattttaagctacctcaaatactttgtggaacaatacagggatgaaaagagtaactgaagaatgtcaagaaggaaggaagacaaggcaaaaaggaagaggaagaggaaggaagggagggaaagggaagaaaaaaggaaggaaataaaggaaaaatctaaagtctgtgtgtatgtgtgttcatgtattaatagctcccatttagagaaatagtgtgaagtgctacatggtaaatgttcatggtatgtttttggtcactcatgagtgtggctgtgacaagctgagctttgaggatttgggcttatatacctatttggtgacccagactcctgtgagctatgaaaagttggcccaagtaggtatgattaattcatttatatatgtatatcctttacagtttttctgcataaccagtacctaacacagtttttaatatatagtatgcattgaataaatatttgttaaataaattcataaaatggttcattttacatctgatcaatatggctcaaatctcatatcccaagtctacactccatcatctaaagctcttaataacatctattattgtatgtttttcatagttttttttttttttcgtagttcttctaggatgaataggtgcagtaattctccaagctacagttctagttacagctcttcttttaaaccctgtgtgagcttcttaactcagaaaaagaaaggtcagagcaaagacaaagtctagggccctgtgacttttgatcacaaaatttctcatcttgtttcttaagttgagtatttgtaaatgtgccttatagtaagtccagaaagatatttatttcagtgtgtaatttgaacctgaattttagagtcttcgtattgtgatttttatttttactcccttttattcctgtaaaggtataaaatagaacacacgaacatgtatttttgaccttgtgtaattgcaataaaacaattcaagccaatatctataaaagcacttggtcttttttccatttatcttcttggtacatgtaacgtgtcatctattaaaataacatgatagacactgaacctgcacatacatccaccgaagtatttcaaagttctctgattaaatacctccaaagaaattaactcctttctcttcttagtgagagatgaacaaacagttaaattttcactcaggctattcagtctaaccaccatccccatcaaccaagaatttttttacataaaccattctgccttagatcaaccatcatcttgcttggtacagggaccacttttacattgtagataataatgtttcacttttctttatggtaggaaagagttaagtgagaaatgtacataccccatgaaagtacagacttctttttagtatttatatgtcttcaagaaagaaaaaaaaaatctactcacaatataaaaaaatctatttatctttgggcttctggtgctaaagttcccaggaaataatgacacagagacaattctatgaggaaatgttgaattttgcttgtattaaaagctggtacaaaataaagcaattggagtgaagtatcatcttttgggtcattgggatctcaaaacacaatttaggtcatagttattctataattttcttttctttgtgtgtttaatttctagggcatgcctgtacttcaattcctcagaaataggcattaatttaggactgttttctattaatcttgtaaatacaataggttgatttgaaatgtcacaaaaataagcataatataaacttgtagtaaatggattgaaatggatatttatgttttagagaccattttaaaaattcagttaaaataaattgatatcccaatgaccttccagaatttgtagattcgatgaagatgaaaagaggaaagtgaaaccacataatccctagagatattaaaatcaagcatggtggctttcccctataatcccagtactttgggaaacagaggccagaggattgcttgagaccagtgttggcaacatagcgagactctgtctctacgaagaatttgaaaaattagctgagtatattggcatgtatctgtagtcccagctactcgggaggctgagactggaggatttcttgaccccaggatttacagactgcagtgagttatgatcacatcctgcactccagcctgggcaacagagggaggaggctctcaaaatatacattaaagtcctgccacaaccactgcctaactatcttgtattgtatttctaggagtaaagtaaaaggaagtcaaattagaaatcttgccatgctttgatttcatattaagatcattttttggaaaaaaaagcctctaagaatcagtccttttgagtttaaagccatgatttgcatatatttgtttgtttgttacagacaatcatgtgtatgttgtattatctcatacatatgaaattcaaaaagagacaagcataatatttggtaatagaaatcagagcagtaaccttgtaggtacatatatttgaaaatgactgccttgatttttactgctactgaagttagtgtatatatttttaaagtaacaatcccccagaaaagtagaactagaattgctctttttcttttgtcctgctactttatgaaaagcttaactgtttataaagaaacattgaattttgtataaaatcttaaacacattctgcaataatgaatacttctctgtttctttatttggtgtcatgtcttcactacttattagacccccatgattttggatgtgtttaagaagatttggttatacattcagcaaaataattagtaaattcttacccatctcaaaaatataatgtatagaatttttcttagattgttatagactagtaatttatctccttcatatccactagtgtattttcttgagtgttcagtttatttgtcaaattaatattaaatttgaagctctaccttgtattgctacaaagcatattattttagcatgaaataattaaaatatattttaaaaatctattttacaatttgtgcctaatggaagaaatggcagaacatttctaagaagcatttcttatcatggaaacatgatttacagacccagaattctgggacagtttatttataaaaatattgaactcctaccatttgcaataaagtagtctaaaagttgtcttattgatcaacctatcccaggaaaaaggaaaggagcgtaagtactgagatataaatagtttaataagcaataatagaattacaatttaaattacacatcattcccttttggaccattttctttttaggaaaatcttttcaaattgtgtaaatgcaacatagtttaagggaaggccattgatctccaatactataatcccttttacatagaagtgaatatttcgttaactaatactcccagactaatcaaaatggatgagagtagttaattcacagagcccattctaggctttcataaaatgaaagtcacataactttcttattcacatttatagaaaaagaatgctttttctatttttactatattttgttagagcatacaagcctctctaatttggcatgctcatgcttggttttacacatcattcttagcctgacatataatgaagaagccggtgggacaccaagtcctctaaccagttctgtttctcttttcactatgagagaatgggcgttattggtagtagaaatatcactacgtaggaaatattataaaaaatgactctttgtgttaaaaatgctatactccctagcatctatactggcaacttgaatggactgtaaataaaaataaagagtgtggtttttctatgggtggtatagatttatttccattgtggtatttaaaattagatgatgtagatatatgttaaagccttcttgtcactgattaacaaacaaaagacaccttgtgaagataacgatagaaagtaagtacaagttacaatcatagcaattctttacattcttttctgccttggatctaaatgttttattatgttgacagatctgggaaattttagtggccggacaagaagtgcagtctctgtgagggaaggccagggtgtcgttctgatgtgctctcctccgccacattcaccaggtacagtaggatctcattctttgctgctgctgctgctctcttttgctatgtgttcattcttttagacagtatattgatgggagaacatttcaggtgaaatgtgcatggttttcttgacatctatcagagtgccagatgagtaattcaagatcacgtactctaaatatcattagacaggatactgaactccaataagattgttttattgccattctaactgttaactgtcactgttatgcctctgtcttccatcagtgaagaatatattgcctagagcacaaaggaagcgataaactgagagaatgaaaacttttcaaaatagtttggagtatcagagttgagttaactgaataccaatatgcgtcttgtttcaaaagataaactggatacttagttgtttatggtgctctttgccacactggaattagaacttctaagaaatgctttttttgagtttcaaacaaaactgcaatttagttagtactttttggctctttgaggtcttgtttgtaaaagtcatggtgagtactttatgtggcttgaggaagcagaaaactaagctctgctcagattaattatacgtccttttgcaagcttacacctaattatatctattttgtttgagtttcataatttgagatgagtactcctttggaacttagtatagctttactataagttaagagtgaccagcatcagttaaagagagagagaaagagaaagagcacaaggaagaaccaaggaatgaaggccttaattaacaactggtaacagaattgaaggtcttggtatgtcagtaattttttcttctttaattagagtgatggccatatttgtttctaggttatattatcagggtagtaatggagcacaatttggctctactgtacatatttttttaataacaaaatggcctacattgattttcttaagacttctttatctttatctgatcccccttctatatttttaatcgaaagtatgctgcatatcaacagggacatatttttgaaaacacttttatttgaaactcagataataattacaattagggtaattattgtttgagttgtacccctccaattgttgagttgtaccactccaattcctgtacaccagtccagttattctaatctttctgtgaaaggtttgggaagtttacattaaacatatctattcttgcctgcatctaaatccagatttaggttctttcaagacaacatctgttttaatttttttaatggataagacaaaaatttttattacatttagggaaagtgtatagcattaatataagtcatgtctcatattggttattaaacagatttcatccaagggggttattagttgaataattgttagagattgcagaaaaggggaaaagaaggggaaggagaaagagaatataacaggctttatagaggatgactgatccatcactagactgacaggagttaacaacataaagtgacccctgtgggaaaataagcaagattttctgagatatgatctttattttaaggctggggaacgtgtatttttaaacaaagtgaaatggaagaggataatatagaagtcaaaacttcgggattacacataaattatccaattggcagagaaaactgtatacagatttctggtgggagaatatagtacaatgaattgcatatatggtaagataaacataagataagaataggcactaataactgattaagtaataatgtgatctctgattgagatcaatatatgtaaattaaatgactgttcagtaatcgtgttttacatccgaactcatctgcttgaccaaggccaacttgatatgttattaccacagctgcagtctctcaattgccatatttacaagcttcttattttctgaacagcatccactgtcttctactcacccctttagtaccctgattgcaggagtcctttcatgtcatggaaatctacaaatcattgatcctaccctattttcattctactccacctcctttgattcttacttttctccttcagttattatcatattcttttatacagcttcaattttgtcatctctcttttgctttcgcacactgacattccagtttgcaaaaccctaatcacaatatagatccaactcttagcctacttcacatatgaatctattcagtttaatattactgttaaacaatcccaaaaaccaaagcacacatacaaaacaaatgaacaaaaaaccagttatacagactgctgtcaatttaaaataaaaatgatgaactttacatcttaatgttaactagaatttttttaaaaacctattatttttactatacttttgtcaaatgttttatgtgtcttccccagtctcactctcaggtgataaacatgcatcctattacgttgtgaaagagaaagcaattagaaaataacctccacaagctctcatcaccaagtcacacaccaattagcatttgtagccatacactctgacttcccagtttttagtatatattatagtatatagtacagtatatggtacagtatagcatagtgtactatagtagagtataagtcagatacaaaagaatttccttttcaaaggtttggcttattcagcatccctgttcttcgtcccctacttccaaggccacactaacttccttatcctttgttcctccctattttaatttcagtaaacaactttcccaacagtccttatttacagagcccacatttgctacccactctgtaaattacccctcccatcgcaacagcttttcctgctgaaaccgcccttcctgccagtgtaaccacattcctgcacctttcaagttagccagccaggttcagcttagattgtgcagtccaactccagccagtggaggcaggacacagtagcagggataagctgcattaaggataaaaaccccttcctgcctttgtttggtgtgctctcatgaccagacttgggagcagcattcttctgcagaagcaaattttgccttgctgagaaatcctgtctttacgtgctctttttcttgcgactccaagctttacttccaacggtatagtatagcatatgcatttgttgcagttctaagactaatctctcaacttgtgtggcgctgtagttcatctttttttgcctactttaagaaattgtttcagcagtaccccttcttctgcatttttatcagagtttgattcctcttctggagcagtccatcaacatggaaacctgctattctttcctccatataaaaataaaacaaaggaaaactccatcggccaatgccctcttcattcagctactacatgatttttggtttccctttacagtaaaacttcaaaaactttgtctttatatactctatccaattctattcctctcagtcagtctgtgtgtttctctctcttccccctatttttgtctctactctctttctaacagatttattgacatgcaatttttatcccataaaattcacgcattttaagtgtacagttcaatgagttttggtacatttatataattgtgccttcatcaccacaacttgaaagatacttccatcatttcaaaaagtcattcaatccctctcctactcatgtccctaggcaatttttgctatgctttctgtctctatagttttgacttttctagaatatttattttattttattttattttattttattttatttaagacatgtttttgccatgttactcaggctgttcttgaactcctaggcttaagtgatccgctcacctataatcccaaagtgctgggattataggcatgagccactgggtccagccagaaatttcattttaatgcaatcatacaatctgcaatctatgtatgtgcacgtctgtgggtgtttggtttcttttactgggcagaatctgagattcatctgtatcatggcatgtatcaatagtttgttgctttatattgctgagtagtatttcattttaaggacacattccattttgtttatccatttggattattttcagttctcatgtgggttatttctttctccataaaacactattttcacttagcttaaaagattcctcactcttgatattcctccactctttcttcttaatctcctttgctgatttgtctcatctcctcaaactcttaattttatagtcccccaagtgtcagtactataacttcttatctccttaataaactcacactttgttagttttcacctgataataaagctttaaatatctaaatatctaaaatctccctaacatacatctctaacccagactctggcttgtatgtatatccaactgcctatcagtatttggctaataggcacttcaatcttaaccatgtctaaatctgaactcctggttatttcttccccaaaccttctctagctacagtcttttccacctctattaatagaaatttcattctgtacatcaggcctcagagccattcttcacttctcactttctctacaccctacatacaaaccatcagtaattttactggtgtcagcccactttctggtccatagacaacttcttgctgtgtactcacatggtggaaggggccagacagctctcttgggccttacttataagtacactaatctcattcatgagagcttcactctcatgacttgatcacttaccaaaacacttgccaactaataccagcacattggcagttaggatttcaacatactacttttgaggggatataaacattcagaccatagaaggtggtatttggagatggggcttttttttagttttatatgaggccttgagggttgggcctttatgataagattaatgactttattagaagagacaccagagagctctctttctctactgaatgtgagaaaacaaagaaggtgtccatctgcaaaccagaaagaaagccctcatcagaaaccaaccatgctgtcacctaatcccagacttccagcctccataactgtgggaaaataaatttctgttgtttaagtcatccagtctgtggcacgttgttatggcaacttgagcacactcatgcaccatctcattcagcttaatatcaaagccaaagtccctaccatcgcttggagaaccctcgccatttgcctccaattgatctgtctgaactcagctactgctttccctcctactctctttcttgtagttattgtcatttccttgatgtctcaaacaaccagacaagctcctaccttaaggcctttgcagtcgctattccctaggcctggatcatgtatatcccaggtatatgaatggctcactccctcacatccatatctttctttaaatatcaccttagtaaaaccttttacaatcttcctcttttgatttctactccacaattcgtttctccatctttgctttatttttctccgtagtactcacagcattacatatactgccttaatttttctccataatgctcctagcattccatatactgcacgcatttacttacttcgttgttcatagtttgtctccttcggttacaatgcaaattctactaagacataaattctgcaggttttgttcactgttattaccccattgcctaggacagagtatgagctcaaaaatatttattgaatgaatctatgtataatattcagaaatatatgaaatgagcccaggttttaataaatatcagaaactttgatggaaaagtcataaataagaataggaaaaaaacagatcagctatgtaacaagaaaacctttcttaaaatttacctttttctcataattatattgtgaaatggtgcattaattttaatgtcttgcttatttgcttaaaagaagaactttgaaactctcttgggaaaatatagtcaaaaaagcttgctgaagaaacagaatatattagtccattttcgtattgctgtgaagaaatacctgataccgggtaatttataaagaaaaagaggtttaatggactcacagtttcacctggctggagggcctcacaattatggcagaaagtgaaggaggggcaaaggtgcgtcttacgtggtggcaggcaagagagcatgtgcaagggaactgccctttctaaagccaccagatcttgtgagacttattcaccatcatgagaacacaatgggaaaaattcacccccatgattcagttacctctcactggatccatcccacaacacgtagggattatgaaagctacaagtcaagatgagatttgagtggggacacaccaaaccaaattacagaggaagtgagaaaagaataatccagggtgaagtttctgatctgacatttattagcaatgacttcaacaactgcctttgtttgggtggaatgagattgatattatgaaattagtaaataacctgatacgtgctagaaatcttagacccaagtttctgtttcatccaaatagtcatgtagattatcatagcatacttgttcaactgatgcttgattgcattttgtttcccaatcttgttttacttccgtttttcaaatcataattagtttgttattttatctattggaacaatacaatgtaaagtgtcaggagtcaaattttattatttttatctttccaagtagattatatgttctttcagtatatgaagcttaccaccttccacttcatattcccaatacgtagcacagtgtctgatccttactaggtgttcattaaacgcatgttaaataactgagtgaaatgcagattctaacagttgagttttgcaaggttttagacagtttctgtcagccttctggtattagctcattgtatcctatattcatgacagatatttgggtcacttaatatcacattcatgtattgctatttcaaattgtagcagctactatgattcagtggaagctgtatgaaatgataaaacagtttacacatcagagaatattaaaaattattcagaaacagcccacagatccattttcttattacctcaaatagatgtgcaatgcccatttttcttcaaataaaagcaaaagcttgaattgacttgatagctaaatttctcagttttcttcccaagagatcaatattaatctctgtcagcaacatatgtacatgaaaataccttgtttggatactgaggtggttattcatctataagacaataaatatatatatttaaaatgttaagcacacctagcccaaatgagttttgattgccaaaaaacgtgtttttcagtttagtaattttgaaattgagggttatattgtaaaggaaggctttgtgaaaatgtagaaatagcctcataaaacctataaacctatataaagttattttactatttagaagctatcatttatagatactttctacataaataagtcatttattactattttacttacatatttgactttattatgtacagaaatattcaaaagcttacgttgaagtggtttatttactttggggtatatacccagtaatgggattgctaggttgaatggtaatctagttttagttctttgagaaatgtccaaactgctttccacagagactgagctaatttgcattcccatgaaaaatgtagaagtattcccttttcactgtaacctcaccaatatctgtctatctaatctatctgtctgtctatctatctatctatctatctatctatctatctatctatctatctatctgacagagtcttgctctgttgccaggctggagagcagtggcatgatctcagctcactgcaacctccacctcctggcttcaagcgattcccctgcctcagccttccaagtagctggtaggtactacaggcgcacaccaccacacccagctaattttttgtgttttagtagagacagggtttcaccatgttggccacgatggcctcaatctcctgacctcatggtccgccggcttctgcgtcccaaagtgctgggattacagacgtgagccgccacacccggcatctattatttttgttttactttttattaatagccattctggctggtataagatggtatctcattgcggttttcatttgcatctctctgataattagtgatgctgaacatttttacatggttgctggctgcttgtatgttttcttttgagaagtgtctgttcatatcctttgcttactttttggttttgttgcatttgcttttgagaacttagtcatattttttttgcctaggccaatgtctagagagtgtttcttaggttttcttctaggatttttatagtttgaggtcttatatttaagtatgtaatccatcttgagttaatttttgtgtatgatcagagatagggatccaacttaattctgcatatggttagccagttttcccagaaccatttagtgaatagggtatcctttccctattgtttatttttgtcattttttttgaagatcaattggttgtgggtatgcagctttaattcaggggcctctattctgttccattggtctatgtgtaccagtactatactgttttggttactgtagccttgtagtatagtttgaagtggttatcatgctttttctgtggtttatttgccctctttttactttcacctatttttattaatatgtttttaaattgtaattttccttctattcatttcaaaatttaatattttatatgctgttttcaaaattatatgtaaaatcttaatatagctatttaacattatttttgaacagtttcaatgcagttgtttttggtgattaatgaatctgttcattcaaacagaatttgaagaagtaagggtgtgtaaatttctggctctatgaaatacagtacctaagaaatggagaatttggtttaggataggaaaagattagttgagttgtgaatacatgaagtcttatatatctataggtagctcagaaaactggatataaatctccagttcttgatacacctgactcccataaagtgcaaaaccatagacaggtatatctcacttaaatatgctctccaaacaatcagtttctctactatcactcctccagttataggtggaattgtggtggtatgcatatccatcagggggaatactagtgttgtatgtacattggatctcagagggaaggaaaataaaatcataataatcagttaagtaggaagcgccaaggcaactggagtaagtgcataaagtgagtatttgcagactaaacttattttatttctgcatataagctttaagccatcatagaaaatagctgaatttataaagtaatgagctatatagcgaagcttaatcctgagcactcagcaaacatagtgtataatgcatttggttgtccttttaacactccttcattgtaaacactctaacatatagtatatccagtttggaaataatagtcaaaatgcaatggacactgaaggactaaagatgctgacacctttctagctgctaaatctaagcaacccctcattccccttggccttgagactccttggaagtattggttagagtagagcaaagaggtcttcagtttttgtgtatgagctgtaacacttcagctggggcatttcctattaaagaaagaaagaaacaaaagagataatttttgttttgtgggttttttttttcttttggattctaaatacttcttcttcaacctagtttaagacaggcagacaggttcaccattctcaaaaccgttgtaaagacagataagatataagtaaacaaatccagagaatataagaggtagtcccaagaacactatgatgaaggaataccagatattctctgcttctaaatagctatattgtaccatcatatttcacctgggatttggtctcagacatccagggattctcatcctggctctgacatttaccattggtctgtctgttaaattaagctttaccttgcctgtagcgaaggaataataaaagctacctcacagcattgttgtcagaattaagaggtagtttatgtaagataattagctcaatggttggaggacagtgagcattaaattaactttgtcttgataatctgtcttcaaaaaccctctttaaaatgcaaatgcttttgagaaaggggttgccttaaatcattatctgctaacattaattaacagttggcagagattagttgacatcaagctgacaaggcaactagaagatgaatggcacttggaaatgggaatctcagagtttaagaaggggaagggatcaagaaaaggaaaaatgaatcctgacagttaagtgaaagggcatcaagtatcattgctatcttcaggagacctctttatcctaaaataataaataaataccagaaattgttcctttaaagctatataaaatggcaaccaaaatttcacagaggtaaaaacaaaatatttttgatggtagttttatttaaaatgagattttacattatacaatgtaaatcataatttaaaatgatgtaattacaacaagtacaagaaaaatggacaagacttttttggcatctttaatcttacaaaatagtaagataccatgatactccttgcttcaaaattaacttttataccacaaacacaaaaagtaattgttccaaaaatatttaaggatttccacaaatttctaaagatttcttagttgttttatttcaaatcactatatattaaattacataagatctttattctgtgagagtttatcacacagactttcattttttgataattttgctttattgattgaagctgttttccaaatgtgtctttgttaaattaatgaaacccacaacttttacaagatttacagttttactttgaaatacgttaatgttgtattcttacattttataaataacttatgcaaaagatattggcaagatggaaatacatagattctaggaagtgtaattgagtgagactaattttaaaagtaatcaattagtcattattatgtgattatgacttcttttcctaaaaggagcttgtaattagggttacttgagttatattatttggacacagagagctctatttttaagttttgcctagaattagccatctctttggataaatggaagcaaagaaaatcagtattttacattttatgtatcctattctatctttatccctgttttataagtaagttattgttaccaccacattgcaaatggtaatattgaagctcagagagcaagttgcctaaaatcccatggctaataaataaaaacacagagatccaggtctgtgaattcaaaccctatgtccttttgactatatcatatggtccttacacattcagtatattgtattgtattagtgcattatcccgctgctatgaagaaatacctgagactgggtaatttagaaaggaaagacgtttaattgactcacagttctgcagggctgggggcctcaggaaacttaaagtcatggcaaaagggaaagcaaatacatcctttttcacatggtggcagcaagaagaattgccaagcaaaaggcggaaaagccccttacaaaaccttcagatctctggagaacttgctcactgtcatgagaacagcatgaggataactgctctcatgattaaattacctctcaccaggtccctcccacaacatgtgaggattatgggagcttcaattcaaaatgagatttgtatggagacacagccaaatcatattattccacctctggcccctctcaaatctcatgtcctcacatttcaaaacacagtcatgcccttctaacagtccccaaaaatcttaactaattctggcattaactcaaaagtccaagtcaagtcttatctgagacaaggcaagttccatcctggtatgagcctctaacatcaaaagcaagttagttacttcctacatactatgggggtacaggcattggataattacacccattccaaatgggagaaattggccaaaatgaaggagttagaggccccatgcaagtcctaaatccagtgggacagtcaaatcttaaaggttcaaaatgatttcctttgactacatgtccaacatccaggtcacactgatggaggaggtgggctcccatggccttgggcaactccgccccttacagatttgcagggtacagccccctctcagctgccttcatgggctggcattgtttgtagcttttcaaggctcacattgccagctgtcagtggacctactattctggggtctggaggacaatggccctcttctcacagctacactaggcaatgcccaagtggggactctgtgtgggggctccaatcccacatttgccttccacactgcctcagcagaggttctccacgagggctctgtccctgcagcaagcttctgcctggacattcaggcactcccatattctgaaatctagccagaggttcccaaacctcaattcttgacctctgtgtacctccaggctcaacaccacatggaagatgccaaagtgtggggcttgcaccctccgaagccatggcttgaactttaccttggccccttttagccacagctgggatgcagggcaccaagtcttgagtctgcacaaagcagcagggccctgggcctggcccacaaaaccattttctcatcctaggcctgtgggcctgtgatggaaggggctgctatgaagacttctcacacgctctggagacattttcctgattgtcttggtgattaacatttggctcctcattacctatgcatatttctgcagctggcttgaattcctcctcagaaaatgggtttttgtttcacattatcaggctgcaaattttctgaacttctatgctctgtttcccttttaaatgtaagttccaactccaaaccttatctttatgaatgcataaaaccaaatgcttttaagagcacccaagtcatatcttgaatgctttgctgcttagaaatttcttctgccaggtgccctaaatcatctctctcacgtttaaagttccacagatccccagggtgggggcaaaatgctgccagtctctttgctaaaacatagcaagagtcacctttattccagttcccaacaagttcctcatctccatcggagaccacctcagcctggacttcattgtccatatcactgtcagcattttggtcaaagccattcaacaagtatctaggaggttccaaactttcccccatctttctgtcttctgagccctctaagtctctaggacattccaaacattcctacatttttctgtcttcttttcagcccttggaactgttccaacctctgcctgttacccagttgcaaatttgcttccacatttttgggtatcctttcagcagtgccccactctccgtggtgccagtttactgtaatagtccattctcatgctgctgtgacaaaatacctgagactgagtaattgataaaggaaaaacgtttaattggttgacagttctgcagggctggggaggcctccggaaacttacagtcatggtggaaggggaaggaaacatgtccttcttcacattacagcagcaaggaaaagtgctgggcaaaaggagggaaaagccccttataaaaccatcagatcttgtgagaacttactgacttcatgagaacagcatgagggtaactgcccccgtgattaaattatcctccactggttccctcctaagacatgtggagattatgggagctacaatttaagatgatatttgggtggggacacagtcaaaccatatcacctattgttactggtggcaagtctgaacagggtccttggtcctcgattcttgtcctgttggaagaaagaatttggccaagaagaggtagtagatttaaggcagaaatgagagtttattgaaacaaagaaaagtccatttggaaggacccaagttggaaactcaaaagattgactgcctcgcctgatccttagctcagtgctcttatagacttattatttcctgctttttatcctggtcttttccccttgtccttcctgttgggcaggatgttggctaatcgcagtatgtagagtgacttgccagtgtctgggaggggccacatgcatcatttggtggttgaggttatctgcgtgctctcttagagcagttttcccttgccaatctagctcccccagaggaaggtcatatactgatcaaactgccattttgctccttactgcatatgcctgaatatattctcagaaaaaggtcacaatctgccattttgtctcttactgtgcatccctgaacatgtcccaagaggaagatcaaattccaccattttgacccttactgtgtatgcctggatgtgtttgttcaattcctaggatcttactgggagtttgttgcccaaaagctcaaggtgtttcctatgtgttaggaaatgttccttcccctcgtgccagtcttgaccactcatttctgaggagaccgcctgacaattgcctgacagtcacctgacagttgcctgatattctttggggccctattctgccctgttcatatctgcctatctacctactctaacaacatggtctgaaattttactaaaaatgtttattttgtgtatacgtaggccacttgttaacatgtttgttatgccaattcaaataaacaagagatttcatcaattattttgattgacttaactaaattgttgtctgaattaaacatttaatgcttcccaaatcaaggatataaacagtagataaaaataaacacatacacacaaacacacacacacacacacacacattttagtatttttaccaagtaaaataatgcagtgcttaagtgtctattttagcagttatttagaagccaggcaacatagacaatacaaggatattgaaggaaatgcttgagaaataaaggaattatttatttttattatatcatgtctgttttcctttgtgagtaaaaaatgtataaattatatactctcaaattaatcagaaaaagactgcttcaacctaaactgtgttgtccattgaagcatttgtaacaagtgctttaactagttacttaataatatctgaatgtagtgcttatcaacagatacattttgacattattttaaaatctgcagagatcattttaaaaatattttactttaaaatatttcaatagaaaaatgttttgttcttttcattgcttttcctgtacttaattgtaatatattttccagatatcactagaaaggaaaactcaatgtgtttcagagtctttagttttttaaactatctgacaaaacttacacatggaaaactaaactatcacaaagcaaacacttcaatatggagtttgttttagaatatttagacacagcataaggaaaaagacttagaacactgcaataaccttggttttttttacttagattggttagggattttgacatcaagcagctctagtttacctaattatttttgattgtttaattggatttgaccacatagtaaaaggatttgacccaagtccttaaaatagcctatttttgtttcatctttatagtctacacagaaaaatgtaaaaaataatggatcaagaaagcaagcaactcactcctttgataactggttcccattagtgggaataactagtgtttccatgttacgttcatttggtttggccaaagtggtcaaccagtcaaattagtatgttaaatgcagacaagttagtgtgcaatatttgctagtagtgcttgctctaaaactgaaggcaggaagaaagaaatggggtaacttatgtatgggttgagcatgaaaaatgtggatgtgtcagaatgtctggaaagttacgatatccttctaattccagagagtatctaagctagtcctccctatctgtcatatgatgatatatttttcatatgaatttatcaccatagaaacctccaatatctccccatcacctgtaaattaactttaagttccttaacctggcactcgatccttttttgagtctcctgtatagtttgccatttgactatgaagcacctaagcttctgtttatcttactcactgtattcatttttttcagcttccttgcctttgatcatgtcatttccagtgccagaaatgcttacccatctcccttatgcacttttgttgaaacgtgtattttattttattttatttttttgagacggagtctcgctgttgtcagcccgggctggagttcaatgggtcgatctcggctcactgcaaccttcgcctcccgggttccagcaattctcctgcctcagccttctgagtagctgagattgcaggcacccaccaccacgcctggctaatttttgtatttttagtagagacggggtttctccatgttggccagggtggtcttgaactcctgacctcaggtgatcgacccacctcagcctcccaaagtgctgggattacaggcatgagccactgcacccagtcaacttgtatcattttttaaagtacataccttaaaataactatagtatatgtatacatatttcttgggctctagggtcagaaggattcaattttgtcacttatcagcaatgtgactttggggaagaaatataacatgttcttaccataattcctcattttcaaaattttacatgtatatgctgaaagatttaatgagatgatatatgtaaagtattttacccagtgcctgcttcttggtaaatactctataacttagtgatgatgatgatgatgatgccctcttcattttatccgtttatggttaacaaagtaacaaaggatttattcttctctcctggccccctgcttcctcattagcattcctaagtgcctatgaacaagttttcttctcttgtctaaatcttgtcacatccttcactgcacaacagtcatttatgacatcttatttttcctactcgatgtaggctactgaggcagtcccagtatctttgtatcttttatagatttgctgacatagccctggatgttatcaggtacttgataactactgtttattaattgttctaaagcaaataatgaggcctgagtaccccactttaaatagttaattttgtatatttcaaaagataatgttacctttctttatattttttcaataaagaaatatagtgatgtagttatttgatcacatataatataaatcttactctagagaaatagaaacaaatagaaaatgttatcttcatttaggaatttcaattaatgttctcagttggcaaattaatatttgagtcaacccttttctctttgttttatgtcacttattaaatatggatcatttttaattagttttattgaggtatattaacatataatgaacatcagcaacttttaagtgtataattcagtgaattaagataaaagaagtcatgtaaccactaccataatcatggcatagaacatttccatcaccacaagaagttccccagtgctcttccctttccaatcaatttttcccccaattctcatccctgatattcattgatgtgatttctgtccctatattttgttttgtccagaaattgtttttgaagaaattctacagtatgctcctctcacttggcataattttgagattcaggcatgttgctgaggcagttagttgggtttttcttaaataattgctgaatatttcattgttgcaatatattaggttggtgcaaacgtaattgtcgtttttgccattaaaactaatgatagaaccacagttatgtctgcaccaaacctaatgcttcaggtgtttatccatttatcagttgatgtacatttcagctgttttcaatttttgactattatgaataaagctgctatgggattagtatataaatcttcaagtgaagaggtatatgtctttgtgtgattttatgttttcatattataggtgcttacttcattttctccatgaaagtaacttgctttcagcatttatatctgtggagctataggaaaatcttgttattaccctttatgttgctatcattctatgtttgaaaatttatacataattttgatgatagtatatattgtttgcagcattttggaatgaaatatatgtttttcttctgtgtgaatttggggactttatagcacatgtattttcctcctttcctagttagcattctttccatttctgtctgaagaaatcaaatattagtcatacagatgccattacaatgaaagtgcaaacagctgtggttatatttacttgctttttctttctcttagttgaagaatctttttcttaacccagagttcagctatatctttacagtttctagacagaagcattagaaattgtaaccagccacatatattaatacacatatttttgagtttaaataacaattgacagttgttttaaaaatctcaatttatattggaggtccacgtgcacgtgataaaagcaatcaatatatatataattgctatatttgtctcatataaacattttctaaattattcgtatcccccaccacctccatttctttcaaagaagtagaaaaaatagtttaatacgtacaacgattctataatgaaattgaaaatcaaaatatgggcggggcatggtttctcatgcctgtaatcccagcacaaggccatggtgggtggatcccctgaggtcaggagttcaaggccagcctggccagcatggtgaaactctgtgtctactaaaaatacaaaaattagctgggtgtggtggtatgcacctgtagtcaggaggctgaggcaggagaatcccttgaacatgggaggcagagattgcagtgagctgagatcgcaccactgcactccagcctgggcaacagagtgagactcagtctgtgtgtgtgtgtgtgtgtgtgtgtgtatatatatatatatatatatatatatatatatatatatatatatatatacacacacatatatatggtgattagtcctaaaacaatacaaattacaaatgtttatagtgaaaaagtactaatatctagaaaatggaaatacatctccagcatatatcttcacatagaaatatatcttcacatagatgtatatctatatcaatataattaaattttatacgatataaaaatattaataaattagcaaacacctgctattgttcagattctatgaatatatgacctagaatagtgtattgaagctagccattgtcaaccagggttccaaaagaaaattgagccctatagaaaatgatatgattgactgttttcttagttcccccaagaatggtacgtaactaaaatcattctaaataaatagaagataagttagtttattacatataatacatgccttaggaccttagagattaggtttttttcaccgagcattatattataaacatcattccatgttaaaaattatttaatccccaatttttaatggctgtatgtattccagaaagattatttaatctctaatctgatactagaaatttgagggcattttcaaaaatatttcttattgtaaattgctttgcaatgaacattaatagagaaccgtgtgtgtgtgtatgtatgtatatatatgtgtgtgtgttgtgtatatattatatacatatatgtaattattttttgataccaaatttctagtggtggaatttccttgtgagagaatcagtattaagtttgttgataagtattgtcaaactgtctttcaaaaagagtgtaacaatataagttagcctcacctagtcatttgtgcactagttttgaatctcttttctcagcctgctggtaatctttactattaccctttgctcaaaccaatgaactttaagttgccagactactagttagtcttctgtagaggaggttgtgtgtagagcaaagagaacaagtatatttcctagcctttcttttatcctaccatgctggaattcagttcacttttagttttatagagggcattcattgccattctctcacgtatgttttgattcttcctgtctacttttacgttgtatttccaccaggaataatgaatcctatcccttccatcaaatctatttcaagaaagacactttgcaaagcagaagggctccaagagcacagctctagtctctcttcaatgtttataaggcacagtcattatttttacccactgctgaaaacatttgcaggggttattaaaaaaattttttacctaaagatactaaatagcaggggttgcagacataagcatccacctgttcactggcttattcacttaaaatataacaagcatgttgcctaagcaaatgtccagtaagttttctttctgttgtttgcgtttagtaaagttctaaaactatacaattttctctttctttccttcagactataataggaactgggtgaatattatccaattaattctgttacacaaagggccttatcttttttcttatccttattttcaaaaggacactgcctgctacgtgcttagcaacaagtagtcttttttttgaacaagatgagaagaaatccagactatcctataacagtggaagagttgtatgtaaaccttattaaaaagtccaaacaatatcaaatagtataggcttatttctctctagcttgctgcaaggttgacatcccagagaggatcagggcatatggggagtaatagtcctgcagatcaagcagccagatgtgactaagaaaatgatgaaagtgaaatctgaagcactactgtcattgttgtctcatcatatttataaacaaaacattcctggttgagatggaagtcttttgtgttaaatgtagggttctccttaaatattaacaacaggcaaggcagggatatgttataagagttaaatgtaaggttcctcttaaatattaaccacaggcaaggcagggatatgttatagaaatgtacatttcattagcaaggaaacaaccatgatatcgatggagttcttaccacatgagacgcacagggatgattaagtgtatgtaatacagtacatataaggtaggtctccatattttattctcctgctaaaaacactaaaggaaaaagaaaaaaaataaaacaggatcttgagctagatctatgatctttctaaattaatttagttaagatagctttttcaaatggattccttttacaaaacatgttgttaagcagagttctttagagcataaaatatagtaagcggtgtaactgtaattagaatatgcccatgtatgatggggagacgaaagtcagcacctaagagctgcagttctgagatctctctgcaaagctggtctggaggatagccatataaatgcgttctcttatgctgttcttacacattgcaaaaaggcatgaagctaacaagcatcgaaaatgagtgccgttagacatggtggatcattcactggaaccgttcttcccctcagggagaatgaaagtctggagagagaaaactggctgacctcgctcaatcagcacagtctgaatgcaggcagaatggccagcggtgacagggctgtgcttcggagatgtgtgtgctcaggctgcggttcaggttatgtcaacaaggatcactctgggtgccattttagtggctccatgttgtacataagagaaagacggaaggagaaaagggaaaactgtgggccactttaaatgtacttgagaactttgcttttcacttaggacatgaactctctctcagcctgtaagcagctgcagctcgaagcttgacaaacaggccaggaagatgggaaagtactctagtagcagcattgcttctccagtggaaaaccgagagtcctaaatgttacagtgcttcagcctgaggtttaactgatagaatgccttgatcttgaaactgaaccaggcatcagtaaactgtagaagtttagcctgttgtgcatagaagatacaactttgcattttataccttttactgtgtttaacaaaagaaacaaaacattccaaaaacctcttattaaatacatatcctgctttctgttttggaagtagtgtttgtatcatgcgaataggctctaaagcttttaaaatatatattctctattctaagaatggatctaacaaaataaatcaaaaggaattttatttttaaaggatttgatggaggaaagggtgagatctgtgatacttatagcttccaaatctgtaggttcataggacaagtgactccctatgcttggaaagtcttcactattttaattacattctaggattctagttataaaccatacccatgtcttgtacaggaaacaaaatacataatttcatcaatccttcgtttcaatagaataaaatgaagataaacaataatattattgcaaataatagagactgcttagcaaaatatctgacacatagtaagttcttattatatacataggtactaaaacggttactatgtaatatttgagagacagatttattcttggagcaatcagctcttagatctatctacccagggaatcatggcacataatgggaagtacaagaagccggtaatagttctgaattattttaagccatggtaaatgggagaaaatagagtattaattcaataccagttgaattagaataaccttgaaatttttgtcctgatatatagaattgttctgtctcaaaaatcttctttatctaaaagatattctaaactaataacataatcaatttagtaaatgcttgcttgctagacaccaagccgcaatctacatactttacttaaatcatttctatgtaatagttacaaaataataagaaaaatatatctctacttctcaaatagggcaacaaagactgaggaacatttagtaaatagtctaggtgatagaaataataaatggtaaaggaaggatttgaaaaattttaaactggaaatttgctttagaaaatctaattgccttatatctgaattagtatttgtatgatttgactcattctaaattatgaggtcttacaatttattactctttgtaaacactgaaacttgtataggtttgcccacagtagactgactaccttttattgagctgatttatcaaccctccggtgtttctaatttctgtattctaaaaaaaatttaaaaagatgaactcataagtcaacaaaataccttaaaatggtgatttaataatctgaacatttctctaacaatgtaagaaattgatttctttcttttctatttagttcagatcacaagtaccttaaatactcgtgcaaattgcttcttcctcctttattatgtttactataaatttgcgtttttcccattatcttgaagtaatttatattagcttcattttttagcgcaaccaaataagttctagaaatacatattttgttattttaaaaacgtgaaaaaataaaattaacctcaaaatgattgagtaaaaagaagtcagtttaatgcattgattcagaattcttcacattatttgcaagtctgtatctctacaaggtaaattatttatgcagaatcaaacaactgaaaaactcttttaatgcaaacttttttctacaatgtgtaagattttataaaaagaaggaaaaatgacaatctaatagtgtccatgtgccactgtatcaatagtcaaccaaatatttatttttttaattattttgatatttaatagaaaaaaatagggcccaaatcactaccaaaacatgatctgaatcattaccaaaatattaagctatattttgacccattagatcaaaggtaaataagtcccttatcattctgtgctgtgaatatgattgagtcctaatttgaattcagtttaggaaacggtactgagaacctcctctatatgtttgtgttatggaagtaaaatcatgaaggaggtattgtgttctgctcttaaaaataaaatgaaaactcaaagcagttagcttttatctgttgatctatctatttttaaaatgaaataatcaccaaataacccaaatggttggcaaccagaatatttcacttctggattagttctcaaccaggaatgattttaccgtcaggatacatttggaaatgtctagaggcatttttaatttctttaataggagcagggggaggagcagcaggatgctatcagcatctagtgggtgaaggtcagtgacgctaatacacatctgcaatgcagaggacagtctctcatgacaaagaattatcagcccccaatgtcaagggtgctgagattgagaaaacttgatctagatcatatggaggttatgcattaagatgatattttacatcaacattaaatttatgtaatttgtgctctttagcttttagatcctccaaatattagtattagtagagattgctgactctttgaaataaagagacaataaactaatgaactaaagtaaaactggaaagaaggcatagaccatgagcctttccaagaggagtatagtatttcaaagttattaacatttaaatggccacataaaggctagtacctagtgttctcataaagatactcctacatcatttaatcataaagtgtttatttaggtacagtattacaacgacatcaacattattagtatccccttagtcaccttctacatatgcattttcatctcttccttgataaaattattgatgaaagtattggtgtatgagacagttcttgtccactttaaaatacagttatgttgtgttttaaaattttggcagtcttagctgagaacttcattagagagttcataaaatcaatgatgtgtgcttaccattccaccacaaagatctaccactggaaaatatggtatttttctgcagatagattaaagcatacattttgatggaatttccttgtaattaaaggaaagactcaggctaagttaaaagtaatgcaaaactgtacaaggaagcaaaatctcaaaatggtagtcttgatagaaaaataattaatgaaaaaacaaggatggcatgttttgtattaagaaatattcaccctaaactgaatcagtttgaaaaaggtagggaaaaacattgggacatagaaatgtgcttacaggtcttccagttcatttaaaaattttatacgtttcattaattttctctcccacttccaacatttgtgaaagcaattaataatcatattgttgcctctataaattttatttatgtcaatctaacgggacctatacaatttagctagaatactggaattggttcaagtctcatgtccttatctcaacatatctacctatatattaggatacatgcattcccagggtttctagaaaaacttccagacaaatcattttaattattttatttatcatcttataaagaggtaaactttacccaatataatagtttttaaaataattattttatggcacatggtagggaaacattttactgtctgcatttattttattttttattcattcaaaaattatttattgtgtaccagccactttttacactactgaggaggtatggtaatggacaaagcagataaaacatagtcaagatttcttccctaagaaaacacttactgccacgcaagagataagtaatagaggtaaatacataagacaaacacacacacacacaaagagaaagagagatagatagagattgattagattgattattgatagttctagttaaggtcagcaaatccataaagacctcccacagggagtcatttgagcagagacctaaaagaagttaagtaatgagccatgcaggtaactggggaatgcgtgtttgaggttaaggtaaaaattattgcacgtgtcctaagttggaaactaacagcagggccagtgtggctagggtggattgaagaaataaaagacagtgttgtagttaaaaagagtcaggcaaaatcatgtcagtcctaatagagtttataagtagaacttataaatttagtctattaccaagggttgaaataggatgaaaagaaaacacctgatttcactaaacttaaaataaccaaacactgcattcatcatcagaaagggcttcataaactacttactggatactctagtgagttgaaaactgtttttgaaaattagagtaataatacccattagcaatttggggcaactcaagatagctccaactatctttactggtaacataacactcttttcaaaatttctaaaattaaattaatttaaataagtttatttttcacctgtatgccacgtttgcacagtaagtgtatgacagagttcctgctctagatgagtatgtgatctggtagggaagatgatgcatccagagaactatgggagaacataggaccactacaagaggaatgtgttgtgtggatgatggaaagggcgtagggagaccatataatatatataaataatatccaaactggatcatttttgagaatgaaaagggggaatattaatattctttctgggaaaactggtgtaaattggcagtgttgtaagcaaactggtgcacgagttaatgatgtatctacaaaatttcagaaaagaagggtgaattgtaaattaatgtgactttttaaatctttaagttctgggatacatgtgcagaatgtgcaggtttgttacataggtaatgtgccatggtggtttgctgcacctataacccataatctaggttttaagccccacatgcattagatatttgtcctaatgctctcccttcccttctcctccacaaccccgacaggccccggtgtatggtgtccccctccctatgtccatgtgttctcattgttcaagtcccacttaggagtgagaacatgtggtttttggttttctgttcctgtgttagaatgctgagaatgatgaattccagcttcatccatgtccctacaaaggacatgaactcattcttttttatggctgcatagtattccatatgtaccacatatggaatatgtggtgtatatgtaccacattttctttatccagtctatcattgataagtatttgggttggttccaagtctttgctattgtaaacagtgctccaataaacatacatgtgcatgtgtctttatagtagaatgatttataaatccagtaatgggattgctgggtcaaattgagtatctggttctagatgcttgaggaatcatcacactgtcttccacaatggttgaactaatttacattccctccagtaggttaaaagcgtttctatttctccacatctttgtcagcatctgttgcttcctgactttttaatgatcgccattctaagtggcatgagatggtgtctcattgtggttttgatttgcccttgtctgataaccagtgatgataggctttttttcatatgtttgttggccgcataaatgtcttcttctgagaagtgtttgttcatatcccttgcccactttttgatggggttgtgttttttcttgtaaatttgtttaagttccttgtagattctggatattagacctttgcaagatggatagattgcaaaaattttctcccgttctatatgttgcttgttcactgtgatgatagtttcttttgctgtgtagcagctctttagtttaattagatcccatttgtcagtgttcgctttcgttgccattgcttttgatgtttcagtcatgaagtctttgcccatgcctatgtcctgaatgatattgcctaggttttcttctagggtttttatggtttaaggttttatgtttaagtctttaatccatcttgagttaatttatgtacaaggtgtaaggaaggggtccagtttctgttttctgcatatcgctacccagttttcccaccatcatctattaaacagggaatcctttccccattgcttgttttcgtcaggtttgtcaaaaatcagctggttgtagatgtgtggtgttatttctgaggcctctgttctgttccattggtctatatatctgttttggtaccattaccatactgttttggttactgtagccttgtagcatagtttgaagtcaggtagcattatgcctccagctttgttgtttttgcttaggattgtcttggctataggggctcttctttggttccatataaaatttaaagtagtttttttttttctagctctttgaagaaagtcaatgatagcttgatgggaaaagtattcagtctatgaattacttcaggcagtatggtcattttcataatattcatctctgggacacagctaaagcagtgttaagagggaaatttatagcactaaatgcccatatgagaaagcaggaaagatctaaaatcaacaccctaacatcacaattaaaagaactagagaagcaagagcaaacaaattcaaaagctagcaggagacaagaaataactaagatcagagcagaactgaaggagatagttaagaacgtatctcaaaataataagagctatttatgacaaacctatagccaatatcataccgaatgggcaaaagctggaagcattctccttgaaaaccagcacaggacaaagatgccctctttcaccacttctattcaatgtagtattggaagttctggccagggcaatcaggcaagagaaagaaataaagagtattcaaataggaagagagaaagtcaaattgtctctatttgcagatgacatgattgtatatttagaaaacctcattgtctcagcccaaaaactccttaagctgataaacaacttcagctaagtctcaggatacaaaatcaatgtgcaaaaatcgcaagcattcttatacaccaataatagacaagcagagagccaaatcatgagtgaactcccattcacaattgctacaaagagaatacatacctaggaatacaacttacaagggacatgaagggacctcttcaagaactacaaactactgctcaagggaataagagaggacacaaataaatggaaataatgtgactcttaaaaccttctttgaggcagtagtacttgtacttggattgtgtccaagtgtgcaactgggcagaggaaggtgggagtgcattctagtctagggaaataacatgatgaaagacacatggatttgagaatcgcccaatgtaaaatgaagcattgatgatagtgaagagtgggtgatagtatcggatggttaagaaagagatgggtacaggtatgacagcaaaccagactatcatagattttaaattccatgacagagttccatatcagagagccatttaaggtctgttagtaggcctgtgacctgtataaagagtaaaactactcctaaactgcaatttgatatgagattggaatactgcagagcaacatatactataaaatttacagatattttagttctgcataatggataatttttgcatggtaaattggaacaagaatagaatatgggtgtatgactgtcctgcaaagtcaaatgcctcttttatgtatatatgtagttttaggtaagaggctatgttttatgaagtttttttagaatgactgctaggatgattctgcatagaaggtaaacatagcaaaaaataaaacctctgtgcgtgtgtgtgtgtgtgtgtgtgtgtgtgtataggctagaattttcaataataatgacattttgagcacttactatatacctgaaataatgatgttaacacttttttttctgaaatttcccacaaaatcctacccgctcagtgttattatcatttcatagatgaagaaacagaactgaagaggccctataaacaagctcaagactgcaaagctgctaggtgatggtgcaaatattcaagcacgtttttgcattggtataaaggcatctttttctatggtgccacattaccttacacgctcatcgagttgagccccctgtgtctcagttcttccccagaggtctcagctggaatacgaatctaggcacttaatacacatttcatgtcactctactataatataaattgtgttactaacaccagtgtttaagctttttattttttcactacaaagaaggcataagtacaagcatgaaaaaaaaaatctattttcttaccctgttcgttgtttgacataaagtatctagatttttcttgatttccagtttaacagtttgtgtgcagtcacaatttctttgggtgatccccaccaatcagtatctctcgatctcatctttaacggtcatctcctaaatcagtgttttgtgaataaatttattcacctaacaactggtttgtattcttgaaattttcagtaatccctacagatatacagttctcctatttccacaactataatattgtgtaactctcctgggttccaagaaaattatagtatttttatttaagctataatagtttctagtcttgagatttgggaaaatatcaccgagtcaatcaccagaattattaattaacctacaaactaggaacagaggcttagtgggaaaaatatattacagagcccacacttgtggagaatacacaaaacacatctgagtgatcgatactcaacaaagaagtctgaacacgtttagattttaaatagtcaatctctgctgtatcttggaattagaaaaactgataaagactgacagtatgggaactgaccaagggaaagccagtttagaacaccaaatcctagaaaactactgggcaaaaaagtaagagaaaggggaaaaataacttagggagaatcaacaatttattattccatgaaaacctttcatccatgtatccatagtatgtatattacatatatctctgatagaacatgaatgttaggttcaaaacagtggccactcaattactttaaatatgacaattttttccaagatatactttcttttttatgtgttctttaattgtttaaatcccctattagtactagaccttattattttacagctatgcaaatatcaaaatacatttgcaaaaaaaattgtctagtaagatatgatgatgtctactttgcaaatatattttgatgataatttgatgaaattaactacatcaatttcaagattatgaaattaatgtagatataaacgtaattataaaaattaatatataagcatgattctacatgattatgaaaatgagtatgttttacattataaatgtgattatgatataaacaaaattagaaaaaatataaacatgattataaaaattaaaaactatgtgattttacagagaaaccccttgtagaataagaaagaaaatgcattcttaatagtttttgtactatttatattactagcataacttgtaccaatttttctacttttgaaaaagaactcaactaaaaaaaaccccagccaaaactttcatgttatgtgcatatgaattaatagtaatttaagatttattacagtgattacatatcaacagagataaatatgtgttttatgattaggttttttttttttttaaacaggtgagcaatagggacaaattcttgatgtagaaaataaaccatttcagtgcctgttgataaatagacagtatccactatttcttcatggtgcatggcaacgtgacaaataaattaccttcattaaagatttgcatgaaggattaatgagcattagttaagccataaaagcacaaaaaacatttttgaaaaattacattgaatataagaataagttgaggggcagacaatctcgttataataatttatcttgcctgaagattctctgctgcacctatgtgataaatgaagcccaaaagcaactcaagttccacatttaacatagaaaatttaggcagttcacaactctagagggttttgtcctctgtgactcacctacctataagggggacaatttataaaacacttatttgtttctgttagtattcagactgcaataaatcttcaaattttcaccataaaatctgcataacatgaaattaaaagaagttaagcatttttaaaaattcatagtgaaaaaatgttgagtgttttaaatacctgccttatgaattttcttttgcttttaattcatagagctaagttaaaatttaattattcgtgttatgtataaatgacaattatcctttggataaaaggtaatattttactaagtaaaacacaggaatataagaaaactttattttgctaaccgaggtcttaattttccttcatttggaatactgtccaagattaaacctttctacgcatcaaacactgtcatcttgtggactgccattgatttcagaaaatacaggctaatttaaaaattattatctgtgcgacttttcatggtaaaatatttggacaactctgtaaatcttaatgtaagtggagatgaggaatagtatccttgtttgtaactgtgcaataatgaagcttttacatttatgaacatctgtatttcaggtccccgtgctggtattttatagtaggtctctacccagcaggccacatccttactgtttgatatggttaagacttgcatggcattgtgaccatggtttaattacagtgtgacttaatggttaatagaaataatcaccagcctgcttttgttctggtctggtgagtgaaatctagacaccgctctaattagtcactatttcaaacatctaacttttatttgcaaaattacatcccatgcatataaacctcaatctagtaaacatttgaaaccactattcaccaggtttccttttctcttttcaaataaagatcgatgctttgtaataattcttaagttattggcaactctatgtcttagttttcccatttgtaaaataaggttacctattcctatgagaattaaatgaattaatatacatagagcacactgcctggcacattctaagtgtggtacacatttactagattgtattggtgctccatccagaccttcacccgatgcgtgcgcacatccagcagctgctatgaagattggctgcttcctcttctccagaaaatttgccacacctggaaaatcgtgcttcctgccctcattgcattccacctgccccagccagcagctaataacttatggatacaggggagagggtgcaaatagcctttgctgatactctttgccttcttttgcctcacttaccagtgctgcagtgaaagttgtgtttgagaaccccaagtgggatcaatcttaagctaatctccaacagggaccacatccctggttagctttatttttttctccctcatcttacctcgcttctcttagtttttcctcctggaaaaatgttgtcaaatcatatctgagagtcctcttcactgactctatttctataaacccaatgaaagacaataagtatctactcttgttgttgtcgttatgcccactggtgtcttgatttaatgaagggtaaatgctgagattacctttgtcatgtccaaagttgaacggagtccatggaacgactccacagcctttcagtagttctccatatatatctttttttaagctaacattttcacaaatttgataagcacattaaggtcatagtccctggcaagattctggggcacaaatagactgttgttggttaaggcagggatttgggggctttatcagtgaattatgggaaacctggagtgaatgctttttaatgcaaagtttggaacctaggttgagatcgttccgctgactcttgcacactgttgagtaaacactggccctagacctgctaagagcttacaattcaatacaacgtaaattaaaaaccccttagcaaagcaagaaatttaggccgccttttgaaaagggttagcaatgacctttatatctagacacagggctcctgggataaaaatgtcctccacactgtgaagtattccacagagaaaagaaaaatagttgctgtcacccagttggtataatcacttgaactctagaacttggaattcactagctcagacctgcttaagttgtggatcatgagatgacgccagtttagtactgttcttattatacatattattttatttatcttatgtttttctaaaggtgttttgaattaaatgtgcataaaatattttcctgtcttggtgacataattatgaagaactctgcttcttttgactttaggtaacaaacataatgaaaatacttgtctccaaagcataaaaaagagaaaattattactttgttttgttcaaccaagataactaaaatttaatgtaataatacagcctactttgttttaaagtaatttcatttttcaaacatatgacaagtattctcttttgcattcttcacaacatctttaaaaatatcttgattctgaggctgggcacagtggctcacgcctgtaatcccagcattttggaaggccgaggcgggtggatcacgaggtcaggagatcgagaccatcctggctaacacagtgaaaccccatctctactaaaaatacaaaaaaaaattagccaggtgtggtggtgggcgcctgtagtcccagctactcaggaggctgaggcaggagaatggcgtgaacctggtaggcggagcttgcaatgagccaagattgtgctactgcactccagcctgggtgacagagcgagactccgtctcaagtaaaaaaaataaagtaaaaaatcttgattctttctcttggtactaaccaagagtcagacagctttattctattgtaactttcaggatcttcgtctctggttgtgtttttatagatgaaacttttgacacttggaaattaaatccaattgtacgaggtacaagatgaatttatattctacaaaattgtgctttatgctagatagtttatcctgagccaatagctcccctattgagcagtttcttcatgttgaacactcatttaagtggcttgtgtaattctcagcattactaccacgtagacattattgtcccattttatggatagtgaaactaaagtttaggaaaattaaattacaataatgaaagaagattaatataatgataaaatataggcttagagtgagaagagaagttttaattttccctctgactctaatcagctgtaattttccactggttctttcacctatttgagcctcagacctttgatgttgaagatgattaaaataataataactatatttctgtagaactaattttacatgaaatattgcatttaaccttccctttcttccatcagttttagtttacagatgagaagattaatgcttgagcaaaattaaatagctttcctaaaggtcatgtagttagtaggtcatgcagccatctttgaatgcctggtctctgtgattttgaagtccatggtcttactcaaaatgctaatttctaatgtgtctgtgtgtaatagggaaagtggggcgcacagaccaagggaagaactaggtaaaaaaaaaaaaacatgaaaagtatgtgactcacggtaaactcttatgctaattttttcccagctctatctgatattttcataatatcctcaactgtgctttgcatatttcactactacttgttgatatcccagttgccttgatctcagttcccaccccaaatctaggagccaaaatgatttttctatatgatccattaaataacttgagctgccaatcagcttcttcaacagaatattaataagcatgctcaagcagaggcaaataattggtcatccatgaggctattaacctctgatagggattggactacctaaaatttaatatcccttatctctaatatttcatctaacttacctagtagaataaatcatgaagttatttgatagtacctttgtaaaaatgatctttttctcttttgctcattcacagtacattccagattgttaaaactgtctatattactataataaatagagactcagtgtctctatttagcccaacaacaagcatcctctctgactcatattctcaaagccagaacaagccaattttgatcttagaaaatttgtaatgaagtttaatatgtgaaaataaatccactcttgttcttaaaatttagggaggtttgtataaatagattatagatacatttctatctcaaatatgcatttattcaccaaatatttatggagcaactacacaccaagtatcttgttgagttttaaaggtatgatggtgaagaaggtagattcaatctctgctcttcggagagtaattgacatggctaatagtgactttttctgtttcaatcaaggtacacatcagcattgtaaaatatatttcccaccaatttcaggttgtccctcatgctcagtagtaatgaataattaagcggacaattctctacaatttctatcataatgtcactaattcagagatccaaagtggtaggattgggtacaaactttcaaaaaagaaaataattgtagtgaaaatttttaaaaccctatttttctccaggaacttactaagttatcctatttaagtgtcttcacttcaattaagtcatcatgaaagagaggagatgagtcataatggatgatggaattatgaaaataaatgtgattaaaagacaatttgtaaatattaaaatgctcctgacatatactctcctaagcagcatcagtaaaaattaatacaagcatatagaaaataaataaatgcaaaacttgaactatttaaaaaacaaactaaaagttatttattttttatttttttgatttggggtctaactctatcatccaggctggagcgcagtggcacagtcacagcttatggcaactttgaactcctggcctcaagctaccctctcacctcagcctcccaaagtgcggggattacaggcttgggctgctgtgcctggacaaaagttatattttcataataaagaacaaattataaatatgatttttggcaaatgaaacattaaatctcatattacagaaataacaaaaaaatagggattttggtaaataaggcctgttaactgagaatcttaccataaagttgagcattttataaaaatagagaagcttctgatttttaagtttttctttctgtacttacagggataaagaaaataggctccctgggacagtttcgttattaattgagtcattcaacaactcagatgctatatccattgtgttctctccaaattctttgacccaaagcctctgatgtgtacacacactattagaaagaagaatggttatttcccaacatgtagttatattaaagaatgttgaatcactgtgattactcattgaacttgttttcaaagacttcagagagtccagtatgcagtttcattccccattctcacactttttttttgttaatggcactgcagttaagagaaatgagcatcattgtccacatgtgtactcctgtttttgtatactctgtagatgtggaaatgcgtcacttaaataatcatctttttaggggagcaaagagaagatcttctgtttattgacactgaatcagttgcagcaattgcatagaaagtctgcaatatttgaatccctaaaatctggacattcaattagggcaggagacagctaacctggaaatgttctcactaccaaaatttagaaatgatgactgaaataaagcagcgaaaattccaatatgtagctgatctcacaagaaagaaaaggaaatcccgaagtatcagaaacaaataagaactaaaatccaaagtatactctctggtgttaaccctgaggagatcttggaagcaaggtacattttttatatgttacagaagtagaccctaaagtctaaaacctagaggatgaatgatcatgccaagggcaaaggacaagtccttgggcctgcctaagaatggaagttgaatagcagtgtctgcccaagtcagactccagatggaatgacctgctggttcagagtagaagacaaaaattccccaatgagaaaccaaaagcctatgcagcacatgtatttgtggcccaaatgcgtattaccacatagtatcaaaaatatgcgattgaaatttaacataaacattgatccttttgttgcaattgcttttggtgttttagtcatgacttcttttcccgtgcctatgtcctggatgatattgcctagattttcttctagggtttttatggctttaggtcttatgtttaagtctttaatccatcttgagttaatttttcataaggtgtaagcaaggggtccaggttcagctttctgcatttggctagccggttttcccaacaccattttgtatacctgtgtaacaaacctgcatgttctgcacatttatcccagaacttaaaggataataataaaaaaagaaagtaaactacatagaaaaatggggaaaaaaattgatcctaagtagggttcatgcaaaagcattctcgaggaagactttcataacgtagatgcacagtatatctcaaagtggtcattgtctgctgaaatagggactactcactgaagaatcagaccaagaacttctaaaacattttagttgctttagataaccatactgttaaaaaaaaaccttaaaaagtgggaaaatcatagttgaccaactaatctcaatatcttctgaaatgaatgctactactactaaatgtttaccaccgaataagatcggcatgcattcaattatttttaagggccaggtgcagtttgtatggaagaaagtggtgtatgaagctaaaggctgtggcaccacagctaaccatactatttccctgaaatattttatagttctcaggttacaatgtaatactaaaaataattatagatttatagtttttttatgattactttgaaggcaatattaaataaatgtgaatagataattgaaaaccttataggaggaagtaaacaggaatattaaaagatgtttagctcagtccaatattttcatttttggcactggcagaaaatccactgcaaactcaggttgtcagctcttctattgcgtactatttctactttttatacttcttggaattatgaaatgcttcactacatgaaactgaaaacttacttgaagaactaaataagcatttttgagtccccaaatacttacccatgtgtaatatctgagaaaataccaattttgtgtaaatgtttttctcctattctaaaaatacaaaacattaactcaacaaatatcatctgtgtaacagaaacagtatttttaaatttaatgaatgatgtcctgtaattgttagttgctttcttttctctgtaactttaatataaaccaaaagctaagaaaacccttattttatattagattttagtaaaataataaaaaaatttgattttagtaaattatctaaaataaatatatattaaaaaatatatgaattatgtgtgaatgacaagtaacacttccattatagcaattaaagggattcacattgttaaatgtgagaaagccttgaatttagagtctacttgagctgtataagaacaagttgaagtatttcaattatactttatggagttccttcattcctttgagtaaagtcatgtggatattttaaataaattattaataaaatattaaatgtactgaaggctgtcaactgggtgatggtaacagtaaaaaacacttttctttataaaacaattgttaaaatatttgaaagttttggattttgtatctgtatattgtaattatgcattaatgcaatacaacatttcaaaattctcaggcttctgctaaatatgtaatttcccctttttttttgagacagagtcttgctctgttgcccaggctggagtgcagcggcatgacctcggctcactgcaagctccgcctctcagttcaagccattctcctgcctcagcctcccaagtagctaggactactggtgcccaccaccaggcccggctaatttttttttttttaatttttagtagagacggggtttcaccatgttagccaggatagtctcgatctcctaacctcatgatccgcccgcctcggcctcctaaagtgccaggagtacgggcgttagcccccgtgtgcagcctatatcatttattttaataataaatattagcgaaatcttgcttagaatcaatgttcaactcgtcattgaaatttttctgtggaaaacagacctgaaaatatttaagtatccattattccttcagacttgttttatatcctctttactgtttttcttatatttaaatggtgcaggtagaaggagctcctaacataataatgtttagttaggctgggatgataacagaaatgttacttttcatattttatgaatgcatattattcattaagttcttaggtacgttgtcttggtggaagcttatgaagtacgtaatattctaattatatgaattttaaaaatgaacctcaaaaagttagttaaatactggctcagtttaaaccatcatactgtctctgaaagtcccaatgaacttaaacttaatttagaagttaaactaagttacaaaatgggatgtgtgtagagaacatttggacagaagacatgtagtttgcctttctttgataagtttaattgcttaagtgtccctgtctcacaccttctttacaataaggtctatatctgtatcttcttattctacattgtttcataggtttgggtaaattttcttcattaaattgatctttgagaatggaaaattgtctcttacctttctattttcagtgttatcatagttctgagtacctaaaacatgttcagtacacattggaattgaaagaataaataaacgagtcaaggtcagacatcgtaagaaatatttcagatctcaccgtagtcattaacaataatcctttgaatataaaatactaaattatatagatacatggatcaaatatgtatgaccttgcaatatatctaatgctttctaaaggctttgttgtttgagctttgtctgttaatgaaaaaatcaaagtctttcgttgaccaaattttgtgtattttcagagatcatctatagctgggtatttaatgagttcccttcctttgtggcggaagacagccggcggttcatctcccaggagacaggcaacctttatatttctaaagtccaaacatcagatgttggcagctatatttgtctggtgaaaaacacagtgacgaatgctagagtccttagtcctccaacgccactcactctgcgtaatgatggtaagttgcttggcccgttaaaatggtcagccaactctaatttggaaaataaagatgtattagtgtgtgttttttttttaagacctggaacttacaaataaaataaaaaggcatttgccatatttagacactacatttttaggccaggattttgcatgccttagaataaaagtttagacataagaaattgatgatccatggttgagaaatattcaccataatgctactctaatgccagaaagggagaaagaatctgataaaaagaaccataataaatactccacagttctttcctttgctcttcagtgcctctatataacatatgtgtatgaattgcaagcattttatgggttcacttttcattacatttttattttagctgccttcaaattgaatgctcaggttttaatacttcatggtatagttataattgtgattattacttttccaataataggagcagttggaactgtaacttttaggtgcaaatcaggcagaagtgatgattctataattatagtattgccatctatccaaagtatcttcaaatttaaacacctcatttgtatttatagacatgtacagttaagcattgcattaaagaattcaagtgctatattaccattgatatatgatgtgtagtttgctctgtcatgcagcaaaaaatctatgaaggcgttattaagaagcatgagaatcctggttgattgtgaaacttaaaaaataatctatttaagtgctgttttttcatatgcttggttttagaatatatgctgctggaatgtatgaccagagctatatcacaagatttttgcttactacttagtttatatagactttgttgtttgcgtgtgtgtgtgtgtgtgtatatatgtttatatgtatatatataaacatttaaatatgtgtatttatgtaaacaagtctatgaaacttcataaactgtgaagtatgtattatatatacatatatagatagagatacacagtattatataaaatatatataatagtaacaacaccatcaggtaaagggtaaaaatgtaatattcattttaaagagaagaaagccagtattaaagaaatgatgaaaattgctaaaggcctcacagttaggtaacggcatggagaaaccagtagaaaaaagaatgctgacttggaaaccaattcaggggctacaaaaactaatccgccaagaggcgataaatgactgaacaaaagcagtgatggtagcactggaggacaggaaacattaactgggatattaagaaggtaggattaccagcatttgataattaatgaattacaggctttggagtaggtggaggctagcatacacaaatatttcaaggctttagcagagttcattgaatgggcgatgattctcctcatcagaaaagaacacagctgaagaagtagagaagtagttaaaaatgaggaattcagttttgaatatgagatacagggtacatgggaaatccatgtgaaaattgggaataggtaatcagatacatattcctaatacccataagagagagctgggctactgaaagagatttaaaagtcatcattgtgtattacatcaccatagaataatgtgtatatattatgccaacttcaagattgtgtaagagtgtctatagatggaaaataaagaaatgcagttttacagtttatctaattaaaagctttgaattaattctctataagctatttctccaaaacttctgagcccctttctccctgatttcttaagacgttattgcattcttatctgaaaattataacttttttggctaacaattaattccattttcactatccatctgtataataatactttatatttgaatagtgcctgaggttgaggaggctcttccaccttcttttcacaccagagacctctttctacacattgccgatcacaagggagagtagcacatgtgtaagacagtgtccatgtgcaagagtgttttgcacttttggttcatggcccagatatatcacttatctttacgttctaccttccatgggcacacatttcatgaataatcattcgctgatatttaaatccctttgcctctgtgtcttctgttgcccttgtttggcaaaaccccaactccagtgaactcaattatactcttaccctgtgactgccttgagattctgaaagctacctgaaatgtttacacccaccaggggttcatgatcatcaatttcaagtgggctctcaacattgccattcaatcccaagtttctgtggacagcttaatttgctactctcccctaaatttttggaaacttctgtgctttccttagactggattgcctcacgaccaccacttcacaaaaactgtgtaccttatcaaatcatcttcctactaataaaatttaaatcttaactgcatctccatctgcattgttatctcccatcctatttcaatagagatagtatactgtccatcctcctgttacaaccaattcctccatcctgtactattgagaatcattccctccagcctttcagaaaattacactataagtcattgcttcttatataacagaattctaggtcactaaactaatactgttttggtcattatgttaattgaactgactgtagcagttgacgttgttgacacttttttcttttacaaacgtctatattttcaaaaagtcattatttgagaagtactatataaaaggctcaataaagcaagtataaatcaataaaacaaaactgttattttaaggttgacatttaacaaaaacaaaaaaaccaggtaggaagcatctgctaaatttctgttacatcgttcagtaacagtcttattttttaccagagaagctacaaaatttacatttgtttttttctgtaacttacctaaggctattgctttctcggcttttatttgtccattttttttttaaatccacattgaatgaatgtagtgacatagaaaaacaaaacaaaacaaaaacccacaaaatcctactcacctctccctgccactaaatctcacgctggagagccaaacttctaacttcccttttttgttgttgttgttccataaggttctcataaaatgctagaaaatatctgcacgtcttggttactcaagcttaaacaataactgtttattccttcatttgataagtgtgcataagtttcttccttccattttaatatgcatttttaagtttactgttgcttatcctttaaactttaataatatactgaaatttctactgctcttttaactcgagtctaattcatagctttttatgtcatgaaatgaggatcattttattcctcctttttccttcatctttcctaagctacttttatgttttttttcttctacttgtattttggcaattctgtgcagcaaatacaatcttatcttctatacttcttcttagactaactctataaactggaaaatcaataaatatctacagattattaatatataattatgacttaatatgatatttttccaggtttttaagccacttcctagacatgtatactatactggatgtgtttttcatactaactgaaactttgaattaaatataacctaaagaaaaataaggctaataacattaataagaatgcagtatagtttggatgtagtgtttcttaaagttctgctgtacaaaaacaattagtagtttggataacagtgttcagaaaggaacatgagtcactacagtgaaaatcgtaatgaaggcattggtgtggttaagaaatcacggggagagagtatgaaatgagaagagaagtgactgtaaggtcaagcctgaactaatctacattacattaggagggtaaataatgaaaatcccacaaaaaataatgaggagaaggtagagagataataagataataggaaaaacagtagaacaggccaggcaccgtggctcatgcctgtaatcctagcattttgggaggccgtggcgagcggatcacctgagatcaggagttcaagaccaacccaaccaacatggagaaaacctgtctctactgaaaaactgcaaaaattagccgggcatggtggtgcatgcctgtagtccccactacccgggaggctgagacaggagaatctctggaacccgggaggcggatgctgcagtgagccaagatcacgccactgcactccagcctgggccatagagtgagactccgtctcagaaaaaaaaaaaaaaaaaaacagtagaatatagtgtcaaggaagccaaggggaaataagggtttccataagaagtgggcatgtagttaaacatggtggactggatgcatgcatttgctacctgtcgcccttctcagatcctacaaaactaaatctatattattaatgagaatgctgaaggagaggaagagcatcaccaagtgagacatttccatatatttctgaaagaatgaggaaggattgagttaaagtattaaagaagtggagaaaactaaaacacagaataaagtgtaaggggtctaaagaaagggttgaggaccatatgcccaatggaagcttgaggacattctgaaatcaaagttagcactaagaagggatgtaagaaatgggattcaataaaggggattgaagacataacacactgaacaactatttcaataaaatgttgaacaccttttccttctctatcgctatatgcaaaaagtccaaagactcatctcttaataatatgaatgagctttccgtggaaagatgaagttttaaatgtcaacagtggcactctagtgcaaaactcttattctagcattcgtatgccagcagcctgagagccagctccctgtcctcacaccaaagcagagcctggtcatccacacaccccattcagtcatgacccccacacacctcagtagagaaccaattcttcagacacagcatcaggggaactcacaccaacttgcaaaattttcgatatatacgtagagagacatatagatagatatagttatatatacatatacacacacacatatatgcaattctaagttaatagttactgttgaaaattcttgtgcttatagagtgattacaaaattcatactaagataatatgaaaaaacttgaaacataaaattactctaaggaagacgtagattagaatggaattatttttattcaaaaactgtttttattataccttaagttttagagtacacgtgcacaacatgcaggttagttacatatgtatacatgtgccatgttggtgtgctgcacccattaactcgtcgtttaacattaggtatatctcctaatgctatccctccccctccccccaccccacaacaagccccggtgtgagatgtaccccgtcctgtgtccatgtgttctcattgttcaattcccacctatgagtgagaagatgcagtgtttggttttttgtccttgcgatagtttgctgagaatgatggtttccagcttcattcatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttggttatatacccagtaatgggatggctgggtcaaatggtatttctagttctagatccctgaggaatcgccacactgacttccacaatggttgaagtagtttacattcccaccaacagtgtaaaagtgttcctatttctccacatcatctgcagcacctgttgtttcctgactttttaatgatcgccattctaactggtgtgagatgatatctcattgtggttttgatttgcatttctctgatggccagtgatgatgagcattttttcatgtgttttttggctgtataaatgtcttcttttgagaagtgtctgttcatatccttcgcccactttttgatggggttgtttgtttatttcttgtaaatttgtttgagttcattgtagattctggatattagccctttgtcagatgagtagattgcaaaaattttctcccattctgtaggttgcctgttcaatctgatggtagtttcttttgctgtgcaggagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatgtaagtctttgctccatcttgaattattttttgtataaggtgtaaggaggggatccagtttcagctttctacatatggctagccagttttcccagcaccatttattaaatagggaatcctttccccatttctttttttgtcaggtttgtcaaagatcagatgattatagatatgcagcattatttctgagggctctgttctgttctgttggtctatatctctgttttgatactagtaccatgctgttttggttactgtaaccttgtggtatagtttgaggtcaggtagtgtgatgcctccagctttgttcttttggcttaggattgacttggcgatgcgggctcttttttggttccatatgaactttaaagtagttttttccaattctgtgaagaaagtaattagtagcttgatggggatggcattgaatctataaattaccttgggcaatatggccattttcacaatattgattcttcctacccatgagcatggaatgttcttccatttgtttgtatcctcttttgtttcattgagcagtggtttgtagttctccttgaagaggtccttcacatcccttgtaagttggattcctaagtattttattctctttgaagcaattgtgaatgggagttcactcatgatttggctctctgtttgtctgttattggtgtataagaatgcttctgatttttgcacactgattttgtatgccgagactttgctgaagttgcttatcagcttaaggagattttggggtgagacaatggggttttctagatatacaatcatgtcatctgcaaacagggacaatttgacaattcctcttttcctaattgaataccctttatttccttctcctgcctgattgccctggccagaacttccaacactatgttgaataggagtggtgagagagggcatccctgtcttgtgcccgttttcaaagggaatgcttccagtttttgcccattcagtatggtattggctgtgggtttgtcatagatagcttttattttgagatacgtcccatcaatacctaatttattgagagtttttagcatgaagattgttgaattttgtcaaaggcctttttctgcatctattgtgataatcatgtggtttttgccgttggttctgtttatatgctggattacatttattgatttgcgtatattgaaccagccttgcatcccagggatgaagcccacttgatagtggtggataagctttttgatgtgctgccggattcagtttgccagtattttattgaggatttttgcatcaatgttcatcagggattttggtctaaaattctcttttttttgttgtgtctctgccaggctttggtatcaggatgatgctggcctcataaaatgagttagggaggattccctctttttctattgattggaatagtttcagaaggcatggtaccagctccttcttgtacctctggtagaattcagctgtgaatccatctggtcctggacttttttttggttggtaagctattaattattgcctcaatttcagagcctgttattggtctattcagagattcaacttcttcctggtttagtcttgggagggtgtatgtgttgaggaatttatccatttcttctagattttctagtttatttgcgtagagatgtttacagtattctctgatggtagtttgtatttctgtgggatcggtggtgatatcccctttatcattttttattgcgtctatttgattcttctctgttttcttctttattagtcttgctagcggtctattaattttgttgatcttttcaaaaaaccagctcctggattcattgattttttgaacggttttttgtgtctttatttcctttaattctgctctgatcttagttatttcttgccttctgctagcttttgaatgtgtttgctcttgcttttctagttcttttaattgtgatgttagggtgccaattttagatgtttcctgctttctcttttggtcatttagtgctataaatttccctatacacactgctttgaatatgtcccagagattctggtatttgtgtctttgttctcgttggtttcaaagaacgtctttatttctgccttcatttcgttatgtacccagtagtcattcaggagcaggttgttcagtttccatgtagttgagcggttttgagtgaatttcttaatcctgagttctagtttgattgcactgtagtctgagagacagtttgttataatttctgttcttttgcatttgctgaggagtgctttacttccaactatgtggtcagttttggaacaggtgtggtgtggtgctgagaagaatgtatattttgttgatttggggtggagagttctgtagatgtctattaggtctgcttggtgcagagctgagttcaattcctggatatccttgttaactttctgtctcgttgatctgtctaatgttgacagtggggtgttaaagtctcccactattgtgtgggagtctaagtctctttctaggtctctaaggacttgctattcaaaaactttcacatcactatttgatctctcttcaaaaaatatgattgaaaagtacgttcataagaaggacactttcctgaatgttttcctaagtagatggcacatattaaacacttgttctgaaaataaaaatagaatatatattgcaccacggtcagctgaaattcctgctgggttttagaaacctctcaatgcagagataggcattacaatgaatgtttctgcaaatgtggcaaatgcctctgtaggggtttgaatataaaaattatctttaatctgctgtgaccatagagctggctaaaaaaaatcatttcaagaacattgtgtttttacacttctctgaaaaaatgtagacctttctaaaaataataagggacatatgcaaaggcagtatttttcctttcaagtagaaattgaattttacttaataactctctcttataaaatgtattatcttagctttggttcccctaaagcaaagctgggaacaaaaattgcttgtaggtagtttatttcaaatttatccccagagagcaggattaagagatgtgatggcattgataggtgaagccagaggagagatgcattacagagatgaccgcttctacaggcatcttgagcttgagcccacaggaccagagccttacaaaatgcactcagaatggtcaccttggagggtgtattgatggactttcatctcccattcccagagtgtaattctcttagcacttaactctcttgttctttgaggttgccctcaagttgcagctttgtgaaactggttgcacctacatgaacctggttgcagtagcatttgtaggagtaaaacatctggtcaagatatgttgaactagcacacaagaagtatctgaaacatagatggtagtgagcgtagatcattttcacagccctagcacacatttcttagagaaagtgactccttctaatacttacataaattcaaatatcctaatgttgaacaaaaaaagttgactttctgttatttattcagtttatatgttgcttccattttgcatttggtgacatatatatgaatatgtatctgtggtagggaggggctttagaggggcttgtggactagtgagaaagattattactgtacaaaatgctgtgatagattgatagatatatgttactttggtaacccctaatagaaacatccaacccagatgatacataagagaatgcttcctggaagaggtgatatctgagtttagttttgaagtaatttggtattaggtgactaaataaagagaggatatttgactatccatcaagtacaagtatagaatacacagactataataaaattgcacttcagtccagattaactaaaatgcaaggctatacgaaggaacagaatgtcataccatgaaatgctttgttgaccatattaccaaagcagtggtgaaggtttggaagatttgaagtgcgtagaaacacaatcattttcccttactgacatggtgaaaaattattctcatgcattcacaaatgtgtattgtctgcctattatgtatcaggtattttgttaggtacaggggatacaatggagggtgaagcaaacgtaactatccttgtgtagcttccaatccaatatgaggtaggatattcccataaaaactgacacagattctgtctgtaaccgcgcactctgggatttgcctgtccttgttcagcatcctgatgaggccaagctcactattattgcactaaaaacaagaccaactccaaaaggatttatgagtaatacagatgtttattaatgtcttggagggtaatgtatgaggcgcttgcgttccacaaaacagcagaatttattgaacactccccattaaccacatctaatttttccgagccgtaattcctcaacagctataatttcttcctcaaacacctgtgcctctccctgtaacagtgttgcttccagtctcccttcagggtcttactacctctgtcttacttggcaattttgtaccttcatttttccactcatttgagttcccagcacagttgttaattactttctaaaaacttatttttatttaatctacacttatgttttctgcatgggaagcactgttttaaaaatggtacaagtattaaagtaaaaatgatggaaaataaatgccaacaaatattaactaaaaagaagttgaggttgctatattaatatcctgtattaagcaaagatatagcaaagctgtacacatcttcgcaaaattcaccatgtacacaaccaggcttctcacctttctttcagtccatgtgggatctttccctacaagatctcactacttcctaaggcaacattttcccatccgtctctggagttagatagtgtagtagagagatttcaattagtaacttaagaaagtgagtggaaatagattgagaatgcgtgttgaaagattactgtttattaggaaattcatcagttgtcacagtgggggaaaaatgtagaaaggctacacatgtagataatctactatttggtggtggggagtctatgattttcatttttaattaatgaactacaggcaaactaatcagctgagaatgtatgtgtagataacatgtttattttaaggaaagaattgtgtcaacatggaaattctgaccatgattacctaattacattaggtaatttgtctgagacaaagcacagagagaatggatctcatgttgtcctctgtgatccctgagatttggtttggtactcaacaatggaatgtagcaaagccactgttatttcctgattagtctgtttatcataaaggaatatggtaattggaatagctttgggtacttttttttttttttttttttttttttttttgtatttcccttctaagtgctgctcctcgggtactgaatattctatcctaaatccaggagactttttctttctctaatcttggttcagaattttcaattatggatagttctaaggggactgggaaagttttgacaggaacactcctattgggatacatttatctctgctaaggaagctgaataatataaaaagtttgtatcaaactctgcaggaatatagaaaatttggcttttgttaatcttttatttatttttctatgtgtctctctggaaagcttataatcttgatataaaaatttaaattaaaacatcaaaaaaattttggacgatttttgaataagatgaatacttcatttgctcacatgtccttggcaatcagtcattccatacaatccaatttcttcctaagcatacttaaaaaacaacttgaatttctgtctataaagagaattttttatcagataaaacagtgtgcagcattttatgaactctctcaatttgtcttgaaaccttgggagaattacttaatacgtggtaacaaataacaagatgaatttgctaaatatatatctaacttagtctttttcttgatttcctatatgattgcctgtcattgtaattcagaaataaatttctgaaagacataaacttttgataactggcattgtaactatgaacacatctttcttcatgaaagaaaggaatgtgaactttgagttgacttttgcagtggtggcaaagatatattcacttacgtttatctaactttttttaatattcagatttcttgagaaactacttgacactcaattctgctgctgctatgcctcttcttccatttaataatctctaattgggcatggggcctcaccatacaactcacagaattttctctaaactagtcaggttacttttaatcaaaggtgtcagcattgtctcagccttcattattctgaccgctctgtagtccatgtacaaagctgcaaatattttcttttcatctttcctggcagtttgttctcccaaactctttcatttgtacctttcactgtctcttctcaatctacccccaaatcagtcattccatgtacttatccatttatatgtctgtccacccagtgtgtcttatttgcacttggcctttgttccatgaagaatttaaggaggcttatcttcttaaatgtaggtgttctttcaaaactccactcctcacccccatgatatttttaaatatttttttctttagtgaatacttctatctctgttttgaatttagaatatcccacaaactaacttctgcagctgacatttgtgctattaattacattacctttctcctagtcatcaaacataaacatttctgggtcaattagactcctaatctcatgatcacttatgccataggttctgcaagcactgtggattctacatctgcaatgtcattcttagccattcctttcttcccacttctaattccaacactcctttacctgacacccatatcagtggctttgaactccttctttctgtagctcacttaagatgaatagtattcctatccaaaacacactgtcaaaaacattgccatattctagattgtagcaaagaagtgaggccataagtataatatcataaaactaattgtaacgccacttattgaatgcaaattcacaagagtgacatgattacacaaatttaaactacaatctatttgcctaatttggtttaaaatacattggtcacaaacttgagtttaatttattatctacttaatcttagacaaccgactttacctgtttatgtctcaataatgaacatggggataatattggtacttatctgatagggttcctgtgaggatgaaatacatgaatacatccaaagcacttagaaaagtgcctgttatttaacaaactttagtaaaggttagctattaacacagtacttatcctataattcccacagcattttacttgtgcatgtgttgcgggggaggtgcgggggtattgcagtcagaaactacttttctagatgattggtaatattgtagtttttgtcattgctgttgttgtttattgtaaaaacgtaaactcccctgtcaagaattgagattttaatagagataaaggggatggatgggcggtaacattgggaggagctttatagtccattacttgccttcaatagtttttcactccaagccttcctcacagttttctgactccataatttttctttctgttctgtcttcatgaagtaccctcttaactcctagctctgtctccaagaatgcaaatgatttgccaaagatcatgaaattagttacttacaataaactggaataaagcctaccatataataagcatagtttagattttattctaaaagcttttccttatgcttgtccatattgaaattcatctgccactttcataataccacccacacagccttatgatatctccatgcaaatcgtatttaccagcttgacatttcactcactacccagtagagctcagtattacctgagatgttgagaattttattcaccctttctcatgttaagatactttacaagaccgggcatggtggttcacgcctgtaatcccagcactttgggaggccagggcaggtggatcatgaggtcaggagatcgtgaccatcctggccaacacggtgaaaccccatctctactaaaaatacaaaaattagctgggcgtggtggtgcgcgcctgtagtcacaactactggggaggctgaggcaggaaaatcgcttgaacccgagaggcggaggttgcagtgagctgagatcgtgccactgcactccagcctggtgacagagtgacactccgtcacacacattaaaaacaaaaaacaaacaaacaaaaaactctacaaaataatcaacaaatgccagccctaactcgatctctaaagactatgtcattttgccaacacatagcttcccgtatctaaggtatttcgctacccatgagaaaacattattctcccacagattgaaattatataaatcgaaattatggtcaaagaataatgttttgttatggctaaagtttataactcactaaagactaagataatcattagcattatttagcaataaacatttttaaattataatatttaattttaaaaaaatttatcaaaagattttaaaagtctgcataaattatatctagcaggccagcactcaataatgtgatccccaaacatttgtatcaggataattgacaatgcttaagaaaaaaaaacaaaaaaaacgggtgggagcggtggctcacgcctgtaatcccagcactttgggaggctgaggcaggtggatcatgaggtcaggagattgagaccatcctggctaacacggtgaaaacttatctctattaaaaaaaaaaaaaaaaaaaaaaaaaattagccgggcgtggtggcgggtgcctgtagtcccagctactcaggaggctgaggcaggagaatggcgtgaacccgggaggcggagcttgccgtgagccgagattgcgccactgcactccagcctgggcgacagggcgagactctgtttcaaaaaataagtaaataaataaataaaaataaaaaaatgtaaaaatattgggtcatacttcagatctgcccagagtttctggggcagtcctagaaagcagccttttttcactccagaattgtgtaaggtgaataaatcagcaagaagcactttgtttggaaatacaaggcgtgtccctgcgcctcaaccttaccaggatacaagagcagccctctcccagctgaaagtactaggaatagttaaatccacatgctctctctttctaaagttgagaagcacttccatttccactgagttgtcaggtcttcccagaaccacacccagctagcagactatgcaatgtctcttagagtgttcagtgaccttgaaaagcagagtccttcagaaaatttccgaagagaatgaaatcttgaacctactctttccctgggaggcctgaggagaaccagggttttcaaatgcaccatctggacatacctagagagggccatcttgtttgtggtatttcctcagagagaggattggaagaggattggaagaacgagaccagttatgatctgtatacaaattatcctcaccccatatatcttaggaatctgcattttccacagtactcccagatatttcacatatattcagtatattttaattgtgtgtacagtaaaatgtactgagtgtttccgtacatttccatggtgagaactaatcattacttgcgacatgtttttttaaaaagatacatatttctttatattttgaaatctcacttttatactagatagggttgcctaaaaaaaggtgaatgaaaggcgataacaaaatcgtgttggagggaatctcactaaaaatacagattcctggttctcccttagatattctgatgcagtcagtctgaagtggagaatgcaggtaattctgacaagcatcactaggaatttttatattcagtcagattatgaaacgtctgacattttatctcaattagtaactgtggctctctggggattttcaggtggtcgcagtatttctgcagttggtcacttgtcatgtatttaattcctagtttttgtgggcctttaaggtaattatagaaatttagattaaaatgtttatttgggaggggtattctcataattgagctgccataggtgatagttgttctttccactttgcttcgacagtctttcttttgttaataagagagcctattttcctatggttttcagttttccttatcatgccttgcattgccattcttaatatgctctacctgatttttctctgaatatccagtaaggtatttaaaaataaccttaaggcttcctgtgaatcattttaaatgatttccttccatttttttctctctgcactaattctcacgttttgtctcagttaatttgtctaaaattgagtaatgtatggtggatattttatttccattatcctgcaaggattctggatttattattttgtgatcatttttattatccagtattaaaaatcacgtacaggatattgaggattctaaaactacttctggaaagtaatttgtaatatttagaagtgtttcttccagagttcactccaatgagatattttgcacatttaccataaaataacaagacatttatttcttaacaaatgtactgagcctcatatattcaaatgagtgttgtgtcttcaaagtagacatactgagaggtaattcagttataccaatataatcctgccattattcaaaatattttaaaactcagtgattcatcttgctattttataacgctcatctttggagctgtagaggagagatagcaagctgcctaagtggaaggcttgataatgattaacattcttcctttgcaccagccactatgctaaaagcatttcatacattctttcatttagtcatcacagcaaaacagcattttgagcttatcttttttttctaggtaaagaacctgtgatttagacaggcagcaagtcctattgctcatgcttgtctgactgcaaagagtacacgcctaatctttatactttattgctcagttaacatcagttaagggacaggcacaaggtcatagttggtgagaggtctcgagctacagatctaactcacggtgattgttttatctactgtatcatcctgcctcccttaggatatcagtgctacattgggatattggattaatttcatcaatattaccagaaatcaaatttaaagggtgtggttagagatgatccttacagaagtaatcagtattagttcctgcccagtttcattggaataaatgtcatgaaggatattcttctcacttctgcaagaaggaaagaatccatcaaatttatgaaactaggaagactatatggagcaacccacataagtaaaattggggttatggtgatctgtcggaatgacagaattcatctatagggaatgtaaggttgcctgctacatagtgtgttaattatctgtcaaattatctatcaagagaatgcagagactaattttcttaataattagtagagtctacttaatattatagcatgcttttttctttaaatgtaggttttccttcacagtgtcagagtgttaaaaatattggttataaaggaaaaaaaatatgctgaatccagaattttaaagaatatttacatcatccacttgtttaataaataaatgaaagccaacataaatattttactgtcatcctaacatcatggtgatcaaataacttgtagtacaaattttacagatgggcaacttgcaaatgattcatatgtataaatagctgcccttccacaagtcggccattgccgcaggcccttctgattttgcctttgtttaaataaaagacatagcctcaagaagcttttagagaattggaaatttagaggcaaaggaggaaaagttttttttttacaaaaaacataagaacagttttggcgctttaaggtttaatgggagtccaccccttgcagcagcatgctctggatgtgagacatggagtcattggagattattttggagcttacgttttaatgactgcctggctcgttttcggacttgcatgaggcctgtagccccttggttttgaccaatttctcccttttggaaagggagcatttacccagtgcctgtacccatattgtgagctctaagcttagaaatggattttaaggtagttttggcaaaatgcggcagacccattgtattagcccattctcacactgctataaagaagtacctgagacagggtaatttataaagaaaagaggtttaattgactcacagatccacgtggctggggatgcctcaaaaaacttacagttatggcagaaggtgaaggaaaagtaaggcatatcttacgtggcagcaggagagagagatcgcgagttgggaaaagccacacctttgaaatatcagatctcatgagaactctaccacccccctgatccaatcacctcccactaggccctaccttcaacatatggggattacaatttgagatgagatttggatggggacacagagccaaaccatatcattctaccgcggcccctcccaaatctcatgtccttccacatttcaaaaccaatcttgctttcttaacccatcatgcttttcccaaagtcttaacttattccagcattactcaaaagtccaatccaaagtctcatctgagacaaggcacgtcctttccacctaggagcccgtgaaataaaaaaacaagttagttacttacaagttacaatgtgggtataggcactgggtaaatgctcccataccaaaagggagaaactggtcataaccaaggggctacaggccccatacaagtccataaaccatccagagagtcattaaatcttaaagctccaaaataatctccattgactccacgtctcacatccagggagtgctgatgcaaggggtggaggcccaaggcctttggcaactctgtccctttgtctctgcaggatacagccctcttggctgctttcacaggctggcattaagtacttgcagcttttctaagcacatggtgcaaactgttggtggatctagcattctggggtctggaggatgatgggcctcatctcaaagctccactgggcagcatcccagtggggactcttgagtggggcctccaaccctacatttcccctttgcattgcccagtagagatgttctatgaggtctccacccctgcgtcagacatctgcttggacttccaggcatttctaagcctcctctgaaatctaggcagaggttcacaaacctcagctgttgtattctgcagacctacaggctcaatgccacgtggaaaccaccaaggcttggggctttcactctctgaagcaatggcttgagctgtatcttagcccgttttagccatggctggagctggaacagctgggatgcagagtgccatgtcccgaggctgcacagtgcaactggccaccaggcatggcctgtgaaactatttttccttcttagccctgttatgggacaggctgctgcaaagacctctaacatgccctggaaacactttccacattgtcttggctattaacatatagctcctacttaagcaaatttctgcagctggcttgaagttcttcccagaaaatgggtttttcttttttatctcatggtcaggctacaaattttccaagcgtttattttctgctttccttttaaacataagcttgaatttcagaccatttctttgtaaactcatatgactggccacttttaaaaacagccaggtcacatcttgaaagctttgctgcatagaaatttcttccaccaggtattctaaataattgctctcaagttcatagttccacagatatctaggtcagaggcaaaataccaccagtctccttgctaaaatatagcatgagttacctttgcaccagttctcaataagttcctcaactctatctgagaaacctcagctttgactttattgtccatatcactatcagcattttggccaaaaccattcatcaagtctccaggaagttttaaactttctcacatcttcctgtcttcttttgagccctccaaactgttccaacatctgcccattactcagttccaaagtcacttccacgttttcaggtgtctttacagcaatatcttactcctggtagcaatttttatattagttcattttcacaccgctatgaagagctacctgagacttggtaatttataaataaaagaggtttaattgactgatggttctgcatggctgagaaggcctcaggaaacttacaatcatggcagaatgcagacagacaagaagcaaggcatgtcttacatggtggcaggggagagagagagtgaaggtggaaatgccacacctttaaaccatcaaatcttgttagaactctcatgagacagcactagggggatggtgctaaaccatgagaaaccaccaccatgatctagttacctctcatgaggccccgccttcaacatatggggattataattcaacataagatttaggtgggggcacagagcaaaaccttatcacacattgtcaaagatctcttgctccccatgacataacaaatacactagtcaggctaaaattccactaaattgttgtttaggtgaataagaattatgttattaaaaataaggttcaacaatgagaatttcagtgcagtaatttcactttactgtattttggttgaattacagtcatgtgctgcatagcaatgtttcagtcagtgatggaccacatatatgacagtggtctcatgacattataatggaactgagaattccagtcgcctagtgactttcagtgtaacctgtgtaggctaggctaatttgtgtgttgtgtctttatttttaacaaaagaattgcaaaagataataaaaattttaaagatagaaaaaagcttatagaataaagatctaaagaaagaaaacatttttacagctgtacaatatgtttgtcttttaagctgtgtcataatgaaagagtcaaaaagttaaaaataagtttataaagtaaaaatgttacagtaaactaaggttcatttattattaaagaacaaaatatatttgtgattaacttaatatatcttaagtgtgccgtgtttataaagtcaacagtaatgtacagtagtgtcctaggcttcacatccgctcaccactcactcactggctcacccagagcaacgtctggtcctgcaagtgctatttgtagtaaatgccctgtacaggtgtaccattgttatttatatcatattttatcataccttttttatgtttaggcacaaaaatacttaccattgtattacaattgtctacagtattcagtagagtaacatgctgtgcaggtttgcagcctaggaacaatagggtataccatatagccgaggtatgaagcaagctatatcatctaggtttttgtaagtgccctctgatgttttaacagcaacgaaattgcctaatgtcgcattaatcctcatcactaagtgacgcatgactgcttattttatgacatttaacattgtactgagacagcttcccaaagaggaaaggaagttggtttatatgggaagagaggtaggatagaattgtgatgatcatcatcagagggctttggcatcatttaaagaaatctatttgtgtttttctataaggtcaggcagagagcttttgaggtaggcttaattaggttgctatcccagttctgccccgctttaactatgtgacccactctctctaaactttagattcttgattcacgtaacactgtttctctctccttttgaaattgatgtaaagattagaataattataagtgtaaagaatctggcatgcacagatttttgtttcatttcgttttcttttttcttttggtgctggggattcaagaatggcatgccctttgactctcgaagaactcatgatctagtagaggagatagacaagttaatgatcctgtcaaaagaagtcatgccacaatgtgtgaagagtaaagaggtatcatatttcagaggtacaaataggacaggaactgaactccacagggcccttagaagcatttgcacagaggagttgacatttgagtacagtgctgatgaaagaaaaagagtttgtgaattgccccaattctgggctggcattgcagacagagggaaaaacatacaaaggcactggggaagaaaagtaaatgaagaagaagtagaacatccccaaaccaaaaaacaaacccaccttcatcttttatgtttttgtgtgaggcaggcttctatgaaggatacatgtatatggaggggaggtagtttactttttcttctcttctttaccataagatccttgctcctatgtcctagtacccaaaataactatgttagtggtatgaactgagttcttcatagtacaagctcatagttcataacttagttgttatgaactaagttgtattttgtgtgttaaatagcaacccaaccactatttacaatattctgtagaaaaatgtctttggatccaaagcactgatatactgcagaatacatggaatacaattcattcattattcatcattgtggagaagagcatggactctgaagccggacttcctgaattcaagtcctggctctggcatttaagagccatgtgactttaggtaacttttcaacttccatgagtcaaaccaattcaaagggttatgaggagtagagttgttatagctaaaggagttacaagggtacctaacacatagtaaaccccatataagtattgggtattattcatcattagtcttgtaacaatgattagtgcataacctgaaaggtaatgctagacctctagctgtcattttaggtattaatttctctctggaacttaagaaagtttttgaaaagatgactttaatgtaagggagaagtggattccagccaacaaaaatcaaattaccagctatttaaaaatccaattaccagctatattttaaaaatcataatacaactagaagcaacaagacttcatagattatatgtgaatgtataatgaaattgcttgcttcctcaaaccttgatgttactaaacttatttaagcctgtgaaaccagcaaatttgttgagctgagataggacaatttgtacctcaagcaaatagatttccaaagacttttcagggttagattcaatatttgtgtaaccggtgtattagcaatgaatacttactgtgggtacagccctgcttctgagatgcttctgaaagcatttgatcgcgcacaaacagaactaggacgatttgcaaaggagggtcccttccactataaatattctgattacttcttttttgaagaagaaaaagtacgtattttgcagtccattaaatagcagttcccagttgctgctgccttttaatatgaatatagtcaataatttatttgatggtaagattctttttgttttttatttcagcttaatacctgataatatgttcagcctaaaaggataataaggaaactgattaatttagtcctcttattatatattgccaagacaaaattgattcttttatgaaagtgaaaacaagtactttgtgatttcttcatcctcattaacaggcttaagatagaatttcattttatcaatgtcaaagagctaaaatacctttaatgattgaagtataaacagaaaagcaatatattaaagggttaatctattttaaaagtaactttttttcatatacacatgaatacaaccatatataatcaaaaattgataattcaatctacctgtattagttagggttttatagagagaaagagccaataggatatatatatatatatatatatatatacacacacacacacatatatgaaagagaattgattagggaaattgattcatgtgatgatggaagctgagaagtcccatggcaaaccatctgcaagctaaagaccctggaatgctcatagtgtggctcgatccaagtccaaaggcctcagaacccaggaagctgatggtgtaactcctggtctgagaccacaggcctgataacccagggggaccactggtgtaagccatggagtccgaaggccaggaggcctggagctctggtgtccaaaggcagtagaggagaagtgtatctcatttccaggaaatagacacatgcctttcctctgttattgttctgtctgagtcccaagccaattgaatggtgcctgcctacactgagggtggatctttcccacctagtccactcagattcacatgctagtttcatctggaaacaccctcacaaacacaccccaaaataatgctttaccacgtttcttggtattgcttaacgtatccagtcaagttgacacaattaaaattaaccatcacactctccaaatgatactgaaatctgaaagttcttatgaggaattggtgaaaatcctagaagttttgtgatgtcttcctggtcctgagtaattataaattctttaatgtatttgaggattggtcatcattctatgccataagtataatcaatgtttaaaactagctcttatcactatgcttgtagcagagtagaattatctatatgcaaataacttaccataatcagagcccatatcagccaaaactaagtgtgagatgaggctctagttaacaataaattatctcattagagaaacaaaattgcagtcatacaactttactaagtagataggaaaagtgtaaatagtaaatgcctaggagtttgtaggatggatccatcgatgtaattatatacagctaaacataattactgtggttatagaaaatattcttgaggaaaaggaatgttatctagccttgttaatggagaatacttgagtgcatatataagctgataacttcagtgaatgactaatgaacttcaaacgaatgactaaagctatttagaagatagtctgaacagagccggggctatggtagtcaagtggaaactaaggttgaagaattagcattggggcaggttttcaaagatttgcatacaaaaataaagagcttgaatttcatcataaggcaacagggaaccactgatgttacaagaaagaaaaataaatgataaaaatgctattttagaaagataaatatgaagtcaaagtatagaatggattggggtaaaaagacagctggcaggaggctgaatacaccatgataaaggcaaaggtagtgaaggttttaattagaattatgtctgtggaaagaaaaaagaagcaacacagagaagaaatactgaaaagaatacaggtattatgaaatcacagtttgctcttgaaacagactcaaacttaaaactaaggaaaatctgttctgatcagaaaagatccaagacaggtcaaatttatttattttttatgtatttgtgtatttttttgagatggagtctggctctgtcacccaggctggagtgcagtggggcgatcttggctcactgcaagttcatcctcccgggttcacgccattctcctgcctctgcctcccgagtaggtgggactataggtgcctgccaccacgcccagttaatttttttgtatttttagtagatacggggtttcaccgtattagccaggatggtctcgatctcctgacctcatgatccgcccacctcggcctcccaaagtgctgggattgcaggcatgaaaattttaatagagaaatgaagtcacatagtcaatgagagaaacctgtggaccatggagggcccaaagagtaacaggtagccagatagaagttaataaatccatgatcagtcacatcaggtgcaaagaataaacttcatttcttcactgctggaaactacagtgcagtgaaagagatagacaagtaaacaacattaaaatgcaatgagacatgtactaagataatgatttgaactttgtactgtgaaaacaaagaatagagtgaatataattattctaaagatggagagatgaatttgagtatggttttaaaagctgaattatagtttattaaacagagataaggtttaaaaattacagggaaaggcaaaaatatgtggctgtaaagtgtcatggttagtttatggagtggagaaaagtgttgtgtagctaaggtgtgagatttgtgaggagaggtatcagtaagtataggactgacaagagaagtaaaatccaaatttggatgggctcgaatgcaatactaggggattcaaattttgccttaaaacattattgagtagacagagtcctttaattagtattgaaaaggtttgttatttttgttgtttgctgtccctttttgcttgcttacttgctttcagcacaaaaactctagtagtagtaggaggagaacagatgaacagattaaagggttgatctagagccctgaaaggacttttggagaaagacattgattgacaatatgctaccatttcattctgttgagtaatgaaagccaaatagatatgattttggaaaagcagttttattatgatgagtgggtagggttaagaagaatacagttgtacaataagatgtgtttgcatatattggcctgggggttcaaaggataaattaggaaggcatcagaaacaaagaaaaactaaagggaaatttgcagtagagtgggttagataggagcattcagatttgatgatgatggttttgaccagtaagataatttaaataactgtatcataaggcagaacatgattggtatcataagaaataaacaattatgggcagctgggcatagtggcgacacctgttaccccagcactttgggaggctgaggcaggcagatcacttgaggtcaggagtttgagaccagcccggccaacatgatgaaaccccatttctactaaaaatacacacaaaaaattttttagctgggcatggtggtacatgcctgtagtcccagctacttggaagtctgagtcgagagaatcgcttgaaccaaggaggtggaggctgcagtgagccaagattgtgccacagcactcccacctgggtgtcagctagactccatcacaaaaaaagagagaaagaaaagaatgggaaagagagaaagggaagggagaagaggaagggagaaaagaaaatgagaaaaggaaaaggaaaggaaaggaagaaaagaaagaaaagaaaaaagaaaagaaagagaaaccacgatggggaatctgcagtaaggcacaagatttcttgcgggaggaattagagaaggttgttttctgttgtggtgatggtgatgatttttttgtttttgtttttgttttcattttggtggggttttgaggggtgggggttggcttctggtttttaatgaaggccctatttttgtgttccttttaaatgtttttataagatacaatttgaagtgaaacataaactgaattttagtatgcatatgatcttattgagatatttttagacaaggaccaatagcatgtatacaggctcataatacatttagaatacagcatatttggaaaatagcaagcactcctattacatggaatgttgcatgcataaatgggaagaatttgaggcaaaatatggaaagataacttaggactagaacattggagctgatgcagaatatttcatgaccgctttgtcagacttgcaacaggggcgccccgtttactcggcccactgtgctcaaccccttacagaagggagcatgtgagtaagtgagtgtggaatccttccagccactgctccaggtgctggcaggagcgagctccatttactatcctgcggcagtgcccaggtgagggtgcctgcaacggtgaagctcaagaaggggtgttacaatgacttcttcgctccactacccatagagtgcagtgtattatcagcttacttagccccttgcctcatcacatgggatggcttccctctgctggcaagggcaaagggtcagtgtgatggccatttttgggtccctgtactcggtggttcctgagctcttgtccagcatccaagaagaataaggtcacacagacacttgaaggatggcaaaagtggataattttatttagcaatggaaatggttctcagcagacaggggagcaggagaggggacaggacaggcaggcagtctccccacaaagtccagctggatcttccctgaagtcaagttgtctctgctctgaagtccagctgtctctctgaagtcaagtcacctctctatcctctactgactgtgtctggggtctttataggcacaggatgatgggtagggtgggctataggtagttttggaaaaggcaacattcagttggtaagaaggcgtttttcagaaagaaccaattgggaaagagagggcagacaggaatagaagttttcactttgggccatgggtttcaggcttttcagcttgaaggtggagtttcaccagggacctatccctgtctgcctcctgcctctatcaaagccttcaagtggaagactaaaacatttagacattagtgagtaaagcattcatgacatccttttttagccattgtaatcatccgtcttttaataacccctcatcttcctggcacggtcttcctcatttattttattcagtcaatgtcttggtgataaccatatatacatcaatgatccatccaatattatgacttctcagtttctttacctccaagcttcccatgaacttgtactccatcccatcttagccaccctttcctgtggtaatagcctgaatcttgtgattatcaattattctaccttcatcacaatctcaatttcaagtaagccattttctgctgaaagcctcttttccattcaaataattatgtttactacttccacttaaacaatcatttggccccttcagacctctcattccttttatcagttcaccacttcactgtccatcataccctcacatcctcaagtgccttccctttctaggtgagattacatagtcacttattgtaaactttctcctctgtcagctctcaactctctatcccatcaatctcttgatcatgtaatactcacttggcaaacctcttacctcaacctcagcctatgccccattcatttcatgattatatccatatagctgagtatagatagaaaaaaatacataattttgaacaccgattttgccttaactttatattcttatttacctttcagtgacaaatataaggtcttccctatgtctttatctgtatgactgctacaccactaattacaaataataaactgttcttgacagttttgtgccctagactccatctcttcttacctacatcaagaagttgtcatctgcaattatttaccctctcttgcaaacatcacatttccctccatcctgaatcattctcatcagtaaacatgctagaatatttattatactgaaattaaccattttatgatttcatagctccctccaacttccatcctttttttctctgctctccttgatagcaagacttcgtccaagagttgtttaaacccatctcaaatttctattttatgttttcttatacctaatcctatgaagctttaataaccaccattattgcaaatgtcaccaaggatcttcacattgccaaagctaatgggatagatgaaagggaatccaaaataaagtaatggcaattagaataaaaataagggaatgaaaaagagagatgtaataggaatcaaattgacagaacttgataattgactgattgcggagaaatggagagaacatcagcttattcattcacaaaatgtgttttattttttaaaatatcccaataatttaaaacaaaatatagattttttcataattccagattagaaaattattttaagtatcccacaaaacaaaaaagaacacaaacattgaaatacaaaaaatgaaatattccctagctcctatgccacctgtcacccacatatatagttgataacaagtagattcactaattgtcatcaaatattcttgaccattaactttgtaccagggactgtgtgaggatccaaagggaacaaaatgatgtggttcctgtcctggtttagtttacagctaaaagtgaaaacagatatggaacaaatgggtagaaatgccattagattgaataattgattgagtctgattggttttaccaaaaaaagaaaagaaaaataatgaacaatgctatttctctttatatatatacacacacagtattcatatatacataatatatgcacatatatattttatatatatttctttctccatatgtgtatatatttacattatatatacttgcattatgtatttatgaatatatatatatatatatacacatacacacacacacatacatatatgcacagagagagaggaaagagattaacttggtgagagaagtggggtggtagagaggaaagactttactgaaaaagtaatatttaaagtagaacttaattgactacaaaattgggaatgggtaaataaattcttccttgcaaacaatatgaatgtttcctggggagcagaataaaatattgaggaaaagtggcttcagacttaataaagtcctagcatttgaactccttgccttttatttaatagctcactgatttggagggggttacataatttttaaaatagttttctattatttaaaatagggactatcgtatctaccttactgtgttttgtaagttttaaatgacagtttacttatatacatttcacaaagcaccaggcttgtagcagatgttcagttaatgtttattcccatccactttacatctagagtctttaatgcacaaaaatccctgtgatgaagctatgataatcagcattccccctctgaaaacatttctcctttgaaccatatcatacacagaggctttgaaatccacaagagtttgtaaaatgaaatatgttgtgaattgtctacagagcaaatcaggagctgccacatcttgtatctcaaatatgagtggtaacagcaggaatgctggcattctccacaagaagactacagtgagaaaacaatctgtgcagattaaagtgtgaaaataaactattaacaatggtttaaaacaactcatttgtcacgttttttgcccagagttatgcaaccaggcagctgatcaactgtgctggcagaactaattcctccaggatattttaggtccctttatttcttggtaattactgtgtagattggtagccagctatgagtaagaaactctttggagggaacattccttctgaagaatgataaaactttacaaataaaaagtaatgtgagtgagtgttcttgatagttgcaaggaagaggagctcactcaagtgaacctaagtaaggaactttctattttcaggagaaacatgacatgataagagaaatggtatagagaaatccaagattaaggtctgtaatacagcttgattttgtggggactaagacaggaagggaccgagtccaaatcgttctaagaatgttagcagcaggagttcatgactattctctttatgaattccccaccagtgtggctgagctattacatgtagcttttccactcttcaattgtcttagccttatcctccactttgaaaatattctccctaccttccagatggggtgtgtgtgtgtttgtgtgtgtgtgtgtgtgtgtgtgtgtaaaaacaacttcctcataacttaggtttgccttaagtcaccttaatattatttgtgcctcactgcctcctttcagttttttgtttgtttgtttgtttttgcagaaaggactgtggataaggtgatttatgattaatttgtctaatacattgagtaaagtccaccatatctgtgagacatatttctttgttttatcatggaaaacttaatctgctagacttaaatgttagagtgaactgtatagaaatcacaatttctagttaaatcacaattgaaaagagccaactctgattggggtgcaagagtcccatagaagtattcagagatcttcaaataatttaattgctgaatatttaattgttgaattgtgtcatttggaattgctatatttttattttgatttaatttcctttttagtcagtagagccattcttccatcattactgggcccactttgctttcaaagaagtgttattggctgttggaagcagaatcctaatttgttgaatatttgatttgtcattctaaaccatattcacacacgtcttggtggcaggtcataaaaatcaaagtaccaactttttttttctttttctaattattcaaaaggctccaattcttacacaaatagatagacacatacacacacacttcaccaagtcaaattaaccttaaattgtaaaaaaccacccaaaagcattttaaattatgaacttattgtaaaatatttgtttctgattacatgcatgtaattacagagaattttctatcattttatgcgtggaaatttatgaaaataataaacatctacttttctttaaaaaaaacttcatctcacttaaagtaaatatttaaccctttgttataaaattttaaaagtttgctctatctttttttgtgtgtgagagaactgagtctcattccactgccaaggctggagtacagtggcacgatctgggctcactgcaacctccgcctcctgggttcaagcaattctcctgcctcagcctcccgagtagctgggactacaggtgcatgccaccatgcacagctacttttttgtatttttagtagagacggggtttcaccgtgttagccaagatggtctcagtctcctgacctcatgatatgcccgcctcagcctcccaaagtcctggggttacaggcgtgagccactgcacctggtctctaacatatttcttaatgccagagaaaactttcatgtttggtaaatatatatagttgctttcttcaggccttacatttctaagatctatttctaagttattgatgcacatggaaggagccctcaaatgatggtggaaagacatgaatatatttctctaaatcatagtggcaagaacaggataagaaaataagtcttaaaatttagtaatcagaagaaagtgattatagtgtaagccagccccttgatcaatttattcctgatgcttggaaagggaaaataaatttattggcttcccttatttttagaatgtatttattggctattttccaaaaaaaaatatttttagaataaatttattggcttcccttatttttagaatatatatatatacacacacacacacacacacacacacacatacatactagtgatgaaaaacattttctcctaatgataaaactctctaggttttttcaatcatcctacataaataatactcataatggtgcatttatttgttggtaacataagccatttatgtcagaacattcttcagtcctttatttacatagcaatcactcaccttaagaaactatgattcaggatgatatacactttttgaggtgagaaaaaactttgtacttctcagtggttctttaaggaattgaaaataaggcatctggacatgtttctaaatgattagaatttccaaatactataacatatttatttgaatacagttacctacaaagatatatgttgataaataatatataatctaacgtactactagatttctaaaccctcaagaacatcagctctctcattatgtatgagacaactggaacccagagaaattctgattgcttcagtgttgcaacagagctagggctggaggagggaattgtgtcacttaactatgcatcacaggtagatatttaatatgccctgaaaggataagtacaatgacatatctcacacatagcacaatatcttttgccctgtctagtgttatgaatgtgacagaatccagataggttatgagctagaacctgatattgtgtcaccattggttatgcttggcacaatgacgtaacagtcaaaactcttctggttacaggccaggcgtggtggctcacgcctgtaatcccagcactttgggaggccaaggcaggtggatcacaaggccaggagatcgagaccatcctgactaacacggtgaaaccccgtctctactaaaagtacaaaaaattagccaggcgtggtggtgggtccctgtagttccagctactcgggaggctgaggcaggagaatggcctgaacccgggaggcagagcttgcagtgagccgagattgcaccactgcactccagcctgggcaacagagtgagactctgtctcaaaacaaacaaacaaacaaacaaacaaaagacaaaaaaataactcttctggttgcaactgagaaacccaacttgaaataaccaaaatagggaattcatttaatttcatgagagaatggcaagatgctaaatcccagatagagctgacatgcaaccaacactgttttttcatctctcctctatctgtattgacttaattctgtcttaattggctgcctttcaatagcaaactacttccctccatgtagtggaagctccagtgactgtcagacatgcaggtttgtttgtttgtttgtttgtttccactcaaatactcaagcaagtattgagactcagacttcctggtctctgattgaaaagtttcaacctcagctgcccattcatgaatcactgtgaacaggacaaaggggtaatcaaactggccaaggttgggtcaggtgtccataccaagttaataaccacagccaggaagataaaacctattcaggaatacagtggctcctattcaactcacatcgtcattgaatatagaagaaacatgtctcaaacgaagcaatgaaaaaatagttgctattttttagaagacaagaaacagatatgaagtatggttggcaaagatgttgaaggcaaaaatgacaatacccattatttagacatacgaaaatgatcagctaaacctttccaactcattagtccagccaaattctcaaggtttactggacaggagttcttaactccagcaatgattattactaaaagtgtcagacagaatggccatttgaaatatgcaacaacaggtatttcatagacattggcctatcagaacaagaccttcagccaatgaggaaaaacactcagctctgctgggagtaccagcacatacaggttgaatataatttgccttaatgttagggcaagttgccactgaatactgtatgtttgacagcatgactctctgcatgccgtttttcagacattttagtcagttatactctaatcctcagaaggacaagtcacatgagaaaaatcagagtaaagaaaggtccattcttgaatttttttaatgttcataaaatctgctaaggaaactatcaaaatatgaagttcatagccctaccttcaaaaaatattcatcatcaggcttagagttgaactctgttgcctgaaattttaataagttgtccaggtttttctggtgttttggctctctgttctgtaaggtgcttggagaaacactgctctaaattacgtgccacttagggaaaagtatcctagctcttcaaaagtaattggaataaataagaaaatcaacaaccataaagacaaagaaggagagtaatgtgctttcagctggaaggcttctgtttatgagaaattagggtaatttaaggtcatcttctaatggcacgtaattctaaactagggcagccacataagccaggatagacaggtctggggaaagaaacggagacacacattgagtgtttcttgagctatatattcagctccatactaggggcaatcaaaagatcaaagagctaccttgactgaagagacaagcctgatattttgatctttgactgtgtgtcttatgggactgtctcccttccctttcagcatcaaactctgcctaacaaaaggaatttgaagctaaactgcacaagatttgagatactaaaacttgcaactgaaataaaccatgtagccaagtcagacagtcagtgattaatgtagtacatatagtatgcctggactattatactctgtgattgaagtttctcaacacagtgatctcaagaaaatagctctgcacataaggtccgaaaatccctaattttgcaacacttttatcagcaactttcagtaggaccttgggccagttacttgacctctttgactctcagttacctcatttctaaaagaagaagggtaaattatatcagctaaggcagtgggtggttcccaaccattttggcaccagggatcaacttcatggaggacaattttttcacagacacagagggatggtttcaggatgaaacttttccacctcagaccatcaggctttagattctcataaggattatgcagcctagctcccttgcatgcacagttcacaacagggtgcaaactcctgtgagaatctaatgctgccactgatctgacaagaggtggaagtcaggcagtaatgctcacttaccggcctctcacttcctgctgtgcagcctggttcctaacaggccacagaccactgcaggtctgtggcctggaggggtggggaaccctgagctaggctcaactttagctgtaacacaataatcccatgaaatgtaaagcaaaacgtaaccactgaatattatcatttgttaaatggcaagatgtctaaaaagctttctaatatgtccttatatcatcactcttagtgtgatgagaaaattttaaaaaccagttataatttcttgcagtatagcccaaattaggtaaaataatttgaagcctcttattcaactctttttgttttatttttaatatatagttcagatattagcaacctcttggggccagaagtgaggcttaagaatgcctttggccataatggaaattatttgaggaactccagaaggctgtatctgggcaaaattaccccccaaatactatcagaagtacccatcctttgggtcatttttaacgacaatggcaacaaaagaatgtcttctttgcaatttataaatgtaatctggaagagaagagagactatatggatctgatctgactcatatcagtcaatagtgtcattaactctttggtattattcacaggcagatgtagattctgaagagcctaaaatgtcgtacaaccttggtaccttacttaataaaaagaatactaaagaattaatataaaagtgggttctacaaatagtattatacttagaaagagaaaaaaatcaaaatgaattaccgtagctttggaggttgaagtccctttctcctaagatctctttagacaatttactagaaataattatatagaaatattttccaaatttgaccttccactccaacaccctatgacactgagtaaatgccagcactcacagggactcatgcatataagaggcttaggtttaataagcatcatgataaatcaggtgttattgtgtcatcagattaacaggtagaaaagtaacaacaataccaaatcaattttaagaataggcagggaaatcggaaattaagtttgaggactgcttcacaagagcattcataggtagcttctaaacaggatgcctggagtcttcctatggggcttacaagtaagagagcattaaagataaacttcacatcattagaaacattcggctgagtttataggtatcaccagcagaccacatcctgctattcaagtagctagtagagacaccatggggaaaaatgctgacatgaagaggaagtaaaagaaaggaacctggcaggtatagtatggaggggcatggggaaatatttaagaagaagcagatgaagcaaacattattgataaagagagaagaagtcgttaaacatttgtttttggtgacataatagtgctaaccactcagttcacttgctatttatcaggctcttgatgtgcagcaaattttagactggaaagtaattgagggagttagccttttagagtaggacattatattggtgataattcccttctatgtcctcagtaaactgattagaaaaatgaaacccagagttttctgatctgtcagagatggtacagactagacattcagtgaagccaggtctagaagccaaatctttgtgataaaaactttagtgacatttttttctcctttgccaaaaaattaaaaaaaaaaacaataaataccacaaagagcaaagataacctttctgtcttatgtgagattaaacattttccatctaaacttatccatatgctttcttcaaaacttatttcaaaacctacataacaaataaatagataaatattaaacacataaaatggttttctcgccaaaggtagccctttttttccctttgcatgtccagtgtatatgaccttcatatcttaaagaatttatcttactctatttggatttcttcttctttcctctcattccacatacatatgcaaaataattgtacagagaactacatatgcacaaagatgcatccatgctcatatggccacaaacatagacacccccaaacacatgcacagtctcctcagagaagcatctgtgccaaatcatggctgttttctatgtggtattttacacatagggggcttctaaaaattaattttaggagaaaatttgctccaaggctatctgatggcactagcaccaaaatccaccaggcctcagctattgcattgttttctaataggtgaaagacctatccagtctcactgcttcatctaccacctctaaatgactgtaggtgttctcccctgtctagaactcatcctgagcgtcattctctcatttttactgtgtggtcagatactttcttctgaatatcttgtaggtacttcaaactcattacctccaaattgaagctcatcagcatttctactttaaccgtgtccttttttcttttactgacattgccaaattccccaagctgcaaattatagtgttattattgacactgcccatgcccttattcctgtacctcattgtctgccgagttttgccaattcagttattaattggtttttcccatctagtgccttttgtctgtttttattactattattacagctcaggtctttatcttgtattactgaagtaatgtcattgatttatttgtctctgctccagtttcactatatacatctcagcataatgcagcttccctattcaaaaccactgtagctccaaaacagattaaagtctaaatgttttactctgataatcaatgctctctatttttcagattccatctgttttttcattccatccatatatttccagatttatctaatatcacttcccttcacatatccagatgtcagaaaaattgatattcctatttctggtcacttcccatctctttatcatttttttatagctccatttactctctcctatcttttttccacttatccaaaccctcattattcttatgatctcctcaaatatgcatgtattagtctgttttcacactgataaagaatacttgagactgggtaacttataaagaaaacagacttaattgactcacagtttcacatggctgggaaggcctcaggaaacttacaatcatggcagaaggtgaaagggaggcaaggtacatcttacatggcagcaggagagagagagggagcatggaaaactgccactttaaaagtctcagatttcatgagaactccctcactatcatgaggacagcatgggggaaactgcccccatgattcagtcatcttccaccaggtccctcctttggcatgtggggattaccatttcagatgagattttggtggggacacagagccaaaccatatcattctaccccgacccctcccaaatctcacattctttgcacatttcaaaactaatcataccttgactcattttagcattaatccaaaactccaagtccagtttatcatttttgattgcgtctatttgattcttctctctttttttctttattagtcttgctagcggtctatcaattttgttgatcctttcaaaaaaccagctcctggattcattaactttttgaagggtttttttggtctctatttccttcagtcctgctctgattttagttatatcttgccttctgctagcttttgaatgtgtttgctcttgcttttctagttattttaattgtgatgttagggtgtcaattttggatcaactaccatcagagaatactacaaacacctctatgcaaataaactagaaaatctagaagaaatggataaattcctcgacacatacactctcccaagactaaaccaggaagaagttgaatctctgaatagaccaacaacaggagctgcaattgtggcaataatcaatagcttgccaaccaaaaagagcccaggacgagatggattcacagccgaattctaccagaggtacaaggaggaactggtaccatttcttctgaaattattccaatcaatagaaaaagagggaatcctccctaactcactttatgaggccagcatcatcctgagaccaaagccgggcagagacacaaccaacaaagacaattttagaccaatatccttgatgaacattgatgcaaaaatcctcaataaaatactggcaaaccgaatccagcagcacatcaaaaagcttatccaccatgatcaagtgggcttcatccctgggatgcaaggctgattcaatatacgcatatcaataaatgtaatccagcatataaacagaaccaaagacaaaaaccacatgattatctcaatagatacagaaaaggcctttgacaaaattcaacaatcttcatgctaaaaactctcaataaattagggattgatgggacgtatctcaaaatgataagagctatctatgacaaacccacagccaatatcatactgaatgggcaaaaactggaagcattcccattgaaaacgggcacaagacagggatgccctctctcaccactcctattcaacagagtgttggaagttctgggcagggcaatcaggcaggagaagggaataaagggtcttcaattaggaaaagaggaagtcaaattgtccctgtttgcagacgacatgattgcacatccagaaaaccccatcatctcagcccaaaacctcctcaagctgataagcaacttcagcaaagtctcaggatacaaaatcaatgtacaaaaatcacaagcattcttctacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccttgctcatgggtaggaagaatcaatatcgtgaaaatggccatactgcccaaggtaatttacagattcaatgccatccccatcaagctaccaatgactttcttcacagaattggaaaaaactactttgaagttcatatggaaccaaaaaagagcccgcatcaccaagtcaatcctaagccaaaagaacaaagctggaggcatcacgctacctgacttcaaaatatactacaaggctacagtaaccaaaatagcctggtactggtaccaaaacagagatatagaccaatggaacagaacagagccctcagaaataatgccgcatatctacagctatctgatctttgacaaacctgacaaaaacaagcaatggggaaaggattccctatttaataaatggtgctgggaaaactggctagccatatgtagaaagctgaaactggatcccttccttacaccttatacaaaaattaattcaagatggaataaatacttaaacgttagacctaaaaccataaaaaccctagaagaaaacctaggcaataccattcaggacacaggcatgggcaaggacttcatgtctaaaacaccaaaagcaatggcaacaaaagccaaaattgacaaatgggatctaattaaactaaagagcttctgcacagcaaaagaaactaccatcagagtgaacaggcaaccaataaaatgggagaaaattttcacaacctactcatctgacaaagggctaatatccagaatctacaatgaactccaacaaatttacaagaaaaaaacaaagaaccccatcaaaaagtgggcgaaggacatgaacagacacttctcaaaagaagacatttatgcagccaaaggacacatgcaaaaatgctcatcatcactggccatcagagaaatgcaaatcaaaaccacaatgagataccatctcacaccagttagaatggcgatcattaaaaagtcaggaaacaacaggtgctggagaggatgtggagaaacaggaacacttttacactcttagtgggactgtaaactagttcaaccattgtggaagtcagtgtggcgattcctcagggatccagaactagaaataccatttgacccagccatcccattactgggtatatacccaaaggactataaatcatgctgctgtaaagacacatgcacacgtatgtttattgcagcactattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactgtcgcaaggccaaaaaaccaaacactgcatgttctcactcatagataggaactgaacaatgagaacacatggacacaggaaggggaacatcacactctggggactgttgtggggtgtggggagcggggagggataacattaggagatatacctaatgctaaatgatgagttaatgggtgcagcacaccagcatggcacatgtgtacatatgtaactaacctgcacattgtgcacatgtatcctaaaacttaaagtataataataataaaaataaataaataaataaataaaaagtccaagtccaaagtctcatttgagacaagaatagtcctttccacctatgagcctgtaaaataaaaaacaagttagttacttccaagatacaggcattgggtaaatgttcccattccaaatgggagaaattggccaaaacaaagaggccacaggccacatgcacatacaaaacccagcaaggcagttattaaatcttaaagcaccaaaatagtctccttgactccatgtctcacatgtagggcatgatgatagaaggcatacgctcccaaggacttgggcagctctgcccctgtggttctgcagggcacagcacctctggctctttcatgggctgccgttgagtgcctatggcttttctgggtgctcagtgcaagctgtggatccaccattctggggtctggaggatggtggccatattcttacagctccagtaaacaataccccagtggggacactgtgtggaggctccaaccccgccattcccctctgcattgccctagtagaggttctccattagggatctttccctgcagcaaacttctgcctggacatctaggtgtttccatacacccttgaaatctaggaagaggttgccaaacctgaactcttgccttctgcacatatgtaggcccaacaccacatggaatttgccaaggcttggggcttgcacctctgaagcaatggcctgagctgtatgttgaccccttttagccatggctggagttggagcagctagaacacgagacaccatgtctcgaggctgcacggagaagtggggccccaggctggccatggaaccatttttccctcctaggcgtccaggcctgtgatgagaggggctgctatgaagatctctgaaattccatggagacatttttcccattgtcttcactattaacactcagctcctcgttacttatgcaaatttctgcagccgggtttaatttctcaacagaaaatggggtttttcttttctaccacatgaaaaggactcagaaaacttacaattatgatggaaggagaaggagaagcaaggcatgtcttacgtggtggcagaagagacgagagagaacagggaaactgccacttttaaaaccatgaaattttgtgagaactctcttactatcacgagaacagcatgggggaatctacctccatgatccagtcacctcctaccacgtgcctctcgacatacgcagattacaatttgagatgtgattttagtggggacacagagccaaaccatattggtgcataatacttaatacctcattcatggcaatgatcacttcttatctttcattacagtaatttgatagatagcttttctcccatacttgagtgtacagtatgttgtttctctctttaagaatatagttgctgagtgcttgagagcacaactgattaatcttttgttactcccacaatatttggcaaaatgccgtgcatattatagatattcaataaatatttgactttataaatgaatatttatttggcaataagaaaattttgataacttttcttatttaaaatgggaaatagtcatagtttttttagaacaattagtaactgtactactaatgttgattaacaatttcaataattattagtttaaatgataatgaacatgcatgtaatctagtcctcaggggaagactaggatttcatcaaaatgatagagcctaagtgtactacttatttcaatacatcgaaaaatttaacagtcatcaaacagacattaacaaccaaaccacagtgattttcaatgtaacatctccaggattaagaaacaaattgtaacattcatttgatgcttaaagactattctttctttctaaggtgtgatgggagaatatgagccgaaaattgaggtccattttcctttcacggttacagctgctaaaggaacaactgttaagatggaatgctttgcacttggcaagtaagtacatgttcttccataattaaacacaattttttattaaaatgtgacatatcttatttttggatcacttattttgctaggtgtcatttccccagttgttccatggtggctatttattttctaaaagaaggtcaaatggcaattgatgaagtaatcagttacagttatcttctagtcatttctatggacaacagtttctataattttgctattttaacataaaaaaacttctttaatgaataaaaagctttacatctttacctatgtatcttaaaatttaagtgtcatctttaaatttcattcagtccttatgtaaataaagaagatagaaaggcaaagtactatctgctcctcatgtataggatgtagattcttataagacataataagacagcagataaaaatcatgaggataatagttacatagtgatcctgtgtattaccttagtatctcctgaaatcataacttaatagcaccagctgtcaatatgtacaacatgtaatcatttcccaaatgagagaaagaatttatgtcacatgctaatgcctgccatatttaatgattatatttctgagggtttacagcccaggatatatagtcacttgtcaatgatgtttacagtataggtattgagatcagaggcagaagtggaattttgattatatttgattattgtattatgatttattttaaacagagtgttgttttctttttttttaggatgctaagacttcagggttctttctagacactataatttgcataaatgtatctctgtcagagttactaattacttaacttcagttgcagagagcaaactcccacaatataactataaagtactcggagataaagccagatacacaagtgtgattattaaagtaggtttagcctttgggtaaggaaaatattagtaaatatgacaaaaaatcagctagctaaggtagatttaaggaacgaacatagtaaacaccgtgttttaatatcaagaatgattaaaataagacatatatgcaattctactttaagtagaaacaacatcataatagactataagcaaaatgaattgttatgtgacccatcttttaagcaaaagatagccagaagtagaaataaatttcaaaatgtaaaatgtatctaggaggtatttgggcagatatctgaggaagcctcctaaacctaaagatgttagttaagcgcataagattgaataatagttaaaagtctggtttgtcaccatttgctgttctgtgtcaaataggtctgaaaatgtcccaagtaagaagctcaatactgacaaatgcaaaaataatatattctggcttgaagacaagggttttagtgtatcctgtagttaaataattcttcagtgccagaatttatactaaggccacaaacaaagggaggtcatattgtaaaacaaattagaaaactagacttataggaaaaaaccaatataaatatttccccaggcaagcttatttaataagttagatgtggttgcctttggaagccttgaaatatgtttagtaaattgaggcttacagtctctttcattctaggtaagacccaacagtcaaatcactaaatcacttatgttcttttaatatgttattttcttcaacctttctactccttctttgctacccaactctcaaaagtaaatacataaaagggagtgtaaagaagactgcttcactcaagaaggtctctgtttatcacttggtgtcctttctaagaaatgtcacaattatggaaaaaagaaacatcttatgaagatgtctaccctctacctaaagaccaatctgccacccttatgaaaataaacaagatcaaagaaataacatcttgacatgtgttcatccttttacagcacattgtcttgtggtgtggatcaccatttcatcccaacataatcacagcaattgcaaattaattcctgagcatccgcgtggctcccacagctcacttgagctgcttcttacttcagcaagcacatggtgctcttgtgggcctttgtctgttgcaaaaacttcagtatctgtcactggatatcgtcaggatcttaccactcaggctgttttccccctcactgtgtcctaaccaaacattccttgtagagtgttataaccaaattctggaatggagcatgtcaaactttttttttgtcttgtggcctttgcacttgctgtttcttacactgggatctctctccccctgttctttccatgggggctctcattcatcctctggcctcaatttcaatatcactcctgaaataggctatctatgaatgtacatgttatctaactcacacccattattctctgtctgtatactttttaatcccttttttacagtccttaacacaattttaaatttcccacatacgtgtttctccacttaaaacatttatctgtgtcaggatcccagatgtaatcaggatccaactcagacatttcaatagaatttagtaaagtgatgagctgaagatctgtgagcaggctaagaagaacaagaaaaaccaagacatgtataaactcctgatagcaatgactcattgtcatgtgtaatcctgaaggagcaagtgggaggagatggtgtttccagaaccagggaaaactggagatatgaagtgggccagggatcaaccaatgggagctgtaatgactgttgctgtgaagagacacagcctttatataagaacacagctgaagaaaggattaggaaatttatatcctgacttctttttcctcttgccttctcatctcctctggtggctctcatggctgaagtcaaacagaagccactctacaagcctgcggatgcaattgtcagttcacaaggcaaggcagagggtctgcagggaacaagaaggtgacaggcaagggaggaaaacagaatagccagcactttccccactcttaggctttaatccccaagaaggcaggaatcattactgtattcttcatttacttattcctagtgcctaccacagcacctggcacatagcattcaggaaataggaatgaatgaacttaaaaatattccatctacttaatccaatcaactctttattattaacagttaatcaaaaataaataagttatttatgccttatcctgtcccccccacaaatacatcatgtatactctgcacctgtatctcctgctctcccgtattctcttatttatatccaaaattacatgctatacttgcctctaccttttcctacctattcttgcctcactctatcatttatctttgttaacttagacctaccattctccaactctcttttttatttttgtggtaagaacacttatcatgacatctaccttcttaatgagcttttaagtgcacaatacaatattgctgactataggtactaggttggcaacagcaaatctctagaacttatttaatttgtataactgaaactttatttttattttattctcaaagcatattttcatgtccaagttgtacttactgtttaacatgacaaccccaaaaaactttcttgatctactgcctcttaagaaggatttgtttgttgccttttttgaggctaaggataagagagatttatcatatctatagaagctagggcaaaggatggagtgaaaaatatttatatatcacaaagtgtaatattttatataataatggtttgagggacaaacaaagaagatcataagtacaaaatcttgctattttcaactttacctgttcccagccttagcggagtaattcacatttcctaccataaatcactattttttatcatgttattcattgaaccaaatatgttcctagatatacagtcattccttggagatatttgaggttcagttccagatgccacaataaagcaaatttcacaatgaagaaagtcacatgaattttttggttttccagagcacacagaagttatgtttacattatattgtatgttattaagtaggcagtagcatttacatgcctggcttacatacatacaacaatttacacacgttgatttaaaaatattttactgctaaaaattgctcatgctgatataagtcttcagcaaattatcatctttttgctgatgactgatgctattgactgataagggtggtggctgctaaaggttggggtggctgtggcaatttattaaaagaagacaacaataaggtttgtcacattgattgactctgtagcttatgatgctgttagatagcattttacccacagtagaacttctttcaaaattggagtcaatcctctctaactctgccaccactttgtcaaccaagtagatgtaatggtccagatcctttgttgtcatttcaacaatgtccacagcatcttttccaggactacactaactcaagaaacccctttctttgctcatccataagaagcaactcttcattcaacttttatcgtgagattgcagcaattcagtcacatcttcctgttccacttctagttcttgttatcttgctgttttcatcacatctgcatttactttccccactaaagttttgaacccctccaagttatccatgagggttagaaccacttcttccaaattcctattaatattttgaccttccatgaatcacagctgttcttaatggtatatagaatggcgaatcctctctagaaggtttacaatttactttgctcagatctatcagtggaataattacctatggaatctctacccttataaaatgtattttgtaattcattcttaagtcattggatttgaaatttgaaaattactccttgatccatgggctacaaaattgattttgtgttagcaggcatgaaaataacattaatattgctcatctacatcagaactcttgggtaatgagatgcattgtcaatggacagtagtatttctcttcgctaatgagatgcattgtcaatggacagtattattttgaaaggagtctttttttctgagctgtaggtctcaacagtgggcttaaaatatttagtaaaccatgctgtaaacatgcagtgtcaccaggctttgttgttccatttcaagaacacagagtagatttaacataattcttaagggccctatgattttcaaattggtaaatgagcattggcttcagattcaacgtcaccagctgcattagcccctaacaagaaagttagcctgtcctttgaagttttgaaaccagacactgacttgtttttagctatgaaagtcctaggttgcatcttctttcaaaataaggctgttttgtctacattgaaaatctgttgtttagtgtagccatttccatcaattatcttagatagattttctgaataactagctgaagttttcacatcagcacttgctacttcaccttccactttaatgttataaagatagcttctttccttaaaccttataaaccagcctctgctaggttcaaacttttctcttgcagcttcctcacctctgtcagccttcatagaattgaagacatttagggcctttctgtgagttaggttttggcttcagggaatgttgtggctggtttgatctacccagaccattaaaactttctttctatcagcaataagcctgttttgctttcttatcatttgtgttttcactggggtagcaattttaatttccttcaaaaactttttttttttcattcacaagtcggctaactgagcacaggcctagctttcagtctgtcttggtttttgacttgccttcctcactaagcttaatttctagcctttgatttaaactgacagatgtgctgctcttcctttcacttgaacacttagaaaccattgtagggttattaattggcttaattttaatattattgtgtctcagggaataagaaatcctgaagagagggagagagatgagggagtggccagttgatggaacagtcagaacacatacatttattattttagtttgctgtcttctatgggcatagttcatggagcttcaaaacagttacaataataacattgaaagatgactaatcacagatcattataacagacataataaaaaattgagatgctccaagaatttccaaaatgggacacagtgataataagtgaaagcaggctattagaaaaattgtgccagtagatttgcttgacatagcattgccacagaccttcaatttgtgaaaaacacagtgtctgcaaaacacaataaagtgaagtgcaataaaataatgtgtgccagtaccttctgtcttaagaaaaaataattcacttattaattcagaggtgtcaaaatataagagttgggctttgtgtagctcatttcataaatatagtagactaaagtacctcaaagaacctagaaccaaatgcaggtctgcaagctctgaaagccaactatgttctagggactgtcatatcttccaggatttccatagtctctgttctcaaagaaattgcattatatcttcaaatattttgctgaatgtaatattacaccttgagtccattcttaatcattatgtaaacatacactatggaccttgaccaagctgtcctctaatagccaacctttatctccacagaaattcactattcgcctttttggttccaagtttaaactaagacttaacaacctaacagcaaattttcttcttttgaactctctttggcccttgacatgatctaatgaatcttcgataagccaaattaggaaatttctttgatttttaaagaatcatacattcaaaccgtgttagaatactggttcattgtgatttctcttggaaagtacagttacctttttatgatctgtccttaatggtgttcagtttttgttacttagagcgtgcatattagtgcagctataatgcacagataatttttccatatataagcttatatctttcccatattctttaagaaaaaagaaaacaaataattgtaggttatcaaattttactatattttgatatcacccaaatttaccaacctgcctcatttgaagttaggtaaaaagtctactaaaaagccataagctgcaagctttctcctaaagaaacctctacttaaatctgaatttagcgaaaattcagatgttttctctacaggctgctggagcagaactcaacaagagtgtactagtttactcctagaaatagctcttaaaatagaattgcacaaggttgagtacagaacttttaaagtgaccgtgacatgctatatcatgctatactgtctgtaaaggtatttccccagaaaaatgggaagtgtttcaagagaacccatagggaaacaaaggtatgtaaaggcttgggtaacacagcaaagtgtaaaaaaaaaaatggagggggattaattagttggaaagaaaagactggtttagacatatggaaggttattatcaagagattgctcacaagctgttctccagtttcaacaagggagggagtgaaattccaacagtatgggattaaactagaagaattagattgggtgtaatgtagaagttcatgaaaaaatgagttgttacagggaaactgggttatcaggagaggcagtggaagctctttgcctgaactgctgtaagaatataataatgcccatttgtcttctaatggtttagatgtaatgttccctgaaaggagagaaatgatctgggtcaggattggaaacgaaaatttaaatattttcttttgctggctgcccatccacacattctcaggctgaatattaagagtagaaggatagaatcaggcagacttaattaactgccttttggcagtgacattattacataacatttcaaaccggttggtggcatatccaggaagtagaaatgatgagtgttgacttttcttgctcagcattcaatctagggaccttaatggaaatggggttattgtggatatttccaaggtcggcttttaaacatcaggtacaatactcttgaaagggattgagagataaaggggtcaagggacaatgcaagcaaggaatcccttaggaccctaataaatatttcatttcagtggttctttctaaatgcagtatataattaaacattggtgatgttttcaactgggtgtgctcagtgtttaagtccagcccatacaagttgttaactaagtaacacagggtaaaaatgagaactttatggaaagtcagtaactacagaaagcagctaccatctctagaggtaaggggggaaaaaaagaattagaattaataaaaattagaacctcagatgtacccctaggaccaagaattctgaggaatggacgaagtgggacacaatgaagcctctcctgaaagtgttgggaaaaaacttgaactgtattttattgctgctaagggaaggattccctgctgaggtgccattcaggggctatcgagctgacaggaagcccctgggaagcccacaggaaataaacaacgatggtgttccttctggcttcttcagccttgcaatctccctacagtgccccctcctggcagtgtagaaatgtggttttcagaacccttgccccagtaccacaaagcctagtagaggatggagctgagaggtggtcatttaaacagtagcaccaattccacttgacattttcaaacccatctcttaatcaactgcaccccttactatacctcagccatcctggctttgccacatctgtggctctgtgacacagtttcctctgtctaaaatatctatcctgccccacaatcctattcagtaaggcttacgtcaaatgcccctcctccattaatcctccctgcttttcttgagctccagtctcttacctttcagtgtgaccacctacatttcactatttagcctgccccactggaacagctatagatatctgtcttctttagtgtgctgaattttgggatccctagagcattattagatgcagcaggtgctgaatatgtacactgaatgaattcaggtatgagaaatgtgattgatctttcataacaggaggtgtgttactgcctttggtttggccagacagatgtctccagatgctttcacatgttttggccttgaaaattcttaccacatttacattagctatagttttctggcaagtttcatttcaccgtgtgaccttttacagaccctagaaagagcactagatatgtcaactagcctccaacagaaacagaagtaaaatctggtcactgatgcttaaatgacccaatacacaagggcaaacagggttactctgtaataaaaaagccaaacgctacaaaacaacatcagtttatccataatgacaggcctgccagctaatagtgttacaggcagattttctctttttttctctctttttaaaaaattttacatgtttcttatcttgctcttgcagccattaacacacaatcagatctgctctgctcaaaaggccttgaacctgttactgtaataattatgtgaatgacctttgcaaactcatctgaaatcttgtggtgaggtgggagggaagaacacattcaatttcctgccctttttagttcctgcttatctctctttcagataccatttacaaatagtcttttgttacactccatcaaatgcctattagggaaccagggtattaagtatttttttctctttttatatgtttactgtaaataaaaagccactagttatcaattcataaaattatttttgctgtagtttatgttttcctttcctcaccccttagctaagctgtctcaaatggctgctcttgtgtcccattgtaactgtgagaatgacaaatattcctctgagacttcctacagtgtgcaactggcaaacgttcctggaagaacctgctctttagttacagattgatgatttattaatactgtttatttggagctgccagtcactaagggctgtaggaattaaaaatgaattggagttatgtggtatttgtctatcaaactaaaatcaaattacttaatcattaggttgacagaagatctggggataggagtcagtctctgggtgttggaatcaataaacatttaggcctcacaggaaagtggtgcattacagaatcaagaaaattgccatcatgaactattgcttgctttagtatggttgagatgaaggacacatcctcatttcagatggtacccagaggtgatggatcctaaaagaaccttaaggattgcatgacctaacaaacgtgaatttgtaaatggaaaactgagacttctcaaggaatggctagacgtgtggatgtaccgctcaggctaatgttttgatgcaacttcctgtgatgttcttgacgtgttcaacattctttcatagggcaaactttgaaggaaatatttaatttacttataggcttttacactgagaggtgttatgtgttttcagggaaacaggaccaatttattattcacatttagagtcaaagttaactggcatcatatttccagcttttccacggctgccctagaactagttaacctgcctcaggagagaaactgtatacatgtgcaaggccaaacagctaatgtgtgtggcctatagaggcagaactagataccctgatgctaattaatagtattctcagtttacagtttttcagttgctaagagtaatttttactttgtcacagcaaacattatattctgaatgccctgaagcatctcagtgagtgagaattaggaatcttaataggcaagacaagttaacaagaacatgaagcaaaagataatccccaaattgtaagatttttacttggattagtttagacttatccaacagctttcttttaagttaatctcccaggaatttccatggaaaagtttcttcctctgggatgatcgtaagatcagcaactatctggatgctgagattcaaaaacaggatgtaaagaattactttattaaaagaatgaagttatgccttttgcagcaacatgtacataactgaaagccattatcctgagtgaaacaactcagaaacaaagagaaataccacatgttctcacttacaaatgggagccaaataatgtgtacacatgggcatatgctgtggagtaatagtcaatggagactcagaagtgtgggagggtgggaaacgggtgacagatgagaaattacttaatgggtataaggtacattagtcagttaatgattacactaaaagcccagacttcaccactacacaatatagccatgtaaccaaactgcacttgtaccccataaacttatacaaataataaaaaagacttagtatatccatcagaagtttctaactttattgtatcccatacccctacaagaatcaccaggtacataatcttgacacttgaataggacatcagtggaacaaaaaaggacaattttaaccaaaaagttgtcaacaatctgagtatatgtaaaactaaacttctaccttgtcctggatggtttccatatcacactcagattccaacaacatctctgacatgttatctcactggattacaaacaggaatgaatttaggcaaattatgtatcccatttgacctgtttccttattttgaactctcacagtcttggatttctaaaagtgttatatcatcatcatccacaaattcccactgagtattctactagaaattgaaatgtttccctaacagttatctcttctaatggtgatttaacaactatattgctacttttaaagccgatttatctaacaataaacttgcttgaatatctttgtttgagatctcattctatctcatatgttttatgacaatactcaatttttaaatctatcatagtacatgtattcttaaaagtagtatgtgtcttactgaatcactgtactttgaactaagcatgctcgtcatgtgtctaatatagtcatatttgtattagttaagctaagagaacaacaaacttctccactagagaaagatcaatttagaacttcaagaaggttttcatatgcagttcttagaatgatttcatggtaacttggaaattaggtaccaagtgtcagtaatgtgcatgccattagaatttcatgcattcaaaaattttgtatttattatttcaataactttgaaaatttgaatatgtgatgatctagtgtgaattactaatgttatatataccacatttgatgcagccctctgcataacagcagtatctctaactcacctcaaaccattggcatcattatcgacctctgccaaatcttccatcccaatctgccagacatttaaaacctctcaagtcccccctctccattttattctatttttcacaaacatagttcaaatctattattattggacaaatttggctctcttacctctgctgcaaataagactagagatgttgttgtcccagctactcaggaggctgaggcaagagaatcgcttgaacctgggaggcggaggttgcagtaagccgagattgcgccactgcactccagcctgtctaaagagtgagactccgtctcaaaaaaaaataataataaattaaaaattaaaaatacatagatttttattgatgcttcattagctttgggaatttctccaagtgctgctttcataggccctgctccattcactttatctgtttggttgtctattgttccccggaccttattcctggtttccaaatcactcctatctcatatactctgatgttattttggactttttatttgattgttgactccaactgcacctcttaatttagcctatttgatgttcttcaataccttggtccacagcatgtgggatcaggctgggtttctagaactccaaaccaagcacaactctccacactcacccatcatcagcctacataaggagtttttattatcactacgggtgaccatttaggcgttttccaaaggtataaaattttaaatatctttgactctttcttcctttttatcatcatctgtttgattaccataaatgtctcttaaattgattaccactgacttggtgcataatgaacatttgttaactgaattaagtcatttatcaatgtaataggtatatatatgtactcaaggggaagcacgaataaaccaatatattaaaaaacgtataagcctgagactaaacatgtctaggcatttagattgtaaaaataaaagctcagtccgtcttagtctctatctcaaattatggcatcatcctagtagggtgttatgcagtaatatctgtgctggtatgcccaaatttcagaaacaatttttctacttgggttctagcatgttgagttgccttaccaaagtcactctaatgaaaaacaaactgtgataacttgctaataaccatcactggtggcccattcatgtaagaaatgccctcagtggaaacaggactaattaaaaatctggtggcctataagcacagagtaagagcaaagtgcacacacttccctgtggtctgtaactaacaaggtactgcaaattcatggattgcagttcttttctcaaaatattcttgtatatttagcacacatcagcaagattacaagcatctcttctctgggtggtggtacggaaaaactaattttattgttgtgattgttattattctgtactttttcaagacacttaattttaaaaaacaatacaaatattttacatgataaaattttttagtattagtttcatgaccctatattaaaatttccaaaagcataggctttttttaaaattaattacataaggtgttgatgatttcctttagattattcaataggaatcctatccttgttaggcacatacttatagtttctaatctagaattataattatatgatgtcagaaatatttctacaaatacttaattccattcattctagttcattcttgttcttcccaattcagaatttattctgacatgtacgtgatacatcatatttatttgtttttagtatcccttgccagagagttgtaatatgagaaaactttctcttatgtctctgatgcttttaacaggcagaacacagaagaccatatatacaatttatttatgttctcaccaaataagtaatcagagacaaaagtctatgtttacctttggaatatccctctcagtgcatcatacaacttgaaaacaaatgccatagatacgggagaagggagggtgaaattacagggaaaggctgttatctgaattacatttttcaaaaacatctcctatgcccatatcatacaagtaacataagttttatctatctctgtaataattttattgtaaagcaatttgctgtaaagttaaaatattgcaacttcatattctttacttttattttgtaaatatactatttaaatatgcaattaaataaatgattatacatgtgcaatgtataatcagtgtggttctgaattgtcttatagctcattcttcgttgccttagattattcatgaatcttcattatatctaggcattttctactttatatgacagtgaaataaaggttttcattattttttgatttggtgctttttacatccattgtcccaggctgtttgcttgatttttgatggtagagccgtatgtacatggtggcatttgctacaattagatttaatatatttcttgcataagtgaaacatgtaagcatgtttatgtatgcacatgtgtgtgtgtgagtggttaaatccacagaaagactattgagaatgaatatgccgagacataaactcaacatctaccaccctgttttttctttgttttttaatttacaatgtaatgtagcagcacctaccttgtgtgaccggtcactggttttgttggtagttaaatggtgcagaacaggttccatgtcaaagctttataaggatgatttttggtctgaaaaacataattctcattaatagccaatagattttaaaaagatagtcgatgagaacatatgtctgctgctgctttatggtaccaaagctaaatgataagtacttttgatcatttttattcccacttttcttttctttgggaggttgaatcaatctacattacaactttgagaatgttttatttatggcctttttctcaaagaaaggtacattatgaaatcaggtcacttgttttatatatccctacagagaaatgcagccttcacaacatttccaaaagaagaacacacatcagtatttcccgtacagacacacagaggaagaatatcttcaagcctccacttcatgtcattccattacatttagccacattctgttgagagaaagcatagatttagtagacccaatgcatactttttttgcattttaatatctctgaaatccagatgtatattgcactcaatgttgtgttgtagtttaattggcagtgttttctttcttagagatagtggtgtgtcttaaagtagtggtgtgtcttacagtcaaagactgtatcttgaatgtgataaactagagtaagatagactaaaattggcatatataaacactaacttagggatcaattaaattagaacctgagtgatgacatgtacttcctccatctatgtgcagtttaatatttaaaatctgagttaataaacaaaagatctctcatagtactggaaagattttagaataaatgattgttgactacatattttcattttataaaatcatcaagagttattgtagcgtcaacagtgtttgttactccaaccatgccatctatgggatttcacacacaaacactttttggaaagaagggttgaaatacaaaggaagctagtccaggagaatccctctgcctgcactgcctgcattatctttagtctgtgggttttattgactatgtgttacaaataaaagaaaatagaatagacaaagactgaaagagattgtgcatcaggtggttagaccatttggttattgtttgacttttgtttgggggggtaaaatgggtataatagaaataacaaatattctaatacattttccgtgacttaaatgtgtagagaaaacacaatatattaagtcaaaagtacaattaagtaaattaactgtactgctaaagtatttcttcaggcatctttttaaaagctttattgccatataattggaacacaataaaatgtttaaactgtagaatttaacacattttaacatacgtatttttaccatgaaaccatcgcacaatccacataataagcatatccagtacctacctattaacatttctacatgtacacttataatctcttcctccttcccatccacgcatcctcaaccccaggaaactgatcctgtatgttttgtcactatagactacgttaccttttctagtcatgcataactgaaatcatacaatatctactcttttgaccgagagtgggagagtttgccttttttcatttagaattattatcttaagattcatacaagttgttgaatgtgtcaatagatcattcctttatattgcacagtagtgttccattttatggctctaccaccatgcgtgcatctgtgcacctgttgatagacatttggattccatgtttcagctattaccataaatcttccatgaacatttgtttagaagtctttatatgcacataagcattgaaagtttttcttagataaatacttatgagtggaatggctaaacgatatggtaggagtatgtgtagctattgaaaatattgctaaacaatttttcaaagtagttgtactattttgcattattattagcagcagtgttggagagtccaagtacctccacgtctttgccaaaacttggttaatctgtaattatgccatttaatatgcatgtagtggtgtcacattttatgttggattccccagtgactaatgatattgactgtgttatgtgcttatttgataactgcatatttctttagttaatagcttgccaatatttttgcctgagatgttgatatttttattattaaattttgcgtgagagttgtttaaaattctggaaacaagtcctttatcatatatgtgattcgcaaatattttctcccactctgggactgtctttttattgccttactagtgtgtctcaaaaggtacaagttttaaattttgatgaagtccaaattttcaattttttgtggggattgagattttagtgccatagctaagatatatttgcctaaaccaagggcaaaaggttttctcctacattttctcctaaaagttttatagttttatgttttccatttaagtctctgctgtattttgaattaatttttgtatgatacaggtatggatcaaagttcattattttcaatgaatatcaaacttggtcatcaccattctactctccacttatatgagtttgacatttttaaattccacatataaatgagatcatgcaatattcgcgtttctatgtctggcttatttcgcttagcagaatgtcctccaggttcatccatgttgttacaaatgacaggatttccttctttttcaagggtgaataatattccattatgtatatatatcacctacttttatctgtttatttgttgatggactcttaagctgattgcgtatcttggctgttataaatatatgctgccaaaacaggaatgcagatatctttaaaatgctgatttcaattcttttggatatatactcagaagtagaattgttggatcatatagtggttttatttttagtttttgagaaatctttataatcttttccatgaaggctataccaatttacatgtccaccaccaatttataagggttccgttttctccacgtcctcgccaatacttgttatcttttgtctttttgtaaaagtcattctaagacatgtgaggtgataccacattgtggtttcatatacctgttgaccatttgtacctctttttttgagaactgtctattcaatccttggctcattttctcatgaagttatttgttttattgctactaagtttcttatatgttttggatattaaatctttatcatatatatgatttgcaaatattttctcccatctcataggttgtccttttcactctgttgattgtttgttttatcaggcagaagctttttggtttgatttgatctcatttgttcatatttgctttgttccctgtgattttagagtcatattcaaaaatctttacaaggaacaatcaagaagctttttcctctgttttctttcagcagttttacagttttaggtcttacatttaagtctttaatccattgaaaggtgatatttgtatatggggtgagacaaaggccctattttattcacctgcaagtgaatatctagtatttcctacaccatttattaaagactgtcctttcctcatggtgtgttgttagcacctttgtcaaataacagttaactgtagatgtgtcaactcgttttttgattctcaattctcttccatatgcctatatgtctgtttctgtgccagtaccatgctgttttgattgttataactttgtggtagattctgagatcaggaagtataatgcacccagtttgttctttttgctcaagcttgcattggctattgaagatcttttatggtttcatatgaattatctctgtttgcagatgacataatcttatatgcagaaaacattaaagagtccaacaaaaagctattagaaccaataaacaaattcagtaaatcgcagaatacaaaatcaacagacaaaaatgaatggtgtttctgtacactaacaacaaagtatctgaagaaattaaaaataaatccatttacaatagcatcaaaaagataaaatacttagcaataaatataaccatggaggttaaaggtttgtacactgaaaactataaaatattgatgagagaaattgaagaagaaaaaaataaatagaaagataccctctgttcatggattgaaagaattaatattgttaaaatgtccgtactgcccaaagcaatttacgaattcaatgcagtccctatcaaaattccagttctatgatttctaatttattttatgaatttttttaaaatttagttatttatgagtatgttatttagcttccaaatattttagcatttctctgtctttctgttattaatttccattttaattacattatggtcaaataacacactttttgtgatttaaactctttaaatgtattgagacttgtcttatgacaaagaatttgttgtattttggtaaatgacttatgtgcacatgggaatttacatactgctgttagtgagtggactagtctacaaatgtcaaatagcttaagttggttgaatgtgttgctcaaatcttctatatctttattgatttctgtctagttcttctgtaagttatacagaaaagagttgaaattttctaatatatttgtagatctgtctgattctccttgcatttctatcacttttgccccatatattttgaatctctattatatagtgtacatactttaggatgtttatgcttctcgataaattgtctcctttaccactataaaatattcctgtttatacatgataatattttttgctctaaaatcaactttgtctgatattaatacagatacttcagctttctctttgagggacagaactaataggatgtatgtatatatgaaagagtgtttattaagcagaaatcactcacatgatcacaaggtgaagtcccacagtaggccatctgcaagttgaggaacaaggaaaccagtccaagtcccaaagcagcaaatgtagggaagctgacagtgcagcctttagtgtgtggccaaaggcccaagagcccctggcaaaccactcgtgtaggaacaagagttaaaaagccaaagaacttggagtctgatgtttgagggcaggaagcaaccagcacaggagaaagatgaaggttggaggactcagcaagacagctttttcttctaccttcttctccctgctttttccagcctcactggcagctgattggatggtgcccaccacattgtgggtaggtcttcctgagggtgggtcttcctctcccagtccactgactcaaatgttaatctcttctggcaacacccagaaacacccagatacacccagaaacaatactttgcattcttccatttaatcaagttgacacttaatattaaccatcacagcattatttgcaaggtgtattatttaacctgctattacttttaaaccgttttgagttttcatatttaaaatagatttcttttaggcagtatgtagttgggtcttactttttaaaccaacataacagtatcttcctcttaaagtagttattgacatggtgtgtttaaatctagcatcctgctatttgctttctatctgtcccctatgttctttgtacattctattctttattctaccttcttttgtgttaatggtgtattttattctattttatctctttagttagatagtattacttctccacatattataaagcccatagtacaatgatactatttgtttgactttaaacagctggttaatctttcaaagagatataaataatgagaacattaatttatatttgtccatgtagttaccattttcaatgctttcaaattctttgtttagataactggtttaatctggcgttattttctttcggcctgttcctccaacataattgtaggtaggcctaataattatgaattatttcaacttttgtatgcctaaggaatgtctttatttcacttttgtttttaaaacatattatcactgattaaagaattacagaccaatatcttcttccttcagtacttcagatatgtttctctactattttctaacttgtataatttttgacaagaattcagctgttactcttatatctgttcctgagtatataatgtggttttttttctctgactgctttcaagattatctctttataataagttttatggaattttattatagtgtacctaatttagttttcttcatgtttcttgtgcttgtggtacattgagcttctgggagccaaaatttttgaccattgttttttcaaggaagtttttctattctcctgctccttttaatttggaagctacaattacacatataatagtctgtttgaaattacccactgttcaacgatgctgtgatcatttttcatcgcttttcttttgtctttgtatgtttcaccttttgatagattctattgctgtatcctcaaatttactaattttctttcgcaatatttgatcttctgttaatcacctccagtgtgttttatcagacagtgaaattttgattttttcaggatttttttaaaaagaactttattgtttagagcagttttaggctgaccgcaaaagtgagcaaaagtgcagacatttcctatatcctgtctgcccctacacattctcagtctcctctgttatcatcatctaccaggatggtacattttttacaactgagacacctacagtgacatattattatcacacacagaccataatttgcattagagttttcttttagtgttctaaattctatggatttgaataaatgtataacaacatatatctaccattacagtatcatacagagtagtttcaaaatccctacaaatcttctgggttccatctacccatctctctgttatccctaacctctggcaaccactgatttttacactgtctccagttttacctcttccagaatatcatatgactgaaaccataaaatatgttgccttttcaggttggcctttttaaatttagtaatgcacacttaagttttctccatgtcttttcatggcttgatagctaattttttttttaatacttcatgttgttccactgtctggatataccacagttcatttatctattcagctactaaaggactcttagctgcttccaaattttggtacttatgaataaagctgctgtaaatatccatgtgcatggttttgtgtcgatataagttttcaactccttttgttatataccaaggagggtgatacagctaggctttttatccccacccaaatctcatcttgaattgtaatccctgtaattcctataaactccacatgtcaagggagagaccaggtggaggtaactgaatcatgaaggcagtttccttcatgctgttctcatgatagtgagtgagttctcatgagatctgatggttttgtaagggtcgctttcccctttgctaggcacttctctttcctgccaccttgtgaaaaaggtgccttgcttccctttcaccttcccccatgattgtaagtttcctgaggcctccccagccatgtggaactatgagtcaattaaacctctttcctttataaattacccagtctcaggcagttcttcatagctgtatgagaactaatacaacaaattggtactgggagtggggcactgctataatgatacccaaaaatgtggaagcaactttggaactgggtaacaggcagaggttggaacagtttggagggctcaggagaagacagggagatgtgggaaagttttgaacttcccagagacttattgaatggctttgacgaaaatgctgatagtgatatggacgatgaagtccaggctgaggtggtctcagatggagatgaggaacttgttggtgactggaataaaggtgatgcttgcaaatgctttagcaaagagactagtggcattttgtccctgccctagagatctgtggaactttgaacctgagagagatgttttagagtgtctggcagaagaaatttctaagcagcacaatgttcaagaggtgacttgggtgctctgaaaaacattcagttttatgccttcacaaatagatggtttggaattggaacttatgtttaaaagggaaacagaacctaaaagtttggaaaatttgcagcctgacaatgcgatagaaaagaaagacccattttctgaggggaaattcaagcaggctgcaaaaacttttatagctaatgggaagccaaatgttaatcaccaagacaatggggaaaatgtctccagggcatgtcagaggtcttcactgcaacccttcccatctaaggcctggaggccttggaggaggaaaatggttttgtgggctgggcccagagccatgctgctttgtgctgtcttaggacttggtgccctgcatcccagctgtggctgaaagaggccaaaatacagctcagatcattgtttcagagggtgcaaaccccaagccttggtggcttacacatggttttgggcctgcaggtacacagaagtgaagaattgaggtttgggaatctctgcctagatttcagaggatttatgaaaatgcctagatgtccaggcagaggtgtgctgcagggcttgagctttcatggagaacctatgctggtgcagtgcagaagggaactgttgggttggagacaccccctgcagagtccccactggggcactgcctactgtagctgtgagaagcggttcactgtcctctagaccccagaatgatagatccactgacagcttccaccatgagcctggaaaagctgcagacactcaatgccagcccatgaaaacaactgggagggggactgtaccctgccaagccacaggggtgaagctgcccaacaccatgggaacccaccttttgcttcagcatgacctggaagtgagatacagagtcaaaggagatcatttcagagctttaagatttgactgcctcactggattttggacttgtatggtgcctgtagccccattgtttcagccaatttctcccatttgaaatggatttgtttacccaatgcctgtatccccattatatttaggaagtaactaacttgcttttgattttacaggctcatttgtagaagggacttgtcgtgtctcagatgagactttggacttggacttttgggttaatggtagaattaattaagaatttgggggactgttgtgaaggcatgactgcttttgaaatgtgaaagggatatgagatttgtttggggctaggggaagaatgatatgtttagggtttgtgtccccacccaaatctcctctttaattgtaatccccttaatccccatgtgtcaagggagagacctggtgaaggtaactgaatcattgaggaccatttccttcatgccgttctcatgatagtgagtaagttcttatgagatctgagggttttataaggggctcttcccactttgctccacacttcttcttcctgacgcctggtgaagaagatgccttgcttcttcttcactttccaccaagatagtaagtttcctgaaacctccccagctttgagtcaattaaaccactttcctttataaattgcctagtctcaggaagttctttatagcactgtgagaatggactaatacagacagcaattactagattgtatggttatagtatgtttacttttgtaagaaactggcaaactgatttccaaaatgactgtactattttgcattttcaccagcaatgaatgagagttcttcttgttctattccttgccagcatttggtgttgtccatgttctgaattttgacataaaggctgtgtagtagtgtttcattgttattttaatttgcatgtcactcataatctgtcatttggggcatgttttcatatgcctatctgccatttgtgtatattctttactgaggtctctttaaggtttttggcccatttttttagtcagattgttttcttattgtttagttttaagagtcccttttatattttggatagtagtcttttatcagatgtctttgcaaatattttcacttagtttgtggcttgtctttttattctcttgacagtgtcttttacgaagcataaaattttaattttaatgaagtccaacatatcaatttgttttttcatggattatgcctttgatagtgtatctaaaatgtcattatcaaaaccaagatcatcttgattttgttcccagacattgaagtttttatctctaaaattctgatttggatttaaaaaaaaaatctcttccatagttgtacttaacatgttaagtattttctctaggttttgaacacatgaaatgtagttataataactgttttaatgttcttgtttactaactccatcatatgtgtcatttttatgttttggtcaattgtttgttttcttcctcattatgagttacattttcctgattctttgcatacctgaaaatttgtattagatgtcagaaatttgaattttaccttgttggaaattgagcatttttgtattcttgatctttgttctgagatatggttaaattactcagaaacattttattctttcagttcctatatttatgctttttcagataggaactgagcagcatttagtattggcttaatttttccccactgttaaggttaagacctttcttagtactcgaacaaatgcctccctaattatgatattttccacatggatgttaggttaggaactattcctggcctgtataaattctgagcactggtccttctaatcctttcagtgtgtcctttcctattttaaaatagtttttccatatggatgcactagtcattactgaattgaatactcatgagggatgtcctgtagatctctaacactctttctctgcacagctgtcctctctcgtttactgtgaattctagttgctttagtttctccagactcccagatctgtcttttcaactcagaaagacagctgagctttgcctaagtctcccttgctatgctgtagagtgaaaactttgtccagggagcaagcttgggcagttgtatgatttggcatgttaatttaacatacttcaaggattactgtcctttatatgctgatgcctaatattttgcgactattctttcatgtattttgtgtagtatttagctaatttttctcatttttatttactcagtaaaaagtgaatgaaagatagaagttgacccaaacctgctctaaatgtctttatctaaccaagagaatagaaataaagttacctgcatttggaatattgcatattttacctgtccttatttgaataaattatgggaaaaaaaacagcaactgaaaggtaatagagtgattctttgacagaatcctttctcagaaagagtttaaaacagaaacagtaaaaagctacagtaaagtactaatttaacctaccattccttaaaaaaaaaatctgctggataaaattcacaaggactataactcttctgtagttgaataggttacatttttcagtgccaagtgacaagagaaaaataaaggtttaaagtacctaatttcaaatatcagttcaattatctgccacctctatgacaccaaataaattatcctctctgaactgcattttcaaaattaggaaagtaggaataacaattcctacatcatagagttactattagatttctccaagagactcaatacatgaagacctgtcattcatatgttaatttattatttcaccctagttttctagagtatttggggagcattgtttactttatgaagcatttgcctatcctctaacattctccttctttctgaaacgccatccaagacacagtccatttctcaagctttccttaatccaagtatgcttgcattctataaacctctctctgctgcccttcagcttttcatggtgtcaactgaaaatagatggtagaaaattcactctttggctttctgcttacaatatatattgtcatgtgccctagtaatccaaagaaactctgaacccacaaaaatgtttctatagatatgaaatattgggaataatttgttagttctatctttcccaaacattgtttcaggtcaaacctttctttttttcctgtgagtttaaagagtattttctaaagctgattttacttactaggtctagggtgacattttactctggctgctgttaatacttaaaatattttgtactatttctttagcatcagatttggcattcctaactaagaaaatgcccggaggccacaaaatttaaaaacttaaagaccaagagccaaatacgttagaagatagagagagagagagagaataaatattgctctaccattagtttttctgccttaacggctgttggaaaaacatacatgtgattcagatatagaaaaaaaaaaatgacaaaacaaaacaacttgaatcatgtctaagaaagtctggttttagttataatatcaactgaaatattctctgcctaaaacaggccatagtgactttaaatcactaaataagacgatttaaaaacatgctaattggccgggcgcggtggctcacgcctgtaatcccagcactttgggaggctgaggcgggtggatcatgaggtcaggagatcgagaccatcctggctaagacggtgaaaccccatctctactaaaaatacaaaaaaattagccgggcgaggtggcaggcgcctgtagtcccagctactcgggaggctgaggcaggagaatggcgtgaacccaggaggtggagcttgcagtgagccgagatggcgccactgaactccagcctgggcaacagcgagactccatctcaaaaaaaaagaaaaaacatgctaatagaatgcagatattaatataattcaagataaattatactgaaaggtaaatttgagtctgctattccttcataattgagactgactgtggagtattctaccccttacatgaaatgattaatggactattcgtacccctagcttttgtaatgattttttaagttaaaaaatcttttaataattaagtttaattttaaacagttaaagattgggaatgaatctttacagccctctcattctatctttacaccaaaataatgaccaatactgtctgttaaattttttaacctatgcttctgtcatctatttaaaaatgtagagtattaaggctagttcttgtgctttacttgaatggaaattcattaaaaacactgtgctccacaaatataaactgaataaatgtcagcattcataaactgttctgtgctctactttgaactgtagtgtggtttctttttaaccatttaccaaatagtaaagaacatggctgtaggtcaggcatggcttacacctgtaatcccagcactttgggtgactgcagtaggagaatcacttgaggcctggcgttcaagaccatcctgggcaatatagaaagaccccatctctaaaaagaaaaaaaaaaattaaagactagctatagtggaatgcatctgtagttccagctacccaggaggctgaggcatggaggattgtctgagcccagcagtttgaggctgcagtgagctattattcagtcactgcagcctgggcagcagagcaagaccttgtctatattaaataaataaatgcagtgactgtagtagacagcagaagtctctgtcttaaaaataggtgaaagccatgtcccctaattagaatagtatatcattaacatggcatttttaccacctgaccccgttaagctgtgccatagatatgcacaatccattgtgaaccaatgtcacaagtgtgccatgtattgtgtatgcctcattgtccgcttgtctctatttgactttggtgtataccctgtagaacaaaagggctgatgtacatgaatgtgtacattgaatatgtacaagaataatgacttcatagagaaatattttctctctttctagctagaagtttacttaatgtctttttcagtttacttacttataaaacacaaaagataaagcatacttcttaggcttctgtgaaaattaaatgatatatcagataaaatcctgtaaccatgttaaagctcaatgttaaagctcaattaatcatacctatatagtgatagaatctaagaatcagggatggatctagagctggaagaccacatttcccaaatacaattttttcgtgaattaaggtctaaatagatattaaataactgccataagtctcccataatgtcatagggctgggtctagaatgtccatcttagtaccattgctcccctacactttccactgcacagtctataggtgctagctttacttaaaactctagcagctgctagcatcaaatattatgtgtgtctaacttcttaacagaagaatggagattttactttctcctggtacttgatagaattcatagggtcaaccatgagcacatgaacttctatatcacacgaaactattgctacggaataaaagatgaaatgctcctgattattgtaaatacaaagttgcatgtgggattgtgtaaagacaatgccaggttggactgccagaatgagccaacagcgcatgatgtgcttccccctgcagagagcctatgagtggacgtgcagtcagggaggtttcacatcaccaagattcctgtcccagaaaagcagatgttcatacatctgggaatggaatgcgacccttgtggagagcctataaacggatgcatgaggggcgcctgtccatacagataagatagggctataaatgccctcatcttgccacagctcttctaggcctctttagggttaaggtatactcccttctgagaatttctggtctaaccagttgtctagcttcacgtcctgtttctatggattttttgtaaccagcttttgctgcaactgttactgctgattaatatcttgctaatcataggttatggaaagactgtttctgttttaaggctctgttagaaattactgatgcacatgttatattgtaaattcttatctctgtatactgtacttctacatacaggtgttatgtgaaagaattacttcatccccatatgaccatctcacctcatgatcaaatgatcctaaatccctcactaacctacccctgccctcactaaacttaataacaaatgctggtatatccagtgcattggtggcaccacgggaccagaaggtggtgacccccctggacccagctttcactgtcttgtgtgtgtctattatttctcaacctgccgatccacataggaacaaggagagagccctgttgcattgtgggctgctggccagatcccacaataaaagttctaatgcacctaaccatatactctattcaacttgaaacaatgtttcaggaacccaggggctgcaggtgagagatataactttacttttatatatttggcccatgaagattctgagaaggcagtcattctgagagtatcactatgacagtatcattagatgcagcaaattaggttatctgagtgttctagtgctttttttgctgtagtatttagttatattaatgtggattttgttctattacattaaagaattatagtttatttcactatggaatatttaaatattattatcaatttcaatcctattcttcaatcctagccaaaacaggaggtgattcaaaaaagacagttataaatttaaaaagccttgaaatgttctagagacaaaaagtggtatcttcttacatatatttgtgaatgtaattagcaaaaaataatgatatatatatatataaaataaaagtttgaggagtattaagaaagtactaactgtcaatgttttctggccagaattttataccagtgcaccaaaacataattcttgtatgactttgttatgactttgttatgcaatcgttgatgatatttatttgcctcataatgtcgtttttaaacactcaatctgttttcttattgctgcccacatttgggggaaagaaattcacaagtaactttgccaaaaaggaattttgtaatgttattcctacatagtctttgagtataaaaataggtataatcagtataaaagaatgtcatttttccagtctaatctacaaataagaatttttaatgaatgaagattttggtagatttccagcttcagttccattattttaatagaagaatacaattcttaaaattttacctagttttttgttttaataaaatgtctattaatttgcaacattataaaagactatatacttttataaaactctgtgctgatgaaaacaagttgaaaattaaatagggaggtaatatggtcacaaactttgtggtatttctgtaagaaagactctttttctatgtaatttttaatttaacatctccacttttgacagaatatagacagtttttaaagtaataaaatgtaatgagcccagacgtgcagactacagtgttccaaactataaacgtcaaattagggagaagcacgggaaactaatcagcttttctggcagaacctggaaaactacaataagaggtgagagtgaggcaggaaataaaacagagtaaaataagggagattgtttaaaaacattttattgttcagaggtacatccatatgtagaattacattgcgtctgaactaataaactcaattataaaggtttctggccttgacttttcatctttacaagtatctcactgttatttgtgacccctttcagtctgcacccatgtctatgtattcttaatccatgatgtctaatttctcccttttcactaggacccctgtcttcacctcttacccttcatgaactacagtacatggtccatcgcttattctctccaacatctttaactctcttgctacaatgctcttttattacattcactctttaaatcctcactaaatatttcattgtctatatgcctctactcaaggtgcttagcactactgaagaaagcacacaatgctacagaatggtctcactataattgtattttccctagccttacttaggccctcagtgctgcacaccagtcttctctgtcttcattgtggctaattgcgacactcaccttcacctcctgctcccacaggcaaggtcagatgctactttccagagataattgaaagtctcggacaaaagattgtttcacttgctaacttcagatctataaacttcccaccctccatacacatccttctttcctcaactcatttttagaagaaaaaaaaagacatttctatctctaatgcaaatccaccttcattctgtatcttacttcctgctttttagagactgtactctcttactgttaaccattcaagtaattccagccactcctctctactggctctttctcatttgcatctgtacatcacatttctcaaatctcagcagagctcactctcaagtttttaacttctgtatacctcatgtgtaagctggatgaaatggtaattcctgcttcatagacttgttataaaaattaattccatggattataaataccaaacactttaaaagggggtctggcccatggtagaagtccaattaatactctccattgttattatctaactgtgtaagccacaaaccaagaaactaaagttgctatctcctttttcatcattgatattctatccagtatcaagtcttgttagttctatatcttaaatatcttaaacatctacttagtacaaccccattaatttaactagaccagagtaatcatttacatgatttcttcctcagccttttacttcgtattcctacctctaaccttgcttattttcagtgcattattcttgctgcatacagagtgtcctaaaccaaagtcttacaaactgtgcaccatggactggtcacctgttttcacgaaacaggtttaactggagcacagccatgtccatttacttgtgtattattggtggttgctttcactctacaatggcagccttaggtacttgcaatagagactatctggtccacaagcttatatgtttagtgtgtctttctttaagaaaaagtttgatgacccctgtcataaactcaaatatgaacatcattcacctgcttaaaacacttcaacgttttcagtaactttcaggatatgtccaggttgatttttgtagtacttcatacttacccttgtcttcctcttcagcctcatcactaaatagtgctagtgaagcaacaaccatacaaaacttctttctgtatctttttttttaaattttattattatactttaagttttagggtacatgtgcgcaacgtgcaggtttgttacatatggatccatgtgccatgttggtgtgctgcacccattaactcgtcatttagcatgaggtatacctcctaatgctatccctccccactcctcccaccccacaacagtccccgatgtgtgatgttccccttcctgtgtccatgtgttccattgttcaattcccacctatgagtgagaacatgtgtgtttgggtttttgtccttgtgatagtttactgagaatgatgatttccaatttcatccatgtccctacaaaggacatgaactcatcatttttttatggctgcatagtattccatgatgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctggatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagaagtgtctgttcatatcctttgcccactttttgatggggttgtttttttcttgtaaatttgtttgagttcattgtagattctggatattagccctttgtcaggtgagtaggttgcaaaaattttctcccattctgtagtttgcctgttcactctgatggtagtttcttttgctgtgcagaagctctttagtttaattagatcccatatgtcaattttggcttttggtgccgttgcttttggtgtttgagacgtgaagtccttgcccatgcctatgtcatgaatggtattgcctaggttttcttctagggtttttatggtttcagctctaacatttaagtctttaatccatcttgaattattttttgtataaggtgtaaggaagggatccagtttcagctttctacatatggctagccagtttttccagcaccatttattaaatagggaatcctttccccattgcttgtttttgtcaggtttgtcaaagatcagatagctgtagatatgcggcattatttctgagggctctgttctgttccattggtctatatctctgttttggtaccagtaccaggctattttggttactgtagctttgtagtatattttgaagtcaggtagcgtgatgcctccagctttgttcttttggcttaggattgacttggcgatgcgggctcttttttggttccatatgaacttcaaagtagttttttccaattctgtgaagaaagtcattggtagcttgatggggatggcattgaatctgtaaattaccttgggcagtatggccattttcatgatattgattcttcctacccatgagcaaggaatgttcttccatttgtttgtatcctcttttatttcattgagcagtggtttgtcattctccttgaagaggtccttcacatcccttgtaagttggattcctaggtattttattctctttgaagcaattgtgaatgggagttcactcatgatttggctctctgtttgtctgttattggtgtagaagaatgcttgtgatttttgtacattgattttgtatcctgagactttgctgaagttgcttatcagcttgaggaggttttgggctgagatgatggggttttctggatgtgcattcatgtcgtctgcaaacagggacaatttgacttcctcttttcctaattgaagaccctttattcccttctcctgcctgattgccctgcccagaacttccaacactatgttgaataggagtggtgagagagggcatccctgtcttgtgcccgttttcaaagggaatgcttccagtttttgcccattcactatgatattggctgtgggtttgtcatggatagcttttattattttgagatacgttccatcaatacctaatttattaagagtttttagcatgaaggttgttgaattttgtcaaaggccttttctgcatctattgagataatcatgtggtttttgtctttggttctgtttatatgctggattacatttattgatttgtgtatattgaaccagccttgcatcccagggatgaagcccacttgatcttggtggataagctttttgatgtgctgctggatttggtttgccagtattttattgaggatttttgcatcaatgttcatcaaggatattggtctaaaattctcttttttggttgtgtctctgcccgggtttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttgcttggtaaactattgattattgccacaatttcagctcctgttgttggtctattcagagattcaacttcttcctggtttagtcttgggaggatgtatgtgttgaggaatttatccatttcttctagattttctagtttatttgtgtagaggtgtttatagtattctctgatggtagtttgtatatctgtgggatcggtggtgatatcccctttatcattttttattgcatcaatttgattcttctctctttttttctttattagtcttgctggcggtctatcaattttgttgatcttttcaaaaaaccagctcctggattcattgattttttgaagggtttttgtgtctctatttccttcagttctgctctgatcttagttatatcttgccttctgctagcttttgaatgtgtttgctcttgcttttctagttcttttaattgtgatgttagggtgtcaattttagatctttcctgctttcttttgtgggcatttagtgctataaatttccctctacacactactttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactatggtctgagagacagtttgttatgatttctgttcttttacatttgctgaggagtgctttacttccaactatgtggtcaattttggaataggtgtggtgtggtgttgaaaagaatgtatattctgttgatttggggtggagagttctgtaaatgtctgttaggtctgcttggtgcagagctgagttcaattgctgggtatccttgttaactttctgtcttgttgatctgtctaatgttgacagtgaggtgttaaaatctcccattattattgtgtgggagtctaagtctctttgtaggtcactaaggacttgctttatgaatctgggtgctcctgtattgggtgcatatatatttaggatagttagctcttcttgtttaattgatccctttaccattatgtaatggccttctttgtctcttttgatctttgttggtttaaagtctgttttatcagagactaggattgcaacccctgcctttttttgttttccatttgcttgatacatcttcctctatccctttattttgagcctgtgtatgtgtctgcacgtgaggtgggtttcctgaatacagcacactgatgggtcttgactctttatccaatttgccagtctgtgtcttttaattggagcatttagcccatttacatttaaggttaatattgttatgtgtgaatttgatcctgtcattatggtgttagctggttattttgctcattagttgatgcagtttcttcctagccttgatggtctttacaacttggcatgtttttgcagtggctggttccggttgttcctttccatgtttagtgcttccttcagtagctcttttagggcaggcctggtagtgacaaaatctctccacatttgcttgtctgtaaagtattttatttctcctttacttatgaagcttaatttggctggatatgaaattctaggttgaaaattcttttctttaagaatgttgaatattggcccccactctcttctggcttgtagagtttctgcccagagatcagctgtttgtctgatgggcttccctttgagggtaacccgacctttctctctggttgcccttaacattttttccttcatttcaactttggtgaatctgacaaatatgtgtcttggagttgctcttctcgaggagtatctttatggcattctctgtatttcctgaatttgaatgttggcctgccttgctagattggggaagttctcctgggtagtatcctgcagagtgttttccaccttggttccattctccccgtcactttcaggtacactaatcagacatagatttggtcttttcacatagtcccatatttcttggaggctttgtttgtttctttttgttcttttttctctaaacttgtcttcttgcttcatttcattcattttgtcttccatcactgataccctttcttccagttgatggcattggctactgaggcttctgcattcgtcacgtagctctcatgccttggttttcagctccatcaggtcctttaaggacttctctgcattggttatcctggttatccattcatctaactttttttcaaagctttcaacttctttgccattggttcgaatttcctcctgtagctcggagtagtttgattgtctgaagccgtcttctctcaactcgtcaaagtcattctccatccagctttgttctgttgctggtgaggagctgcattcctttggaggaggagaggcactctgatttttagagtttctggtttttctgctctttttttttcccatctttgtggttttatctacctttggtctttgatgatggtgacgtacagatgggtttttggtgtggatgtcctttctgtttgttagttttccttctaacagacaggaccttcagctgcaggtctgttggagtttgctagaggtccactccagaccctgtttgcctgggtatcagcagtgatggctgcagaacagcagatattggagaactgcagatgctgctgcctgatcgttcctctggaagttttgtctcagaagagtacctggccgtatgaggtgtcagtccgcccctacttgggggtgcctcccagttaggctactcgggggtcatggacccacttgaggaggcattcttcccattctcagatctcaagctgcgtgctgggagaagcactgctctcttcaaagctgtcagagaagtacatttaagtctgcagaggttactgctgtctttttgtttgtctgtgccctgcccccagaggtggagcctacagaggcaggcaggcctccttgagctgtggtgggctccacccagttggagcttcctggccgctttgtttacctaatcaaacaactaactcatcaatggtgggcgcccctcccccagcctcactgccgccttgcagtttgatcttggactgctgtgctagcaatgagcgagactctgtgggcgtaggaccctcctagccaagtgcgggatataatctcctggtgtgccatttttttaagcccattggaaaagcgcagttttagggtgggagtgatccaattttccaggtgccgtctgtcacccctttctttgactaggaaagggaattccctgaccccttgtgcttcccgagtgaggtgattcctcgccctgctttggctcatgcacggtgcactgcacccactgtcctgcacctactctctggcactccccagtgagatgaacccggtacctcagttggaaatgcagaaatcacccatcttctgcgtcactcacactaggagctgtagactggagctgttcctattcggccatcttggctcctcccttttcagtatcttaaatacactctttttctctcacagctccaggagttagcatagactactgactcttcctagaatattttttatctctcttccttgtctaaataactcctaccaattatgcaagtctgaacaaaaacatttcctgactcttgccacactagattggctgtgcctatgtccatacttcctctaaatcatgtccaatattctttaagtcattacttaagtcattctatgaattccacctctatcactctccccattgtcaactccaggtctacgacaaagtctagaacatagtaagtaccttatatataattgctgagtgaacaaatgaatatacatggcgttatttcagaaatttctcttggctactttcaaacttactcttgttccttggcaaggctgctttggcatgtgattctcctgggtcctccccattttgctggatacaaggattttctctggtttggaagataagaaacacctaggcaaaaatgatatgtgagaaaggaaggcagccaattgcctatagttgggacataggctgacctcagcatttattgctttcagtgctaaataacttatttttaatgaaagaaaagattataattgttttaaaaaacaatggtaaaaacataaaggccatatcagatcataatgtcacagagactgtcaagcttctttacctaaattagattctttgcctaagataattaaaagtgatgctatatattctgaaccacatgaagtcctaagcagaactaataccaggggaaggccctgagttaatacataatcacacgttctgagtcaagaatcagaaaggagagagatctaaagcttatattcaagttagatgcagttaatttattatccctgaaggccaattattctaatcatttggagactgcgacaatgtggtcccctgcctcaagggagagattcatatactctcctctcaagaagggcccaagctttgcactcactgcccctgaaggtttccagactttttcaaagaaaaattttgccttcaaaagtttttgtgtattatgtagatagtagcaatcacccacattagtggtttagttttgttctctctcttttttttttttgagatacagaatcataaaaggaaaaaaaaagcctttgtctcaatagcttttcttatgatagctttttatgtgctttcttagagaaaagttataaaacttggttctttcagcttctatcaaagatatacaatgtttccttttttttgtgcaagtcacaaaggagccataactgtatatattttcacatcagatgtaaaattcatatctcacttgtgacttatgcaaggaaaataggaagctccattagacagacctacaatttgtctgtgaatagtgatttgcagttggggagtactttcttttgaaatcattaaatcttcacagctaagtattccttctgccttgacagattctacacattacctcatcatatgtataaaaatgatctttaaaaaatacctttaatgacttcaacaatggccaaagttcatccaacactttccatactttcaagaactacatttggaggcactttttatcctgtcactttgatggtgcataacaaaaagcttgtgtcagaatttcagtgtggcttcacatagtcttctcctgttattaagagatatttttgagccaaatgaatagcatcatcctcggtatgatattagctttaaaaaacctcctatatcttcaagttgcattgcttattgtagatgaaaatcaaatgtgtagttgaacagatataatttcaacagaactaaaataggagaaaaacagaactgtgctcttcctttccatcaaaactgacatctccattcattcttctagtgtagctaaaatcagtcctttgtttgtgcttgtgagcaataactctactctcaggttattattatagagaaatttgttttggataataccataattttaagcaaattaaaatcttactatgctctcaaatattttttaaatcttaaacacttacaaaaagaaaatgaatgaatcattcttgatttcaaatcagccatttgaaaacagcaaaattatttcattttccctaagttgttatgtactatataaatgcatatggcatattcataatgtcagtaaaaccttggcactgccagcaggctcaagaacactatttcatttaacaatagcttatgtttggaagtctttccaaacaagtttatagccactctatcaatttttacaaataattttatattccaaagctccaaataacttggaggcaaaaaatttaggagacttaaggacataggaaaggaaaatttaaataaacagcattaaactttcataatttgaagatatttttgtttttgaagggaaaacctgcactttccataaacttgcagttgctttcttatgcccatcctgcatgctttagcataccaaactatgtaaagttccactcatttgccttgctatctcatactgttctgtgtgttcatgtacatggattttcctgccaggaacattttttgcctcctgcaaaaattgccttcatccttcaagctcacctcacatgtcatcttttctgggctacattccctcaccttcctgtctaacataaatagtcttcttgactatgttctcttaatactgtctccttctgtatttggatcatttgattcagtttgttgtatttctaattaggtcataaattccttgagttattacagcattcactttgttttttatttttatataaattcaaggggtacaagtgcagttttgttacatgtatatattgtgtagtggtgaagtgtgtttagtgtaaccatcacctgaataatgtacattgtgcccgttaagtaatttcttatccctcacctttctcaccccctcccaccctcccactcttcccagtctctggtgtctattattccacagtgtatatatacacacacacacacacacgtatagacttacatgtacatgtgtatgtacacacatatatattacatatcatgtatatatatatatacgtgatatgtatatataacattttctttaatttccagtcagtcattaatggatactcaggttgattccatatctttgttattgtcaacagtcccgtgataaacatatgagtgcaggtatatttttaatatagtaatttattttcctgtaggtagatacccagcaatgaaattgctgaattgaatggtagttctttctatgtttagttatttgagaaaactccaaactgttttcgatagagaatgtgctaatttacatttctaccaactgtgtataagcattcccttttctctgcaactttgctaacatcttttttttttctttttaatagccattttgactatagtaagataatatacaattgtggttttaatttgcattgatctgatgcctagtgatgctgactaatctttcatatgcttttggccatttttgtgtctttttttttgaaaaatgtctatgcatattcttcactcactttttgttattttggaattttttgttgtttttgacttacttaagttcattgtatattctggatatcagccctctgtcagatgcatagtttgcaaatattttatcccatttttcaggttgtctgttcacgctgttgattatttcatttcgttgatcttcatttttaatacaggtccagagacctgtattatactatactgagaactcagaaaagttatactgaggagttaataaacatagtgagactgctcaccctgacaattgactacataatctctcgcattactgaaatcctcagggtttttgtttttgttttcttactattaggtctccttttttctcaggccatcaaaatgcagttttctctcctactgcaagaagtcttttaacatgccacctgtaatctcacatcgtgtatctacttacccctaacccaaagccttgtcttccatattacttttttttttctattcattctcgattcctttctctaggtgattgtacaagaagatgtaaagaaattaagactttattccagccaagtaaataaagtagcttaaaatggttaggcagaagccaggaagtcaatggatataccacagaaaattaagacattaagaatttaggtaaatggacaatagtaattttaactttagtcaccatggtttaaggttgtgtgtttctaggtaaataattaggggccaactataattacgcattgtgggctccaaaacacaaactaaggtagaaatgatccaaagattagagatagaagaaaaaaagggccaagtcagtaattttgtcttttaccatggagaaaatataaaaatctagatttaagaaagtaataacaagaagtagttatcctcatatgaaagaattaagttttcttttcagtgggacttgtctaatgctttaactatttttgcataaacaactggcaaaaatataaggctgacaaaaagaagtcattttctctccaaaatgagactggaaaccagtggtcggtgggaaaacacatactgactacctaaattcttttagatgtacatttattattaaaaaaaaaaaaaagagttctgctagaaatctactagagatgccatcacacaaacaaatggtaattataaagtctgatgatgacaaaatgaattttaaaagaaatttaaatgttaaaataagatttattcgcccaccaaaattgataattgaaaaaggatgacagttatctctgagaacacctgagcaatgaagaaagacatcaaacactttttttcctgttattaacatcttttattttattttattattattatactttaagttagggtacatgtgcacaatgtgcaggttagttacatatgtatacatgggccatgctggtgtgctgcacccattaactcactcataggtgggaattgaacaatgagaacacatggacacaggaaggggaacatcacactctggggactgttgtggagttgggggaggggggagggatagctttaggagatatacctaatgctaaatgatgagttaatgggtgcatcaaacacttttggtctatactgttttgatgtaatatctgattaatagaaaaaacaattatgaatccagcaaccaactggagaactaaaacagtaccaagagtaacaataattttgaagctcactgcatgatattctccaatcccatctgcctgtattctctcaagaggaaaccaacagcctgaaatatgtgttcataatctttgtgatttaagacaattatgttatgatgcatagatatatattttaacatacattctttatttttcttctttttttaacattgctaagattgcattatgacatatgtagttatttgtgatttgctttttttcttcaatctttgtttttaagatttctccatagtgttcaaggtaattgtaatttatttattttatctaataaataatcatctaatgtgtatacatataaaacatatgtattcattattctattatcagactttggattgttaccagattaatttttcccctattaaaacaattttggactgccactaataagcatggcagggtagtttgtaccatattaggcctcaattgtagactatgaaaaaaaatgaataaaatatatggaacagttgttgtcatatattggataacaggcattgcaggaatgtgatccctcagagaataaaaaacagtgaagttaaccattatcctagtgtttttccaggaatttttttttatcagaaactgacccagataggagaaatccaagatgatcacaagtttcatagagctgaaaggacagagagggagatcagtgaagctgaggtgactgaaatttatagggcaagtaacaggaatagaggagttacacaaagaacaacttccagacatctgcattaggatctcattgaatatatgaacaaataccaagctatgagtgtacagggcggaaaaactaagaaaaactagtagagaaggaacaaaaaaaacagaaaacctgaaaaccaacaaagagccagatattgaactgggttgggaaatcttcaaactccagttaaccacataaaacctctttgaacaccatggttcactcagtagagagtgaaaaaaagaccaggtcacaggggtagggttaatctagttctaaaataaagactatttttaactcaccctaaaaaagattacaaacaagttttacaaggattaaactaaaccacaaataaattagctgcatgccagaaaaaaatttgccaatgattaaaggacaaaaacaaaattcagagacctgataatgtgaagcctctaataaaaattggtagaaatgtgaagaaactacaacaaaaagaatatatggactataaacaggagataaatcagtcaataaaacattcccagaaatatcagaaatgttggaataaacaaagtattttgtggcagctcttaatatgtttagtcattgtgatggttaattttagatgtcaacttgattgaaatcagggatacccagatagcttataaagcataatttttgggtttctctgtgacagtgtttctagaagagattgtcacttgaatcagtagattgagtaaggaagatttaccctcatcagtgtgagaggacattatctaatccattgaggacacagatagaatttttataaagaaaaaagaggcctgaggcggtggttcacgctgtaatcccagcaatttgggaggccgaggcgggcagatcaccaagtcaggagatggagaccatcctggctaacacgatgaaactctgtctctactaaaaatacaaaaaattagcccagcgtggtggcgggcacctgtagtcccagctactgggggtgctgaggcaggagaatggcatgaatcccgagggcggagcttgcagtgagtcgagatcgcgccactgtactccagcctgggtgacagagcgagactccatctctcaaaaaaaataaaaagaaggttgaatttgcactcttttctggagctgggacatccgtcttctcctaccatcagacattagaactaaagtttcttgggcctttagacttgagggcttacatcagtggcccccaatttctcaaactttcaacttcaaataaagttacatcctcagatcccccaggttcttctttggactcagactggattacatcaaaagctttcctggttcttcagtttgaagacagcatgttgtgggacttctcaacctctataattgtgtgagccaattcccataataaatacatatatgtataaatctatctcttgttgattctgtttccctggagaactctaatacagtcatttaaaggaaaacatcaatataatcaagagagaaatagaagttatctttatgaaagttttagaataaaaaaagtgaaaaaatgtactagattggatttacagtggattagacactgcagaagaaaagatcaatgaatttgaacatagagcattacaaactgtaaaatatactagataaagagaagtaaaatggaattataggtattgctttatggaacaattagctacataacgtatatcaaggtttagtctcagaagatagggatagaacaaaaatattttgaagagtataaaaatatattatctgtattgttgtaaaacttaaccctacagatctccaacgctcaatgaaatataaacagggtaaaaacaaagaaaaatgtgggaagatacaacataaactaattgatgaaaaacaaaaataaaaggagaatcttaaatagttcacttggagttatgtatccagtgaaaatattcttcaaaaaattaaatacatttattcttttaaaaataaagacatttttagctaaaataatttgctgcaggagaaaacaccacaagaaatgttaaggaaaattatttagattgcaggaaatgtaatactgttttaaaactccacaaaaaaagagcaagaaatgtttttttaaaatatatgtgtacatataaagtatatttgctgtttttaatttctaaaattttctatttccacttgttttgtaaagaaaaaatataataatgtgttagagggtttgtaaagtatgtagaaataatgtgtatgaaaagaatggcacaaagggtaggaaggagaaccggtaagcataatattgtcagattcatatcgcaaactttaaaataatcaaacacatagcacaaaaaacaaaaggctgtattaaataaactagtataagactaaaatgaaatactaaaaactaataaaaataagacaagaggaaaaaagatatgaaaactgatgggatagacagaaaatgtatattataatgctagacttaaacccaaccacaggtaattatattaaatgtaaattcacaaactaaaccaaagaaaaacattgtcagactaggttgaaaacaccaaaagcaacggcaacaaaagccagaattgacaaatgggatctaattaaactaaagagcttctgcacagcaaaagaaactaccatcagattgaacaggcaacctacaaaatgggagaaaattttcacaacctactcacctgacaaagggctaatatccagaatctacaatgaactccaacaaatttacaagaaaaatacaaacaaccccatcaaaaagtgggcaaaggacatgaacagacacttctcaaaagaagacatttatgcagccaaaaaacacatgaaaaaatgctcaccatcactggccgtcagagaaatgcaaatcaaaaccacaatgagataccatctcacaccagttagaatggcaatcattaaaaagtcaggaaacaacaggtgctggagaggatgtggagaaacaggaacacttttacactcttagtgggactgtaaactagttcaaccattgtggaagtcagtgtggcgattcctcagggatctagaactagaaataccatttgacccagccatcccattactggctatatacccaaaggactataaatcatgctgctataaagacacatgcacacgtatgtttattgtggcactattcacaatagcaaagaattggaaccaacccaaatgtccaacagtgatagactggattaagaaaatgtggcacatatacaccatggaatacagtgcagccataaaaaatgatgagttcatgtcctttgtagggacatggatgaaattggaaatcatcattctcaataaactatcacaagaacaaaaaaccaaacaccgcatattctcactcataggtgggaattgaacaatgagaacacatggacacaggaaggggaacatcacactctggggactgttgtggggtggggagaggggggagggatagctttaggagatatacctaatgctaaatgacgagttaatgggtgcagcacaccagcatggcacatgtgtacatatgtaactaacctgcacattgtgcacttgtaccctaaaacttaaagtataataataataaaataaaaaaaagaaatgagaaaaaaaagaccttataatatactatctgcaagaaagcaactttaaaaatgattttttatatatgaagatatatatgttaaaagcagaaagattaaaaacgtgtaccatgcaaatactcatcataggaatgttgaagagagtatcttaatatcaaagtataatgtagcacagagtgttgcctaagataaggatgaacattttatgataataaaaagattaacttttcaagaagacattcaaatccaaaatgtatatgcacctagtaacagagctttacaatgtatgaagcaaaagttgacagtacttaacaggaaattgatattttactataatagttggagattttaacactcttctctagtaatttatcaattacaagaacagcaggacagaaaatcagtaaataaccttattctccagtaatttatcaattataagaagaacaagaagacagaaaatcagtaaagtacagaagacatgaacacagctattaaccaacttgacctaattgatatttaaagaactctaccaaccaacagcagaatacacttatctgcacatggaatattcaccaagataaattatgtgttgggccgtaaaacaagtcttacccctaaaaaagactaaaaacgaagagcgtatgctctctaattgcaacaaaattaaattatgtatcaataacaaaagaatactttaaaaatcaccaaatatttagaaattcaaaacacacatctaaataacaaaatgatcaagaggaaatcacaaaagaaagtagaaaatatttttaactgaataataatgaaaacacaacatgtgtgtgatatagttaaagcaatacttaatggtaaatttttgtcatttaaaagggaaaattcaaaatttaatgatctaaacttctaccttaaacaaatggaaaatgaaattaatttaagatgaaagatagtagaagaaaagaaagattaagtagtagatatcagttaaattaaaaatggacagataataaggaaaaagtaaaactcaaatctcatttttagaaaatattaataaaactgatacacatcaaaaacaagagataaaatttaaccaatatcaatcatgaaagaggaaacatcactacgtctctatcctaaaacatttaaagtacaggaaggcaatgttaactgacaacatttaattttacaactaggtcaaataaaaaagctccttaaaataaataattcttataactggcacaagtagaaacagaaaatatgaatttttccatatctatcagtgaaattaaatttgtaattaaaaacccttatactataaaaaattgagtcccagttagtttcgttgatgaattctatcaaacatgtaaagaagaaattatataacgtggccaaccaacttggatttatctcaggaatgtacagtgttttaactattaaaaagcaatttatataattagtcacatgaatgggataaaagaaaataatcttacatcatcttagtaaatacagaaaatgcatataacaaaatccattatacacgatgaaactgtcaaatatgtaggattagagggaaactttctcatctaggaaaaatacacctacaaaaagtcaatattcagcatcgtaatggtaagagactaaaatatttcccctttccttttatcaccacctctgttccacacttaacgggagacctggacagtatagtcaggcattaaaaataataattatggctttgagatggaaaaggaaggaataaacctgcctctgattggaggtggcataaatgtgtatgtgtattttcaagaatctacaacaaaaaccctaaaattaatatttagggataaactaaacaaaatacgcagaagacctgtacactgagaatttgcataacatttatgagagaaataaaagaataccaaaataaggagatataccgtgttcatggaatacaagactcaatagtgttcagaagtcaattctctcacagttgatatatgtattaaatattatccagtcaaaatcctagcctgcttctacttttgtgaaatttagcaagctacttctgaaacttacatgaaattcaaagcatatgaaatagccaaaggtagaaaaagaaacaaacttagaagacttgcactacttaatttaaagatttactcaatatttattctaaaagtaatgataatcaagaaaatgagacattggcataaagataggcttatagattaatgcaacagaagaaagctcagaaatttacctgccttctaaagtccatcaaaaaaatgccactttattcaatagggaaagggtaatattttgaataagtagtgctgaaacaaatggatatcactgttaaataagttgatcctttaaccatatcctgtaccataaacagcaaataaacttaaattggatcatagccctaaatgtaaatctctgtattctgtatagatttctacatacctaaatgtaaatctatgtattttctatgtattctacaaatacatagaacaatatctcactttttactttctggagtcagaaaatacttcttaagacagaaaacgaaaaaccactaagaaaacaataagattaaaagaacttcatcaaaattaaaacctgcttttgtcaaaagacaatggtaagaaaataaaaaggcaagctcagattggaagaaaatatgtgcaatatatatttgataaagaacttgtatccagtatgaactaataattcttacatttaatgctgggaaggaaaaaatgcaacataaaaaatgaaccaaagatttgagtatgcgaatggctaataaaaacatccaaagtagctccaagttgttagtcatcaggcaatataaattgaaaccacactttagtatcactacagtactacaaaaatgactaaaattaaatgattgacaataccaagtattttcaaagatgtagaacaactggaaatttcctacactgttggtagacatgttaaattatacaggtacaatggaaaaatagtctggtaagtacttatacagttgaacatttacttaccgtacattctagaatttctatgctttttacttaccccaaagaattaaaaatgtgtgttcacaaatacttgtataaagttttattcataatagcctaaaactgaaaaccaaatgtccaacagtcagcaggcgtctggataaacaaactgtagcatatccatatatcgatatactcctcggcgattaaaaggaattaactaccgatgtgcacaacaacttaaatgaatcttataaatcttacacagagagacagaagacatactcaaaatactacgtagtgtattattcaatttacataaaagtataaaactggtgaaagtgttcctaaattatggacatcagctcattgattgcctgggacatgggtgaaataattgggaagagatatgaggaagaacttggggtttataaaaaatgttctatatcctaattttcctgattgttctcatggtaaaggcaagggtccaagagtgagagcagcacaaaagaattaaagctacaatatagtggccaaagcaaatcataaggcaagccatactcaaagcatgggttaagagactccattttctaatggtaagatgtgcaaagttacccagtgaaggatgtgaatacaggcagtgatggagaattaagaacagtttttcaattaatctgctatactgaccaaggtcccacattttgcattctttctattttcatttattctcccaacaacctaaccagtattttcctgagctcatgtctttcttctaataattcgatgaatgtagctagtaataatcacacatttttaacgttctgtcttgtaactccttttctaggtttagaagcgtttcagattacctttctaagctctcaaggatgacagttttaccaaatgttttccgctgcatagcatgacacttcatctcctcattctccagtatgcattcgtttccatcttcatcctcactgtcatggaaattccaaatatttactgtgttgttctgtcagttacccgttttcatttttatgtattaagttctatattagtaagataatgctagaaggcataaaaaagaaaccctagaaagtctggagcttagcaaggtatacatttatatctcattcatgtaacatctgacagaatgttattagttagcattggtgaggtaacaattttgtacttttctctacacagtcgtttagaaactcagtcctgctattttcaacttgttacttacaaatttattctgggtattgatatcaaactgcccaacaaaagagtagagagtcatagatttttaaaaacaattcttctatacttgattgccagaaatcatcatagccgtagcctaaaaaaaaaaaaaaaaaaaaaaaggcaaatgtatgtccaggagaccaaaaaaacaaaaaggattttggaaagagatgaggtttccagcctttgctatatacctcatttgtttgtaaaattatactcgtcttttctactattttatgattttgtcattaatttcagtatttatttctaaagtcagaagctcatcgatatcttaaccatcttcctccccaaaatgaaagaacttcaggacacattagcttatgacttcttttttttcattacatgctctttttgatcagtattttagtactgtccctttttatacacacacattatttttattgctgttgctattactattatttgtgttttttcttaccacttcttgcatcttaaactttctttctggagtcattattctccttcttgaagtgtatatcctttagtaatggtttattggtgaaaaacttgttcaatatttgtagatttgatatctttatctcctttttcactcctaaagaaaaatttacaggatacaaaattattagtttataggtgcttttactctcttttccgctatattgaacataattgttccaacatcttttcctgcttccattgctgctgttgaaaagccagtagacatgctaatcattgttattttgtaaattatctgtctccctctctggctacttttaatatatgtcataggtgttctgtggctttagtcatgctttgtatatattgtatttcctgtgcttatggattcatgtccttcattttaggaaaattgtatgctgaatacttttcagatattacatagtcttctctctctctctcttgctctcactctctcttaactctatctctatatctattatcttagattggacttacaccctctagctttatactacatgtctactaactgatgcccatatttatgtattttctgtctcccttcctctcagtgcctcattctgtatatgaagctgtaatctatctatcacttttggaaatattctcttcaactatgtctaatttgatgtataacccagccattgagctttacgtttatgtgattatatttttgtctttaaatgtctattttatttttaatctgaatatttacttttattgtcatatcttccttgatcatttttaacccatgactatttttactccaagttttattgctgtgaacgttcaatatgaagttatgtgctgttctgtattttgtgattctgggataactgaataagaacaatttaataaattggagcaacaaaatcaaaaagtaaaattccactatcaaaatacgcagattaccaaatatagcttttaagtcaaaaattaaatctaaccatttgccatttagaggaaattagattaaaacaaagtgacataccatgaaaaaaaaaagctaaaaataataggataaatagacaatgagcgtgaggttaatggagtgtttcttaaaaggataacttaaagcaaaaattagaaagagggccattgtatttggtaaaggataattacaactctaaaaataataataacttttatgaacaggtattttcagagagaaaattcatcaaaacacaaaataaaacttatataagaagatactggtagtaatgatagtagtgggaaattaacacacctatctcagtctgacagatcagtgaagatgaaaataaagaggacatagagtagtagttttctggggagtgaggggaggagtgagcagactccaggaccctttttcctgcttcaagcagaatactttgcatctattgatatgggttattttagtgtacaaggattccataggaggtaaactgttctgaaattattaaaaacatgaaagcaatatctgaatgacaactaacaaaagctatataaaaactaatttttaaacttttatcataaataaaatatacttttttcccaataacatggaacttgtaccaaaaattaattctgtatgcaaagattctcagcaggttcctgaaagtagaaagtgtatatcactctgtgtatcaatacgtatcatatgtggccatacgtttgatgtcagcataaaagatagtcatatgattttattattaatcatgaataataattatactgatcattcagctcaaaaagttaaagtataataggaattatatataaagtataaatatatacattatatataaagtataagtatatacattataaagtataaatatataaatatatataaagtataagaggaattagtaaatttaaaaacagaaactcatgaattacaacaaaaaagtaataaaaacttaaaatgcttattttagagaccaataaaatagacaaacttctgtcatagtcaatcatttaaaacttattatatctatcatttattgggtgcttacaatatgccatgtattttactaagtaatttataataatttatctcacttaatcttcaaaatagtattttgacaatcattcattcacttatttcataagcatttattaacaatataccaaacatatgaggcactggggacatactgctttaacaaaattccactgccctaaagatatttgcattttggaggaataaacaaatatcttcattttacagatgagaaacaaaatttagagaacttaggcaaatttcccgaggtcaccatagcatctttgtgcccaaatcatattagaacccaggtttctctgaaggtccgtgctcctaaccaatatgtagtgttatttctgtgggggaaaatacagaaaacatatattcataccatataaattataaagaatatgcaaggagcatcattatattattgtaaactagggttttttgcctgctactttgtgccaggctgtttaaatctttcaagattcacaactactctctgacataagtcgtaatatttccaccatacgttacaattgagaaacctaaagaaatgaaatgttaagttacttgtagttgcagagctacctctatacccagtcagtctggctgcagaacctacacttaactactagaatatgtaaccagctgtgattaagactgttttaaactaaacaattacaatttatataacttgctgctaaaacattgaaattatagataaaatagttggttttctagtgaaatgtgaattgccaaagttggcataagcagaaatttaaacaatacaatcaaggaaaacacagtcaaaaaactaactccactgacggtggcagacccaggtaactttgtgagaatcctatcagtatatgaaggcaaatataatttccctacaatttaagttgatacagaatacagaaaataggaatattctggcttgtttaccaagcagtcactcaccattatgctactgcatctgtcaaagttatccataaacaaaccatgaactcaccaacgaataagctcacaaacaaccttaataagctacagacaatctcacctctgaatatatgcaaaaattctaggatctattaaaagaataatatgtcagactcatataaaggatattccaaaatgcaaggttcatcctttctggacattgaatacatgcacctacaccaacaagcaaaaattgccaactccttcatccagcaacttcaattttatgttttattcctaaggaataaagcagaaaggtattcgaagatacgtaaggatgtttatcataatgtcacttataatggagaacattgctatcactccttaggaaaaaataataggaaaacatcttacacttaacggttataatctatggtagactgttacaagagacataagtaagatacacaaagcattttgttatttaaaagaaaaaattctagctggctacacaaattaggactttgctgaagaggaggcatttaggacaggtctcagaggatgagtagcattttagcagatatgattggaaacacagacggatgtgtttctgggtcaggagatccagaaagaagtagtgagaaatcaaactgaaaaagtcgactgggtccaaagcatgaagtgtattaaatataaatagtactaaataaatcagtggaacagaattgagaagcctgaagcagattcacatatgtgggaacaaattatatgacaaaagcaacattttaaatattgtgggacacggagttttacttatttaatgatgctgaaataatcacttacattccctatgtcacatcaataaacaaatatagtccagttgggtgagagatccaaacattttaaaatgatacaaaatgctaccaaatacttcagaaaatacggacaaacttaggtttatagataattttctaaacacacaaaaaatcggaagtcaggaaggaaactatagacgtgttttcttctcgccaaaaatgattataaaattgtattacaggcaccatcataaactaacaatacactggggaagaatagttctatggccctaaaacacaaagaactctaagaaattaacacaaataagcgaataaagcaagcaaaataataaaaaaaacataagcaaacatttcacagaaatgcaaatgcaaatggccaataaaatcatgaaaagatgttcaacctccttagggttcaggaaaatattaagcaataaaataccattttttgccctataaatactaacaaagcttcaagcagattgatcaaatgcgatgctggcaaagatatagggaaacagtatcacatattaccaataggtagggaaactgcttgtatattattgaaaaacaatttggcagtacttattaaaatggaaaatgtgcatgtcctttgatccatcagtcctgcttttgtgaatgactgctacagaaaatagaatagtacgtgaaatatgtgcaaggttatttatagcagcattgatttttaatgattaaaaaaagaaaaatgccgggcatgctggctcatgcctgtaatcccagcactttgggaggcctaggcgggcagatcacttgaagtcaggagttcgaaaacagccttgccgacatgatgaaacaccatctctactaaaaacgcaaaaatgagccgggcatggtggcagcacacctgtaatcccagctacttgggaaactgaggcaggagaattgcttccgagaggtgcaggttgcagtgagctgagatcgtgccactgcactcgagccttggcgaaagagcaagactctgtcccaaaaaatattaaaaaaaaaaaaaaaagaaaaacctccgctgctttcaatgtttacctaaaagggggcagttgattaagctggtacatctatacaatgaaataatttgcaactattaagcagaataagtcaggctaattattgaatatgatcattaaataataaaatagcaaatatacaaaatttatatttaaaaaataacaaaacagaaatattacatgtgtgaacatatgcttcacggagatgaagtgggagattatgtgtaaactgtatttgctatttggccagaaaataagatttgcagtgttggaggcaggacaagttttaatttacttaattcctaaccctttggtttgactcattgcaataagcacatatatgttagtaattttgccaagttactgttgtcatttacaaaaacataacaattttttttcttttttttttttttttaagatggagtttggcttttgttgcccaggctggagtgcagtggcgcgatctcggctcactgcaacctccgctttccggtttcaagcgattctcctgcctcagcctccagaatagctgggattataggcgcccaccaccatgcctggctaatttttgtattttttagtagagatggggtttcaccatgttgcccaggctggtctcgaactcctgacttaaggtgatctgcccgccttggcctcccaaagtgctgggattacaggtgtgagccactgcacctggctaacaatgtttttaaaaataaatcataattggttacaacttatattgtcttttaattgctttcctgaaatatgaaagaaaaggaaattctttttataatctacttcccagacaacccacgtggaaagtgaaatatatcaaccagcacatggtccttaattgtgattacattttattgcactcagcctattaagtgcttaaattaccagataacagaatctatgttcctaacagtggagagtgtattaacagtatttttgttccctatcgtagccccgttccaacaatcacatggatgaaggttaatggttatattcctagtaaggcacgtctgcggaaatctcaggcggtgctggaaataccgaatgtacagctggatgatgcaggcatttatgagtgcagagctgaaaactcacgtggaaaaaattcctttcgtggacaattacaagtatacagtaagtgttttcagcaaagcatgattgctctagtcccaaaagtcaaactgaaagtggaaattaactttaactaaatattgtttgttaggtacataaaaaccaagtaataatttataatcatacttcattcgtatggtaaggcatcatgtcaaattaccctatacatagaaatgatttaaattataaatgaatggggaattatcggtgtctttgtacagcatacagaacttacgtccttaaaaatgagctatttccctggcaccagcactatactctgacaagttaaaaatcttggaaaacttattaacttattctacaacttggccagaatcagaggttccaatctagtgtccatcaacgagatcctgcccaggtgccattttttgtaaatgatgttggaacaaagtcacacccacttgtttacatatcacctgtcagtttttgcctggcaatggcagaattaaatagagacagagaccagctgacttgcaaagactgaaatatttgcttttgagcatttttcagaataagtttgctgacctgtggcctaaattaatacatctgtatgataaatagcccctacagcctgcaagtgtttatattgtccaaaaatgccagtcaaccaggttgtgtctaagaattaggaaaatctcgttcaaaagtttttacaatctcatctttacttctaaagttcaaagttgtttgtacttttcatatttgatttacagtatatatataatgggtaagttagggtattctcattttctaggtgaggacactaaaaagagaagcaataggctagagcattgaaataagcaaatatagatgctttgaatatatagttatccaaatttcatattggctgtttcctccaggaaaccatgactgtccctgtatctcaagatcagttccaaaagcttaatgccctttacaggaactcctaaagagtattttgaaatattaataactgaattcaaccagtctttcttcatctttaacaactcctttaggaatttagcattctaaccaaattgattatgcattgcacattttatccattcattcattgatacagttaatgtttgttaagtgcctcgtactgctctacatgccagcaatagagccttgaagtaactcatgatccactggactagaggaaaagcaaactccacattagagtggagcattctgtgtgcagtgataaaggcatgtgaagaggactgtgggaatgcagagtctactgcattctactcagaggagtcaggaaaagctttagagaggattggtaacttaagagctaaacaggggagagcatctggaagaaaaggacatagacatttaaatgtttctaagattgaaatattagtagtggtttgattgtttttaggccatgaatatttggatgaaatccacaaagtttataactgttcataattcataaaacaaatcattaagacaacgctctctagccatagggaaaagtttttttctgtaccccagtggagcaaagattaatgttaaaatacacgttcattttattctcacaccaacagtttgaagtattaccatccctctgtacagataaaaatctgatactgaaagacaagtgttgaaccggaactttactactgaaaatcacaaataatgtaaagcatgcctgttactctgaaggctatcagaggaaagtacgaattctctgtgttcgaagaatggcccacacctaaatagaattagattgtatgttctagggactgaggctcctacatagcatgactctacttactcctcccttaaccccagctacttaattcataggtaatgatgactgtttccagaaatgtaaaaaaaaaaattgctttcactccttattactggtgtacattctagtgagaaagtgctacttaaacaatctggggtgtcgttgtcatgcactgtaggccatctgggtaaagacaaacctacccaaagcgtgcatcactttgaatagaaaaaaaaaaaaatctagattgttccttagaaagagaaactgggctggctggctacttggcatatatttgtgacaggtgtggaatatatcttgaaagcatgtgaactctttcttcagcccatgtttagggtagctttctaccaggctccatcaggaggccatacaccttgctttgccctagaaaatcccactttacatctgctgccctatgacaattatgaagagtgtcctatttcacttctaaaagtatcttggtaactaggtgtagtggctcagacctgaaaattccaacactttgggaggccatagcagctgaacctgtctctaaaaaaaaaaaaaaaaaaaaaatacaaaaaattatctgagcatggcgttgcactcctgtggtcccaaatactcagaagcctgaggtgggagaatcacctgaacccagaaagtcaacgctgcggtgaaccattatagtgcctctgtattccagcctgggttagaccctgtcttaaaaaatattacaaataaaaaataaaagtatgtcggttatcatgtattcatccaacttttgtacttttaaaactgtcatgttagacatgagggctttcctccccatcaaactctgtaaagtgtagataggattcagtcatttccacctgactggcagtagatatggatagcatgatgaatggatgtttcactgtctcatggtttatatttagaatattctctcaatagaatgaattactgtaggaagctctgtaattgggattctatctgttagaagtacagactacccattttatccaaacagtcagtattcatgtagtactgaaaacaatggtagcacattgtttttgaaagtacaattgcaagaatacttatgcttagctattagtttcaaaaaatgaaccagggatctaaggcagcatttctagtcccttttcttggtcaaagcattataaaagtgctatatagatagtacacataagtttaagctgcagattttactgtttttaattcagtatctacattgtaaacataaaacaacaaatgatacaacatcaagaagtccatggtagttaaattaaagttaagatacacttacatgtctaatataacataaataggtcttaaaagtaatactcataaaaaagaaataaaacttggaaaaattaaaatactaagttttggaaataatttgaaccttagcataaactgcataaatattctatttggtatgcctttcttgataataggattttcatgggttaagtcatttctttggctatttctgtcccctctagtttctgacgattgatgaaaaagacctggttttaactcatcatataaaattttgtttctatagttctaatgcaagttgaactcttgcttggtaaagttctcaattaaaaggaaaagaaataaatgacaaaatgacaaaagaaatgcagaacaaagtaaggagaaaaggggtaactgaagggggaaagatggaggcaggaaggacaaacatcatttaagcagttttataaggagttctcaaaatgggaaatattttatgtacacaaaaatctcattatataaagatgtgtgatctgtgagtttaaatgtgtatcatgtgcgtcaccaactagtaacttgtcactctataaagacggtcactatgacctctagacagtttatatttactatttcaactagaattgtatcagtattaaaatattcctttatccagaacgcttaaaagttagttgtactgtactaaatatccagtaaaggaatacagtttcattttcagtgtagagtggtattatagatttccttatcttcataaaacctctggacagtatcctcacaaatgttaatcgcttctatcgtctgcaatttgattgtaagctctttcaaaatagtctactttttttttcatccagccctgtgaattctgttcagcacacagtggataatttttattatgattctatactgttataaagatgaatgcttaggtatgcacatcattttataatgtccactatgaaaaatagatgagagtcaggaaagactaaggaactaatgaagggaactaataatcaccaagagcttaccttctagacattactacgaggtgctttacatacattaactcacaataacccttaggtcttaagattcccatttgacagacaagaaactagacctcaaaatattaaggaacttattaccccaggacccattaataacaaatagtagaaccagaatccaactgaaactggcagtgacaccaggattcaaatcctacctccacccccaaggatagcatgctacttctcagtgagacactgagaacctgaactaaggcatgagatgagaatggcatcgagagcagataatttctactttctatatactatagttaacattttattaatgttacagaaaactgtatgatatattaaaatccttgccattagtttttgttcttttttcttttcttcaaaatactgtttatgtacgttaggtctgatctttaaagatgttttagctgttaaagtatattaaatatttactctaggaaatgatataaaattgttgattcctggttaataatttcatacctaaagacagttttcaatcctgttttatggagaaaaaattcttgccttgaattctactgttattatgaaagtgatgccatatgtatattcacagttgctagaaaacacatgggcaatggattggggggaaagtaaccaatatatattatcttctatcatcatggtagctcattgaaataggaattactatctacagcttacagctgagactcattacagttaaataactcattctcagcgacataatagagcaagggcatggtagcactagaatttgaacccatattcatccccaactgtataatctctccaatataacacattacctctcattggcctacagctgagagtcataatactgaaagtgatctatgcggataaaatatgttgactcctcaatacataagagtacagaagcaacaaaagaggccaataacacttagcatttatcagtagagagttacagaatttctaatgacaagagataataagcaagagttttctttatgcacatctgcttagcattttataaaatgtaacccagagactgatctgaagctgaaatgtattacataagtacggtgcatctggtgaggctttaacagctcctgggtttaaagtgccatatgtctcttcagttttccacatcctaaaataggtggcttgacaaaagctagattttaaaaagttattaggtttgttttaaatgtggcccaacctgtgatttttctttcccagacagatgaaagactttccataatgcagaccacgtcttggcatctgctcaccccatgttattattcagaagccaaagccaatgccctttagttacttgcagtcctctgccaaaaaaaaaaaaaaaaagtttaaatgtaaccttttatgtttctgattttatgttaccagtaattttgttgtttttgtaagaatcttgcaagtactgtactgtctttttcagattacagcctaagacaaattatttcaggccttaattcagtttttaatgttttattttaaaaattttaccactgccctttcacataatgttttttgcctcggaccatatagtatagacctagtggtttataaaatatcttgcaatgtaaacaagaaatctgttgtagaagtcaagctgatctagtattgaacataacctacattttccatgtattttgtgaaggatagccattcataaattcccatagccttaatgttaattaatgtttattcaattatgacattaaatttatttttctaatgtagagcttaacttcattgtaacacaatctacaacccaaattccacttgtgtgtgtgtctgtgtgcatgtttgtgtgtgtatgtttatgcgtttgtgtgcttgtgtatgtatttgtttggacttgcttgaaagcttttatatcaagtcaattaacaagcaggctatatatactaactgcatatggcatcttaagcagccaagtgacatcaccaagttatgccatttcaggattttttttttttttgctattatgcaacatagagataaagctacagaagtatagctcttacacataacaacatagtttggtacaaaagattcacacacaaggtacagtgttcaaagcaacaaaatatgaaatgacatctgtcttttatctgccaataattgacatactgatagcattttttcaattttgagggcagtgtaacaggccacttttacttgtagaattcttggtagaatgaatttgaataacattttaatggcctttcacccactagagtttgagcttacagcaaacagatatgatagcacatttatgttcgtatcttcagagtaagcattttacctataatggtatccaaaaaaaaaatctaaagaaaggaaggaaaaaattaattcatatttgtattaatgtcattaatcatatgtttgattcctatgaaaaatttgttttggaatcaggactctaaattttttcttccaatttctaatggattgttttctcagatgtcaaatctgtttttatttaaatattttaactgttctttctttcctagctcttcatttctgtaacttttaaaaatctcttttgaagttattttaaaggctacagtcatggtacatttagagatagatcaataagtctaacaaatacaatcagttattataggtaggacactgtttcgcctaacattaagtttagaatcatctctactcttaatgatctcactgtctagctgagtgtcaaattctaaccaactaaaatattaaataacaatttaagtcagcaacagaagagaggtaacaagctacgacatgaatattttccaaacgaataagaactacaggtgtccagaggaggtgcacatgactcttctttgaggctgtgattaatacctcttacttaatttagaataaacactgaatcgtgagtagaattaaaagagacagaatagaagtagaacactctatgtagagtgaacagtttaaataaaatacagtgtgtgcttgggagataacacaccagtttatctggcttacaggagtcatgcatagtgtaaagtatcctggcagattagtaaagtttacagaaaagccagatgtaaaagtagagtttaatattgtttgtgtatctcatcactcctatcagcattttagcatatatgacacataactacaaagagatgatttccgaaggcaggtacaaaaatcatgatgaatatttgaaactcactatggtaaagatttttgaatgatagcttgcaggcttagaagctgaatcacagaatgtattccaaggtctacaaatcctgactatgctatgccaaagtggggcttctaaagtctagactatattggccagaagaccagtaagctaataaaagcaaaattccctcttagaaacaagtaactaactttgtgaccttgggtaaatttctttaacctctttgagtcaaaatctgattcataaaataggacatgtttgtttgaaggatgaatgttacagggattaattgagaatttggctcagtgtctaggacatggtaatgactagcactagcatttaataaatgtgagttctttcttgctctttctcctccctgctaaactggctttggtttcggacatctgctactccgttatacccactattctgacatgcatgtgtagttttctttattttttatttttcttttttgagacaggttctcactctgtcacccaaagtggaatgcaatagcatgatcacggctcagtgcagcttcaacctcccatgatcaaacagtcctcctgcctcaaccttccaagtggctggaccgataggcatgtgccaccacacctgaataatttttttttttttatttttagtagagacaaggtctcaccatgttgcccgagctgggaactcccaggctaaagtaatccctctgccttggcctctcaaattcctgatatgacaagcatgagcaccgtcccaggtccaacgtgcagttgtttaatacatcttttttcacatgctctcctcttccttggcagtgacattagaccacctctaccgcagcaaaaactcttttagagccgctctgtttctgtattcttaatagcctctaagatcgaacaagaactatgtagcatatatgaaacaacatataaatgaatgaatgatcaaagccctcagtagcacatataaatattttacagtttttgccaaaaatgttgttagaaataataaattcagtgcaatatttttatacgtatttctttgactgttttaaacagaatatttgtaaagaaagagtcagctttattcaacatttttccttaaaaattggccaatagtggaaatgaactttaacttgtatcttaagatttcatataattacaacagtatctcattcttaataaaataaattttcctctgtaacaattttgcacaaataaaaaaattatattgcaagaatgtaaattaagaaaaattttacagtgaaatctggattcacaaatcatttttccaaagtcattcaggtgttatatatatacacagagagatagaaacaagttgagtagatacactgtatatttctacccgtgctaatgctgccccactacattgaaagagcaattgactctagtacctgacttcctattaaactggttcaggtgccttggggataactaaaccacttaaagtccaaaaaaaaaaaaaaaagaagaagaagattttgcatagttaaaatagcattttatattatcaaaatatcttcactgctattttttgggggtacaggaaatagaattttgtgtgtaacgcaatgctgtgcttcttcaaaatacctatggttgaatgaattgcttttaaaaaaatacgttgaatttttccatgtaaattttaaacttggtaaagcgtttgagaaatgaaatcatccttgtttactgcttacatacttacagcctacccacactgggtagaaaaactgaatgatactcagttagacagtgggagccctctccgatgggaatgtaaggctactggaaaacccagacccacgtatcgttggctgaagaatggagtacccctctcacctcaggtactgttgggagttattaacctgttctgctgtaattttagcgagatttcacacaggacaaactaggcttctttagtcttattgaaagccttttcctgtttctgattcgtataataggacatgtttgtgttaaggatgaatgttacggggattaactgagaatttaactcaatgtctgggatatagtagtcatatattttaatatattttgagtgagaaacataacaaatatgtaagcattttaaaattttaattacctcattacattttttggtaatacagtgtttctttaaactgttttcaatcctataaatttttatgaaactatcaatattatcatagatttatttccatttgtagctaacctttagatatcacctaaaattgctcggtatcttcgttgatagacaaagcactgccaactaagagttttttttttaatgatttgcttggcattaagtagacaagacatttggaggtttaacaacatttaaaatttaaatttgtttttgaaatatgctcttgacttgaggttaccttaatttgcacatgctcaattttttgttttttatactatcttatgatactgaagtatattgtctgaccaataattttatctagaatcgagtcacaaggcagttttctatctgtgttagttttttgggaagtgagtgaaaatggcaaactcctgattggatccatatagtaaagggattgttcttatgacctgggctatttttaaccttgatctcatgtgtctacaacctcagtcttttctactatatgaatccttctttccctttgtaaacggaatgcaaataaaagcatcacctgctgattatatttcacaagctcaactagtgtaccaaaaaagacacctcactttaaaaaccaaactgaaagtaaaacttgtcagaataactacaaaaaaattgtaatttctttttcaaccaataaataactataatttacaagtggcatgttataataaaataatgaacagtacatttacattgctaagtggccaaataatgtttaactgtattaattgcaaacttgttttttcttagtctaggagagaatacccataaaatccatgttatttgtttactttctagatctaatttttttaattccattacagagtagggttgagatggttaatggagtattgatgatccacaatgtgaatcaatcagatgctggaatgtatcagtgtttggctgaaaataagtatggagccatttacgctagtgctgagctgaagattctaggtatgcagtttctaagtgaataaattgaaaaaaaaaaccttgcttcttttcatgctctaatttttactatactgaaggtttatgatgtggttgtaaaaatctattttatggcttgaaaagaaatactatgtcttgctgattttttttaactttagtagacaggtttatgttgtgtatagttcgtcccataactttttgttcatatagtttttctaactttagttttaatcttaaaaggtttacacaatacgtctttgctatagcacttaaaaaaatcatataaagaaatacatgttaacttccaaggaagaatgccttgagggtaggagatcagaatatagaattccagcagcctgtccatgctcccatagcaatgcttaataatttcccaggcagttcctatcagtagctgtgtggctcctgcaaagcaagactccaggctaaatcactctctcctcatggggcatcaactaataccttccttacttaacagggaaaggcttcctgatgccaggcactacaatctcatagggttacacccttgataagaatgtaacccaggcactgcatttcttcactatttaaatactacaggaaacaatccatccagtgaaatagactacccagaaaaagcatatatgagccattggaatgaattttacttttcccactttgattttttcctaaactggttcagggatgtttgtaatgtaaagaaagatactcactcattgtctttccaaagcgggcagaagcccaagtgtgttttctattccccatttaaatttaaattctcaaagcataacttaagagaaacaccaaagatctcaggaatcttggagcccaccatttacatatcagctaaatgtaatacatcctaaagtgatttgttgaattatgaatatttgcagttgaaatttctccacattacaacaaatccatccaaaatagttacaggattcttcctttcaatctccttcattctaaacaatcaaatgttaatgaactttcttgtcaactcacagtataatagcactgaattaaaaggctgattcacccttcacctagttagtagccctgaaacatttctcaaacccttatcattcacaagaaatattttcaaaattactttttgtaaattctattcccaggaggcaaaaaaaaaaaaaaaaaaaaagttacttgcaactatctcctcataaatttctttagctttttaactttttttctttgagacaaaatctcactgtcgctcaggctggagtgcagtgatgccatctctgctcactgcaacctccgcctccagggttcaagcgattctcttgcctcagcgtcccaagtagctgagactacaggcacccacagccacacccagctgatttttgcattttcagtagagatggggtttcaccgtgttggccaggcttgtcttgtactcctaacctcaagtgatctgcccacctcagcctcccaaagtgctaggattacagatataagccaccaggcctggctaatttctttggttttaaaaaatctcttaacctatctcaattctatacatatctttttcaatgttgtgacatgcattatgttgctatatgatatattttatatatataatatgaaatacatataatatcagattggtaaaagtaaatgtcacagatactgtggacttgtagacatctttcaggttctcttttagattcaaaagtgttttgatctaaattatagtatacacagtatttatgaatgaatgatcaaacctaagtgaaaaattacaagtaaaattgctaattgaaattcaaataattcaattttaaaaattaatttttaaacaatgtattatataaaacatttaatgttttataatattaaagtaatatacagaataaattaagattcgtagatgggaaatggaagacacaggattgtctttttcgcaggtcacctccatcttaccaaaggaaggtcaaatggactctgtcagttagccttttgctcttttgccaaggtcattcactagtctttcataattgaagttggtaatcataattagaacatgtcattttttgaaatagcctttacctgtagatcccatattgtatgaaatcacctgctaatgtactaaggtacatattaattaataataagtaaaattttgagctactgcctttttcatgtgtagatatactatgattttatgagaaatgcctcccagaagaaaaagttacaagatcttcatgaatcacccattagagattattgtcattgcttctggtagaaactaacatttgcttttttaatagcttcagctcccacttttgcactgaatcaactgaagaaaacaataattgttaccaaagaccaagaagttgtcatagagtgcaaaccccaaggctctccaaaaccaaccatctcttggaagaaaggagacagagcagttagagaaaacaaaaggttagaatctattttataattcaagttcaacattagacttttttgaggttacaggtgacacacacaaactatgcaagaaagagtcttgcagtaccgtgagacgtattttatgaactgattgaaacatggttttgcctatatagtgattttaaaagaacccaaagtttgacttcaaaatggtcagtcttctttgactccatggggttttagcataagttggatatttcactaggttttgaagaaagtactctttaattaaactaattatttttgtttgtttttcatcttgcttctgcatttaggaggtctacaaatcatctgtgataatttttaagcattgtgttttaatttgattttaatacaaatgataaaaacatatgtgaatcttctggataatcatgacagaatactttcatgtgatatttatgccaatgcttgtctttttatccaggtcatatttaggcaaaatagtataggattatttttagtgccataggcaaatgagaagtgagcagaggaatatttaatatgtaaacatttgtctttggcaactaaagccaaaggatatcacaggagtacaaatggagaaaaaatcatgagggaatcaaatcatcacatggcaatctatttgtaccaaattcaaatgttccatgtcctactattattgatatattggtattacaaatggtgattcaactttgacaaaatagtatcctctattatgtcaaaataatattgtactgtattagattttgtttaattgatctagaagtataaggagtttatgacttgttttatgtttgtcccaatctacataaaatataattaaaataatttaagtctgcattagcggttcacttgaataatttcttaagtaacagtgaaacattttgaaaaatttttaaaaatagagtatttttgttttccatcaaatctgagggacactgatttaaatagtctatttcagattaaacaatttttggaattactggcttcagcttagacccaaagatctatgcttcttggaaagggtgatcacctgggattgggatgggtcgtcgttggcactcttacaccaaaagacctatcataagggtcaaggctgtcattcaaaacaaaagacaggctaacaagagaaaaacataacacatttatttaatcaaagttttgtgtgacacaggggccttcagaaatgaagacccaaagacttagagaaaactctttttatgcttaggttcagtgaagaatagagagccgtgtagaaatatgattggacaaaaagtatgtgatctaatggttatagactgagaggggaaatccaccaaggcctatgtgttcagattcttcttggccattttgtgtggtattcctttcctccaggtgtaggacaaatcacctgtcacatgagacaattcaagggagaagggagaaggtcaatctttctaggttttatagtttgctttgacgaagggaagttatagtttctatgatctgccttgggggagagaattctggtttctatcattctcttcagtagagaaagaggagtttgaaacggacagatgggagaagatcaaaaatatcctgcttccaaggtcctttcagtcttcttcaggtcaaggtactctgtgccatattctggggtatcatgttctgagccccaacatcgtacaacttgttttaaaaagaatttctcattcttaggttggggggcgggtagcaaatgacaaattgtgagatcattgttgcctatgacagaattgatcagatagtgattgaatattagtggatttttgctcacaacactatgatttttaaaaaactgcacaaacctaattaaagtagaagaaaattgttttgttgcatagtaagaacaaataatttacactgctaggttattttttctggacgtattaaaaagcttacagtgtcattaaaatatatatgccttatctacgcaaaacattctatctgaaatgcatgactttgttttatgtttctgggtggcatgtgagttttgtcctatttatttcagttcacaataagaatgttcttcatcaactgttgaaaaatgacacatggtgagtttaaaaaattagggtggaacctcttttaccaaagcaaaagtattgagagaagtaacaggattatgagtattctattacaacaacataagcttactaaattttttatttttcagatgttgaaaaatacagtttgtgaatttttcaactttcttgtttctcttcctttctttactgctaacccttggggttagtgagaaagatacattgacctgaaactcagatcactcaattttttctagatgtcaatacttccagtcaaagtgttgtttaggaagaaggctaaaatgtaatttttttttttaatttattcaagtaaaagcaaggctcagccacatttccttagcattctgcctaccttgatctacatgttttaggtcaataaactggctttattgaataacaaagcccagacatatattgcatttttattcttaatattgacaggcacacttacaaaataccatttttattattgaatgacttgttaccatatctggcagccctaggttttaagaagaaaaatgtagttcactacaaaaaataataacacttaatattaaataagaggctaagatttcaacagcaataggcagaattccataatataagaagacacatagttgaaaaattgtacattctaaaattatgactagaaacttaacaatgtcaaatgcctatattttacattctttaaaagaagtctcagttacaatgacaacttattttcttgaggaaattttagattgcttttctgttataatgcacaccaaccatttgattacagctctaaatataaatttaaatggaaacagaggtgttagaaaactgttaagacttcaaaaagtttgtgtcattttttaatttataacttacattgggtgtggagattcaaatcatggcttattttattggaatataaatataaatatcactcatatgatctacatcaaatatgtgccccactcatccaacctacaacaattgagacaaaaatgttgaatgagttagtgttgtccttcaataaaaattttgttgttttgggttcattccaaagaactattgaaacagcaaatggcagtttctgtataagaaataaataataatattatattggggaaaaggaattaacataatagtatattatgaaagagacattcaggccaggtacagttctcatgcctataatcccagcactttggggggccaagatgcgaggatcacttgagcccaggagtttgagaccagcctgtgcaacacagcaagactcctatctctacaaaaaataaaaaagaagaaaaaacaacttaaataaatagtcaggcatggtggtgtacgcctatagtcccagctactcaagaggctgaggtgggaggatgggttgagcctgggtggtttagctgagccataatcataccactgagctccagcctggatgacagagcaaaaccctgtctcaaaaatataataaaataagatcaaaaagaaatatttaaaaaaacaaaatacgtcaattgctttcatagcataaaattatgtccagagcaatggcataaaaatgtaatatatagtcttaattgcaggaaaatataatctaatcatctgaaaatatgtcagaaaatctcaaaggtaaatttaatttagcattacttaaatttaactctaaattgtaaataaaatgattgaaaatgatagaacaactgaaggttatagttcgtcatttgtcaacagagtgccaaataaccatttggctcatttttttctaccacgttttgagtaaatctgccaggtttagttttctttgttttcttgaaggtcagtgtcttcaaaacacagtattttttatgtgtatatattttgctaaggaaatttagaaatcattattctaaagttgaaaatttgataactagaaaataatatgacttttagaaaaaaatatgattaacaaattagctgcctgcttatatattaccaaacatttcattcatttggccctaaatgatacaactaaaatatacaagaaaatggattacatcagagctaagatttgtttacatttgtttgttatttatatcacagaatgatcaatatgaactcccttcagatagtaaatcacattattactaataatgatgatgactgcttatgagttcgtagcgtttatgatttgcaaagcactttaacgttgttggtaaaagtataaaccagtgtatgaaaagaggacttacttgctctgcttatcctgcagattatgaggtttcagtaagttacctaatttattatcttactaaattaaaagagtaagctgattgggttgtgagaattaaatgaaattttacatgtaaaatatattgcctagtgtatgacatctactcagtactcagtgaatgttatgtataatgataatgatactgatgacgatgatgatggtggtggtggtggtaatggtgatagtgataatgatggtatctgtatcaagccattttcctactcctataaagtactgcccaagactgggtaatttataaaggaaagaggtttgattgactcacagttcagcatggctggggaggcctcaggaaacgtacaatcatggcgtaaggcaaagcaggtgcaaggaaccttcttcacaaggaggcaggaaggagaagtgccaaggaaagggggaagagtgccttataaaaccatcagatctatgagaactcattccctatcacgagaacagcgtgcggaataccactcccgtgattcagttacctctacctgatctctcccttgacatatagggattatggggattataattcaagatgagatttgggtggggacacaaagcctaaccgtattaatataatttgtacctttgaatcttagaatactggcatccatttctgttatcagtagtctggaaatgcttaccattctcctttctttctccagtcattaaggaaaagaatacctaagatttgtttccaaggactaaaggagtcttttacatcttttatgtcataaatttgttattcatcaatctatgtccgcaaatcactattctttgttcatcagagccccaaacctgtcgtcatttattcctggcattgaaaatctcatctcccttacctatttctagctcaatgtctttggaataggttcctgtcctagccgaccaaatatttacttgttccattaacattttataggccatgtgcaaatagacaaatagacatggggagttaatggaaatagaaatgaagtattttaaagactttttttttcactgtttttctttaagggctctccaggttttccccccatcactttcacttttgaagattactggcacacagtcacttaggttcctgtatcaatcatttcccttttcatactgaaactaataaactccagaagtactagtaagtaaaatattccacagggattttctcctctagcagaccttcattcagaatgttctgctcatcaaactcatattggattttcactccagctcattatttccattacttggccattaacttttgttaaaatataatcatccagaagcactccagcagtgcacaaatattaagtcttcattattacatgttcaatttcctgtactttttgtggacaaagacaatcttagctaaaatgaagaatacatagtttttgataaaggtatagtttattttgtttcctttccataagtgcatatataaactgttgttgaacctcatagaatgtcatatatgtttaaaattattcacaattattgaaatttcaacatattttaagcactagtttttatgcccaggcagagtaaggtaacagttatgaagataatggactataattcaaactggtgcttaagaaatcctgcatacaaaaaaaataaaattatcctatggaggtgcagtattatagaataatttttcttttatgggactgtaatctaagcaaagacttgtccaaaatctgacataatggccccctgctcactaaaggagcttcagaaaggcaaaattttcaacttatttaacacgcatagaaaattgcactagaaatacccattatttgacttctagtgggaattcatgttgtgtttattaggcaacaatgatgaagctcacatactgactcagagacatatgggaaaatctgttcttaacaaaagccctaaaggacactgttgctgagaagaaagcaaggtcttcttattttatctatggaagaagaattcatgggtataattagggccctgtttttgtccctttgtttccacctacatgctgggtttgctaatgaacaagctgttttgttgtttcctctgtgacagtgtcttttacatattaagaacgtaaaacaatataaactttaagtatctgggttttccttagtgtgtaagaaattgtataatgaaagaaaattagcattcataaatcaagaatgtacaatttgaatttatatgtgaattaatatctatgttttcaaaagaaataaaatgattaaatggcattgtttacctaaaggaagaaaggtttatatctgaatttataagatttagtaactataaactgcttactatataagatgccttagtactcagggatggtttcttgctgtttcctatccatgaacttaaggggatgagaaggaaatggccttacattcattatgatgagattaagatactgacttcctgatttcagtgaaagctaactgcacaagactctgcctgagtcaccttcttcatcttttccttagaatgctaattttttattagaaaaaattttaaaatataaagcattagcattttattatattttattagaaaaatataaaaggaaagaaaacacagtcatagcagcattggaaattaagaatatatagcattggaaattaagaattgttgacttctgggaggaatcaccgtttcatatagaaatgagctaaattaagaatttatcaatgagttgttgaaagctagacctctgaaactttaatgaagtcaattaagaaaccagcagaggaaaaattttactcacttctactttatgtccatatctactaaattcagaaattgcatcttactacagaagctggcttgaacctccctcccacctgcaaggtggtaagatgctatgtccgtattccaccccatctgaactaatccaacactttttggacattatgaatccagcaatggggtgagagaggacataaatcttaggatttcaagtgattagcaaataaagcataatgtcaacaaatggtgatactgaggaaaaattgaaattcatggattctggaaattatgtaattccgtgtactacttctagcaaaagaaggactatataccgtttctaatttttcaggagtaaatttacctctagatacgactaaggactagaaaatggaaattgacaaacatctcacctcagtccagttgagcttcattatagccttagtagaccttgagcgtttgactacagctgtgtacctaactgaccttgagattaatatttggggaacagattctggagcactgagagaaaaaagagacaaataaaactgaaaatattgccaattggcaaaaataggcctatagacataggagtacaagagagtttaaagcacaaacacacattaagcatgacagttaactgatagtcataaatttggtaacaagatgtcaagcaaatataaaaagaatcatcatcatgcttaagtacaatacaaaaaaattgtgtgtgtatgggtgtgtgtacaaataagttaataaatatcaggagttgcaaagcaaaaagctgaaagcattctaaatcatggtggcaacgcaagtaaatatagtcatagtccatataggaaaaattaaagatttacaaaaaacagatatattgtagaagcattgtaggtttgcttttattgagatagggtctcacaatgtcacccaagctggagtgcagtggcacatacacagctcactgcaacctcgaccttccagggtcaagcatttgtcccacctcagcctctcgagtagctgggaccacaagagcacactgtcaccaccatgcctggaaaatttttttaatttgttttggtagagatggggtctcaccatgttgcccaagcttgtcttgaattcatgggcttaagcactcctcccagcttgacctcccaaattgctaagattatacgtgtgagccactctgcccagcccactgtgggcttttttaattacatttttgatgagtacttaaggacaatgataaaataatggtatattatcagtggaagaaatcattgaacacggtagaaatttcatttgaagagaaaatgtctgcatggacacaaatacattaaaaatactggaaataaatgcagctaattgttcacaggttatctctgagaagaggattatagataattttcaacgccactttatgcatttctcttttgcatcactgtgaggaaatacctgaggcatggtaatttataaagaaaaagaggtttaattggctcacagttctacaggccatacaggaagtgggatgccagcatctccttcaagtgaggacctcaggaaactaacaagcaaagtagaaggtgaagcagaagcaggcacctcacatggccagagtgggagcaaaagagataagaaggctgggtgcagtggttcacaccggtaatcccagcattttgggaggctgaggcaggcggatcacctgaggtcaggagttcgagaccagcctggataacatggtgaaacactgtttctactaaaaatacaaaaaattagctgggcgtggtggtgcattcctgtaatcccagctactcgggaggatgaggcaggagaatcacttgaacccaggaggcagaggttgcagtaagctgatattgtaccactgtactccagcttgggcaatgagagcaaaactctgtctcaaaaaaaaaaaaaaagagagatgggaagaggtcccagagtattttaaacaaccacatatttagtgaactgagcaagaactcacttatcatcaggggatgatgctataccattcacaagggatctgcatctgtgatctaatcacttcctaccaggccccatctccaacactgggaatctgatttcaacatagggtttggaggggacaaacatgtaaaccgtactatccatatttctaagcttggtctctttaagagaattaataacccaaaataatgcaaatttattgaataacagtgtactcacactctgccaaatagttgaatgagaatgggaaaaaaattctcacattttcaaataattccattttcaacagtatgtttacatagtataacgatgatcacaaatatctaaattaatggcatccacttaaacacagaagatcagaagataaacacttcaggaactctcaaaatatcagttcctaatattttccaaatttagggtgatggaaaacctaaacactcctctttaaagtccttcaaatattttctttttcttgaccactccaccagtttgtttctagatttcacttttttcttaattgttgaatataataaaataagtctcaactcccaacgagagataacactgagaaactcagttaatttaagctgtaaatgacaacagaacaagtctggtttgttgtactatgagcacctccagtttttgactttacatgttacatctctagctaattaccagtttaggaaacagtttatgaattctacttctaaccatggttcatttaccccagttactataaattgcttcacaagttgcctggttgtgctctccacataagcacaacttgaacaagccattaattgctcacaggtttttcttttccaaaagccccccagactacaactttcagcttaatttgtccttaatacaaacagcatctaaaatacttgggaattcaagcatctaagtatatgctcctaactgattcgactacctccccaagtgactcttcagtgaatataaaatggtgaggagagaagattctgaggctgcttagaaaaaaagcattgtacggtcgagatttttagcatcctctgagaattacatagtcacttcttttcagattttgcataaatcacgatgtaatttaactttggttaatttataatgagaattagaggtttggttacaaattaaagcatagtacaatgataaccttgactacaaatggaaagaaactgtacatcatttccatgaaatataacatatacagatgttatcatttgcatgcttacatctctgtgttccaatgacagtgtggtttctgaaaaaaaaagaggtaggtaggtaggtaagtagggagatagattgatagttaataaaatacctatacattttaagatgattactatgttattagttaatagctggagttttcaagataccaatatgattttgttcctctttctttccagttgcaaatggtagctctacttctccttttccttaatggagagagaaaacctttctttctctaccctctgaaggttcagtaactgagtctatgaaatataaaccgacagtagacagattaataagacaaaatgcatacaaattgattgtgtgcacaggggcatcacagaaagaaaagtgagtacccagtaacccaatgaagtttagaagcttatatatccttttcatagaagagaggggtggtgggatataggccacttaagggggagtaaataattttggggagagaatgaataggcccaaagagcacgtggtaaccagtgagaaattctgtctgggtgtggcgctaacttccggtctttttttctgggatatgtgtcaatttctcacaatgatgagtttcctggggaggagatccaggatgaattgaattttttctggagtatctggtatcaaaacaataagaaaaattcagagaaaacctctgcctgctgctgctggtccccaggtgccttcaatttaaagtaatcagcacaacaaaacttcatattttgggataacattcccaaaactccttcaccctcatgcagcagacacatggtctatgaacagttatattcaattcaatttatttccataaaaactaaactttcttcaacatatactgtatataagacactatgccagttcataccaagataagtaagagagaatcccatctcccaaggaggcacctgtctggtggaaaataaaactaatatagacacctataaaataggataaactaaggtaataataaaaataggactgactgagcattgggtatttttatattgcattactttattaaagtcctcaaaataagatacgattttaaataatataatcctgattataaataattaaatcatagagagactgcctaagcacacacactcgtaacaagtaacagagccaaaatgagagcgtcctaattctgtttgaatctaaaacctgttctcagtctactgtaccatacaaaaaactttgagagttaagaaagaagaaaataaaatctagataaaagataagcttcctgggggaactgccattgaagtggtcttggaataggattttaacacagagggacagagtatattttaggaagagacttcagaatttgcaaaaatagttatgaattcaggacacttttgggaaagtaaatactaatatttgtccagggtatagactatgtatcaaaatgaaaaatctgctgaaacaattgaatagctgaagacaaataaagaagaacttgaatgcacagattgagttcaagcttaacttagtagccaagaggtagtctttgaaagactcagttcacatctttttgaattaatatcttttatttaattttttaaattatatttattttatagaaaaatgcccactaattactctgtctaccaaagagaaaagaattaaagttacgacttaaatataaaatatataaataaatattacttaaatatccttgtttcaacaacgagctagcaagaagctagaaggaaacttctggtatcaaaacaataaaaaaaaagaaaaatttttagtgcaaccagtaaaagcattgaaataaggtatgctatttccaaactagttaaaaaaataaatataatgaaaagttaaccaatcaaaaaacagagggatatatgtacatataccaataaaaaaacagagggatatatatatccatatatatgtatgtgtgtgtgtatatatatatgagataatagaaagcataaaataattcagaaaaaccaaatatatcagaaattactgtaaataccgaactagaaataaaaattcagcaattatatgtaagagctttgttttaagcaaaaataaatagcaaagttgaaagttaataatgggaaaaaatgaatcatataatattaaccccccaaaacttgtttaactatatcaatacaagaaaaacagactatacaagaaggaatataaaaatagtataaaatttccccactatcagagtggggaatctcaaatatattccttgtatttcagaatataagggaaaatttatcgctctatgtatttatgttacaaaagaggggagttgaaaatgaatgagctgagcttctatcttaagaaattaggaaacgaacatgaaactaaaagtaaatgcaagaaaataataaattcaaaaataattcaattacaaacaaatataagcacaattagaagattggtaaagtcaaatattgatactttcagaggaccaagaaaatgaacatatctgtagtaatcctaaaatcaagaaaagagctacaaaatactgagagcaaaaatgaaaaataagcacagatgccataaacagataaaaagaaaataaaaacatgataaataattaaatgacaaaaaattggatcatttgattaaatgaataaaaaatgatatttcaaattgactcaagaagaattgaaaaatttaaataatttcataactattaaattagtagttaaaaaatcttcaaacatacaccaaaaaactcaaggtgtaaatgctttcagtagaaatttctaccaaaaaaaataagaacaaatgatcccaattgtacacagttatttcacagtatagaaaagagggaaaataaccctaacaacaaaatttgccaaagacaatatgagaagtaaaaacacaagccaatcaccctcatgaacatagatgacattatataatgataaagggttcaattcaacaagaagacttaactatcctaaatatacattcacccaatactagagaacccaaattcataaagcaaatacttctagacctgcaaaaagacttagccacacaacagtagtgggggaactcaacatcctacttagagcattagacagatcatcaaatcagaaaactaatttaaaaattctggacttaacttgaccaactggacttaatagaaatctacagaatactctacccattgaccacacaatatacattcttgtcatctgcacatgaaacacacttccaagatctaccacatgcttggccataaagcaagtcttaataaactaaaaaaatagaaatcataccaagaacagtggaataaaaatagaaattaataccaagaagacctctcaaaattactcaattacatggaaatttaacaacttgctcctgaatgacttttgagtaaaacaataaaattaaggcagaaataaaaaaaaaaattctttgaaataaatgaagagacacaacacaccaaaatctctaagatgcaaataagcacaatcagaaatgacaaagatgacattatcaccaatcacacagacatacataaaatcctcagagactattatgaacacctctatacacacaaaccagaatatcaagaaaaaatggataaatttctgaaaagcagtgttaagagggaagtttacagcactaaatgcctaccttgaaacatgagaaacatctctaacaatctaacatcatacctagaggaactagataaataaaaacaaactaaacccaaagctagcagaagaaaagatataactaaaattagagcagagctgaataaaatactgagaaacaaaagttcatgcaaagaatcaatgaaaccaaatttggttctttaaaaggataagcaaaattgacagactgctagctaaattaacaaagaaaatgagaggacatccaaataagcacaataagaaatgacaaaggtcacattacaaccaatcccacagaaatacataagatcctcagagactattatgaacacctctatgcacacaaatcagaatatctagatgaaatgcataaatttatgaaaacacacattctcccaagattgaatcaggaagaaattaaaagcctgaacagaccagtatccagttccaaaatgcaatcagtaataaaaacctaccaaccaaaaaacactgaggaccagattagttcactgacaaattctaccaaacatacaagaaagagctgatatcaattctactgaaatgattccaaaaagacaaagaggaggggctcctccctaagtgactctatgaagccagcatcactccaatatcaaaacctggcaaagatacaacaaaaaagaaagctacaggccaatatccccaattaaaaaaacaaaacattctctaaatatactagcaaacctaatctaaaggcacgtcaaaaagccaattgaccctgattaggtaggttttatttctgggatgaaaggttggttcaacatatgcaaatcaataaatgtgattcatatgtttgttgaacacatgtatgtcttcttttgagaagtgtctgttcatgtcctttgcccactttttaatggggttgtttgtttttttcttgtaaatttatttaaactccttgtagattctggatgttagacctttatcagataggcagattgcaaaaatttcctcccattctgtacatgcagccaacaaacatatgcaaaaaagctcaacatcaccgatcattatagaaaggcaaattaaaaccacgatgagatatcatctcatgccagttagaatggttattattaaaaagttataaaacaatggatgcttgttgggctgtggagaaatggaaacacttttacactcttggtgagaatgtaaattagttcaaccattgagtaagacagtgtggccattcctcaaagacctacaaccaaaaataccatttgacctagcaatcccattactgggtgaatacccaaaggaatacaaattattctattataaagatatgttccttgcaacactattcacaatagcaaatacatggaatcaaaccaaatgcccttcattgatagactggataaagaaaacatggtacatatacgtcatggaatactatgaagccatagaaagggacaagatcatgtcctttgcagggacgttgatggagctggaagccattatcctcagcaaactaatgcaggaacagaaaaccaaacaccacatgttctcacttataagtgggagctgaacatgaaaacagatgaacacagggaggggaacaccatacactggagtgggttggggagtagaggggagggagagaattgggaaaagtagctaatgcatgctgggtttaatacctaggtgatgggttgacaggtgcagcaaaccaccatggcagacgtttacctatgtaacaagcctgcacatcctgaacatgtatcccagaactttaaattacacttttaaaatatgtgattcaccacaaaaacagaattaaaaacaaaaaccatatgatcttctcaatagatagagaaaaactttcaataaaatccaacattttatgataaaatccctcaagaaattaggcattgaaagaacatatctcaaaacaataagagccatctgtgacaaacccacaaccaacatcatactgaatgggcaaacaatggaagcattcaccttgagaactagagaaagacaaggatgcccaatatcagcactcctcttcaaccagttagaatggttatctttaaaaacagcagtgaaacctgatcaatttgttattttctttttccctctgtccctctttctttttcttttcttttctgcctgcctgccttccttccttccttcctctctttctctttctttctttttctctctttccctccctcctttcctcctttcctccctccctccctccctccctcccttccttccttccttccttccttccctccctccctccctccttccttccctccttccttctttcacatcagaaatttaattctcactgtctgggggctaggaagtcccagtacaagctaccaggagattcagtgcctggtgagagctcactctctggttcacagacagtgccatttcactgtgtccttacatggtagaaagttcatttatttttgtctttaatatctatcattgatttatattttgtgcactgctaatccttaatcaatttttaccacagaaataaaatcttttgaactgcttaaagttgttttctctctctatctacacacataatacacatcactttaccccaatagcctaagaactggcctctctttatccagtcttgctctgtacagcattctctatccagcaatcagagttttaattttagaaaataacttgaatcatgtcagtttactttttgaaactttccaatggcttccccattatttggaataaaattacaactcccttctacgacacatgagactctgcatgagctaacttctgcctttgtctttctctttgtcccattcccgcatttcttcatgctcatgaaagtccagccccatcattacactccctgttcggtgcatgcagtagatttattcctactgcaggacaaggcaccacttatctcctcagcttgaagtactgttgcccagagtgttgccttatggtctcctgaaatctaggtctcaggtcaaatgttaccttctcggaggccttcctgaccctctatctgaaattattacccctatccttgttacttctctcacacatctcatctggtgttcttcaaatcactcatcacactctgcaatgttctttttggtttattttttatttattcttttttttttttttttttttttgagacagagtctcacccttttgcccaggctagagcgtactggtgtaatctcggctcactgcaaactccgcctcctgggttcaaatgattctcctgcctcaacctcctgagtagctgagattacaggtgcccaccaccatgcccagctattttttgtattttcagtagaaaatgggtttcaccacgttggccaggctggtcttgaactcctgaccttgtgatccacccaactcggtctaccaaagtgctgggattacaggtgtaagccaccgcgcccagcctatttattcattttttatttgtctcactaactaaaattgaatcagggggcttgtttgcttttcattcagtgaccccagagcctagaattatcctttgtacatgtggaagctaaaaaatatgttttaaatgaatttttggagtaacacatgtacccaggtcttctgcagttcctaccttatatgtgtccatgactcaacctcacaaaagtgtgtgtagatggtaatagctcaagctaatttattaaggatattatgaggaatgaatgagacagtattatataccactctgaatttctttgaaaaaatataataacaaaaatcatattattatgactactttcatattactcagataaagagtaattacttttttatggttaaaatagcatggaaattgaatcagaaggttgtaagcagaagtagggtcagttccctttgtttatttaagaatattaactaagctgagttggattttcaagaaagcttgttttctactagtttaaattctgattatctggtcaactgaatttttagaactatcactaaattaaaaagaaacagcagtggggtgtaacttttctcatctttacttcatttacccggtgaagcatctgcaaagcctctgtgggaggtttaaatgctaatattcagaaaagcagtcttggaagcaaacacccagctgtatttaaggcctgcattttcgtggtgaatgtgtctccagggctgtacctttccactgcccagacttttaagcaccatccatattaagcacaaatcagaacgcttttcacaaaccacttaatgctgtttaaaacccacaagtaaatcatcttaactaaaccctttgatatagctttgctctccaaactgtccctatctggttttaaacactattataagattgttttaaaaatttagaggtggcacaccacattaaagctgttatatctgtataaatcatgtgtggaataggactgtgctcttcccccatactgagatcaatgcttaaaattttatgtgattgtcctctttgcgcatatgtgtgtgctgggaggcggaggtggggtgcagtatgcttgcacctgtgcacctggttttaaagcggtgatttccaacttcttttctctttgagttggttgaggccctggtgcttgcaatgacactgaaacaagatgtgctttttaacatataggctgtaaatgttagtatttctgagtttcgcagatccctactcgccctggttttggagaaaaagctaagttccatcctcttgcctcatttcatgggtcatttatatgtacatgagcctcttcagcagcaatatacagtatctgcctcctctctcaatgaccaactttgagtattgtccctgatccgccatacatgttctgcaacagtgcggggttgactcaaagacaacaagagtggctatttccttctgctagttcagccctcacagttatgatctagctgtgggaagccctgttttctctcgggtgttctctataccacagctagtgtttgttgatcacttctgaaaaatgcactttttttgagacagtcttgttctgtcacccaggctggagtgcagtggcaagaccatagcgcactgtaatctggaactcctgggctcaagcaatcctccatcctcagcctcctgagtagtggggactacaggtgtgtgccatcatgcccagctaagtttttattattttttttttatacagatgaggtcttgctatgtttctcaaataggtctcaagctcctggcctcaagtggttctcccacttcaacctcccaaagttctgggatttcaggtgtgagccactgtgcctggcccaagttgcaagttttcaggtgcacacccctatttaattgatgtctttttgaaaatatatataataaagcaagccagggttctctaattttttctacagtctgtacaacctgacttgagttcagggccacaatcaggacctcatgactgctcaacagcttttgccaaagtggcccagtcacaagaattacacgtggattttgttaggaatacagacacctaggccccttcccctggaaattctgatgcagcagatctaggtggatccccatgatctagaagttctattagtgcctaagtaactctcatgagcaggcagaaggagcaaacacagctggtcaggattaacatttcccttcagggtgaacaggagaaagtttcactctccagatttgtaccaattaactcaaattatgcaggttattcataactgtgtcggatccttttgtttacctgaaaccagacatatttaggctttatttaataatggtggttaattacattgttacatctgacaatgagaaaagaaggaatctcttgggttaaaaaaattaaaaattaaaaagcacaatgggagccaggtcttcaggagactgaactgagcagatgccctggatctggtagatgcggaaatcttatcagctatggtctatggatctaactctcaggtgctcccacttgactgaaaacttcttctttctccacctcttcatctcattgtgtatcttgctcctccccctgcctccaactgggtaagaactcatattctactaggcaacatactgagcacatgactttaatccagtccgtctgcctctctcacatcagctgcataatcatttagcttaaagtgacattttaaaatctcagttttcttactagccttgatttttaaagagtcagtcgacttttaaaccttttaagactttaatgttatcaaacgtttaaataatatttccctaatcactggagtaaagccctgatgtgtgttgtggaggggtgatttaattttctgggttctgagtacctcttttctaattgatattcttcactgccagcttctctaaagagagatgggtttgtggggagggtggaaagaaagaagaaatgaaagaagaaagaaatgaaggaaggaaagcagaccaggaggaaaaaaggaaagagagagacagggaaagaagaaggagggagggagggaggaaaggaaggaaggaaggaaggaaggaaggaaggaaggaaggaaggaaggaaggaaattaaaggagaaaaaaatcatcattattccatttatgcttgtttgaggaaaggtaacacatctttttatgagaatttgttgctcaccttgtataagtagagacactagtatcagtcaagacttcacatagaaattattattcattaaaaatcctttgcacaaatatatttaaaaattacttaagctaagcaaatataaagcactttcactccagtgaactgagtattttaggatagcatccatattgtagcacgatttctccactttgcttattagatgatgatattgcacaaagaactaataagccaaaagagggtgaaatataaaactagattccaacttagaggatggatatatgctatcaattttttttctgcaattacaaagtatcttcatttacactgagtttccaagaaaaacctagactatgtttttatgtggaagaaactaactagaagtcttgttgtcattgttctctttttattaaaaattactgtttttgaggggaagaaattaaagtatgtttttgagtggaagaaactaaccagaagtctttttataattgttctttatttattaaaaattcacgatgtgtttgaaaccacctagtgcttatttatatgtagattctggtgtctagatgtatatgaccacaggcaacacagtacacatcatgggtcatgtccatgccatctgtgcaaatacatgggtaatgtgcgtgggttcattgtgtatagttagttaccaatttgtctctctgtaaaaaattgattttaggtaaaaggctctatttgaatatcctagagcaagatgttgtttgaaataaagtttgaaaaatgtgattgtacttttagcacacatttcctcaatcagtaatttagtctcaagtttggtcttaggcaagatctacatgtaaggcttatttctgatggtttctcaagctgggagagaaaacaattaaagaaaatacttagtcagtttttatctacacgtgtgccttcggtgatttatttaagcattccaacagataacatgtctccattatttttagcaaagggctttttgtcagtattttgtctccagttataataagtgttttaaacatctgtcaaagctgttctacttcccactcaacagcaaagaaaccatgatatgtgctggaggtcaggaataccagctacaagcagaattaggattaattattggtagacagggccgatatcatggtctggccacctgtgcagttacataaagcactaaagttagaaggatcctttgcttgctttagtgttttactggcaccaaattgaaattcctagtaatttttgaacaagaaacccatgtttttatttttcactgggccccacaaattgtgtagccagaactattgctagactatttgcttgacgtgtagtcccaggcacattatttaatcttcctaggcttcattttccacattttaagaaggggaggataatgacacctatttcattggttttgcgagaattaaaagagatcgcgctttcaatatgttaagtagagcacatggctcatgttaaaggcccattgttctgagattcactgatatatacccgtattctgggatagtccgtctactcgcaccttttgcccttggctagtgtgtaaacaactacttcacatcatcccctgatacctgatctccctcccacctgggagctccatcactgttgctaccattctcctagccatccgggtttgaaatgataaaccccttgactgcctaggccttattggccaccaaaacgtacaaattatgactacctcatcatgctctaacactctcatcctagtgacttatatccagttcccaagtacacctacactagaatgtagtctgcatattctaccacggagatcaatctacctggcatgtcactttctaccagcatattagtctgctctaaaactttttggcctggggaccaataattccctgtgactctcccgaccacatggagaaagaaaggaaaacatgaatttacatcacatgtgtatttaaaggcaaatcagagactacacagtagatggaaaaagcttttttagctactaatgtaatcccagtagctggggaataacagaattttcaagctgcctgtttggcagagaaacccagtgttccacaagactttgctcttctcttcatttgtttcttaaaaccacgctgtgttatttaaggaaatgatgatcaacaaaattctaactgaaaagtaacttgatgaaatattttccattaaccgttgagatattatagaaatgtactttttcctaagtgattctggggcagaaaaatacctttataatcctaatatatcacaattcctttagtgcctaatattgagggagcagcttttattcaagatggaaggaatattagatatcattcaatctagcttcctcattttacagataataaaactgaggatgagagtggtaaagtgatttgctcaaattcatgaacctgcctctcctaatattcagccaagtgtcttttccagaatgtcacagttccctgtataataagaatcagctttattttccacaagaataaaagaggttagagttagaaaaagaataagttttctggatacagagtgtcattgtgtctatgtgaaggaatgttagcaaaagtgaaaaaaacaaaaaccttgtacagaataaaagaagttattcctggcaattgactgaaatggaaagaaatcataaaagacttgaatgacaggcaaatgaataatgtgatgagatatatcaaattttgactctactgagatcaaaaggaagaatagagtatagggaatgaaagatgatgtctggatttaacattcatttgggaatcatttcaaaatcttgagataaaaggttctttagaaataataaatgttgtgtttctttaatttttagggactgagagattcatgcattgtcacaagatgttattaaaaacagctattcatttttcatggaatgagacagaatgcatattgtatattggaggcaaaactatatcctctgttattcccatatatttcctttcaatagccgatcagatgaaattgtgagtggatatgaaaggacaaaattaaacatggtaaaagaaattaaatcggggagtttttttttaagaaaaaatccttcatttgtttcgttgtcagaattaccaagatgagctaggtaataggttagctttacgagctaaaagtcatcatctatacatgcaaatcacgttgcatgcaaacgttctttctggtccattttcattagtgcttaagtatggagagactactacaggactttaaagcttctgtccaattacccagggacatctcaacatgaattatagctatgtataagcaaaaaaaagtatttgactttaaagcaaatacatcagactgtaaagcaaattcaatattattcatcttttgttgtattcaaagataagaaagtagtgattacttacattataaaggtttaaatatctatatttacccctgactttagtacataacaaaatatgaataatattaagattcccaggatatgataatttcaataataagaaagccctcttttgactaggattttcttatttccaacaggtttttgtgttgtgtttaatctgtctgtctgtgttttagatttactctattaggaaatattagttccaaccattgtccttacagctgtccttgcaggaacactactcattttggaacagattagtgtatcttggtaccccctttaccttgaatgtataaattatcttttagatctatttgttgctatgtaacaaaccaccctaaagctgagtggtttctaatgttattgcccagtagcattttgggccagcaaaatggttattctcctgggcttatcatttgtctgtggtcagccgcaggttgagtcagcagtttggctgaccttggctggtacctttcatatccctcatcacatctgtcacatctgtacagcacaacagttgtccacaaattccatcattttctagcagattagccggacttgttcacccggtggtgagcagagtgtcaggaaaatgagtggaaatcttcagggtttcttaaagcctagggtcagcatcatttctgctgtattctactggtcaaagtatgtcacagagcaggtccagattaaagggcgggaaagacaagtgggaaaaactgcaaagtaactttggaaaagagcctaggtatacagagggggatatttgcagccaattttgtaaacaatttacaaattactgaagaatttctacagaaaattcattttaattaccttggttatacttaaacataaaaacagtgaggcccagagatgtcgagcaactggcccaagttcacacagaaagttaaaagcagaactggaataaccaactgtcctagtttgcccaggattatgtcagttttagcactgaacatcccacatttcaggcaaactggggtggttggacaccctagggaaagggctaggatttcctgattcttagtttgatattattttctgaacactaaaattgatctatgtgactagctattggtgtttaagatcaatctaccctcattcctgcatcctctattagcatgcatgctgacatttaattagtttgtccattggttagactctactctgttccaaaatggtttaaggcattttataaagtactgtacatcacaaggggataactacacaaggctaccttgccattcttcaaacattccacgtattttaatgtttatgaatgctaattctttctgctttgtgattagtctttctctttctagaatggtttttgcttttttttttctattaatatcattcaatttatagtttccaattaccttctctgtgatgtaggccccagttgaagaattcatcattatctcctctgagctcctgggagacttggcccatattttgatcgccatacttagtacattgtttctactaagttacgtgttatctcattacagtgtgttttcaccttacatctcctttatttagtataatcttccatatccagtaggcactctgtcatttctttaagtcattgtttctgttgcataaatgagtgaacagactgtttagtgacagcctagtgaaatgtggaaattttcactttcttcactaaaaacccttgactgcttttcttcttagttccaattatccatttgctgcatttttatcttttccgttggtataattcctgccctaagcaacacagctctcatataatctgctgggttttaattggctgcagtttccaaagctaaatgattagtttcaaaaagattgtttctgacccaatgcactgtaaattctgcacggggatctgaagtgcttttgtttgaggccctgtgtttttgtgtttgtgtatgtcatttttatacccattctggattagtttccagaatatccagaaaaataccaaacacataataggtgctcagtgcacttcatgattcattgttttatcatttgctcatatgtctctatacacccatttatacttcagggcccttcataggcctcttcacttttggaaaactttcctgagcaagcccctccctgtccagctggagttctacaaacatttaccatagaacccattcttttatattttcataaagtattcaattctttgtctctccatccactgtctgtaaactctttgaagctggcatctgtagactatttgcttttgctgtacctggctcacaggaggtaccaaaacaacctttgtttatgtgattgattagtcaaattgatgaatcaatcaaaaactacagtttcagaggaaaatgttataaaaagaaaaagtatttcagacgtcttcttggctcgtattacctgtgtcatagcttttccatattcagaacagtttgcatcttagaatttggttagcagatatacttataagactttgcaggtaagaagaggaaatgcccagcaatcagcttgctaaatttctcaatttgccccacctaaacttgcaacttaaatttagacatttttctgaaataggtaagtctaaactatgagtaggatggatttccccaattttcttgcatcaactgatacaatatctacaaattatcgaaaagatgtcaaaaacacatggggctttagccagtccttataatgagagatgggtcttggtttagcagaagaaaagaatacatttcagataaggaaaataaaagcatctaatgcataaaatagaaacaatacggtatgttcctgtaatagtgaggcctttcatacctttagaatacaggataaaaatggagatttgcatcaacttgatgattggaactaagctgggagatgtaaacttggcatgttggtatatatgagtagaagaggagctttcaaaagtagcattcatgcaagttcagtggaaaagaccagtgacaggaaaacacttgtgtaaacagacatgatattctgacagtgagaatggggaggaaggtaaatgctcaagaaggataagattaaagtgaattatatttctgaagggaggaacaatccacttttctagccttttctcttgccactcagtcatgtatcttttacactccaatgatagagaatttctcataagcatcgagcttattgcatccctttagattccatcatctttcctcatgcagcggcttctgctttatctttactctaaactcctaagaaattccaatgtattctttttttaattttttaatttcaatagttttggtggtacaggtggtttttggttatatggataatttctttagtggtgatttccgagattttggtgcacctgtcaccagggcagagtatactatacccaatatgtagtcttttattgctcaccccactcccagactttccctctgagtctccgaagtccattctacaattcttatgcctttgcatcctcgtagcttagcttccatgtatatgtgagaacatgcaatacttggctttttattcttgaattacttcacttagaataatggcctccagctccatccatgttgctgcgaaatattatttcctttctttttatggctgagtaatatcagtggtgtaaacctaccatattttctttgtccactgattggttgatgagcacttacattggttccatagctttgcaactgcaaattgtgctgctgaaaacatgaatgtgcatgtcttttacatataatgacttattttcctttgggtagatacccagtagtaggattgctgaattgaacggtagttctacttttagttctttaaggaatcttcatactgttttctatagtggttgtactagtttacattgccaccctcagtgtaagtgttcccttttgccacacccacactaacgtctatttttttttttaattgtggcttttctggcaggagtaggatggtatctcattgtggttttaatttacatttccctgataattgtgatgttgaacatttttaaaaatatttgttggctgtttgtgtatcttcttttgagaattgtctattcatgttcttcacccactttttgatgggattatttgttttttcttgctgatttgtttgagctccacattttagagaagtataaaatatttaaaagacagaaagaatgtagagcctttggaataagagacgtgggagaatgtcctgaaaatacagttttccagaggtcaaaaaaaagaagttttaagaataaaaaaggtaaactggtgccaaatgtaaaaagtggtcaaaaactgataaaagaataatttagaatttgttaagaatctgattattgatatgaaacgtttaaaagaacagttttagcaaaagacattactaaaatgtgtattttattatatattttatttatcctaggctataaaaacctcaggactgtaagatttttaattagtgttaataatgcttgatcatagtgtatgacttttctcccttctgtattaccagcaatctgaacattagcactaggcttaatgtgattaagagaaatggattcttcctctaactggctgattttggagaagacatagaacaagggaatctttaagggtcatcttactctcacccaatatgagaattcctcctacaacctccttaactattaacttatttcacctttctagatgtccgtgaccttgtctctaaaataacgcacttggacttctagctctaacttctgattaaatgaattagaacataaagtcactgagtcagttgccttcaactcattctgcatgcaggctgtacaatattttcatccacattttaaaagtgaaatattttaaatgttagtaaatgttaaaaattagtaagcaaagagcaattagcacgggcacattctgaatgccttttagcccttgcttaaacttaagagaacagtctgttaaaaacaagataatatttttattgacatttcagttgttgcaaatgagtctttgccagctttcctcctgattctagtattttgcctaattctgatttcacgcgtgggtactttctgaacaatccatgtcttggagcgcatcatgtactaatgttgctctgacaaccttgtaatgggaatttgaacagttattacatttttcttgttaaaaccagggggaaagagcattccaagtgtttatagctccctaaccttactgtgatgaggtgaagtttgatgtagctatttcctcttactttgaaatctcatttttaataacactgttccacgcttggcgctgcatgtgtcagctgtgaacccattcacctttgcaaggagtagccttaatcctgcaaatcctactttgctccagtcagtacagggttgaagagaagaatctattctaattacttaaagtttacttaccagtgcctgcaatgctacaagggaactggaagctataatagaccaccctcttcagtttgggggaaattctacaagaaaggcttctgtaacatgagcagctcttgacttatcagcaacttccataggctaatgattatatttgccaacatacccacaacagtttacagagatttttgacttacagcagataaatgtaaagattgaaattacgaaataagtagaacttgtgaaaccctttacaaagtcacagaatatactttatcttttttgtcaagtagaatggaaatttgttaaattatctgcttctcacatattattttaaaacaaaacagatgaaagctctgaaatacaaggtagaaaacgtcacttttttttttttttttttgaggcagagtctttctctgtcacccaagctggaatgcagtagtgagatctccgctcactgcaacttccgcctcccaggttcaggcaattctcctgcctcagcctcctgagaagctgggattacaggtacccaccaccactcccagctcatttttatatttttagtagagacagggttttgccgtgttggccagactggtctcaaactcctgacctcaggtgatccacctgccttggcctcccaaaggtgtgagccaccacacttggctgataaggtcactttttaaaaagaatagtttttaggcatcatagtgtcattaggtactataagcagcaagttctagaaaaaaaaatcacatataataactatcttttgttgactacttagtagaaaccaagtgtacttctagacactctgcatatatcatcaaatttaatcctgacctaattgaaaaacatataataaaatattaacaaaagtaatccttaggtgaaggtaacagttaactttacatgggttatatcgattaatagataaaaagacaggtaaacatactgttttcctttgaggaaaatagcaagtgttttcctttgaggaaaatgggcaggacatagtatatatctgggtaatttgacccctccattcttagtgcatcttacctctctactagttttatacctgaatatgcttactgtactattccctttttaactaagaaatctctagaatccttctacaggcatatcatatgttcctctcccctttttgtactatgcaagtatttttcacaaattttgcacctagaatcttcatgttatattccacatcaactagcatgagagaggctgcttttcattaggcaataagaagcagagaaagatctatactgcaataactctatgataaaggcaggacggtatattttacactgatttcaccatatatcctccgcatcgcaattggaaatgtagattttataatgcttattttgcaattcaggaaactaatgttcgaggcttaacttattcaaagcgattacttgaagcaaaagcttcatgaacttgcccagggttattctgctgctgagggggagagatagcattggaacacagggtttatttgccttcaaagttctgttattcctattacatctctgtcatgaggaagactccatgcagcagaatacctaaattttagcaggtgtttttaagagatgcatgagcagagagagagaatttgcatctgtgtggatagagggatcttgcttcatttgcaagcaagaacttctgtgagacttccggtacatcaaagaatgcctttgcatggctgtcttctggaacaacctgtataaccacatgggaataactaggtccaaagtgtcacactggcttatgcatctcctcaagtagtcctacaaagtctaaaaagttaacagatacaaaccaatatcggaaggaaggacccatacggtaagatgaccacaaacatagcacttttcccactgagtcccctgttgttctaagtctgcctttgatgagtatccaggagcttgtggtctcctagtccttttcctcctctcctttgtactctccaaggtctcatcgtttcagacctctcaacccctccattctccatttagagttctggttccaattcaaggcaaaatcctcccagccaggtcttcaggtttccaggcagtgcccaaggctccatgcagcagcaagtcctttgcacttaaaagcaagtctttcacacatgcaagttcttcaaagggaaacaactcttagtcaaacaagcctttctctcataacattggccccattttacagtggaactctgatgcttaattatactaacaaagtatactttttaatggaacactagctacctttaaaagttagccctcagatcataaggcttaccatgaatgaacatgatttcagctcctgtaaagttcaaaccagtgctgctgatcagaagtcggttttcccacaaagggcgattcagggactgcagatggtgctgctgttatctctacatcaagccactaaaagggaagtgacatgggagtttaaatagaccacacctggaatggcagctgtcaccttcactcacagttgactagtcacagctaactgccaggtaatcagagaataagggccactaaatggcacagcaagttataaaatgcattcttaaccggcatatgatatctagctggatatccaggaataaaagaagagaggtcagctaagcagatagctagactgcgtgatgcaaaattttgctaatttctaatgccttaccaaagattcctttcccttaggtttgggacattttgtaatggaagaaaagggagcattctgagggaatgagggaggagggaataaagcatgcatgttgaagaaaactctaccgttgtaatttaagaaacaacaacatacatgccagaatccctttgtaaagtgaacttacagtttaaattgtacattgtatgattgtaaaaccattatataaatgaaaaaaatagggaccattactgccttaaaaacaaacaaaaaaatgaaatacatttgtttggaagatgagaagactatccagatttgactagagatatttgcctataatatcactttaaattgtttctggggacaagaagaaataataataataatagcctccctctctgtaatagaaaaatgttattaggtgacatgatatttatataaaatgttgtttccaatgagacaaaagtaaaatatcctactgtttttagaagcacctggtattcactgtatgacatcttactttcaagggagttcttgaaccacctctataaggcagtcaacttttaaagcaacttagtattttggcagttggaagacatattaactacagtcatacctatttatgcctaaatctaaaagttcaaaaaataattaactcagatttagtagatttggaatatggattgatagtttctagttttgaacctagcttagacattaacaaagtggactaataataaacttagactaataaaagtatccccaagaccactttttcctcactcctgccttgcttacacacttgtcagtaaattagagttttatttccttcatgccaggtatcctgcagattttgagggaaatagaagcccctagtgtaaaatacaagagtttctgacaaccggttgataaattcttatttattaaaaataatttctaacttagcatgaggtcaatagacttaatgaaaaaatttcatggtataaacaatattaaaatattctaattatgacaattctggcaaatcccagaatgcattagattacagaatcacaggcttatttccagatgctgcaactatagtattcttttttttttttttttttgaagtctaaacatctcagtggttccaaaatacagcagaatcagataaatgtttgggaaccatactgaaaaccaattctgagaatttaattaaaggctggctaaaagcaaacaaaaaaactattatatagtgtagttgagtgtgacattctcattggatagttgataattgcactgcttttcctccatatcaccacaaattcatcaatcaataaattgttatgaaaaatttatgtatcaaacgatagagtttatacaagtaaaagaaaattcttattttcaaagacctactactccagtgatacaaatgtatacacatacattttaacatataagcctatatagatatatgtatgcatgtgtgtgtgcttaatatcaaactcttcacaaaatgtaatatagtttatagaaagcaaagtttattttagatgaaacctagagagctgagtcaaatttacctaaacagagaatagtggggataattttttttttttttttgtaaagaaaaggcctaagtaaagctagtaaaggcattcgaagtgcattggtttgatgaaagtagaagacttgtgtataaataaaggagtgagaaaattagagaagagtttgaggtcatacttgtgcaaatcccagaaggccaagctgagaacggcacctgatcttatagagagtagggagataaaatattagaggagttccagcattgtgtgacaaatgttattgagcttggatagaattcagtgagattagtgctatatagcaaaagaatgcataaaatacaacataagtactggctttacaaaaacatcattggaccaacatgtatgggctacatggaagtggaaagagattgaggtaggaagcagatgcaatcattgagatgtgtgagatgtatggtaggaaaggtggatggcgtggggaaggaaaagaaagggtcaaatgggagagacacatattttcagcacaaagcttcaataaatacttgctaaacgaactaataaatctatataatatttcagctcattacatatcctatttttcttagttctgtcaagatcctctgagggaaacaagcaggctgggtacagaagttaaactttggaacactttctctttgagtccccattatatatgttctcatacatgccctcattgatgctgccagtccatatttttataatatcatgtattattcttttgtagcatttattatgattttattaacttttatattattatatatgtaaactgacagagatcgcaactactctacacactccataagagtgcaatgtatattttctcacaactgtatctagtatatatcaaagttcaataatgtttaattgatgtcacattgctatgtggaagatcaaagtaatttgcagcatattagctctgtgtttcttgcataaaattatcgtcttgagagctggctctagaaaaaatgcaaaatcagtggggagaaaaacttcttcccactttataatgatacttcaacacccttgaccaaattcttatctccttcatctgaactctgtcatgccaccgtgtttgcctgtcatcactaaaggaaagcaaaccataaaattaaatcacaaataacgctagaatgatttgccttttaaagattccccaaatagtccaggtacagtgctcactcctgtcatcccagcactttgggaggtcgaggcggatggatcacgaagtcaggcattcgagaccagcctggccaacatggcgaaaccctgtctctactaagaatacaaaaattagccaggcgtgttgacaggcgcttgtaatcccagctactcgggaggctgaggcaggcgaatcgcttgaacccgggaggcggaggttgcagtaagccaagattgcgccgctgtcctctagcctgggctacagagcaagacttcatctaaaacaagacaaaacaaaacaaaatcccccaaacaaggaatcaatcactggatgatagtatttcaggcattcctgaggtacacactcctggcaactatctcttccacttattttttttatttcttctaacaaaaatactaactaaacttgactcaataattctttgttaatgagagagaaaaaaattgttcttatttcaacatatacttcagatagaatttagtacttgaataagcattcagaataaaatgcgaaagtattattaagggcacaaaagtattatgcacttaacgattatgccgataattgttaagggcgcaacctaacaatgtaggatgtgacaaaaatatcaatatcggctttattcaccttcatgatggaatgtaaggcattcatttcttatttctccttggctttggagttagctcactcatttctacattctagctgtctaactagaaaggcaaaacatagccatgtgtggtggctcatgcctgtaatcccagcattttgagaggccgagatgagtggattgcttgagttcaggactttaagaccagcctggcaacatggtgaaaccctgtctctaccagaaatacaaaaaattagcctggcatggtgtcgtgttgctgtagtcccatagtcccagctactcatgaggctgaggtgggaggatggcttgagcccagtgggtggaggttgcagtgagcagagatggcgccactgtactccatcctgggtgacagagtgagaccctatctaaaaaaaaaaaaaaagaaaagaaaaagaaaagataaaacataaataagcaaaatagaattttctctataagttctagaaatctaataatgccaaatttttagcatttaagtaaattgtactagagtgacagtttataaaggaacactatttaaacaagagcacctgtagacgtgtcatattttaagggcaattataagaaattctatccaagttgatattttccaataatataggattgctatttttttttctgatacatggttaagcaattttctgaattttttaaaaacaagatacatttcagttcatgaatgaccttagatatgagttttctcactaggtgttataaaatgcgctagaagagaaaaaaacacagaacaatctatttataaaccatataatgagaataaggtaccctttatctaatttgcaatccataatagaaactataattgtctatagttagaggaaaataacttatatttgcttatcaattgtaccttgaagggctctgtatttaattaaatgtccaatgacaaatctgattccaccaattgcatctttagaatcagagattgatagaagccacagagtcaggggaaccatttgccacaacagtgaaatgtgggattgatgtcacttcagcctgggatggtttatttgaaaatggtaagcctctggtagcatcaataatgccatgttattatcttttggcatttatgcatatactcctgatagtgcagtccattgagtattgaattaaagagatttcaagtcctgtccttcactagaatatagcttttcttgaagtgttaatgcaaaaaaaaaaaatgtaaagacaaagaaaacttgtaatcccaaatttttctgtaccagaacatgtttatataggtttaccaagggaaagagagggagaaatacattggatttaaggtagaacctgttcatatcaagactgtttataaatgacacccaaaatcagatactggggagtggagagggaaaggttagactaacctttttccacttaactgacttttgtgggactgtatagatattgttttaaaaccagtgccgttttttgtttcagttaaattctccagttaccaattcactttagacagtgaaaaaatggaatgacagagagtctgaatgaaacagactgatgaggcaacatctcaaaaaggcaggatacaaatgatgaaaggcatatgtcagccaaccaagttatctttgtgatccagaggcatggcagagagacacaaatctgtccctgaagttctcagaatgaaaagtttggttcatagttcaagcgaggttaatattcccaatctcattctattctttatctctctaccaaaagagacaataatgttgttcattttacctactgcaattttatcttctttcttgcagtgtcttttgcttatgaattaattttttattcttactgtgataagaacacttaatatgcaatctatcctcttaagaaaatttaagtgtacaatccattattgttgactataggtgcagtattgtagagaagatctctagatctcattcatcttaaccgaaattttatgcctgttgattaatatctccccatttgctcctactcctgtccttggtaagcatcattccagtctttgattgtatgaatttgactattttggatatttcatgtaagtggaatcattaagtatttgtcttcctgtgtttggtgaatttagtagtttcttaacatatctctttttcttatttgtttacactacgttgtataggaaaatattttttaaatgctgcaatttttccagtactagtcatgaatcttcataaatattctgactctatcctttccagcacatggagggattacacctccgtgttgacttggaaactaggtgtggccatatgacgtgctttagccaatgaaatgtgagtggaagatgcctgtgtaatttctgggtaggagctttaacagccagagactgctttaccatgttcttgtcctctgccaccaacatggactgaggccattccaacatccaaagagataaggatgaagacagtaaagaacagaactccagctgaccttcaatgaacatgttgaggaataaggggcaaaaagttctctgttatttttagatactgagattcagagtttgtttttttactgaagcatagtgcatatcactgatgatataaacactgataatagtagagaaatggataaaatagaaaaattctattttaaaacatgaattaatgatattaactatcagacaccgaaaatgtaacatatatccctgtgttgtcttagttccttataaattagtctggtgttagaactgtaattttctgacacctacttagagatacggtagggtgcttgttacagttcacttctttgcatggcattatgaaacataggcagccatgtttcactcctcataactagggtaataaaaatatgagaagatagagaataggcagcgcacatctttctttacttgaaattgttcagctcattttgagattgataaaatggcacaattaagtttaaaaataaagaagtgaaagtttcagactaaaggtcatgacataatttaaagctgagggcaaaatgatataattgaagagggaagagtgccttttaacaacagtaattgactaactcccagttaataatgttatgactgaaaattaagagcatagctatgctcaggtgatatatctatattaagaagaaagcaaaatcaaagtagtattgtctatttatatatcctactcatcaaatatctttgtaacagaattcttgattgcttctatgctagtcattagagttaaacatagaatattgtattctttatttaacctgtttgagtctttcattatggaagtcaaatcttagtctctctttaatgatatcggatagatattgctgtgatcagacaactgttctgtatctgtgctgtccaacaccatagccactgttgaacatttggtatgtagctagtgccacagaggaactaaattttcagttttactgaaattactttacatataaatgtaaagtattaattaatttacattttaagagcaaaatgtagctagtagctactatattaatcatacagctggtatcgccatgtaacctgaaactaaagttgaatcttcaaggtcacaaataaacatttgaaaggtttaatgcccaaccagggatgccatgccaaaaaaaaaaaaaaaaaaaaaaaaaaaaaaaaaaaacaagaaagaaaaaagaaaaagaaagaaaaagaaaaaaacaagcaaacaaacaaacaaaaaactttgaaaagtaccaacaccaaaatcttagcattcagagcctcagtattgttcaaaagttattaaagtggatgaagggagcacaatgaaaggttttgccaccagagaattacatagcatatgacaatactgaatgcataattttccccacttctttctaacttcttaatctaaatgggtcacatttctgtcagcaaacaaattcctatagtcaatacaatttcttggaaatctgacattattataaacacttcaaattactttaccttcttggtaaactatcagtttctcagatttttgtttccacacaagctcaaaagtctccatgtatgtaatttcactttttttaaaccttttagcgtatgtctcatgtggtcttgttgccaagagagtgtaacataagtacatttctaaaacttaccatttacataaaacttgaattttcaagtagagccatttgagacctcagatctattcttccatccctcttgaatgtatatggtcttgatttgtttggaactgccatccatgtaagtatcttattctaccactaagtggttggagcataggtaaaagtattcgaactttgggcgtgcatccaagatttgatttttcagcagtttaaaacaaaactacctgatgtgttccactgtatgagatcaaaaatagacagtgttatctttgtgagacaacatcaaaatttgatttaaaatattcagatgaaacatttttttcttaaggttgtttctgtgggtaaactcaagggaagattaattctatacctagaagctgtcattgatctggcactgatatacatatatagtctgttttttaatcagtatttggatcatattccaaagtgtcagttttatgtgatagttaaaacagtttgtggcaggaagaactttaaaagattttcatgaatctcaattaaataacttgaagttttaaaaattcaatcacattaaaatattttttgttttttaataaagttctgatttgatagattatcacattaattacaaaccttcagggctcgcctttgtccattgtttaaaatgcttagtgtagtgtgttaaaagttcttcaactctgggaccaaatttttagccccttcttacagaagttttttttccttctgctcacaacttaacttgtcagtccttgaaaaatgctctcttttgaatagttagaaggctattcttcctttccccattcaacaaatctcgctcatcctttaagactcaatttacatgtcatctcattcattcattcaacaaatagataatgagcacttgctgtgtaccagtcactatgcttagtgctttataaattaattcatttaatactctcaaatgtttttgtgaagtcgatattaatgttatcatttcacaaagacaggtaagaactgcctaccttttgtcccactccactccacccaccattctgactgtggaagctccatgggtgtccccattattggattgcgctgacaccattagtcttcaccaccagtcagtttctttaggactgcctcctctcccatggccaaacctcagagaaggactacatgaattttctagactgctataggtatacagtaaaaaaaaaaaaaaaaaaaaaaaagaaagaaagaaagagactctgattaatgtggcataaacctggttgcatcttgagaatttcagtctagagattcaagttagtttgttagcaaaatggctttagttcctactatgcttttcctatgtggtgactacaagttgtcttcttattcccatcaactattaagactaattaaggagtaagatattatttgtatttagctcattttgatcaatatcagaaaacatttattgagtgactattatgcaagggcatctacaaacacacacaccaaaaaaacaaaacttgatgtaataacaaaaaacaattcaaaactttgagagagaactgtcctgggggaagaagttgagtatatatttgaagcatgttgtttcctggagtgttatggaggatttaacacatgaacacgccagcagaatgtaaatgtaacagagaggttggggtaggagaaataggacacctctgtcttcttttcccagaagtgccccaaacctgtaagatgagaccatatgctcagtttatagcaggaatgttttggtaaaagacctattttttaattataatataatttttaaatcataaaatgttagtggaatttgagagattgttctattttttcctatatgcctgattggaaataattatttaaatggaaaattagatattgtttttaaaatgttacaaggtattttgggttttgaaactcagaaactaagaaatttattcatatatggcccagtgaggtgtgcatgaaagaaagaatctggttctacattcatgtattacctcaagccattcatatgaaaaattcaggccaatgaccacaagagggatgaagaagagaatttgttggatggatctgtctgaagccattaatgcttttggagaagaaccacctcttcctgcctttccattcttctagtactctaagacagtccctcagccagaatagcaataaactcttggcatctggcccaagtttaggttctctggggctggattgctcttatatcaaaaagtcacatatgagatccatcagtaccagcaagcagaggaaagagttcttctgactgctgggtcagtagaattcatccataattcactcaacaaacagcagttttatataaaagagaaaatacattttaccttgctgagggcaaaactaaatgtattaataaaccagttaagcaaaaagaagtcgccttcatattgatgttatgtaattgtcacttgcaaaacaacctgtagagcatggaaaatatcctatctaataaaaaaaatttggtgattataaattggacttagaagagtactaacatagtatattcaggtatcactgattactggcttgattaccagagggaattagaaaaaaaaaaagactttttaatgaacttggttacctaaaaagagaaaaaagagtataaacccagtttgtttccttacctgtttttttctaggttataaaaaatagcttctgagagacaaatagaaatataattgcctattacaattttattttacctgtataatgataatataatatcttttttcttcctcttaatctattattcttgactaatctcatctttgaaaggcaagtcttacattattttacatgtagatttttcacatttcttcttacaagtttgaattgttgatttaaaaaaaagtaaaataaaagatttaaacttactataaagagaaagcattggtatatagcaaagtgaatgaaatactggataatagctcccaagaagctcttttgggataatagtgcaaattgaattgcctgccttgaaagaacatcacaggtaggagttgaagaaattctcagcttctctgatttctttccagccagtaaatgtgtctatcaaagtcacatggtcagcactacttgcttgcttggttagacttgtattcagttaaaaaataaaataaaaaataaaagcaaatactgaaataagcatatgtttcttttctcctggcaaaaggacctactgtcttctgaaaaggaagtagattttaggcaaaaacattgtgtgtctattaaaatcactctacgtaccatcactcaaaagcattttttgaataacttcaggacctgggttctggtatttcttactccatcttgagcactgatctgctttgtgacactgattgagccacatccctgtactttcagtccctgtcttgcaaaatactggaaataaataatgctctttccaactgccacttgttatgcttctagtgtcttatttatgttatggaactctgctatgagaagaaaaatagcagaacacaaaatctatgaagtttcctggcctgatagtatctgttgcaaaatagtgtttctgggaggattacgtgaaatagtacatataaaatgtctaccacatagcatatgctcaacaatgttaatccacttgccacagggtcacttccaatatctcactctggtaaaaattaccttcaccacctgaaaatctctttgtatcaggcataatagctggacttaagaataacaggactgaagaatacctgaaagtctaaaattgttattgcaaaatcagtacactaacttttgcagggcatttttttttttgtaaagaatggcattctatttcaacacactatattttacttaacaactattagttattcaataagtggataacatttacttgaataagtgaatgaataagtcaattgaataccgtacttctccactacggcattaatgtataatgtatcttgggctatttgtctcattagtttacataggagaacctgacttactctgtgatactgatttggcctgtgtagcagattcctgtcgtgaattcaacacgaactgggaaaatttctctaacttttttaacctcgcagttgttttttttttcccttccatgtaatgggcataataacacataatgtacagagatttgtcaaaattgaagataatatctaacgtcaaatctatggtatgagataaatatgtatttatttttaagtaaatttgtatcacttttgagtatatcatgtgcttttaaaataaccactttaaatttactttttaataacatttctgaatgtacactgttggggtagtgtaggagattccctcactacctttggactaggctgttgctcatgacagcagaatgaaatttgctaacctctactgtgatcccgaatttcttgtgatcaatatcaaaaaaagatgtgaaaggcagtactgctcgttacactatagtttcttttaactatgcctatctattattatttggtcatagaaataagaaaatgacattgatataaaatgcaaatgactctttgaatcaataataaattactgctcacaaactattcaataacaagtaattgatttgaagccaggcagaattttagacttatctattgtcttcagctgtacagagttaatgaggatttgtaattactttggattttaactaatacatctttttcattttggaaattgattttatattagtgtcatattttatggtttacacaattacctgactaaataaaggttgacaaaattgaccataatcaaaggcttgggagtacaataagccattttaatgcatagaatgtgttttctcttttcaagaatacccatctttttaaattttttatgtataattgttaaaaatttctcctttagaattgtaaaatgggaaagggaatagcttttagtaactaaaaagcattattcacataaagttctttggatttttcaaattacattgtttacctagaaaaaagttgaaaacctgtatctggcattttaaatttctacgtcataagccatgtacattttctacattaaccatgtcaaagtgtgaacttttagtctcctttttaaaagactggttcaaaaaaaaaacaaaaaagaatataccagacattctttgaatgtcactcaccaaggaacacttacatatgcctcttgtgaaaaagaagaggcatagaacagccactgaagatattatcctaaacttttatttggcttggtttggaattgtccagcagcataaacacacgattgctgtattctcagctggaaacaggttaagctagaaacacatattactacagccaaacaaaatagatcaatttgtccatggttattcatttatgtttctccttgggggtccctaagaagcaaatgatatgcaaacagctgcatgattattgctatgctcttgttgctatttggtgattgctatttacatgtaaattactacttggcaaagtacaacttctcttcaccagcaaccagacaacaaaacagttcttactaagctgtccaagattaattactcaaaaatacttcctaaaggatgattcctttagatttctgcatttcctagaaaagtaattttagaatgaataaaatataaaagaacaatcccaccatgattctaaggcagtatctatttaataagcaactttagaagattatggaagaatatagaaatgtaggtttcttgctgtgaggactgatttgggcagaatgggaaagaaaagaaaaacggaaagctagagtagatgcttaaagacagatgataagagatcaaagataaacttgatttatttccaaattttatctctgagtcaggctagatgatatcactcctcgcccttaatgtgtttatacctaaaaattgtcatgagactagagattattaaactgcctgaattaggcaaataaaaagaaaaggagttctgcacattggtgtcagttaacacttccgtgcctttctttacaaaacaaaaattatttaatgatatgaaaatagatatatttacaactgggtcataatctatatgcagttttgcatgtttttctcctaacattatatgaaatgtcattttcatattaattaatgtaaccacagcaaaatgttaatgattgtataatatctcctttatgcctgcactgctacttatttagtccccagatgtgttgtttttcacttttcactattataggatattttaaaatggaaatacttaagcacgcatctttgttttactcatccagttacttacttggaatttttgtaacaagcatgtgattaaggattttatacatattgacaaattgctctccggggaagttatccaatttacaccaccattaaattagtaagagaatgtcatttccttcatttgatttcatttaaactgatcatagtatcaatagtctacttagtgactcttttttttccttcaatttcatgtttcagaggatattaatcaacccaaaaaagttcaagctgtattagtatagtcaagaaaaatgggaaaaatgaaaggatttatgattcaacagaagaatcataatccatttaatccacgtttaatccatttaatcctggtttttcacaactggaatacctatgattataagccatagatttgggggaagaaaaaataagaattttagaaacagttgaaacaaagtgaagacaaggtttattttcaaatataccttggagacttgtagattttatataaaataatagggtcaaaagtgacaagcttatttttacaccatttttgataaatatggttgactctatattaatcaagatagtaagggagaaagaaaggtataaatatcccctattactattttaaaaaggaattagtcataatgtaataaaaataaatttattttaaacttattttattgtaatagcatctagtatttttaacacataagtaattcgatagactatcattcagcattttttttcaacaaacattttatttttccagtactgtaggggtgaaagtaaagcatccccttcgccttcagaaagtttgctgaaaacccattccaaaaaggcagattaattggagaaaaaggcatacaaatgtattggatcatagtttatgtgacatgggagccctcagaatgaagacccaactcactcaatggggtgcagaagcttacataccatctggaggttacagaaagaatgagggcttggatcctggcaaaacagtttacaggagaggggagaagaggaattttgaaaaggagcaataaattacttctaggcggaactgatggacttgaagaacataaaatggtctaggaccaagactattggatccataaagtagacaatgttttgtgacaaaagtctgcctaggttttagacagattttaatcttccttcctgtgatgtgggttttgataatgaaaactcaagaaaggaaatagaggagatttttttcttctttggtgtgaccagactgtagacagataagggaacttcagcctgtgctttgggagaggtagaagattgaaaaacagtgggggcagggggtggggagggcaattgttcctctccttggtgggtctgcctggtcttcatgtagaggataagtgaaaagtctcttctagcatctgttgatctctaaaggactttaatttaaaatattcattataccagggagccatattttgaaatagtatttcctgttctccttcagtatttaccatgtgccaggcactgattgatgtcctggacctaataatagtgaataaaatagagagtctcttgttttcttttcatggagattccattgtagtgggagaaaacagtcaaaaatcaagtaaaaaacatagtaagcaaaatagaggaaagtattatgaagaaaaatagagcagattaaaagtattaaaaatgatagagaattacaattttaaaaaaagatgaacagggaaggggttttagggttctccagagagaaccaatggaatggataggcagacatagagacagatgtatacgggtagagagaaagagagagaggatttattagggtaatttcttccagatagaggatttattaggggaactggttcatgaaattatggagtctgagaagtcccagggcaggctatctgcaagctggagaccctgggatgccagtagcaaggctcagtccaaatctaaacacttcagaaccaagaaagccaacgatgtcattctcagtttgaggttgaagacctgagaacggggtgatggtggggtggggaggtggaatggtataagtcttggagtcccaaggtcaaagaatctgatgtccaaggacaggaggagaagaatgtcttccaagttcagcagagagattgagagagagaggccaattcctcttgcgtctctttttgttctatcaggcgcccagcagattggatcacactaaggatggatcttccctgctcagtccactcagactcacttgctaatcttctctggaaacaccctcacaaacataccccaaaatgatatcttgccagttctcaagctatttttttattccattcaagatgacacctaaaattaacaatcaaagaagtccaatctggagaggtcagatttgagcatagatctgagtaaaatgaaacgtgagcaatgtgaatgtctggggaggatgctcttaagcagagaaaaaccatttggagtatgcttaggtgtttgaagactactaaatgggccattctgatggtgtagttagtgaaaggaaaattgtcagaggggaggtcagagccaagaggtagtggtggtaaaacatggagtggaaggaaaacttacaggttaggctacaaaagtactttggattttttcctgaatgtgtctggaggtttgatattatcatactcatgttaactctccctactgtgggaagaatggattctaggcaatgaggatgtaagcaagagatcagttcagaggcttttgcaatatccaaaggaaaattattgaatatgttttgtagataatttgactgatttgctgtgtgtgtagatgtggggtgggagagaagtgaagtacattaatcagaactgtgaatttgcttccagggtaatagtttaaggaccaaaacattatataaatagtttaccagaagtatattcctacagtttttattccgatactatttttttttcaggagaatgtactcatctttgtctcatattttaggagtctaacaaaactaatgattcagctttaaaatttgtgaaatagtataaataaatcagtccatcacaatttctaccctttaaatatgaaatatttttgccacaaggtttttctattattgttagataaaaatcagcactttcttttatatctctatatatgtctagtcttaatattccatgcagaaagaggaatcaaattcataaataatacatctttacctcctaggtggaataaatataaatatggtgagttgtatgctaatcacaaatgtaatgtaaagcattttagtttaaaccttttgatgtcatttaactgattacaatgccaatcattcatctaaatattgaaattagtcatttttgctaatttaaaaagtcttccctaaattttttattgaaccattaatcagtcaaactcctaaggaaaatgaagacagtttttgtagtctaaccaagaatcaaaacaaattctgcaactcaaaatgctttgaggaacagaaaagatattgggtggaaaaagatatctagctttgagtactaatattcaaagttaataacagtgaatgactataatgcaattaaatgggttcggtggattataaatatattgattataaaaatattactataaaattgagttaaccagtatttattgagtactcactagggttaaggtagtttttaaaattattagctataaatcatattagagaataaaacaaagtttggaaattactatgtcatcatcaacttaatttgagcctacagtgaagagctgttaggtaataaagaagaatgtctttagggtatatcaaatgggcttataaaccaaaaagttcttgttcttctttataaaaatagccaatatttattttgtgtttaccatgcaccaggtactgtgctaagcactttatggtcaatatctttttcagtatttccagaaaccctctgagggcagtactgttattgtaaaagatacagaaactgaggctcagaattgttaaaatagtttgcttaaagtctcatgaagtaagcaacaaagacagaatatgagcccaggcattatgactctacatcccattctcttgaaaactggatattagaaatttggtaaatataagattaacatcccctttcctattatttgtgcaatatatctttttttctgtacataagcaccatcttacataaactatacataagggcaaaggtttgtaaatgtgtatcaagaaaattattatagatcctggcagagaagtcagagaacagagaaaggtaaacagcatgcaaggaaaaagctataaaagaaataaagatgagaggcagggagaagccaccaggaaaatttttaaagagatacatgacaagacccagttcagacagatttctggcaatgagccctgggaataaaagcaactaatttggaagtatcaataccatataaagtattgtgatttagtataaacacaacagtagtgctcagcatactatccacagcaaaagacatttatcttcactctttgcaagtcttgaaagagtaacaaatttctgaaagggaacaaaagagagtggggtcttgtagagaaactcatgtttataaggacctagacaagagatgcatcaggattaagaaataaaactgtgtaccaataaattgctcatgtgaataggtatataaaccaaggttcttcacatgtaaataaaatagttcttatgctttaagccaatggttctcaaactttagtatgcataaaattaatctggatggcttgttgaaatacagacgtctgagtctcatcctcataatttctgattctgtagatctggggcgaggcctggaaatttgcatttctaacaggtgattgccaatgctattggtctgggacaccatctcttgaaataggtaaggatgatgttgctaagaattgaagatgttatagaaaataaagtgggagatattttactccattcatctagtttatacaggcattctttccagtttttttcaacttttattttagattcaaggggtacatgaacaggtttattaactgggtatattgcatgaagctgaggtttgtgatatgattgattctgtcacccaggtactgaatataatacccagtagcttttcaaccttggacctctccctacttccctctagtaatcctcagtgtctattttcatctttatgtccatgtgtactcatcgttcagttgccacttataagtgaaaacatgcagaatttggtttcctggtacttcgttaattcacttagtataatgaccttcagctccaccttgccacaaagcacatgatttcattcttttttatggctgtgtagtagtccatgttatatatgtatgacattttccttatccagttcaccgttgatgggcacataggttgattccatgacttcgctattgtaaatagtgctgtgatgaacatgtgagtgtatgtgtctttctggtaaaacagtttattttcttttggatatatacccagtaatagcaatgctgggtcaaatggaagtttggctagtggtctatcaattttgcttatcctttcaaataaccaacttttggttttactgattatttggatgcatttttgggtctcaatatttccttcttttctgccgtgattttagttatttcttttcttctcctagagttgggtttaattattgtttttttagtttttctaggtgtgatgttaggtcattaatttaagagctttctattttttgaggtagatatgcagcactataaaccttcctcttaacattgatttttctgcatcccagaaatttttgtatgtgtgtatctattttcatttatttcaaataattttttgatttctgccttaattttgttgtttacccaaaattcattcaggagcaagttgtttgttttccatgcaattgtgtggttttaaaagatcttcttggtattggtttacagttgtattccactgtgacccaagagtatggttgggatgattttgagttttttttaatttatcgagacttacttcctgggcagatcttggagtatgttccacgtgcagatgaaaagaatttatattgtgatgttgatagatggagtattctgtagatgtctactaggtccaatttgtcaaatgttacgtttaagtccagaattcacttgttaattttgtaccttgataatctttgtaataccgtcagttggtccccctctactattgtgtggccatgtgaggctttttgtaggtctagaagtacttgttttatgaatctgggtgctcaggttcatatatatttaggatagctaactcttcttgttgaattgaatcctttaacattatgtattgtccttctctgtcttttttttaaaatcgttattggtttcaagtttgttttatctgatataagaatagtaacttctgctgttttatgttttccttttgcaaggtagatctttcttgaaccctttactttcagcctatgtatgtcattacatgtgagatgggtctcttgaagacagaggaaaaatgggtcttgtttttgtatacaacttgccattgtaagtcttttaagtgggttgtttagatcgtttaccttcaaggttaatattgacatgtaagcttttaatcttattgtgaagtcattagctggtttctttgtagtttctattctatggttgctttataggtcctgtgggctatgtattgaagtgtggttttgtggtataaggtaccactcttttttttctcttttgagatagggtcccgttctgacacccaggatggagtgcagtggcatgatcataggttattgcagccttgacttttcaggcacaatggatcttcccacattagcctcccaggtagcccaggtagctgggattacaggtgcacaccaccatgcgcagctaatttttttttttttttttttttttttttagagatagggttttgccatgctgcccgagctggtctcaaacctctggtctcaatctatccactcacgttggcctcccaaagtgctgggattataggcatgagccacagcacccagctggtattgctttttcctttctgtgtttaggaatcccttaaagatctcttataggctaggctagtgatgacacattcctttagcagttgcttgcctggaaaagatgatgataacaatcctttgaaagcagttatacgttcctgcttcatgttcccctggttttcatcatagtttttaatgttatttttcttaaaaaataatgttgtccccttacaggacagttagtaatataattgtatagcaggaataatttgtatcagttatgatggagttttcattccctggaagtggttaagttcaagatgtataattatttttctatgttttacctgaaatcctacctggagtcaaggaagcagaaagccaaatgaatcttaatggttcataaacagactttctgactttctttctttcttttttttttttttttttttttttgagatggagtctctctcttgtcacccaggctggagtgcaatggcacaatcttggctcactgccacctccgccttccaggttcaagcgattctcctgcctcagcctcctgagtagctgtgattgtagttgcctgccactgcatgcagctaatttttttatatttttagtaaagacaaagtttcaccatcttggccaggctggtcttgaactcctgacctcaggtgatctgcccacctcggcctcccaaagttctgggattacaggcatgagccaccacacccagcccccataaacagactttcttagggtaggaataatggctactctgagtcctacactgtcttttctaatatcctttctgcagatgatctctattgtatcaattgtcctttatgcaccaattattcaaaatttatatctttgactcgaatatctcctcttagccccaaactcatatatccaattgcctactgaacatctccacttggctggctttctcccttttacgtacccaaacctgaactcataatctcaacctcattcctaaacttattctccctccttttttcctgtctcagtaaacagaagcactatgtgttcatgtgcttaagccagagatttaacagtcatctttgatactttcctctttatcttttaccacatctaatcaatcagtaactgcagttgattctctatcctatacattgttcatgtttatttcaagttgcataatggctcccaaagaggtccatatcctaatccccagaacctgtaagtatgtcactttacatggcaaagtgttgcagatggatattatgtggctaatcaactgatattaaactagaaaaacatttctttctttattcctatgaacctaatgtaatcacaagcacctttacaagcaaaacagggagacagaataggagaatttgagaaagatacagctatagtagaaaggcacagagagatacaacattcttggctcagaaaataaaagctaaggtatgtgtgtagcctctagaggcttgaatgggcgaggaagctataatgactccatgttccttcttgcctcagagagaccttttatgtgctactacatctatctgggatactttccctccccacccactcctatgccacccccctaagccaacttctacctggctaccagggttgatataaaatattacttgcccagagaaaaactatctgaatttgcataatactagattgtatcccccctcccatcatgcattagtgttctgcaattatacattatatcactcgctactatttcagatcattaatatttgtgtaacaatttgtttacagagtttgttttctccaatagatttaagcactagagaatatgaggccagaatatatatccactttatttgttgtgatatccaaataacttgtacactgtttgaaatagagtaggtccacaggaaatatctactgaatgagcacataattaaataaatgaatggatggacaaatgaaggttaggtgaatgaaatgagaaaatacatttatatagcgtgcgttatgccagtttaaggtatattttgaagtggctatacccctttcaggtagccttttttctattcacagctagaaatttgacagaaactttcaagctgggttttcaaagtagatttgtcttaatcttgaccaatgggccagtaaacgccccagtccataagagttatttgccattctatgaccatttttctatgcttccatttttacacttatacacagacactcatcacatcaaaattcctttgaagaccgaagaaagagattgcaatcacagataaaactgcagttgcttagaagtgtgagtaaagctattttcatcagtatttctaaagagtggcataaatatatggctctctgtgcatgaatattttttaattttcttcggagctacagaagttcttttggtctcttttacatacatttaaattgaccagtatgaaatatttccccaaaaaaataaatagctaaagtccaagatgttgcatatcacagaggattatcttagtgccaaagaaaataccagttgttcatattcacactcttttctcataatcacatgtgaaagctacaattagtatgtaaaaacgagaatctcatatatatttgtgtgtgtgtttgtgtgtgtgtgtgtgttgtattaatcaggttaaaaaaacacctgactggtacaactaatggttgtgctaatcattagtcgtggtaaaaaaaatcaccatcactagtggttttttaacctgattagtacaactttccaaaataggaatatagactggaaatcatacatggaaaataaattctaatttttactgatgatgttctattggcttcataagtgaaataagcaagtaacctctgttctcagaaaaaaagaagtaatgcatatacacacaccatattcaaattaaacccacactttctcattgatatccgcatattctttaagaaagacaaaggtaaaacttaaaattcaaacacttcaaagacacagtcatttgaaagcttaccttttatgtttcattcacttgtttccttcattccctctcttattcattcattcattcagtacatttctttaaatggcacccatgtgctagacgctatgttaggcattggagaggtacttgcaaacacaacagacgtagtccctgctctcacgtaccttagaataaagctataacagaacagaatttaatatactggtagtacaaagaatatggaaaagaatattttcttaaagggaacgatatgtataaaagtactgaagtgagaaagaggtgggcattgtgagcaagggccaaagtatccagtggcaaaagatgagacatcacaaggttatcaagcagggctctgcagggcagggatggctgtgtgaactacagtagttctagaactgtgcttgagtacccacaggatgccatgggtttgggcttacttattgttagtttttacgttgctcaggaggcatgctattctcctagataagatttggaagtggaagtgtaaggatgagagcagaataaatagcctggaagggctgaggaaaggctattgcttggagggaggggagttaaagagatggcatgatccacaggaagtacagttttggcgggggaaaattgggcaatttaagcaggattttaatgacttattgttgactgatttggaggtaagctatattccatctcccataaaaattttcaaggaaataccaataaacaatggcttttcagttagaattgtatgctgttgatcggttgttatgtaacattggtatcaagatggtaacggagagcagggctacctaaggggtctccctgaaattcagagttaaaatgttaagtaacttttattatatcctcgtggcaatggtaagaaaattaagcacgggagttatctgatcttatttaccgtttaagaggttttccctggcttttgtgtggaatgaaatgagttgcagagaagcaagagtgggtacagaatcactaattaaaaggctattttagtgttcaggagacagaggatagtggcatggactagtgagctagtgatgaagagcaaaggaaagaaggatttcaggtattttggggaggtaaatgcaacaaaccttgatatggatttgatatggagtgtgaggatttgagtgactgggtagaaacatatgctttttactgagatgggatatgggaggaagaatgattccaggatggaatgagaggaggtttaatagttaagttttcaacatgttaaggttgaggtatttgtgagttatccaaatggctatgtttggggggaaactgacacaaaaagcctggacttgattcttggcaggtggtaatggtcgaaacaaagcaggtgaaagagattgccaacagagagtataaatgaaaagggaacaaagcccactgcctaaaaatggaaataaaaaaaaggctgaccagagaggtaggcggggagaacaaaaggcatgtctgaaaataaagccaaaggaaaagaacttttcaagaaactggctcatcataataatgtgcttaccagtgaggatctaaaaacctcgaatttacatccctgccttacagttgaggtaggctgaagttgggggaagggagacttgaacaaaaataatttcaacaagtccatgataagggccatgatagaagcatgtacagagtattctagggaccttagagaagcatttaattcagcttggaagggcactgaggcaaggagaaaggtagggcgggggcatccacacacagggactagaatgtacacaggcgcagtttagagagacaacagattcatttccaagaggaggccttgggagtagaagaacactgaacgtttgagggctttgagcaaaggaaaagccaaatcatatatagccaatttggcttccttcaacaattcttagttgaactctggttgacctcattagacaacttctctcattagactgagaactctttgagggccaaggtcaacgcttattcaggtttctaatacttatttgaccatgagttatttacctatctcctggggcagtttcctcacttttaaaagtagacactcaatataatgattatgaaaattaaataaagggtgataatggatgtaatgcatctcatatagagcctgcctggcacatactaaaagcacgacatatggtaggagctggtagtggtagaagagatattaatgggggcagtaggagtagtaactgtagtaatagttgaggaagtaaagtcaactgctcttgcttatttaaataatgtcttctcaaattttaggggttttgagatatatttgtcagtgtttctagtttatttttacatggagatatcatggattggtccattatgcacattgttgaaataagcttgctagtgagggcactacagcagttaggatgaatcatatttatcttttgagaatatcatgtgacattatagttaattttgagtaactaagcaataaaatccccaagtgtttcatacgtattttttagaactgaaaccaaatggtgcgctatgtattatgaatgcaccaaaggttctaataatcaagaccaccattttgcaaaaaaggtattttccttaaatacaatctatctgccttgagaaagcaaatatttatgattacacagtttttgcttttcatatatagcaaaactagtgtttttgaattatgatttgcaaataaaaaggcaactcatattttctatttttagtattactctataggattattatagactttatgtattataaattattcaggcctttataaaaatagcagaacagtatattttaatattaattttaatgatattacaaaatggacagcataaataagagatagttggaaattctgtggtaattttctcaaaaatgaccacatagatcaaaagaaattatatacactgatgtttatatgcagtcattggcaatgacattaatgatgaatagcaacttacatatgcagttaatggtgagttcaacccatcacccttcacacaggctgtcagcttttagatactctgcacaaaaatgtactgccaccaacagatatgaaaagaattgccaacatgagaggattaactgttccatttaggatgtccagctggctaatgggattcattttggtttgttgtcagattcagcctggcatatttaatttttgttctcttgaaagtatagcttctcactgagattctgcacgcataacaccaatgaaaatggcgtagtaaaaagttgaaaaattcagactccctgtttatctctagcaacacagctacaaagaaaatataattatagttttgcattgggaatgtatttataagggcttattggaccccagatagatattttaaccctgatgcaattcaccaagaaccatgtaaagttataaatgtggccatatgcctcttcttcactcattccctccacacgtatttattgagctgctctctgttctcagcaacagtgagcttgaccccctttaccatataatctgaaagggtctagactatttggccttttgttactgatattagttccaatgggaggttaccgagggtaagtaatcaagatacttgctggtaactggagttaaaaattgaacactacaatttgtatctaatttcaaagatggttctccctcaaattcaatttataatgtcatttgattttgattattttttaatgataccaaagatggatttatagatggaagaaccaggaaaagcaaaagctagtccagcaggtgaaatgtcagaaaataacgaaggattgccaggatagaaatcagaaaagctaaatggaaaaatgagataaatctgctaaagatacaaataaatgatatctttaaactccttaaatatatcaacaaaaaaagataaaggaaatatgtcttctgcaggagatagagaagggctcatagctgcttctaataattcaattacattcaaaaataaacttattgagcatgactttttcctttaaactcagtttttacaaaaataaatgaaatatgaacttagaagggcaggctgtaaacccttgaggatgtgcttacagaatcttattttcttctatgttcccctgaaagggtggtattctcgatgaaattcagcctccacattttattggctgtatttccttgggcaaattcacttttctaaacctcagtgtcacaaattatgacacgggtggtaggaatttaaatgagataatgaatataaagtgcttatgtcagtgccaggcatatggctaatgcctaataaatgataaactggagttttattattttattccatgtatttctttatcaatcaattgggttcattggactacaaatccctgtaaatcaggggctgttatttatttttgtattcttagcatgtaacagagtgcctagtacattgtacctactcagaaaatgcttgtgcaacaaaactgcacattctgatcatccatcagccttaaaggcctctatcaatttctaccaatctgcctaaatttgactttcaagatgcggcagaaataaacattttcccaaaagctttccatggactccagtccacctaccaaatacaagcacagtgagttgccctgtctctgtatttcagttgtattttattgttttctgcactactccaaacatgaggacattgcaattatttgttcatgtgttcatgttttccctccaattaactcatctttttatacttagaatttataccgtggcttgtatgtagataactctcagtatatattggtttgattaattgttaattcattcattgattcatttaggggtttattattaaagttaattattatattttctcttgggattctaaagacataaagagacaacataatttaagttgtgataaaaacatttacattcctgtttggatatgtgttatcttgttaggttggatataaaagtgtttttttttttttttttgagacagaatctcattctgtcattcaggctggagtgcagtggcatgatctcagctcactgcaatgtccacctcctgggttcaagcaatcctcctgcctcagcctcccaagtagctgggactacaggcatgtgccaccatgcccagctaattttttatatttttagtagagatggggtttcaccattttaaccaggatggtctcgatctcctgaccttatgatcctcctgcctctacctcccacagtgctgggattacaggcatgagccactgcgcccggccagaaaagattttttaaaagaattatatttaaatccctcagataaaacaagtgtgcctcttaccataaaattgtgagaactaggttagatcactttcctaattttcttccatcactaatagtcttaaataagcaatatattcattaaatatttactacttgcccagcacaaactaatatgacgagttttcttacacaaagagtaaaatcaccatgagtattactctctcttctgctttctgatattggtgacaattttaactgtgctgttttctgactagcaaatatggctatggtcacacctgtagttgctggtattattttgtaattctttcatctttcattcgggtttatgatctcttgtttctatttggtttcaatcataacttataggttgattttaaatgatggtccatcatctgctttgttagatatatctctgctgttctttgagttaaggtctggtttcattcctgttcgtaatttattgaatactggtacatgatattatttgtcaccattatctggaagttcagtgctatgttcaggggcatataaaaatgatactctcaatctataaatcatacagtattgtcttaactttggaataatgttttgttgaattaggaaaacagatgtgactaaatcatccatagctcaatgaagatcagattaaacccaggattgtcaaagcagacgtacaaaagaacaaccatcagcataacactggtcttgggaatttgaaatactttgtccttgaatatggtattcaaggctggctatttcaatcttctgttcaatataaatggaaataaaatttcttcatatatcactccttatggcagtggcatttttacatcttttctaaagatcacatattcatctgtatttggacttagagcctgccagaaatctgatttatgccagttcttttgcttttcttctaatttagtttgaggaattaaaatgaactttgctctatttcccttgaagattatattttcaattctggaggaaaaaatgacctattttatgcttatgttcttttaatttattttagttttttgtaataattgacattaatcaatctagtgataaataaaatcattatacaaaaaaaatcatatgaataataaatttttactaccaggacaatatcacaagtgtgttcacagcactttcaaagctcttcctaaacaaaggtaaaaggatcatcatttgcttaaacaaactatgtgtatgcccagtatggatttattacaccattcagttataaagagaatgaaaataaatatgggcctggtttccacattgttaaaaaaaaaaaataaagtaacacagaagaaacaaacacttgggaaaaaaaagaaaaataatatgtcattttatttcacctttcttatttagattggacatcaagaaaagtctatggtaatgtgaactccattacctgcaaggaaaattagagaaattaaaatgaattcagatatttttatcattaacagtttaaaataaaatatatacttacttaaatatgtatgtttacatatatgtaatataatagatattttaactaaaacatacactccaggtataaatacagaattctatggcatataaaagatttaaggtaaagacaaggatgtgtttttatattttactaaagaaagatgttttccattatccatttctcttttatatgtaaatcattcttccatcacatgtgtcaaatagtgttgcacaaaataaaatgtaaatatcaattttaatattcaggctgttttacccatataggaggcttataatgtgaaattcctactgtgaaccaataattcaaagagtttcaaatataaatttatttcaaattggaaacataccagaaactatttattcaactattaattcaatttaaaatgtatctactgaacactagctatgggccaggtgctatgctaaatataggaactctcatggggaagaaagcaagaaattacacaataaataaattctaatttaaatacctagatgataaatgaaaggatgacattcatttttatctgattaaatagctatctcaaattatccatgtaatattatctaaataaaatctcagggaagttggtgactgtgtgtgtatgtgtatcaagtgtcctggagtaaaaatcacaaaacctggaatctagtcacttattgagaacttgggcaagtcagtttatcactatgagcttcagttctgctggtaaattgccatacattatcaggccggtatggaaaatgcaattaggatatgattaattgaaatacattataaaaagtactttaacaaaattatgcaaaagatgatgtgggagcaaagagagtaaagcattacccatatttcttaatcattctgcccacagtgtaaagggtggttttgagagaactgggaagacagccagggataccagtcaaaatgatggaaatatctaggtgagtccctaaatattgacactggcgatgaacttgaagaataaaaaactgacttgagagatattggaaagatagaattaacagaacttagttgacaaaatagatgacggaaagggaaatgaaggacagagagtcatctggattcaacttgggttagggtgccactcattaagatagaaacatgaaagagaataaaataagggagatgagaaaatgagcaggttaagaagagttgatttaagggtacttttaaaaatccaacttgaaatgttctgtaggcaagtggatatatagtcctggcactaaggaaaaaaaaaaatgaaccgataccaaacatttttgagttaacattcactgattcaataaatactcatggagtacctactatgtactaggcgcttttctaggtaccgggaactcagcaatgaacaaaacaaagtctctgccttaaataatttgtattgtatcagggaaagtcagatgacatttttgtaaagaatgtgatttgtcagattgtgttaagtgcaatggagaaaaaaataaatgggtaaatggaatagaatgccaaaaaataggaattaggattttggcttcatataatacaatcagaaaaggcctattcatttaagaaacagcaaacagattactatggctgatgatgattgagtgatggggagagcggtaggtgatgtggttacagagctcgtaggaggacagaatgtgtgaggtcttacggtcactgaaggactttgatttttcactttgagtgatatagaagcctttcaagtgttgaggaggggatcatgatatgacttattctctactggattgctatgactactgggtgaagaatgaactgaaggagcataatggcagaagcagaaggacaggttagaatgctattgtacaaattttaggcaagaaataagggtggcttgaaccacaatgcttggtagtagagatgatgagaagtgatatctttctagacgtatttggaaggtagaaatgacaggattttctagttgactggagtttgagtgtatgggaaagaaaggaatgcaagatgattctagaatttttgacctgaggaattgaaacaactaaaagaataaaattagtccttattgatggaaccatttgcagaaaaaagtagatctggatgactgaagaatttaagtgagaacctaatataaataagaatatttgaagacagttaaatatatacattggtagcaggagatgtagtcacagggcagagatatggcataatcaccatatagattataattaaagccccggtttagctcaccatggaatttgtgctagtgaaagaaattgtagaagtaccacacttcaaaatttgaagtctttggaaataaaaatatcagaaaaagaaactgatttacatagtcatttagatagaagaaaacaaaacagaagtcaagagcagaaagtatttcaaggagaagaaaagaatcccttgtgccaaatggtgctgatatgtcaagtaaagatgaggacacagttttgaccatagcattttagtaacatagaattcagtggtaaccttgacaggagcaggcgcagtaagccagggacaaaagtctcattagggcagtttcaagaaatcataggataatggccaggtgtggtggctcacgcctgtaatcccatcactttgggaggccaaggtgggcagatcacttgaggtcaggagttcatgatcagcctggccaacatggcaaaaccctatctctactgaaaatacaaaaattagccgggtgtgatggcacatacctgtaaccccagctactcgggaggctgaggcaggagaatcacttgaacctgggaggtggaggctgcggtgagctgagattagcctgggtgacaagagtgagactctgtgtccaaaaaaagaaaaaaagaagaaagaaaataataggttaatatttagagaaagcaagttgtagactcataaagaagagaagaaactgatggctaagaatataatccctggtgcaatgctctcaagtatggaatggctgacaaatcctagcgcacagtagaaaggttagcccagcagggtgtcatgataagttatcaagagaaagagaggaagtagagtagaaacaagggcatcccttaacagtgaagaggggaagagatagaaagtttgagccaaaagaagttggtgtgaaataattgcctgaaagagcagaagaataaataaaccagtgatctccaggcagtattaggagcttacttgagttagtgctcatgaattttaaaagaaatatgccaacatggctttgtatttttctccagctgtgtttaactgtatgggtgcaggcatagaggaggtggagagttcaatttaaaatagaacttcaggttttaccaagtgagtatgataaatgtaaagagggggaagtaaaagaggcaagaacataggaagaagtggttatgataactcatcatggaatttaagctagataaatagatggcaaaggacagtgagattaatgaattgttggtcttgatgagattaaaggcttgttggagttagggtacagaaaagggtgaactagaaggatggagttgaagttcaagagtaggatatttgcaattgagattatcagggggttttaattactagtaaaggaaaggccaaaggcctgaccagaggcgtgaagagccgagatgagttagaggacagaggagggtaagaaactgagaagccagagaagtagaataattatctgggatattaaaatcaccaagaattaagacagatagagtgttagaatgaaaaacggcaagctaggagctaaaattttcaaggaatgaaagtgattaggaagaaggttactatataattctaacacaaagtgtcagttggggctatgacctggtgatgtaagagtcaaagttgaatatttttagtgaacaggaaatgagatgttctggaaagggcagtgagaagcaagaaagtcccccatccttcagctgccatccttatgggcatgagcgttgtacagaaataatgttcacatcaaagggctaacagggaagtattgtcggcaggaaaaatccaggtttccattggaacaaaatggtcgaggaaaaattgaaagtttgcaaatatgacagtatggtgatgactgaagcttcatttccatagggcacgtggttggggggaggcatgttaaagttggagaggggtagaattcggagtctaaaaaggcaatacatacagccatgtggggattaaagtctagggaatgaaagacgacttgggagtcttgcagttattgtgatttcaaggagcagggaacagggaaaaatgaaattagcccaatcctgagggttccaaggcagaaagtgttgacgagactgcttgttttggaaacagtgaggggtggggtgccctttgaggaacacacgaacagttgggacttcctaacttctgctttgtggctagcagaaggacaatcctgagcacaggggtgttcttttgacctctcttaatagtggcttgcagaaggagaggtatttagcacattctcagaagagagaataacaacttacctctatttagtccctaatgcattttgttataattttgtagcagtcttctcagagtgaaaacatcttgaaaacctaggaatattaattttgtttcccagtgcttgtcaaagtatttggtacagagtatcctctaagtcaacatttgttatagaaatgaataaaatagcgtaagaaatcctaacctgacagggttattcaagtgatttaactggtgattaagttaggtagcatatgtgtaatttatggtaagctgaaaattcttatatattatgatgggtaatttgaggtgtcaatttgactggattaaaggataccttgaaagccagtaaagcattatgtctaggtgtgtctgtgagggtgtttctgggagagatttgtgtgtgagttggtgggctgacaggaaagagctgccctcaatgtggatgggtaccattcaattggctggggtcctggatagaacaaaaaagcagagaggaaaggcaagtttactctctctttcctggagctgggacaccctttgtctcttgcccttggacatcagaacgccaggctctctggcctttggacttcagtagacccccaagttctcaggctttcccctcagacggagaattacactatcaccttcccttccctggttctgggactttcagacttgaactgagcctcactaccaggatttctgggtcaccagcttgcagatggcctatcttgggacttgtcagcctccataatggcataagccaattctcctaataaattccctctcacacttctatgttatccgtctgtctgtctgtctgcctatctgtctatctgttgatctctcttctatctttctctcctgttggttctttgtctctggagaactctgactaatacatatgtagattgagcatccctaatctgaaaatccaaacatactaactgctccaaaacccaaaatttttgagcttctatatgaaactacaaatagaaaatttcgcacttgacttcatgtgacaggttgcaatcaaaatgcaggtgcacaacataatttattcagtgtctccaagcggttactgtatcaagtaaccttttaatcaaaacacagcatcctaggtgtagacagaaagcttggcattttttgctgttgctgttgttaacagctgacacagatattcctgggatgctactgtgtttcttggttaccctgaacacattattttttcactgcattaatgatgtcattttttttttactgtaaagtacttatatgtgaataagttcaggaaagtgattacatattagtagaatataaattcaaactgagtaattattatggtgatgccaaacaaccacagattgtccacgtggatggctgagaaaatgacacctttgctttctggtggttgactgtacctaaaccttgtttcatgcaccaaattatttaaaatcttgtataaaattatcttcaggctatgtgtacatgtatgaaacataaatgaattttgtgtttagacttgggtctcccaaaatatttcagtatttatatacaaatattccaaaatctgaaaaaattcaaaatctgcaacactactggtctcaagcatcttggataagccaagggctactcaacttgaacatacaatgtaatatgtatgaatcatttcatcctagttttatgttttttttctagtcatgtttgaaaatgtatctgtaacattgaaccaagcttcattgacgacatctataaggaaacattactttcctctcccttattatctcagtattaaacacatttggtgagtattctaattgttaaagccagctggagcctgaaaactgtaaatgccagtccctgagtaggaggtaggatcttcctactagtcaactctagccattgacaaacatgaactaaactcagaaaaatgagactcgctgggcaaaacctagttatactaggaaagagaacagatctctttttctcttgggtcagattttaaagactccacctgtgcaggtctgcagtcactcctggacagaatggcaatgtgcagctggaccagttccgggaaaaaaggaaggagattccaagggaaggggagggcaatgtttatgaactacagagtttaagctatactcctctatgccagattgttagtaatatggtacccactctatttatgtattccacttttgtctttaaaaaatttagagccagtgtggcaaataaaatttagggaaggtcaggttcatctatgcatgagtcagagctttcacgggaaagggacctgaggtagccagagggatgctagcagaaggcattggtagggagagatcaggtggtgtgatttgagcttttttcctcctcaaggcatgatctcaacttgtaaacagtccaaaggtttttattatccagatgattctcattttagtgcttaccttgtatatttctggttttctcgcattaaggaaaatggcattttcttacatcattctctgtaatgattctctataacaattcctattaacatttaaaaacaacattatttctaaatgaacaattcaagctcaatcatgactatcaaattttactaaaatttggtagtttagtatctgcttcgatccatgtttcataaaccaattcaatataatgttaatgtgttctgaagaaacaaatgagtttcatggttaaacaagtttttttattttatttttttattttatattcagtgggtacatgtgcagatttgttatgtagatttattgtatagtgctggggtttcggcttctattgaaacccatcactgaaataataaacatagtaccccataggtagtttttcaagcctttctctcctgctttccttccactttttggagtcccaagtgcttactgtttccatctttatgtctgtgtgtacccactcttttgctcccacctacgagaacatgtggtatttgattttctagattaaataagttttaaaacactggattaaacagttaaacagacttagaccttcttggcgcattcaatatatgcatttgctctgactctgaaaggagatacagcataaacttctaatgcttatttaatctcagaaactcctttactggagtacctgttgccaacctagatgtcatccacaaaatataattgggaaattctaatctaggtgattaaattatgctttcttttcttcagcctattggagtgaggaatttttttttttttgagactgagtctggagtgaggaattttaagggaacattattcttgtatttcataataaagccctgtacttggttataatgttaaaaaattgattattcttcagaattcagtgtgctagtttccttccttctttccttccttcctctttttctttcatttctctatcatctgtctccgagattgatgcataccttcctctttcatactgtctttctcaagtttaggtgtcaagtttatggtaccgacttcacataataaattagagacctttccattggggtcatatctttaaattctgtcttttttaactagattcaataggtctttaaactctattaactacctgtgtgattatgagaaagtcacttcttgatgtctcatttttgatatatgtaaaactcaggataatcatacctactttgtagagttcttgggaagagtagacaaaattacgccgctaaatcacttagcacataaaatgacatttaacaccaaacgagtattagctactgtcgttaccattctggatagcatacagctggtttcttccaccaaccaccaattatatatgtctttattgaagtcatgtttttggtgtgcactggtttggtattttcagacctctaacccatttgctgctcattgatcactaatctcttggctctgcaaatgatgatgcgtttaaatttctgatgagtgactcttacgtaggtaggtgttacacatttgcaacatgtctgaacacacggtttgtatttaaatggaaactgggacttgacaggagcctctggggaatcatcactacctaataggtttccttaatgaccagtcaattaagaacttgtatttgcaaagtgctttgccatcattgtttttctttcaattctctgagccattactatcatcttactgatgaaacagagatacagaaaggcttattgacttgcttttggctacatggcctgaaattccagggactctagggatttaggtctcaaaaatcctgcagttctaagcaaacagggttaggctttctcaatagactcactcaagagacagagaactaaatgtagcctgctcacaaaccatgagaggacttaagggcttttggtctgtaaaagagttctgtgatcgtccccaaatcactccattaatagccgttctctaacagtcatgatttgctcattaaattattcaccagtattagaatcagataccatggaatagagaagttttatcttaatgtgtgagatatttcaggatgagtgttacaagacttaattcttaagtaaaaagcgagacattccctttagcttctctgtaaatgtagtaaataccgctgtataaatataagcatgggctctttgtagcctgcaaagcagattttgtgttttatgtgagggaaataacaatcagtaatacttagggttttgaattcagggtttgattaagggtgactgtattacaatttttctcatctaaatagtgttcattaaatattagaagaaaagagctcaaaatgtaggcagtgattatgtctaaatgttggaatcatacaagatctttactttcttccgtacacatttttacaattgtcatatatattataatgaattgccattacttttatattttctaatcaggagtacacacacacaaaatttaaataccctttgtgtttttataacattagatctatgatttttattataaggagggctgagagtataattacagaaacagcctgttagcttctcttaagaaacattctctcattatttcaagttttgttttcccttggatctcagctttttagtgacaaatgaaataagtattatgtcagtttgtaacaaattattcatttcaaaataagaactccacagaacgtttaattactattctcagcgagtagatcatattcactgttgaaaatataatatagttagaatcttctgtttgggcattttatacacaagataaattcattttttcctaataatttttacctttaagctaatgtaaagggatataaatgattaggcaaggtgacttttaaatgttgtgaacaatgcatgaacatctttaagtatacatattagtagaaatttattgtgtcagctctttgtaatatatttcactaagcaatgcaaaataaaataaaagatacagtctccattttcatcattgcctataatctaagccctcctcatattttgcataggctatttcagtaacctcctaaatgatctctttgctagcataatcctctgtttcacatgtaaacgtgatcatgtcttttatagtctcctcatgcctctttctctacaggataaagtccatactctttagcatggcaaacaaggtctctgcaacctggtttcatctttctgttaccttctgccagcccacctcaaatttactctggaataaggttgggctgctgaagtcccctgagactccaggcagggtcccatctctgtgcagctggcttatactattttctctccattgaatttcacgcattcataggggaaaggaatgagctcttccgtctggtctttttatctcccttcttcagaagaggagtggcttatctgacttgtaagaccagtgacagctagatctgaactgagttattgtgttaaaggtcactgttcttatggacttctcatgtctcatggtatcttgcctcagttctgcatccttaggtggaaagagtttgtcttgcccctataagttaaacctgaatcattcgaacctgcaactcttgcctgcagctgggtcagttctgctcggaagccgcgatttatacacacgtctccaccattttctccaattcaactctgctaggggagccttatatttttttgtcaaaaaaaatgcgtgtatttgtgtgtgtgtgtgtgtatcctttattgtccctttccttctattatatgtcttcatattattcacgacacccacagagaagaaaatgactaataggatttggggtgcaaaaacctgccttgaactttcgaggttctgccattctccagggactgggtgctaattttaccttatggtgggatacaggaagccttgccaggattacaatcaggttttctataaataaaactcactgatgacatttacgtcttcattttctctctagggagtgtttctaaattgtttaatttagaaggtgtatgtttgaaaccctaaagcttttaaaaatattttaaattaattctctgtaaataaaacatttctaaattacacttaacccctttatctcattcattctcctctcatctggaaggtttagccaatattagtaacttttatacttgttcacaggctctagcatttctctttttaataagaccttatccatatactcataatttttaaaaactgtaactcattcctttgtttttaataaaactctgagcactctatctctgcagctttgagatacctgcttagtttataatccaagcttgtcccatagttgtttggtcttgtacatattgtcatttaatatctcagcccccaaatcagtatctatacatggagaagataatacaacttcaaaaggagagttgctctcagggctaagtgccatggctgtgctgtgaaaagtttgtatattttaactcatgtttcaatgtgaaagacaaatagccatagcctctttctcttttccctgcccttccaagctttaacaatatatctctttcaaggacagtatgcagggcactcactgttcaaaatacactttgtcaccccccaaaccggtgtaactgagatctgctaactaactccctttgatctcaagtatttgtgtgagtcgtttttgccaccactgccctgttggcctctttggtgtactggactaatgtgccttctgtgagatgcatgaagcccccgggccaacaaataacaggaccaatggaaagtatgaaaaattacaggtcagatagatatatctaacaaacaaacacgtgtggataatggaaactgggcactcttgtaacatatagggagtagtctatgctcttgctctagcatccttgtcacttatcttgcggtgtaaatatttatttgattgtttggtagtgcggttcttatttagtaataaatattttggcagcatgagctaacaaaaaaaaaagaatgtttaatgaaaaaattaagtactgaatttataattcttaaagaacttgatgaacatattagtcgaacaaaatatttgtagatacttaccaagaggactgctgagcacttgaaaaccagggggcagaatgtgctgatgaaacatcagcgttttttcaaaagttaatagattttaggaagattatgtctaaagatgacaatttgacatgtgaagctgctggctatgcatttgcatattactctgtgaagcatcacttttcatttagataaatgtctgttcctctaaactaatttcattcattttctgttccaagttttcatatgaaagtacaaaaagtgaagcaattgctgttaatgcgttgccttcattaacagcatcagaccttgaaaatagctaaatgatactggttttaaaacaatgcagtaaaattaaatatcaattaagtttattcaaattgaatcaatatctgtcttcaaaaccatggaattgaagtatagctctttgtgatccattctgttgaagatgaaatatctgacaccataataaatgctatgataaattcagtttaaaatgtaaaaaaattaaaggaaaagtgtttgcttttaaaattatatttattgaattattttgaaatgataaaataaaatatacatttgggtgtagcacaatgtcatggcacaaatgatattaggaatctcatgggggccaggtgcggtagctcacacctgtaatcccagcactttgggaggccaaggcaggcggatcacgaggtcaggagatcgagaccatcctggctaacacacagtgaaaccccatctctaataaaaatacaaaaaaattagccaggcatggtggcgggtgcctgtagtcccagctacttgggaggctgaggcagaagaatggcgtgaaccatgaggtggagcttgcagtgagccgagcttgtgccactgcattccagcctgggcgacagggtgagactccatctcaaaaaaaaaaaaaagaaaagaaaagaaaaaaaaaatctcatggggtagagctcttctcaaaatttatgtagtgcacatttaagttacactttaatccaaacaaactgtgatattctaccaatataaacaggagaaaagtacttggtgtggagagaaaacagtattatgaaaatatttagtctcaaacatttatgcatttcaatagtaactgcccctccaacagaattgaggatgtcttccatttagcagaatgcgcttttgcatatcaggtaatttatcacctatagagagaagatttttctcaattaaatatattatgatctgcagaaaagttccatgtaatatatcaagaattttaaaaatgcattcttcagaaaaatacaagtgacgaggcattagacacatatatatgtaagaaactgagtaaaatatatggctttgtatccagaattattattgtgcttgcttgtgttattttaaaatttgcataagatcaatactaagatttcaaatttttttctttaatgtgtatggccatatgttcaatttttgaaagaattttatttttgaaaatggcctttaaacagaatgattttataggtccaccgatattataaaactgatttgtcagttaatctataaatatttcaaaaactctataattttagttattttttgtgcctttttttccctctcaaaacttttctaatttggattacaaatttttacggtcagtcctcatacacatggaatactcggaaaatcagtaaaatgtcatcaacacaagcagaagaacaatcaacaaaacacaacttagttttctagctgaactcggctaaggctttttgcctgttcttcgtgaggaaaaactagacattaacaacaatattgcattgttatggatttaatctttgtgtctccgaaaaattcatatgttgaacacttaccccctaatgtgatggtatttggaagcagggtctttgggagacaattaggttttaatgaggtcatgagaatgtggaccccatgaaggaattagtgagcttataagaagaggaagagagaccagagctctctgcttgaggacacggtaaaaaagtaaccatctgcaagccaggaggaaggttgtcaccaggagccacattttctggcaccttggtcttagatttcccaccctttagaaccatgagaaataatgtcaatcatttaagtctctctgtctgtggtattttgttgtatgagcccaagctgactaagacatccattttataattaatttagttgttgtaattgttgtgtgtaattaaacttgtataagtaaatgcacattatacttattcacaatgtaagtggagttcatggtatgtatatgtgtatatggtataaaatataccatgtatgtttattacataccatgttccaggcattgtcctaggtactgggaaacagcagtgagcaagagacaaaaatcttcattgagtctatgttctagtgtatgcgtgaaggggtagggggagacagacagttgccaaaatgagagtaggagattatagaaactctagttagttatggcagtgaaggtttttgggctcaaagtgcaagccatataatatcagcattctttttagaatgcttctgaacctaggtatactcctaacggggcaagcaacccggtacatcgacttataggtttccctacgttaatttgaacagatattaccaacttaagtgtcttcaattttattgtcataccaggtccttaaatctattcccgctctacctatttcccagattttattaaattatcttgtgcaatttagatagatatgcttttcctcagctcaaagctacatgagtattttttttccagaaaagactgactgctacttatactttttttgtatacttaaagtattttgaaatatcttcagctacactgtgataggtttaggtgcctcttagcttcctgtgtatagtatgtctttattcctacatgaaagcctcttggcaggtgggttagccagtcctctggcctcagttctgtttaataatatctttcagacagaattctctcctgatcctatctgctagtttttctgaaactcttaacctttcacaatatgaccttaaccacgtctcctttagtcacaattttattcctggaggaaataagcaatcttcagccttgagcctctaagtgaaatcgtcaaccagacttccaccaccctgtggcttggctgcctgcctgaattgttgtgacttctacagcgactcatttgtctcctttttctccttaaccccaaaggcttcttccacttggtgcgttcttttaggctatgatcatccagcaagtcttgctgtattctgtggcgttaacaaggtagccttattacaaacagagacccagaagcgtttagagatctgcttaagtttggaaggttaattgctggcagaaccagacctggaactctggtcccctgactccctgttccaagcattttctaattcacgtactgccaaaacaaagcaaaagcaaacaaaaaacccccgctgaataaaatgcttttatgcgtgacacagaagaagtgaactgaatgtcaatatgtgcctgaagaaaggtggcccatttaggctgatgaagctgtgatgaaggtccctagttgatgaacaatatatattcattgattgattgaaaataattgacttcttattccttgagattttccccaaacgaaaactgcatgtttagtgcctccttctaaaggtatctgaatttttttcagtacttaaaagactcagaagtataacctgtattatttttcactatttttaattaatgttaactcattattaatgattctttaaaaatgtctactctgtatgagtaaaatcatctataatacaaaatgcttcaaagtatgttatagcattcctgttttacagatgaggaaactaaggttcagaaagttaaataatgtgccaacaatcagacagagcttaagggtgagagccaggatctgcctcctcagggcatgccctgagcatgagatcaccataatgaagacatcatgggttgtttttacccataaagtattaatttttaatggcttaaccacaaaaaaagtattctcataaaaaggagaacagaaagaagtaataaaaatgcaattttccattccatttgatttatgagaaacaataaggggctagagcaactgagcaaacattctaaaattagaatccagctagtatcaaataatcaaactctaatcagcaaaatcgtttacatgacacttattataatgttgctactttttgttgtcacaggattgcatcattaacattattagtaaacctgcgcaatcagttaaaaatcactcatttcctgagaatcgcagaatgttgaatttttttacgatttcagtaaagttatattcttggagtacaagtacttttaaaattatttgttcttaatcagaaggttatgtgatgtctctgataataatgtatctattttaaatattgaaaattccctttcatcaaatataaaaaaacgcttattatgttcttgcccccaaattggtcaaaatgtacagcaaataataaatcagatttgttttgatgtacttcgtattcttgttaaaaagaaaaagatttccaaactctatagaaaattataaaagcaaaatgaatttactgattattaatcaaatggcgtgaatactaacctttcttccttgaaaaataaaatgggcacacagttttggtgagtataaaaagcctttcgcaagaaaaaactatgccaaaacattatatctggtattaatgctgactataatttctggcatcataatgcctaaatgttttaaagaagctaacaaataatttgatgaccgtatataaattatattattttatgctaacttttgtttatatatggaatagattaccaggcagtaaagtattatttctagtgcatataagtttcaaatctgttagtataagtttcaaatctgttaggtttcaagtctacttaaaattaaaatgtttctctgctactgaactaagcaatacttagtaatttaattatattttaaatatagcaattttatcacatttctttttttattacactgtaagttctggggtacatgtgcagaatgtgcaggtttgttaacattaggtatttctcctaatgctatccctcctctagcaccccaaccccgaacaagcccctgtgtgtgatgttccccactttgtgtccatgtgttctcattgtttactgccgctaatgaggacatgcagtgtttggctttctgttcttgtgtttgtttgctgagaatgatggttttcagcgtcatccatgtccctgcaaaggacatgaactcatccttttttatggctgcatagtattccatggtgtatctgtgccacattttctttatccagtctatcaatcattgatgggcacttgggttggttccaagtctttgctattgcgaacagtgccacattgtccagcctatcattgatgggcatttgggttggttccaagtctttgctgttgtgaacagtgccacaataaacatacatgtgcagatgtctttatagtagaatgtgttataatgctttgggtatataagcagtagtgggattgctgggtcaaatggtatttctggttctcgatccttgaggaatcgccaccctgtcttccacaatggttgaatgaatttacactcccatgaacagtgtaaaagccctccaatctctccacatcctctctagtatctgttgtttcctgactttttaatgatggccattctaactggcatgagatggtatctcagtgtgggtttgatttgtatttccctaatgaccagtgatgatgagctttatttcatatgtttgttggctgcataaatgtcatctttttagaaatgtcttttcatatcctttgcctactttttgatgggttttttttcttgtaaatttgtttgagttctttctttgtagattctggatattagccctttgtcggatgggtagatcacaaaaattttctcccattctgtaggttgcctgttcactctgatgatagtttctttggctgtgcagaaactctttagtttaattagatcccattagtcaattttggcttttgttgccattgcttttggtgttttagtcatgaagtctttgcccatgcttatgtcctgaatggtattgcttaggttgtcttctagggttttcatggttttaggtctaacatttaagtctttaatctatcttgagttaatttttgtataaggtgtaaggaaggggtccagttttagttttctgcatatggctatccagttttcccaacactatttattacatattgattcctttccacattgcttgtttttgtaaggtttgtccaagatcagatggttgtagatatgtggtgttatttctggggcctctcttctgttccattggtctatgtatctgttttggtaccagaaccatgatgttttggttactgtagccttgtagtgtagtttgaagtccgagagcatgatgcctccagctttggtctttttgcttaggattgtcttggctatatgggctctttttttgttcatatgaaatttaaagtagttttttctaattctgggaagaaagtcagtggtagcttgatggggatagcaatgaatctataaattactttggggagtatggccattttcacaatattgattcttcctatccatgcacatggaatgtttttccatttgtttgtgtcctctctgatttccttgagcagtggtttgtagttctccttgaggtccttcacatcccttgtaagttgtattcctaggtattttatttctttgtagaaattgtcaatgggacttcactgatgattgggctattatttgtgtataagaatgcttgtgatttttgcacattgattttgtatcctgagactttgctgaagttgcttatcatcataaggagatttggggctgagaagatggggttttctaaatatataatcttgtcatctgcaaacagagacaatttgactcatgtcttcctattttaataccctttatttctttctcttgccttactgccctggagagagcttccaatactatgttgagtaggaatggtgagagggggcacccttgtcttatgctggttttcaaagggaatgcttccagtttgtgcccattcagtatgatactggctatgggtttgtcacaaatagctcttattattttgatatgttccatcaatgcctagtttatttagagtttttagcatgaagcggtgttgaattttgtcgaaggccttttctgcatctattgagataatcatgtggtttttatcattggttctgtttatgtgatggattacgtttattgatttgcatatgttgaaccagccctgcatcccagggatgaagctgacttgatcatggtggataagctttttgatgtgctgctggatttggtttgccagtattttactgaggcttttcacatcgacgttcatcagggatatcggcctgaaattatctttttttgttgtgcctctgcctggttttggtatcaggatgatgctggcctcataaaatgagttagggaagagtccctctttttctattgtttggaatagtttcagaaggaatggtaccagctcctctttgtacctctggtagaatttggctgtgaatctgtctggtcctgggctttttttggttggtaggctattaatttcagaacttgttatcggtctattcagggattcaacttcttcctggtttagtcttgggagggtgtatgtgcccagaaatgtatcaatttcttatttcttctagattttctagcttatttgcctagaggtatttatagattctctgatggtagtttgtgtttctgtgggatccgtggtgatatcccctttaccattttttagtgtgtctatttgattcttctctctttatcagtctggctagtggtctctctagtttgttagtctttttaaaaaaccagctcctggattcacagattttttgaagtttttcgtgtgtgtgtctctgtctccttcagttctgctctgaccttagttatttcttgtcttctgctagcttttgaatttgtttgctcttgcttctcttgttcttttaattgtgatattagggtgttgattttagatcttccctgctttctttttatcacttttcttaatatgcaaattagttgaagcagtattttgtttattaaacccttataatggcatgttgttagtacataatgaagtataaacattgaaagagggaaaaaatcacatacaattgcacatactgaaagaggaaaacatatagattacgttttagaaataagattcacatggttgtagttttatatcatgataagagcaaatagttgcaaaataaaaatattttaagcagatatttaatatagaattttgaaaatccagaacccaggaataaatatgctaaaatgggcagaattctatttaaggaaatttttccagtagcattacagaaattaaataaatgtgagatataccatgttaatgaattgaaaaactcaatcttgtaaaaaaaaaaaatcccaagtctcaacagtgttttagtattggtcatgtatatttgctttgtttttgtggagcttgataagcaaattctgaaaattatatgaaagtgcgaaagttgaaaaattgtaaagattcacataaagaaagaaggtggaaaacttgccttacagaatatgaagacaactatgatacagtcttataagaatgcagaatttaaataaaatactgacaccaattggcttgcaaacacatgttatagaatggatagaaacaccaaacgaagatctgcatagttacagatgcttaagacagtggtgatattccagatctatatagataaataaaaaaagcatgtgaaaaaaggaagaaatttacccctattttgcattatactcaaaaatacattcaggtgaattaaagctctaaatacaaaagtaaacataaaatttttaaacatgatattggagaatatcttaatgaccttggagtggagcagaaaaatttaaaaagagagaaggaaaggaaaagggaggaaaaaaacaaaagtggcaaccattgaggaagactaattttttgaaaatctgtattagaattaggaaattttgttcttcaagtgccaagacaaactcagaagagaaagatgagttgtttgaactacaaagctaaaaatgatctatctagatttacagtcacacaaacaaaccaaaatcaaaacgaacaaaatggatcagggttactggaaatggagagttgttggtcaaaggatacaaattgcagttgtaagatgcataagttctggagatctaatgcacaggatagtgactgtaattaataataatgtattgcatacttgacatttactaacacagtatttgcgctacacacacaaaataacttcaaggtgatgcatatataacatttcatcttgtatacatatatcaaaacttcatgttgtttactttgaatatataccattttgttaactatatcacaataaagctgggaaaaatgcgataaagtagaaaaattggcaaatatcctgaccaagctttccataaacaagaaacttcaatagaagaagtgttcaactttattagtattagagaaatgcaaatttttaaaaatacattgtgtgatagccttaatacaaatgctccaaattaggaaacattttaataatctgaaaataccaagttataatggaacaaggggcaaccatacatgctggaagggttatatattttcatgaccactccagagacagtttggcattatgttccaaggatatgaatacccaagaatttagcttttcaacttttatgcaaatataccactaatctgttgtacatgtgcatacaacaatgttcatagcagcactgttagcactagcaaaaactgaaaaccacccacgtgtccatcaacaatgaaatgataaattcatgacagtgtattcagataatggaatactatgcaacaatgaaaattaataaactaaagctatatctaacaatataggtgaatcacataaacatactgttgaatgaaaggagtaagacacaaaggagcacatactgtgcaattctattcacctaaagctcaaaaacaggcaaaactaatatagatgctaaaactacaggaaaagtcaatgaataatcatcaccaaagtcagactggtattgcatagatttgtcttgtgaaaaaaaaaagttaaaatggtgtgtagggttgtgatcatggtgggccataaaaaaagtgtaggttttaaaatgttgccaatgttctagctcctcaccttcataatgattacataggtgttcccttcattatttctgcactcttcttggatataatgttaaatttgtacttatttttaaaatatctaccatacaccaaaactgctctattactgctaagtcacctaggttgtggatttctcagaacgaatatggatggctgtttatacttctgctgttgagctttaaaaaaaaatgatcattgcaattacattgaagagatgtagatcaatttgactccagagcttgtatttagagtttctttcatgtgtatgttctaatcacacctcagaaccctaagaaatagacattatagaacagtagaggtgaatatttcatgcattggtttaaagaacaccaacatgttagaaatttagaagaaatgtgggtgacaaaggtcgttaggttctccttctaaagataacaaggtgacaatagagcacatgccagatattacttatgccagtgaacttgctgaatatttgcagcatttcctctgaggttcaaaagacctccaaaatagacataatctagagtgattgataggcagttcccatgggccactatttcttcaggcagtgtttttttaagtactgtgaagtgcactcactttatcacaacatgtatatttcttttcatatatatactttaagttctggggatacataggcagaacgtgcaggtttgttacataggtatacacgtgccatggtggtttgctgcacccatcatctacattaggtatttctcctaatgctattccctcccctagcccctcacccaccaacaggccctagtatgtgatgttcccctctctgtgtccatgtgttctcattgttcacctcccacttatgactgacaacatgcggtgtttggttttctgtttctgtgtttgtttgctgagaatgatggtttccagcatcatccatgtccctgcaaagaacatgaattcaacttttttatggctgcatagtattccatggagtggatttgccacattttcgttatccagtctctcattgatgggcatttgggttggtgccaagtctttgctattgtgaatagtgctgcaataaacatatgtatgcatgtgtctttatagcagaatgatttataatccgttgggtatatacccagtaatgggattgctcggacaaatcacaacatgtatatttgtaacagatgaagaaagatgattgtttatgattcccagtagaaatgtagtttcatcaagagagaagagagtgaaagagtgagaaacagagatactaaatttaggaaattcattgaacagaaactccactttggactggaaatacatttctccaaaatcacaaaagagttactttgtgcacactcaagttacttctacttatggggaaaagtcaactatacattcataaatgattaacacttatgggataataatgacaactaacatgcaccgtatgccaggaatcatgctgcgcacttaatattcattacttcattcaatctttccatcactcctatgtggtggagaacactatctgcagtgccactaacgagcaacgtttgatctccctaatatgtaactaagatacaaagtagttaagagacttaagttgtataaccacaaggtcacataactagatctggatataccattatagggatccagatcagtatgactccagagcttgtattcttaagagttttcagaatatcttccatgtatatgttccagtcatacctcacaacagacattacagaacagtagagctgaatatttcatgcaattgtgtaaagaacaccaattctaaaaattatcattaggtatcccattcattttttttaattgtcaagtaagattagataataaaccaatacaattttctttactgaagtttttcatgattgggctgtgactcttcacaagagagctgtatagctagtggtattatctaaactgatgaattgtggggtccccttgaagaaggcccaagccccaatagagatgaaaatgttctaaatgaggctgtagagaatcagacaattgaaggacatttctagcagactgacttggtaaatattatagttaatacctgcagattgacattgcattctattaatgttcagtaaaacggttatatatcatagttcattcaaatatattttactctttgcaatttgtagagtatactgaaagatattttcatggatgatgttcaatattcttactagtaaatgcatattgtaagtaactttacagagagaatgtctaatcagagactaaactgacttcacatagacagtaggaagaagtccatgaagtggatttgagtcctctccttgctatgtagtttattttttcatttacaaaatgaataatacttatatcaaaaaagcaatgatgtaaataaaatttttatgctagacatacatatgacagaaggtggttattaattttagtaaaagcagaggtcagaggtctgtgcttttttagactagtaattgatatctcctctcaaggatagccctggagcttcctacacacacacacacacacacacacacacacacacacacacacaaaacaaaaaacaaaaaacaaaaaacacacctaagcattgattggtcttggaactgctcaaattcccttgacttcctaatttactcaaataagtcatcttctctaatggaactttaaaattgagagtggttcactatgctatggaggagtgaggccagcaggagacagccattcattcgtccaagtgggtgaatagggaagagtctgggctcaggatccagactccttggactctcattctggctgcctcacctactccctgctctttgttctcatctgcaacatccagacagtgaaagtaccaacgcagaaggttgtcatgagcattaaatgaactaaccgcgataaagaacttagaataatgcctgacacatattaacaccataaatgttaatgattctagttcttccatgcccaatcaatgataatgcagccactttcattatcctctatgctaattatactttattctattcactaaacagaactaactagcaatgttttgttagcctaatactagttattgtatttgagaataacaaattattattttattataaattattcataatttgaaatgtttacaaacagaaactagctggcttcatgaatgaaggcgtactgattttttaatttttgaaaattaacatccattgattttgatacaattcctccaagatattgtctagtattaggcatctgcttaagctattgcttttctcaccttgttagatataactcattcacacaactagatcaggcttatcactaccccataaaaaggataattacaatcaggaacatcaaaaatgtggcagaaacaaacgagagaactgaagagttgaaacttgatatttcatctcttgtttgctaatggtgcaaatgctttttccctcttcatattaatagtaatgagatctttgaatataatgtatatttcttggtaactgccttttttccccagttgctaagtaatatttcacctttcatcagaagagaaagatagatggtacttaacctgctttgcaagtcagagtaccagataactcaattcatttctggaatgccaaatgaggtttttattctcactagaggaagccaagggagtgtaaatatgactctagttcattattgcctttgtgcctcctacagccttagaaatgtgttagagtatattaagttttaaaacaacattatttttagagtacttggcaaaaattatctttcaaaatctctgtactaaatttcatttcgacaaattaaaaacaaaaaaattgatatttagcttatttagacatgacctttgttaacattcatttggagaatcttaaattaagattgagacataatagctaataaaaataaggagtcaggttacaacctgagtctcattataaaaattattacacttataattgtttatattatatacatatttaaacttgtttatgtttttttctgttttgttttacattatgccactcagtacagagcattctcactgtaatgttagtggtctaatgaatgttttgtatatcagagcaatatatttacatgatacagctgatctggatatgtacagatggatatgaaaatatttcttgaaggaataattcccttggatgtcatactactaatacttatcaagcaactattttctggaagtcaataaatacagtatacaacttcctacattattgctttggagtttactgtgaataccagaggtcctgaaatcaatcaatcagttgtctgacctactgcctaccacacacttcttgtttctgctgaccttgtttatttgctcaacttaatgtgcttaccttctaaccaaataatctcttctccagcccactgattatttcatttcctctgatttagttttctctgttttgaatagtttacctcattaggaccttccattatccctaaggatatttctgagtgaaaacaatcaaaatcattgctgttactcctatgtaccagacactttaaaaaggacttcatatgttttatatcatttagtccccaaatacacacatgagttattattattcttattttacaaatgaaagaattgaggcttagagaagttgcataactcacccaaggtcaaaatcctatctgactcaagtctacactcctaaccacaaaggtgagtttgaaagattctttaaaaactaggactagcctactactgttaacctacccttgtaaactgctaatgttattactgtgaacattcatagatccttattgaattttaaatcaaaagcttgagagactaagttttcatgattctctatgtccatcatttggcattgacgatatggacaatcaaaggcaaaaaaatctacttctgataacaggagaataaatagaaggagatgacaaagtgtatagttaataatgtatacttttaatgtggttctgtatttcttagtcctttgaattttatttagcctttcaattattatttgctggatttctgctttaaattaaaatacaatcttattaaaagagatagctatatctttcttattctatataccaatcctcatattacattaggctcatgaataaatagcaaatcaaatggaaaaattcatattttagttatacctaggtgaattagaaaaaaatggaggacacagcaaaagtgaacaactaaagagaagtcccaaaatacatactaaaaatataattttgttctgttctcattctccatcgtttataccataaattataacactagtactatagttgtatttcaataacagaaaagacatggaataaaaatgataaaactgctttaaaaataaaataacttggtaatttagtaacagatgactaatatgatttttgtagacatatcagaaaaccagcatgtaatattggtgagagtatggaaattagccagaagattctgtttgggtttttgaatattttagttacttgcttgcacaagttgcataacttttcttactaatttgtaaaagagattgataatccctgacctatgacactttttaaaaatcaagggagatattacacataaaagtcataaaaccataaaatattgtataaatgtatattttttacttattttttaagcagtccacagtcaatctcaggttctagttgataggtttcagctaaggagttgtctgttgaaagccggagtgcatcaaagtgaatgggaggttgggtaaaggaagaggagatgagggtcaggactagatgggtggcagcaaaaataaaaaattaaagaggcaattttggaaacattatgaaagaataggagactcagattctcatctactacaaatgaataattattaatcttgtaaataatatggttgaaggacaataaaataaagagtacatagatcttggtgcccctcctgctttcactgtactccagtgggaagtatcagatcctgtgtaacttggccctctcctctgttatcagtgtttctcacatagcaggtgctcaataagtatttactgagcaaagaaatgaataaattaatgaataggtcacagggttattgtgtcaaataagataatgtattgaaaagtgactaatgtatcaaaagagctctgttaattgtaaataatgacatataggaaaatgttattactaacttacaggaagtatttttaggtttcttagtaagaaagttccaataaagctcttcaaaaattaattgggttaccttcaaaatagtgaattccctatctctgaaagtttaaacatagaagttgaatcatcttccatcacataaccaaaataattactactgagagcgggagagtgaatgaataaggtctcatgcaattttaagattctacagtgccattaggaatgatacctaatgtttatttgatgcttgtttggtgtttgttaggcacagtgctgatcgccttgcattctattttgttaacccctaaagcaatccttgagataaatattattattacatacagaaaaatgggggctctgacaagttaaagaacttgcctgcatcataagctaggacataactaaggaaggattttaagccatatttatctaactcctgagctttcagtttaaagtgtgtatcactatgatactctgtctcataaaagagtagttttctctgttccagtttaccttctaaatgattggtgttggctgcttgatgattcaagtctctgttaccagaagcaaatcaaaagtaccatttctgatttcatgaatccctttaactaccaaatggtacgtgatgcatggaaagaagcaaataactataatatgattttttggagtgaaaaatacatttttaataaggtgtcattgatacttaatattccagaagcagtgctcaagattttgaaccaattagagatttgggcttcatctgaccagacattattacaaattttacaataatagtttagtagatgattactgcccccggcatatgaaaatgttccatgtaaacatctcattaccaagactaaatattaaagaaatgtattcctctaaaaggccctttgtgtttcagaatatggaaataattcttctgttcatttcatattattcaaggtaagtgttggcatcctaactgtatatggcctccaaataaggagttaatactaatgtattctattactccttagctcatggtaatcatgccaagaacactttttaaaattaaccccatgctctctcatgggttcatttaagaagaaatgttataagaattctttggaattagtgaaaaacaattttgtcctcctaccattaagtctgtcttcatatctaaagcagaataggcacaaaggaaagtagttactagctttgtgttaatgacttttaatttgtgtacacttaacagtatcttgaaaaattgtcttacctggtggattctctgtttggtcagatatctaaattaaaaaggcctttctctatgagtttcttggatcagttatcttagttttagagtcatatggtgtgaaggactaaaagatacattagaaatcaactagaataatttcctcattttataggtgaaagaaattgcctgtaagtgaaatgacttacttaatgacacacagaaaaatggggcagaagaagacttagaccccaagtgtcttatttcctagtttttatcctatgcatgattcatggaggaattcctgattgtgctacaatataaaatcatgtcatttccaacccttttaaagtggcatttcctgccacaacttccaaaccccgcccccaaattccaattaaaacagtacactgagtttaatattcatcaaaaacaaacaaaaaaaaattaaagtaacaatgtatttaatcttttattctttcagagagtgattaagacatatactgtgtgtaagatactgtgtgtaagagaccgtagcttctgcttaaaaacattatttaagcttaatttcaatagcaacagagaaaattggagatgactgataaatacatttaaagcaggcaaaatttgagatgttttcttaaacattcatttctgtattaatgtattcacttaacaaatacctagcactttatctgggtcaatcctcatgttagacacgagagatacaatgataaacacaaataggcctggaactgcctatttgagcttttaatataatggagaagcttatctcaaataagtatcacactaattaatgagtaataaattaggttaagtaaattaactgcttttctgaaggaaagaggtgtgatcctatgcatatgtgtaacaaaagaaacagacctagattaggactgaggtagtcaaggagaacttctggaaggaggtgacacttaaactgagaactgactgaagaatgggtgtcagctagccaaaagatagatggcagtagtggagtgaaggagctagaagtgattaaacttgttgaagaaggcatgtcaaatgccaagacaggccaaaagctaggcctcttgtggcagacagttagccaagctgtgaatgcaacggaaaagtcctggacagaatttacaagtgcatctccattgaatacacaaatgataagagtgcacaacagtctttgctgctatggagaaaattctggtggtctaggtagatcaagccaaccacaacattcccttaaactaaatcctactctagagcagagccttaatcctcttcaattctataaagtttgacagaggtgaggaagctgtagaaaaaaaaattttgaaccttgaagaggttggttcatgaggttgaagaaaataaatcatctccataacataaaatcacaaggtgagccagcaagtgctgacgtagaagctgcagcaagttacccagaagatataactaagggcattgatgaaagtggctacactaaacagtagattttcaatgtagacaaaacagccttattttggaagaggatgccgtctacgacttccaaagctagagaagagaagtgaatgcctggcttcaaagctgattctcttgttaggggctaatgtaactggtgattctaagttgaagccaatattcatttaatactccaaaaattgtagggctcttgagaattatgctaaatctactctgcctatgctctataaatgatacaacaaagactggataacacaacatctatttacagcttgctttactgaatattttaagcccactgttgagaaatactgctcagaataagattcctttcaaaatgttaccactcattgacaatgcacctggtcatctcagagccctgttggaaatggacaaagaaattaatgtgtttttcatgtctgctaacacaacattaattctgcagcccttggatgaaggagtaatttaattttcaagtcttattatttaagaattacattttgtaaggcttaagctaacatagatagtaattcctctgatggatctgggcaaagtaaattaaaaacgttctggaaaatgtttaccattgtagatgccattaagaacattcatagttcatggcaggaggtcagaatatcaacattaacaggagttggaagaatttgattccaacccttagggatgactctgaggagttcaagacttcagtagaggaagttactgcagatgtgttaggaaagagcaagagtagtattggaattggagactgatggtgtgactgaattcctgcaatctcatgataaaagttgaagggatgaggagttgtcccttatggatgaataaagaaagtggtttcttgagatggaatctattcctggtgaagatgctatgaacactgataaagaaagaaaggatttaggatatcacatcaactttgttgataaaactgtggcagggtttgaagagggttgactcctatttttgagagaagctctgttgggtgaagtatgaaccaacagcattgcatgctacagagaaatctttcatgaaaggaagagtccattgatgcagcaaactgtatcgttgtcttattttaagtaattgccaccagttacttaaactgtgactggacaagccatttaatatttctgaataatctgagtatttgccactagtcagttaagccaccacagccttcaacagccatcaccctgataagtcagcagccatctacggtgaagacccttcaccagcgaaaagattagaactggctgaaggctcagattacggttagcgttttatagcaataaattattttaaattaagatatgtgcattgtttcttagacaaaatgctattgtacacttaaccacagtatagtataacaataacttttgtatgcattggaaaacaagacatttttgtgacttgctttattaagatactgattttattgaggtggtttgcaactaaatccgcaatagttctaaggtgtgctagaacttttcttccatagtagctgagatttaagttgtctagttagtatgactaagtttttccattaatacaaatgtctatgctcatatcttcattgactatgctcattcacaccggccttctctctgtccctaggctaaaacttattctagtctcatgacctttttacctgttatttattccctccaacaagaatattttcctcccagattctgtgtaggtatttcttatccttgaggtcttagcttactgttactgtatgaaaatacttcccccaacttttctagataaaagaacacaccacagttcctgacccatggaaggcactccacaaatagtagctaatatgtttaatgttaaataataataattgaacgccttctattagtccttgcacagtaatagccacttttaacatttctaattctcaccatacaaatattaccatctctcattttgcaaatagattattcagacagattaaatggcatgcccaaaagcttgtgacagtctgtctaaatataaaatctgtgtatgattttgtttgcactatgtcaattttcattacaagaaataaaatgcacaaatgatgcagttattttgggcttaacacttcataagatagtcaggctattatgattttagattgggttatccaaacaatactatcatatttctccaaaacctttctatttatggcactggctaagccctacactcaaccaacattttaacttattcttgatttcctcatatactctagtcaacaatgacttaaaattctttttgtacttacagttatcccctaccacagaaattagctcttgagtgttgtcagtaagcaggttgtttcacataagtgaaaaagggatcagtgattatctcaaacgcactgagcatgttttatattcttgcgtgtcatccatagacaaggacagttccatgctgtctatggtggagtacaaattggaagtcagaaatggcatcttttctttgctctgagactgatcttgatgagaaagaaacttaaacttcaaggcaacttcagagaaaggaaaaaaaaagaatacactgattctctgatgcttactgttaactttaagatagaaaagaaattatagaaggtatcctgaaacaaaaacaaaaaaaaaactttttatttatgggtaaataggtgaaatgtgctagaaatcttgcccacactcttctttttatacatgagggggatgaggcagggaattaaagggaggtcaattacacatgagattacaagtgatgttattgtactgactgccactgtattttacaatgccacacataaaagttgattgatgttgatttgactctgttcaaaaaaataacttgagctaaattgtggaagagctgtgaatgaattgaaacaataaataaaatgagttcttttaatattaaaaagcttagccacggtcaagctttctaattaggtcagcataatttaaaatggactaagaaccatcccaggtggggatatcaaatatttataatcttgccccggatgctatctctgtgaccttagtggtttcagaagagcacttaatgtacccctagttcctatgagatttagatatttatgcagacaacagattaaaaagaacacgcaaaaatctcacacaaattcaagaaataatgaaggttacaattctttacgaatatttgtccttttcctttttagtcagcattaagaaatactgtcaggcttcatgtccaagttaatgtgaaatgacagattattcagttcagagcactgtgaagagctacagggtaaatgattcaatgccacctcaactatgtgtttttactgaaaaagttatcagttttgaactatatccaattctacagcatatttcagtgtaggaacatctcagtggaaacgtttagaacccagtgcaaagtcactctgaaagcatttacttagctttattgtgtttggttttaatttctctctctttgtgagatcaatttctcattagtgcaaagccgaatacttccaggggaaaacgaaggaatgtatttagttgagacaggtttttaccaaactattcgaaaagctaaaagaaaaaaaaacctctaatatatagtagaaaaaaatgttataaatacgttggtttatatctagctataaatagtgttttttcaaagtatggttcaaaggagaaacaaccattaagttttcagtagctttgtactgtcaaggaaaaaccagcttattcatgttaatacacatactgtagtaccatatgtacctaaaacagtgaaaaatcataaaaaatattttagcagtggaaataaagacagtaattgcaatccagtcaaatgaagttaattcaaaatgcaaacgcagtttgcattaaaactaataatattaaaacaaatactattaaaactaatagtagttactgtctctatctgtaactttcactccctgccacccaactgtagttagatagccagagatctcatcatgaaccttcatggggaaaaaaaaaatgtggtctgataaattaattacattaaaaaaagtgattaatcaaataccctgatgaggaaatggagaacatattaactaccatttgttgactacttattgtgttattatgatactcatttccttcctcaagtaaatttcagtctagggaaaacatttacaacagaatatgctgagtgctgggatactgaggagtagactagaagtataagaggacagaggaagagtaatgatgtgtgggtgaaaagataataactaggaatctgggaacattgcctaggtgtaatttgagtatcagcaaaacaataaaaattagagaatgataagtaatgtattagatatgagacttggaagcaggaaaagtcttacagaagtgaaggaaggctatttgcaaaaactcaagatcatgacaaaacagactcttcagagaccaagtagtgcattacgaatggaaaataggatggatatagatgtaaaaaagcagctgggattttgagatggaatcagaaaggcagaaagaggttatgattatgaggaatatcctatgtcatgctaagaagtttgggttttatcctgaatgcagtggggagcattaagtcagttagtgacatcaacctatgtcacactgtgaaggcatcaagaccaatgtgttgaaatggggagtggcctgataccaaaggcaaaggtagcagaattgcagtaacatagatgaatcctgatgagagtctcaaataaggtaggggaggtcagataaagcagtaataacataattaagcctaaggtgggaacaaagctacattaggcacccagtatactgaagaaacacctaaaattctggaaatcagacagctcctccagagccttgctagctgcaccagctctgcttatccaaatccttatcagcatagcattgccttccccattatgccaccttccattcctcacccctttacatatgagaatattaaagagaagggaagacattttttgcacactttagcgtagtgggggttgctaggctttttcttaacctaaccttcctacctccaaattcaaggaagagggaaggctcctagcactcatccccagaaattataaaaccagtattttatttcttgtttgagagtttgcctaggcaacagacttgccgattagctcttggccctgtttggacaggaagagaaaagaagtagagagagatgacaagacagagcagtggcaggaaagaaacctacacctccaccgtttagaaaggcaagagtatgcaagtttcccgtgggttggatggatggactttggagaaggtaggccagcatgaactttctaggctccatgagcaaaatggtagaggtggtagttgaaagaagtttagaaaagacagtgccagaggagtcgtctaagtcagggaactctgcagtaaggaggttccacagacatcacaggtgtgcttacaagagcgagcctttggaggcctgcctcagtcacagatggttctgtggacaaccagcttcacccagagtggcagctatgtcccagaagggaccacaacagaagttacataagtaagacgctggtcccttgcctgctcattctgtcctactttgatacacagagaaggaaaggaacctggaagcaggaggagaacaaatgtgaaaagagactttcctcctcacagctgcagggtcctgggtcccactctattgtcaatactgaactagagaagagaaagagaagagcaataaatcagagctaagctttacctttataacaactgaaagttatcaaaaagctatgggaccttcctggatgtccaaaagggatagaaaaatggatttgacagcatagttaaaggcaacggttagaaggagtaaaaccacttcatctttgttacccactgcatttagactctccagtaagtcagaaacaaggatatggatatcagagatacgtaaaacgtggaatagatccaacttcacctatttgttataagagaaaaaggaaagtaaattaaaacttttgagttagtagcctgaattatgttctgagctttaaaaaagaaatactctaggctttccttctctgggcatagtaatcgcacctataaaataaacaattgtatgatagttcttaaccttgttttcatcacagagtcccttgagaatctaagggcaactatatactgtctccacaaaaataggtacatgcacacatggaagtttccacacaaaatcctataaaatggaaaacattgaaatgagaagccaatttgagcaaaaagattgagtgtagctctatatatattaagcctgatatgcctgtgacgaataccttgtagagacagccttcagaaagaagacaagtctgtttctccattttgttttttgtttgtttgttttaatctcaagcaccttctgatatccagctgacaaaaaggcggcccccttcttattcttccattagagcctggaggttctgaaattattcggtcgcttagcacacaagtctctgcagtttcttcatgattcttgcagtgatgctgagccccaggggtggtggctcattaattaaagtaaattctgcacttaggctttcttcctcactttccaagtgctgtcatccttgtctctctgggtcacctcacttcttccttccagctaaactttatctagaagaaagaccatggtgacagcacagcctttcttgagtgtgtattgcccttagctgttaaaaaattttactgatcacgttaaagagtatgaatttctttcatttccatcatctgtaggaaacacgtgtcttatcttgttacccttgagtttcctcttctgtcagcctggattgtaggtcagagctgctactaagcatgtgatcttatgcaaagctttcttttgatatttacttcaggtcagtgtgcagtggctgaaaattcagtacaaatttgggaatccagcaggtctacttttaaaatcctcaggtttgtcagcccggtgtgcttcattttcttccttttcctgtattaaatgagtgtaataatatatgctaggtctttgtaagtgttaagataaggtatcaaaagtgccttgtacagtgcctagcaaatactaagggcttaataaatgttatcgaagtaaattattaccattgccttttttaacaaaaaaggaatttaaagtgatctggatctcaatgtcttcatctataaaatacagtgattcaagtatattcagtttgatttagtcctcatttattgagtatgcagtacttggaaaacactatgtaccagttaatgtgtcctttatgaagacaaaaagtgaaggaggttacgaattagtcaaggagacactgacgggaaaatatgtaacaaatcaaagagcctggttgaaattagggttctgccacttgctaaataaccttgaacaaggtagtaagtcatactgagccacatttttatcatcagtaaatgagaccaataatactcaactcacacagtggttagaagcattacatgaaacaaagttgggaagaaaagtagtatgatgtctgacacatgaggtgatccgtaaatgtttattattagcagaaacattttaagactttcataggtcctgggctctcttatttttttaagatctcatcctgcattatatcaaaaataataaaatgtacttatatcctataaaaaggtgctttttgctagaaaaatgtaaaaattacttttataattgactttatagttgaagggattcataactttttttttcttgagatggagtctcacccttgcccaggctagagtgcagtggctccatcttggctcactgcaacctctgccttccggttccaagtgattatcctgcctcaacctcccgagttgctgggattacaggcacctgccaccatgtccagctaatttttgtacttttagtagagacggggttttaccatgttggctaggctggtcacaaactcctgacctcaagtgacccacccacctctgcctcccaaagtgctgggattacaggcataagccactgagccagcctatgacaatggaagaattaggttgtagttggctgattgttataacgttacattgtattattttcaacactacagttattattttattgttcaagccaatagttattttttaaggtctcaaatttttatgttggcccttaaaaatgttgaaactatagtgcttaatggacaagtgctcttgtctattaaggaaaaatgtaacaaatgctatgatgaagccctgaggaagcaaaaatgaaggcaggaaaaattctatgtaaagtggattaaggatgagttcaggcagatatatttgagcagtgataaatagttaggaatctgaccactgaaaagcatgtggtcttacataactagaataatggtctccaaatagaagtctgagcaatttagagagtgagcaagagatccatgaggggaatggaagatggaagggagaaaatagtataacatacttgcttttaattctaattctaatttgaaactactgtttgttttactacatatttaatatatgagtatatttcatatagtatggtgtgtgtgtgtgtgtgtgtgtgtgtataaaatgcatatgtaacctctcaataaagcatatattgaggatgcattacaagacagttccgagatcttcccagcacagagcaggaaataattgaggttatgactatttggtgaagatattcagctcttctgctgaagagtatgttatcttgtaggcatggggagccatgaaatgtttaggaaaagagtgatcagatttgtaattttagaaattaaatcctgagataatgtgcaatttgaaggaaaggagcaaagactagagttcagaaaagtaattaagaaaaaattcaataggcttatccatggatcattttacctattcccctcccaagccaggaaaaagataaggctaactaattttgaacctccaagtgagatgtcagctcctctgagatgccttccctaactgtgctcacagcacccctgctgtgtatttcaagtagctccctgtatttccccctttccagaattgattacactacatagtaattgcgtgtttacttgtctaactcttcctttcacactgtggtacctgagggtaggaactgggtcatattcagaatcttatcccagaagccatctacagtacctggaatttagaaactactcaatgtgtagtttctatagtagtagttgatgaatctgactgaaatacttcactccttctccacttccagccattcagtgaactaattcccattagttcccattttcaagtctgtgcttagataccactttcacctgaaaggtgtgtctctgtttagcacttatctcctttaattaaaattgtatgtataattgtctttccttttaaaaagatggctatttcatctgccaaaacagggagccgacatatacgtagagtttaaagttctgttcagtgttaaattgaatatattcatgctcttctggggatattgttgtaagtcctgtggtgtgaaggagatggcctacatagtcaacccagatgacgtcatatactttcagcctctatgtagccactgtttttctcgtccaagttctctctcttctgacctggtttatggccacatccccaccctgtactcagcataaaaaaacctgccagggttctcatttcaaaggagcgaactcaatgtcctgtacagagaaaataggtagaggcaaaagcagagagtaccattatttatgaaggttttcagaatccatctgttctctggatcatgaaccctttatcaatgcactgtagcaaaaccctcagctccactccctcttctaccataaggagaatagcagctcttttcttgtgctcttcattagtagctactgacagtacagctgccatcatgcctctccaaacgttattaactcgttttcctaaaagcaaaacactattctggtctgttttatttcttttctatcttataaacataccatgctcacttttgaattctcctcctttgctcatttgttcccttttttcttaaaatcttcgtctacttcctcctccctgttcattctttcaaatctgtatcaaatcttgtccacttgtaactggactcctccagcttttattggtccttccttctgagctacactagaattatagtttgatacataattttaacattctgcaattcgcatgtgaacaattaaattgttaggactttatggacaaagattgtaccttaaaacttccttcatctcttctgccattatggcatagcacaagatatacactaagcattaatgctattcaccagacagttgtggtttttcttccacacacatagtaagattgtgtttccttgctgttctgaggtcacatgagactatttgccttgccagtgaagtgtgaatagaagtgttgtgtgctgtttttatgtgacaaatttaaaagtcacagtttgatttgggatattctatttttctctatcttggtcactggagaggtgtcagcacggatgcttaaatgaaggtgatatattgaagaactctccagctgacccccaatgggtggcatcccaaagattcaacgtcacttgctgaaggtgctgggagagccacctgcttagtgcatagcatgttttcacatttttgtgggtacatcagaggcatatacaagtatggggcacatgacctgttttgatacaggaatacaatgtgtaatcatcacatcagggcaagcactcatcatttctttgtgttgtgaacattccaattgtactccctcagttattctaaaatgtacaacaaattattgtcaactgtagttatcctgttgtgctcttaaatactagatcattcattgtatctaattatatttttgtacccattaactatcgtcatctccaccatcatcccctactcccatgctgccacagcctcaggtaactatcattctattctctagtttcatgagttcaactgctttaatttttaacctgtagcatttggatcatgagcatcagatattgggccagtttaggacagaagcaatcagagataacagagaaaacttctatggaataaatgtgaaacttctctactcctgacataagcataaccttcctattctacagtactgtaagagtactggtacacaatagtataaaaccattaggttgaaccaagtaaaattgacatttttataagataaaaatagccaaataatgaaaattttctatagttcaaccaaatagaaataagaccaggaggaaaaatgtgaaaaacctgcgagaagaaatgtgacacccttgaattagctattgagtcatatagtgtctgataataatgaaacctgcatttacctgattatacctgagaggtgatgatatactagaattcacttgttactagattataaccatattgaactaaaaataatttatccattgctaagccagaactaatgaatcaaatttgcatttacataaataacaaaggaaatttatattttataattacattccccagcttaaaagtctttttgaactcatttaagaagtagataatcgtaatagtcctatgtcttttttaaatatttaatgtgtagcttaaatctttcccacaaagaaaactttaggtgtagaactccctactggagaattctaccaaacatttaaggcaaaattaatgccaactctacaaaaactcttccagagatttgaggtggggcagatacttcccaactcattatacaaggacaacattatgcttaaacccaaactagacaaaaacattaacagaaaatacaattataggcaatatctcatgagaatcaagatgcaaaattcttagcaaaactatcttgacgaagaacaaagtgaaatgaattatttttcccgatttaaggattattagatgactacagtaatcaagactgtgtaatgctggtgcaggaatagacacataggttaacagaacaaaacagataacaaaaataaacccacataaatatgctcaactgatttttgacaaaagcaaaaaagtaattcaatggaaaaaggatagccttttggaaaatggtgctagagtgatttaatatcctgaggcaaaaacaaagacaaacaacaacaacaaacctctcaacctgtcttacatctccacaaaaattacctcaaaatgaatcagagacttaaacgtcaatgtaatattgtaaaaattttaaaaatacacacaaggaaagcataatgaactaaggttaaacaaagaattggcagatatgattccaaaagtatgatctataaaaggaaagttgatagattggtacttatcaatcaaaattaagaactcttgctctgtgaaagctcaggtaaaaaggataaaaggtaagctacggactggcagaaaatgctttcaaatcacgtacccaacaaagaactggtatctagaatatataaagtactctcaacacttatcaggaaagtaaaaataatccaattagaaaatgagcagaagatatgaagagacagcaagcacagaaaaagattttcaacatcattacaatcagaaaacaaaacaaaacaactaaaacatcacccactgctaactggtgatgatgtgtacaaagtggatcattcatacattgctggtatgaatgttaaatgatacagccaccttgaaaaacattttggctgtttcttacgaaactacatatgcaatttccatatgacacagatattatactcttgggcatttatcccagagaaattaaaacttatgttcacataaatatctgtacatcaatgcttgtagcaattttgtttgtaattataaaaaagtagaacctgcccagatgttgttcaatagctgaatggttaagcaaactatggtacatccatagcatggatcactacttagcaataaaaggaaataaactactgatacatgcaacaatttggatgagcctccaggcaggaaagtaaactgattgaaaaaaaccaatccccaaaagttatatactgttagattccactaatctaagatttttttgaaatggaaaaataatattataaatggagagaaattagcagttgccaggaattaggaagcgaatggtggtgagtatgtgggatgaagatgagtgtggttataaaaaggaaaataaagaatcggtgggttagaaatgtccaatatttttattgtggtggtagataaacccaaagtggtgaaaaatattgtataaaacttaaaatgcgcacttacacaaataagtcaaactggaaaaatctaaattaagatgaacgcgtataaaaatatcaatatgctggttgtgatattatactataattttgtaaaatattattggagaatactgaggaaagcatagaaggaatctgttttatttcttaaaactgcatgtgaccttacaattatctccaaaatgttcatttattaaataaatactttaaaaaagcaccaaaaatatagatataaacctttaaaaagatgtctaagatctatagaccaataactataaaacattgcttagagaaattgaagacctaaatagatggagttatgtcttcttcatgagttatatgactcactgaagttccaatcaaaatctcagcatgcctttttagaaactgacaagctaattcttaaattcatttggaaatgcaaaggacacagaacagccaaaacaatttgaaaaggaagagtaaagtaaaaggacttaatctatacaacttcaagagaggtcattatgctatagtattcaaaatggtgtgggtttgtcataaagacaggtaaatcaatgcagcagaacagagaatcaagaatttgacctacatatatatgccaattgatttttaacagtgatgtaaagcctgtgggaaaatacagtgttttagtttgggcagctgtaacaaattactgcagcctggttgcttacatatttatatctcatagttctggaggctgtgaagtccaggatcaggatgctaagatggttagtttctagtgaaggccctctttttggtttacagatggctattttccttctgtgtcctcacttgtcagagagcagagagagagagaaaacaatctctttcatgtctcttcttataagggcactaatctttatgaccttactaccatccaaagactccatctctaaatatcatcacattggcaattagaggcttatcatatgaatttgaggcagacataaacatccagatcatagaagttcatcatttcaaaatcaaagtatgatgcaactgagtaaccatttgcaaaataaataaatagtaagattctacttcataccacaaacaaaaagtgattcaaagtgtatcacagacataaacatcaaatttaaaactataacatttctaggaaaagaaaaacagaaatctctgtgaccttaggttaggtaaatatttctgaataaaacaaaagcacaatgcataaaataaaatcaataaattaaacttcaacatgaggaatttctgtttttggaaaaacattgagaaatgccacagactggtagaaaatagttgcatgtttcatacctaaaataagagttatttatacactgtaaaaaaaaaactctaaatcttgaaatctaatgaataaattgataaaaaagggtaaatatttgaacaattagctcaccaaagacaatatgcagatggaaaatgaacatatgaaaaattgctcaagatcattagggaaatgcaacttaaagccacaatggattctactacctacttgttatgatagctaaaataaaatagactgaccatacgaagtgctgcaagagctctcatacactgctggtaggaatgtaaagtggtacaaccacttggaaagattatgtcagcttcttaaaaaggtaaacgtaagcataaagaagttgatctagtcattgcaatcttaaatatttacccaaaagaaatgaaagcatatatccatagaagacttgtgcacaaatgttcatggtatctttattttttatagccctaagctgagagcaacccaaacatccatcaacaggtaaatggataaacaaattatggtatatacacacaatggaatgaatactactcagcaataaaaggaagtgaattactgataattggagccccagggctgaatctcaatttaattatgccaagtgaaataaactagagtaaaagtatgtaatgtattattctgtttatagaaaattctagaaaaatgcaaactagaaaaatgcaaactaacttatcgtgatgggaaacagatcagtagttgcctaggacaacgatggggttagaaggggctgggggaatgcaagggaacacagggatgcttctgagggtgatgcatatgtttattatcttcactatggtaatggttttatgactacagacatacaggaaaacttttcaaagcatacactttaaacatgtgcgattatatgcctataataactcagtaaagttgttgaaaaatgttaatagcttcccattgcccttaaaattaagaacaaatgattttcacaggatactatgttctacagggtctccccctcgcctacctctccagtctcatcttttgcccctccctgaccatctctctgttgccatcaggattggccatttcttcaaggttttcttgtccttccgacctcaggatctttgcaaatgcaagtccccctgctttcccacactgaaggataagctcaaatcaatcacccttcagttctcagctcaaatattaccccctaagaagagacttaactacttccgtaaatagctcaggtttctgtgttatttcctggcactctctactatttcctttttaacatttatcacacatttcacttatattttcagtaaaatttaatgtatatcacatgccactacagtacatttacatatattatgtaatcaatacttttaaagaactagatattatgacagttttacatttaggaaggagattaagaaactttgcttaagatcacacatagagtagtcagtgtcagtaatttgaacacagccctatcctgctttaaaacatagggtcttaattaatgattaattaaatgattctatgatataatgtccaccctgatatgataccaaaaagaaatctgatctgctgaaagcggatgtatgccaaggaatgcaagtggcttccagaagctgaaagcagtatccagctgacagacagcaagggaacagggacacatacaagacaaattctgccaacaggcatgaacttggaagcagcttcctctcctgagcgtccagagaggagccctgcctggccaacaccttttgagactgtaagcagaaaatccaattaagcccacccccccagacttctaaccaaaagaataaatgtatgtttagttcattaatagctatttgttatgcagcagtggaaaactattacttttctattttctaaagtgcttacatatgatatatagggatcatttacaaattatatttcttattaataagttgatacagtatggctctgtatccccacctaaatctcatctacattgtaatccctacatgttgaagaagggacccagtgggaggtcattgtatcatgggggtggtttcccccatgctggtctcatgatttgtagtgagttctcatgaggactgatggttttatatggggctcttcccaccttggcgctctctctcctgccgccatgtgaagaaggacatgtttgcttcccttttctccatgattagaagtttcttgaggcctccccattcatgaagactgtgagtcaattaaacctctttacttcataaattacccagtctcaggtacgtctttataccagtgtgaaaattgtctcatacataagtcatgggctcaatcaagtcattttaacttttggggggttttgttgcttgatctgtaaaatgaagttttactggataagttctactctctcaacttccctaagtctaagaattcatttctagctttttgcaactattgtgacacaccctgatcaggtatcctccattctcctctccagattcattctccacccttcagtactctgcagtataccccaagagactgacccctaagaactacatcagtgggctcccttgtccctgagaatggggcagcagaagtgataaagaagagcgaggtctcggtatttatttcctggcttcctacaagtacacaatacattaaggggaaaaatgattcctaacttcacttgtgaatttttggaagcagaggaaggacacgtaatggactgaactgtgtcctcccaaaatgcatatgttgaagccctaaccctcaatttaaatgtatttgagggagggcttctaagaagtaattaaagttaaatgtgttcataagtataggctcccaatccaatagaactggtgatgttttagaagaggaagagaaacctctctctctctgccacacatgtgcactgaggaaaggccacgtgagcacacggtgagaaggcagcaatctgcaagccaggaagacagacagcccttacccaaacccaaccattcttgcacctgattttggactgtccagtcttcagaattgtgaggaaataaatttctgttgttaaacaacgtaatctagaaatcaaagatcactaaataatatcgcaatgggtaaacagacggtacttccaggcaagcagtctatttgtaaaggtttaaactaagttgtgtagtatctgacaagtaagccaaacatagatatggagagtccaggctgggcagggtggctcatgcctgtaatcccagcactttgggaggccaagacaggtacattctttgagtctaggagtttgagaccatcatgggcaacatggcaaagcccatctctacaaataaataagtaactaaatacaaaaattagccaggcatggtggtgcatgcctgtagtcccagtctttactcaggaggctgaggtgggagaatctcttgatcccagaaggttgaggctgcactgagccatgactgtaccactgcattccagcctgggtgacagagcaagaccttgtctcaaaaataaataaaaatataatgaaataacaaatatagggtccagaaaatggccccgaaatcaagataggcaaaataagtcaataataaattcctacaagataggggtaatcacagtgatgtcctacatgaactgggctactggacagactaacaaagcagagactgagtaactaggtgcaaggtgagaagcaagacatctccagggctagatagaaacttatggagaagtctagagaccaggacataagtgtgacttgatcttgaatgcaagaatgctgatttaaatttccaaaatctctcccagcccctgaaaaccttcacctcactgctcccttcactccctttcttcaagtcaaagactgtctgagcagaattaatccccatatatgaaaattctataatgtagaagccacatggtaatagcagaggaatgaagacaaaggggctgtattgtaaggaagtattaattcaatattaaattatctaagtaattacgtgtgcaataaccagacattgtaatgtaaatcacattatctaatctgtatttttgtgaagttaaaaaaaatgagctcagctggtaagcatttgcaatttgaatcagtagacagaattttggagaaatgacactgccacttaacagacaaaaaacattgtggaattttttttccatttgtgtgtgtcttctattacctctttcagcagtgttttatagttctccttatagagatctgtcacctccttagttacatatagtcctaggtattttaatttttttgcagctattgtaaatgggattatgttcttcatttcactcttgcttgttgtgtatagaaatgctgttgagttttgtacatcgattttgtatcctgtaactttattgtagttgtttatcagttccaggagtcatttggcagtctttagggttttctaggtatagaatcagattgtcagcaaagctggaaaaatcagtattaaaatggccatacttcccaaaacaatctacaattcaacgctattcctatcaagctgccaacggtttttttttttcgtgtaactagaaaaacttattctaaaattcatatggaaccataaaatagaccaaataaccaaagcatttctaagcagaaagtagaaagcgggaggcatcatattacagggcttcaaactatagtataaggttacagtaaactaaaacagcatggtactagtacaaagacagacacatagaccaatgggactgaatagagaaaccagaaagaaagctccacacctacagtcatcttaccaaagttgacaaaaataagtaatgaggaaaggacttcttggtcaataaatggtgttgggatcgctgacaagtcatatgcaaaagaatgaaactggacccctacctctcaccatatacaataattaactaaaaatggattaaaaatgtaaatgtaagacctcaaagtataagaatcctagaagaaaaactaggaaacatcattctggacattggccttgggacatttgtgactaagtcctcaaaaacaattgtaaccacagcaaaaaacattgacaagtgtgacctaattaaactaaagagcttctgcagagcaaaagaaaactatcaatatagtaaataccctgcagaatgggagaaaatattctcaaactacgcacacaacaaaggtctaatatccagaatctatgaggaacataaacaattgaacaactgaaaaacagctccattaaaagagcaaaagacatgaacagacacttcttacaggaagacatacaagaggccagccaggtgcagtggctcactcctgtaatcctagcactttgggaggccacggtgggcaaatcacttgaagccaggagttcaagaccagactgaccaacatggtgaaaccatatctctacaaaacatacaaaaattagccgggtgtagcgggccacagggggcgaggagagacctgaggcaggaggatcccttgcatcccccagaggttgaggctgcagcgagctgtgattgcaccactgtactccagtctgggtgacagagtgagactctgtcttaaaacaacaacaagaacaaaacagacaagaggccaacaaacatacgaaaaaatgatccacattactaattgtcagagaaatgcaaatcaaagccataatgagacaccatctcacaccagtcaaaatggctatcattaacaagacaaaaacaacagatgctggtgaggctgtggagaagagggaatgtttacatactgttggtgggaatgtaaactagttcagccactatggaaagcaatttggagattcctcagagaacttaaactgctattcaacccaacaatcccattactggttatacatccaaaagaaaataaatagttctaccaaaatgaaatactcatatgttcattgtagcactagtcacaataatgaagacatcgactcaacctatgtgcccatcaatggtgaattatataaagaaaatgtggtacatacacactgtggaatactagccagccataaaaatgaacgagatcttgtcctttgtaacaacatggatgcaactggaggccattatccaaagtgaattaacacggcaacagaaaaccagtgccacatgttctcactcttaagtgggaggtaaacaatggaactcatggacattaaaatggcaacaataaaaactgaagactactagaggagagagggagaaagtggggcaagagttgaaaaactaactattgggtactgtgctctaccctgggtgacaggatcaatcaatccgaaacctcatcatcatgcaatatacccacccaggtaacaaacctgcccatgtatcccctggatctaaaataaaagttaaaattataaaataaataagttgaattaaaaaaaaaaaaaaaaaccttgtggtactcaaaattctgcatgcccaagtggatcaggggccgaaagtacagggcattcataaactgtctttaatagtttatgttaaatgttgcctcctgtcagtaagaaagcactcctcttaaatcaaaaactataatactgccagtgtctgtgacacatttatttctttaaaggaagtaaacttttaagccaaacttcttacctgctagatgagaattcacccaagtcagtaaaatccacataatttcaagatattaacaatcagcacaaattaatgtcaaccatctgtaattcttacaagaggatgcttgtttgtttacaaagagtataatttttgctttctaatacattgttttgtagcataggtatctttggggttgaaatggaataaataacatttcattttcatagaaaatgaacactatataatgaatagaacttttcattgacaatcttgaatgcattacattactcttaagggcattgtgtttttcaaatgttttaagctagcatctctcctagacttaaatgacaaaatgaagttcaccatttctagtttgactttttttctaaatttgtcttccttcttacacatcataaatcaagtttgatccatattggaaaccatatgttttcaaactgatatctttattaatgaaaatatgtaagtataaattcctgggcagtttttttcagcagcctagaatctaatatcaattgttacgaagttcaatgctctaaataaccatgagctccagttaattgacaagattgaatacacattttaaaataacataaagaatgttgactaaacatttagtcattatttctaaatcttaaatagtttaatattatcatactgccatggaataaattgtccttagaatcaggaggatccaattttaggattttaggattttaaagttcacaggggctactggttcttacccaaagctagtggcatattcactaaaaccacaacagccgtgtctattatgtttcaggttgccggagtaggtcgatgcactggtgaaataataggttatatttctggagcatagaagggagaaaaggacaaaagtactaattaaatttgaaatctgtataatcctggaataaatacacaggagaatacgttaattccaaatgtcagcctcattttcactgaacttctaaaaatttttaacaacgctttaatttttcaccttcatatgaaagtgaaggtccagttttaacaaaggtcttgaaagagcccaaatgcaaacttagatatcatattcttatgtttagaaagtgcagtgcaagcagcccaggtatcaggttgcattttcatactcttgctactctggtggcaacgcagaataactgccataaatcatctcttggctgtatacaattaattttgtgttctgtacttatactcctctatgtttttatgctgttttttttttttatatatgacttttgaggtcactcttggttttaggtgaaatactcaagcttaatattaaaatatcactgggtgatattgtagtaacaagttctaataaccaaactcagggtcaccccttctgcaagttttaaaattaactgtcaaaaaatgtcaaaagaaaaatatcttgttactccttaacctttttgaatataagaagatttaagtaagcttattatacttcttgaagggtaaaatatttctactatcactgcatattttcacagtgatcctttatcttacttattatcaccctagaaatggttttagacttcatcattggttcttactatttagctgattgcagtaaaacagaaaaaaaaactgtttttaaataattttcagaatagctattcttccagacgggagtctacggatcctaaatgcttccaaatcagacgagggaaagtacgtttgccgaggggaaaacgtctttggttctgctgaaattatagcttcgctatctgtaaaaggtaagacagcacgggtaaatgttttacaagcatagtctcatggtcttatcggaaagagaataaatataatataaatgcatatatgtttggacttaagtgtgtgcatgcttgtgtttataaaatacattgcaaacatagaactaaaacagccacattgttactttccaccatttagggtaccaaaaatgaaggaacctcttattggcagaaattttattttgctttgaataaaatttgtgagagaatgaggcaagctttctgaagttttagtcagtgtctcaaaacttgaaagtatgccaacggtataaaaatatttttcctctaccaagaataattttagcatcaatcactaatattactctgttatcacttcaactagggatttggggcagaaaggagcagcagcaggaggatatgatggaggggtggtataggacttcgcattagataaactggctccagagctgtttgttgatgtctgtatcaatgaaatttttatatgcctttattttatataagcaatattaatattactgcttatatgtttccattcattttatcgttctaaaatgagctcgatttcaagcctagaacattctgttgaggctctatgtcattgtttagtgacagaaaacctatcttaggcagtcccttcagatgtttttcacattgagtctttaattgttttcactgtgcatgtatcatatggcaaaccatactccggccataaaaatataaaaatattattttttctgtctttaaaataaaaatgtaattaatacatttacattactggtactaaaataccagtactctgatattttagaagagagaacatcaagaaagaaaagaacaaaatgtaaaatatactttcatttatataatgcattactggactcaaacgcagcctttcagttcttattccttctgtgtgctagttgttccattttgtaataaggcaatgctagatccaaagacatttttaaaataacaacaaaaatgttattttcttaatcatgagtttaattgtttactcagaacactccaatccccacaaaatttaaactacagtgtactgcttttatctgtcttctctgatgaggccagaacttagaatgccatatggaacatttgacttccagaatgttaatatttacagtgacattcctgtcccaggattccatttttttctcagtgactgcatagaaggacatggaacattaaaggatctgatcagtggttaggagtggtgtttcatcagactgcactgtcgcaaacaatagacctagaataggaaatttaagccaattgttaatcactgtgttaattgtcttgaggtatctatgaccaggaatctaactaggaaagaagataaaaccaaaatcttcatcacctctctactatatttaaaacacatcatcttgtaatcagctaatcactaacttaactcttaaatgtaaagcctgttttagcctttattggttcaaagttgctctaaacccagtaaaaaagtgtgtttttaaaatttaactgaatcattaaggagttaaacataaacattgttttctaaaaacatttccattcagtgtttctacctttctttatatatgccaattaagccatctacaatacagcaaaggtacaaaaacaggtacgttcttctgattaaaaaatacttttctactcctaaaagctttttgtcgagtgtaaagcaaatacaaggtagtgttgttgtagtattatatttttatctctgttaagatagttatttggagggaggtgctttctattgccctgtagcctcctctcatctttaagcaagtgaaccctctctgaattcttcctgaaacacataacctttttattgtaaaaaatcttttatttacttaatgatccttgaaagtggtcagagaggctacagcctcttctttttttctaatgttcctccttccataatgtcaaatgctgcttctaattaggtagtctcttgtctttttaaaatccaagtcacattcttaataggaacagaggctcttaaatcatttctcccctacaaaaacatggtaatatgccctagcatccaaaagctaataaagatgtaaaaaagctggtatatgtatctggagcaactgtattgtatagatttcttcttttctcaattatttcaagcaaaatattatgtatggtaacacaacaggttgattatcttaattaacgtatttttatttctatagaacctacaaggatagaacttactcctaaaagaacagaattgacagtgggagaaagcattgtccttaattgcaaagcaattcacgatgctagtttggatgtcactttctactggactctgaaaggacagcctattgatttcgaggaagagggtggacattttgaaagcatcagggccgtaagtgaatacacttttattcttttagtaatgataactttagaaattttgaatcaaatgtaagaccttgcttagctatgaagtgctaagaaaaaaaaaaacagaacatcgacttgataaaaacaattactttctgccattattttatgttatgtcaaactgaaagtaatatgtaattattttaaaacccccagtaaaaaactgagaatacctcattatttaaatctggtttctttgccacctttgtttaatatttacacaatacttctcaaaagttatgttgctacataaagtggcaattcattatttaaagcatcgttaacagtaattatgataaaataaataaataaaatgcctgcctgtccttctcctcaagaacagtaatttttggagtttctttaattttttacaagctatagagcttaaacatacaactcgtagtcataaatgcacattagccttaagtcagtattcaaagatatactcatttctgccatttttttcttaatatcttcttttatattgtgtacctacatggcaatcaaccaaatggagtgggaaatctcttgaaccaaatcctacagaaccatcacagtgctttaactctagagaagtgaaaagaggccccttccccacatggacttatttaaaatgtaatagagtaacataatgagagagggaggagaaagacagatggaactggggtggcagaaaaagagcgactttggctggaatcttccttctatattggctaaagagatggagccaaatacaatttttgcctacaaattggatttaaaatgctgttgcatacttattagtatcagttgatccatcctgaaacactttgagaagcattggaaaaccatagctttagtgagcccaagtatttaaactcagtgtcaattggattttattttaaaggttatgggatacaaggaaaaaaaaaaaaaagccctaaatccaaagtcaggaattctctggatcaaatcccagcttaatctctagtcagctgtgtaacataaagccagtcacatgatttgcctgggcattaatttctggagaaatcaaagtgaaaaagttacaccagataatttctaagatagcttctcaccttagaatttggtaaatgtatattagtggaagagtaaagatgagctctctttgttgcattttccaatgtaacaaaaattagcccactttcttcaaaactattcctttcttcctggtttactatccaattaataggagagagtatataaataagaaacaattgccaactacattgttcaccatctcattaaatgagcgaattttaactgttaatatccaagttatatgtaaagtatttagagtgtgttaaattaaacacattttgctctgctttatggttttccttcttcctttaccttgggtgataattccttcctacaatacttttcctacacattttataacatggatgttgtaaaacagaccaagaaaatttaattttaaaatatcacattttgattaaaaaatcccatgagaaaaatatcttcttaggattgtctgcaaacatcccttttgagtgatcacatatctaaagaaaaaatacatctaaaaataaatagcccctcttcttataagtaatccctctctttattttacaataccaatataaaaatgaatgtacctggtgaagttacatgaattattgtttttgtctcttagacatagatatgtttaggttgatgtcattcatttgtatcaataaatacctttttttccatgaagttggcagttaagaacatctgctgtattcttctttgcatatatgctttccttgccccagagagtgccaaatggactccttattccacgcaaacccatataattacaacccactttgaaattaggctctggattagagacagtaacaataaactctgagatagaagaagaaagcaaatcatggtactgagaagggagaaaaacatttagctttaaggtataaagccaaaatatacttttagtatgcatatgtattttaaaacatatggaagcttcaaaactatggcatgtataagaaattatctatcacctttctctcagttacttcaaacactgagtcttggttggcttcaaggacacacaccagagaaaataccattgtatgacaataaaaaggcaaagaatggaaagaacaacattctgtttcccttctgcccttctcatgtaaattatgtctggaaaataatgctttaggagaaaacatataaaagtgttataaaggcagatttgggaggccttctgggcttgtggataccttctttctgtgagaccaaggacagactgtgggagtcagagggacaggatggggctgagaagagagccaagtggggtgactcaaggtctgctttgagtttccaagaagagtcattaaaggatctcctaaggtgtctaacttatcccagcagagtaaaaaaatgaaaatgggattccgggacttaagcaggaatagagtgtgcctatgattggagcactgtccaggctaactgtcctgggacagaaccctgccagtgggtgagtgaatgagggtgaatcagaagaaaaacacattaccactgcatgaggtaacttaaactaactaaacctctcaggtgggaaaaagagataacaatattttgtattattttgtagatgccaaaatatgacttaatgatgttccctatttttcaactgttgtactggtatcttttatacacagacattagcttgcatataaatctctagtcaattattttatgtagccttcatatacaatctatatacaatgtacattgtatacatccacatctatatacaatgcacatttttatgttttaaaatagatgattgctttgaactccatttcaacagagtgcataaacatatgatcacatcaggctaaaaaataatagtattgctttaaattaaaaattaagtttaaattaaaacattcataatgaaaatgcttctactatttatgttgccctcttaggccatgttttacaaactcagcaatttgactaatttggagtgaatccattattggaagtcactgttgaaaggggagaagcaatcagttagtacataaacatttgatccaattcatccaaatccttttttttggcaaattttatgaataaactgaatgtgataagctagtgagtatattcttaagattttaaatctttttagttctacaagctaaatgctgttgggggatggggatccaaaataaaaggcatagcccttcacacctaagagagcaccatttaagggtagaaattgcagtatgggctatgatctgctataataaagctacaccagagaactatgtgcattcagctgtttgttagaaggggttggtatttgaaatggacctggcctcagatccattcaaatggaaggatttcagcaggtgcataggagaagctgcatctcagacagagcgagcacgttgggcaaacaaagaagggcagaagagcttagtgcgtgttttgggaacagtgaggaaccagtgagggtgtatagtagacaataagtcactgtttgttgaataagtttaaaggaaagcagcagaggcctcaaaggcactgatttcggagctataaaatttgatttgtattttgagtacagcagggattcacatgattcagatttgtttttaggaagataattctgacagctgtgtggagcagggattggctagtttgtggattttacattcagtgtagacctgttaagtagaggttataataaggagataatcgttgtaagtgttgaccttaaataaccatcctgtaaccaaataaaagcatttactatggtgtcctgacttgagagtttatgttggtcagaggtctacaagaacctctgattcctctcaggatatctgaatagcatctgagctattgagcattgccatgtggccccagagccacagtcttaatggaggactgtgctgagccactgttttccagtgacttgaagtcctctaattattcaaataggatataagaaagtttctatccttataatgcataaagaagtgttacactgaatatcatggtggcctgcaatttgctgcttttttaacacagaaaaatatctcacgcatttgttgtcagaatggtccactagagaagaattgccctttcattgtgaacttgataaattgcaaccaaataggcaactgagccaaagtgctatatagctgtatggtccttcacatttacccaattctctggttatagcaatacatgtaggaaggcagaatgggaattttgagcccatttttttaatgaggaaactgaagaataagacttttccaggccacataaattggggtaataagattcaatatcatgtgatttttaaactacacatttgttcactctcctttataaaccctctccatattcactgaccacttcttatgtgttaagcctttgtctataaactgtgagaaataaaaataaaaggaaggtttgaatccagtcttcagtaaacataaagataatgcaagacattaagcaattcaagaaaaatatgaccataaaaacaattactaactaacttttaaaatcacagccaaattttgttgaagactagaaagagattaatgtgatattttgtcattgtggagaaaagcaaaataaataattgaacacctatgtgccaagcactgagctaagatagatggatactgtatgtatgtctgtctagacacacacacacacacacaatagctcactgattcctcttaacagccatatgaagtaatgttatttggggaaaacatgctacctgacctagacctcagtgagtagcattagaatagtcaaagaagaaaaaggaaggcaacctaaggtgagaaaagatattgttatcttagggttgtgctggatcttagagattattgagtttggcctaggctggtaccggaagtctctttcagtatcactagtgtatgtcctaaccctttaagtgatgaggactcactcctctaaagttcgtttcattatcagtcacttctgaatgtcagaagattggaaagtaggagtaattatgatcacctgtatgccaagcatgagactcataaggaaacatgcctgattcatatgcagaatttttgtggaatattaggtgaatagaaagacagaatataaaccccttagtgccttgagaattttatattagctggaaaactctagcctatattaattttcttattacagacacttctactcctagtttatcttcttcagaattagctatttcctaaggagtaaaagtctctgaatagaacatagtaagtgctcaattggcaacattctgtttcctgattgataaatattaattgtgtaaaaatcaatggaatgcttgggtatactgccagtttactaaggcacaaagctgtaagcgtttcataagcaaatgcttcatcctcttcttcatcaacttggcatgcgaagtcctggagccatttcaccactaaacaggaagtgtatcaaagggcggaagatctaacaaaggctcacagtctcttagactcattatgtttgctagtagcattcacactttcatgtaaatggtcccatggactccgagcgctaccctttccctatctcactaagggcctatcctttctcatcagttcagatcctacctcttggttctttggcctgctctgaacgctggcaacctagtaatccacccattttctattccaacctcctgaccgccacatatttgctatattactgttccctcccaatctttcacctaacttaaaaaattgtgtaattttaataggacagaaacatacagtaaccatcaaccaaaacttggggaccctcacgaagaaagattaccttcaaaggttttagaatattcagactatcccagaaaagtgcaccatattcattctccctgacttgtatgtgctaaaaaatgtgtctccactcactgtcttctcaaagtagaaatcattccgaaagcaaataagaatgtccatcttttttttggtattatatatgtttgtttcatatagtttatgaatatgatcaatatatgccatttaattatgttattctataatatttcatgtattgatgataaactgcagggatcctaaaagcaagggctaataagtaattttatttttcatcactttgtactaagaatgtccataaaacagccattcagctagccaatgctgtttcaataaaaacaaaacctgatataaagcgttttctctgcttagccaactgctacattatttcagaggttttaatataattaaatactgcataaaattctgttaaaatctgttttcataacagaatagtttgtttccttgcttttttactttttacacaaaatggaatatcacgttagcacagtttggaattgaatgaaagatgactgccttgatgacacctaagacagtctgttattgggagacccttacttcctatgggtcacagggcagtcagtactggaaagtagtgctgtattgattgcccatctccactttactctaattagcagatttttcacacatagcaaaatgtgaagtgcgtctcttcactttctgtagattgtcaaaattagtaaaattaggtaacgtcttcaagttgtcccatataaaaagacaggcttagccatccaattcataggctgaactttgttcatctaaatataatctaccaaaacaaacttcctatattgtcgtaggtatacagagcatttttattaatttggaagttccatttttgatagctgttttatctttatgacaggtctcataacattatgtgtgctatgaatagttactagtatccttgcaaatttttattttggtgtagaactgcaggtctttgttattattgtcagagagagaatataaagctctctgatagagaaaggcaatttttgtcgggggcatgcttggaaatattagatcaataccttggattctgtaatctctgaggggataagagtaccgtaattcccagagccagctaggatattttaggttattggatagaaaaaaaattgaagaatgagaaatagaagacactccttactccttagaatttgctctcctaggttgtaaatttcaaaagttaaatatgcttctagctcagtaactccagaaacttaaaaaatgcttacaggtatctaggactgtatatgttttctctttctgaggttttgtgtttttccaatgttgtttttccatttcatacctatataaactcagactagtttttaataatcctatattctcactgagttgattgtttttaatccaacaaaaacatgaatttatctggaatgaagtgcctattattgggaaatgtgatcactggtaggccacagtgggttgttgcattcactgttgttaactttgacagtaaagtcaatccgatttatttcagtgatgtttattaaaccaaattctcacctaactccaagttacttttgacaatgacttacttagacataacagtctttctgatatacataacaaacttctcatgcaaatttctattgattatcctgtaattgtacattgaagagcaatcaatggctcctggctttaaaaccattttccctttccaatctgacagaaacttcagaaggcaaaaaaaaaaagtcttaattatatacatgctattaaaagcttagaatgagtgaataaccaaataaatgaatattatcaaaaccattctttataacattatcactttccacttgtatcaaatgttcaagttactgaaatgagtacctaaattatctttggtgcctaataaccatcttttctcagtattcaactttacacataatcggtactttcttttatttatatcttaagggactgctgttcacatcttgataatttttcaatatatctctacctccctcctgttttcctttacttgtctttcactattcatattactcgtgagcctattccaatgaattgaaattggaaggataactaatgtgtcaactttaactgaagataccataagccagtgtagtagatactgtggtgtgttgcccaggttctcccttcaagactgaaccactccttccccaagctatggagaatattgggggctgacagctctcagcagtgttccgctctgggaattgccttcagtcaaagagagttatctggttcaagctgtgctccaccccaatctcatgctcaatgcatagagatgattagtgtacaggggtgattataaagaccagacccctggcctcagctccagaattacatctctcacctgttgaatgcctaatagatacctggcaatatgctagacttttcaaatattatttcatttacttccctcaaatacgctatggtatagaaattgtgttattgttgttgtcattgttgtttgacaaaacaagaaaaagaaatttagaaagataaacaactttcccaaacttaaacaactgttggatacaagagttatccaaactaggactgaactccaatacattatcatttatcagatctagggcatatctagaactatttagcaagatcacatttttaatttcctacttagtaaacttagtaatatcttgtgaaaaatgtaattatccttcatccattttagaatttgtgagtcaattatttccattgccggtaacattttcatgtattcttctaatattactcattcttatgaagtttatattatgattatgtggttacatttacactatatgagatccaattttcaagtatttatacatttcactatcatgggcaatctcctgcccctttgccagaaaacatatttctattaaatatagatatatatttatatttatatatttatattaaaagcagccgtataagtcagattattaaaaccttaattgtttgttttataataagtttgaaacagtttcattgtctgagtaagacctaagctaaaacatttaaatagaattttacatttttaacagccctttttacccttcttccctcataggtattatttcattggattcctgtaactacactgttagtcagccaagttatatataaatgagaacactgagccccaggaaggaagacaagtaaaggtcctccctaatgaagacctgagcaacacaggcccatttacgcaacagcccccatcatcacttgggcttccttgaacttaaaacttcattgccatgaacgatgttccaaatctgatttgctgttgtaaagcacagagagaactaaaactagctgtaactcttcattgtgtcttttaacactgagatgataaaaaagatggtgttattctctgaagtcttacctctttagctgggtaactacatctgttactactatacttacttgatcactattaaaacattaaaattaaaattatgttcagtaagataaaatcatcaaattgtttaaaattctcccataaaagttactgagaattatttgaaaaacatcttaaaatatcctactacacttgcctcttcagatgttctgtgggtgtgttttcccattaattaaagctcattcttctggctgctgcaattgtttcattttatggtatgtgaacccatttttatcaacatccctttttaggctttgaagcttctctcaaaatggatatgagatgcagtatgttacattgctttaacaactgaagtggatgcaaagaatgtagagtacaaaggtctcaatcattcttctgaagaaaataattggtatccacattttggacattaaaatcatacctgttcttaataagtatgcatttacagcattgttttatgcagttttggccaccaaaatccagttttcaagtcaggtatctggcagtgtctcagattcttttctttactcccatatatccatcaaattttcaaatattactaattccattttgaatctgttgattccttttctccattcctggagtcaaagtcctattcccagcacttatttctagtgctgtcatctcaccaccttttacactataatgactatcattaccatgtttctaacaagccgagtttatcatactgcccctccccatcccatccaattacataaatgtgcacgtacacacacacacacacacacacacacacacactgcccctatcttggatctaactccagcctacatatcaaacttcatcttccaacatttttctcttattattttacagcaaagcataataattctctgaaaatatcatgttctcacatgctgacccactgccaagaatactcttccctgacttgtaagctttgcaaactgcagcatttgcctccaggcaacttgaagtcctttcccagtgcttccattataccttacagatcccgccaccaggatctatgctgctttaaacatttgctcagttttttttcctcttctagtctttatgtttctgaaagttagttaggaacatacttatttgctgggcttaacacagtacctggtgcacagtaaagaccaaataaatatttgtagtcattaaaggaatcagtagacataggagtatatgaactaaaaactagccatttagagtagctcaccaagaaacaaacattgactaatatatatatatatatatatatatatatatatatatatatatatataattataggcagacagatagatatatcgctctctatatagatatctatatatctctcattgatctatatggagagatgatatatagatatctatagatctatagatatagatctgtaaatatagatacacatgaaaagaaagagagaagagagacaggctctcactctgtcgcctaggctaaagtacagtagtacaatctcagctcactatagcccccacctcccagactcaagccatcctcccacctcagcctccagttaaagagttttagttaacagaggaagtttctaacttctgttgtaattatagaatattatcagtgataaacatgtttattcattttacttcacataaaaatttaagtatttttaatgttgtcctaaaagtaattattttctctggagataataatcacaggagttgctcataaaagagaaaaatacaatggattctagttttcatgttgaagaaatactgatatgttttataagcattgcattattttaaggagaatgccctacatatatgtatgtatctaggagatataatttaacctggagaatgatgaaatgcgtaatataataaggccctgaatactggaatttttaccttgtaggaataatatatgaaaaagatttttctttttagttttttgaaagccttcttagataaaagattgttcctattatttaataccacataaggtttaggatttatataagcaaacagttcagttttacattttgaaatactattgatatgtaagtattgtgtttttagattgactcctatgttatttctcaaagtgattttcaaagagttgggtttttgagaggccattatttctaagacatctttaaaattctaccttcattttgcaatttctctttcggcatctgttttgtattaaattctaaagggtgactaagtgttatgatatatttagttttcagcttttcagaatcctctagtttctttcatggactatttttatcatattacagcacaaaaatcagctttaggagtctagaattaataataggtagcatctcaaatatgttttctctctcagaaaaggaggaagaggaaattttagaaaagactattggactattattcacttcctttttccatctggtatccattatataagagacctggaaaaggtcactttaaagaatttgagaagcatgacaccattttatttaatgaataattgaagcctctattgagcatttatcagtgtacaatacaatcagccttctgtctcacgggttctgtatccatggattcaaccaatgtggatagaaaacactttaaaatcaataagagcatacaacaaaaaatacagtacagtataacaactatttacctagcatttatattatattagatattataactaatctagagataatttaaagtatactgtagagtatgcattaggttatatgcaaatactacactatttcatataagggacttgagcaagcatgcattgtgctatgctgtcctgaaaccagtcttccatggatacagaaggcaactatacataagttcttattttatctcagttccatggaaataagtggagcattcacacactaggcactattcaggagctgaggattctgtattaatcaataacaaacattatatgggaggtatacgaatacaactgaagtaaagcactgtctttgagggtcagtcttacagaggaacatacatatagagatatggcaattgtaatgaaggaagtatgttcaggaagctgagtcaaaggtacacatcatccaacccgtggaagcagggcagacttcctaaaccaaatgttacctgtgcctactcttaaaacagagtaagttttgcagacaaagcagagagaggaagtacaaaagaaaaagactttacaggtagagggtgagcatgatgaaatatgggagatactgaagttttgtctactaaatcccaataataaataatgatcttatagttaaacttcatttaatatattactatagtaattctgtattaaagagggcttctcaaattccctatgagagttaagtaaatgaccatgattattcttggtttcaattatagcaaggtacatatacatagcaaaagtaaagttgccagatttttccaaattaaatccagggataaactatatcttgcttaacataagtatacgtgttttacataaatttagatgttgcttgaagctttctgtggtatagataaaatagaaattattacaactgtaacactcaatttttagggtcattgagataattccctgaggactgtatgattttttttcgtgaggctgcttgttattctaaaggcagttctaagaataaatgtacttcgggaaaacagggactaatatcagaacttctgcttcctttcacatttattctcatactaaacaataaatttttttaggacagggattatatctattttgccaaccactgccagcacctggcatcatgcctggcagatatatttgctaaacaaaatatatattaaataaaatgtttaattattatataaacaaatagaattgtatatccttatatatcagcacttttttatatccttattatctgctgaactacccaaccaaaaaataaaaatatatcaatgtcaggaaaaatgtgataactttgttcactttgcaaacacttaatggttacctgtaatgtgtacagcattaaccagagtatggttgaataagaccaggccagtgtcacccttttacatagagctgtttgtctattaacagatagatggacctttaaacaactatttaacatgataagctttatagtattcagatattatactgatgagagaaataaactcgaggagaaatttgacttaataaataggtatgtcattagcagaaaagcttgttcttacaattaatgtttaattgaattcaactaagctcattactaaaggttgttcaaccaactagcataagctaaggtaataatctgactgataatttttgaattaccttaaaatcaactctttttctttatataccttacacattctataaaaccaaagaatttactattttcaggcaaaattagataaaataatttagattgctttaccagtgaagatataacattactaacttgttcaaagacatcttaagaagcctcactaaaactaaaaaatactgcattttatcctttctaactactgatagccccataaataaatatattatatttacaaaatttgttttaaagtacctattaaatatagtgatagtatttcctaaaagcatttttgaaacctgtacttcaattgccattatttatcatttgcaagaaaagttaaatacttatggctttccccaaaataagggaccctgtgacatgctttgctcactgagctcgtcacatcactaatcattccaacagtctgctatggtgtctctggtgtttaaaattactgtagctctaccatgttaaactgcaaacatttcaatatcatatgacaatatcaaatgcttccatttgctttgtaaaataatcaggcaggagaatttaaagttcatttttgttgctaactttttttgggttttgcccacattgctgtttccaaccacatttagtctcataccaaaattctgactggaataactcattagtctgtctcatttttatattttaggcattgagatttaaatatttttagaggaaaaaactacatttaagtatcaatgaataccttttgctcatctgctgtaactataggaaaggaaataagaagttgttatcctaaatatatagaggtaagaattaaatatggtctctatcaattttcactacaaaataaaccttgcaaaaacctagtggcttcaaataaccatttatttagttcatgattctgtgggttggcaatgtgggttgggctcagccagagtacatctatgggtctcaccaagactcacgcatctgcaatcagctgcctatcaacttcaaggcattcatttcgggcatcatctggccattggctggggctgctggaggaagtgagccacatgtttctcatcatccaccaggctagcccaggcttgttcacattaaagatctcagggttctaagaccaagagcagtagtgctaagactccttaggcctagactcagaacttgctcaaagaaacttacatcacattttactggttaaaacaagccataaggccataccagatttaaagggtaaggaaataggctccacctctggttgggaagaactgcaaaattttgtggccatttttgcaacctaccaccatctgcccacaatttttacatttctccaacttgcaactttcataccagaatccacagaagtctcattcaatcatggctccaaatttactttccagttagcttttgctgcaaaacaaactgcccaaaatgtatgactcaaatctaatggtcagtggcttgatctggactcagttgagtgactgctggtggtctcagttggggtcataaatgcatctactgtcagcgatcaggtcaactgggagctgtttggtgaagggggcagctaggatggcttgtctctactctaagtggtcttctattctgcagcaggctagtccaagctatgtcgcgtggttatcacagaatttcaagacaggaatctccagtgcacgcacgcaatgcaattgtctgtttgctccatggtcacacatgtctcactgacctatccaagtcacttacagaagcacagagtgagtgtgagaggagattatataaggatgtggatccaggaccattactgtagcaatctaccacacaacctctaaatgatactttagctgtgatatcattttgatactaaactaaaatttagattttatgtgtggtgtgatgtggaggagagaggtgtaggagatagcctttcaaaaaataatcatttgtacaaccctaaaagtcaacatatattgtcactatcaacatgaactaggtaaactgctcttaccaaattaaccagccactatttgaatggatccttttttactgaattaagttcagccagacaaagcacttaatctggttaaagagagtcatttttccattttacatggttaacattctttttaacatgttagaaaattctaatcactttacttgttaatagaaaatcagcaacagttagaaattaacagggaaacattaatttctaatgaaaacataaatgggttaattggtttttcacaaaaatagcatgtctagaagacagtcataatatttgctacctcatctgtcctaaaataatccttgttaaatgtttctaccacatgttagttctagtgatctcagtgcctcagccacattttgataaaaacaaaagcaggtatatttattaataaactactataaagagactatgggcatatctgaagcaaaaataaagtatactgcatgttacatacacaaaatgaattcataggctcttttaaaccagcatgttccagttgtttcctcactaatgaataagggtattgttatttgtgttatcactgactttgctgcagagcttaactagtggagagaatgaaaatatttatgaacctgtagctaatctagaattacattaagcatttattatataaagctgtgataacagtaggttaatctaagaaaatagtagaggttaaaaaaatagtccagcctgcacacatggttcaagcctgaaatcccagcattttcagaggccggggccagtggatcacctgagcccaagagttcgagatcagcctgggcaacacagtgaaaacctgcctctatacaaaaaaaaaaaaaaaaaaatacaaaaaattatccaggcttgatggcatgtatctgtagtcccagctacaagggagacaggtgggaggatcgcttgagcccaggaggcagaggttgccgtgagccaagaacctgccactgcactccaacctgggtgacagggcgagactatctcaaaaaaaaaaaaaaaaaaaagtccagatttatattgttttcaacttctccaataattctgtttcctatgaaacttatttatatagattatatgggtggctttgaggtacaaaataggtatacacattttaggatgtgaatgtgtaactcaagtattagacttgataattcaaagatttaggagctttcaaaagatatttgaagataaaaacaaagatgactaatgtatattgattaatgcatttgagacttgacaaagtttataatgatgatagattacattaggcagttttgctgaatttcttgtattcaacagtaatgtttccatctgtgaacacaatgctagaaaatttgtttcccatgaggtaggtttttagctagtaataccaaaaaataatgtgaaccccatcaacgtccttcaagaaacctttcaagaatgtgtatgcagtcatgatgataatctcaatacataaaatcaaaaagactttggaaatcaacttaactatatggctcgatatgccaaaagataattcaaatatagattgtgtattcgtcttcacagaaacccaatgtgctgccaagataagtttgaagtaatataactatttctaggtagttgacacattgtacaatgtgctagattaagccaaaaataaaaactgtctgtagttagcttgagccatcctagttgcataaagctcgaatcaaacctttaagatccagagaccagttgtaaaatgtcatcctccatgtgtctagaagtccttgatcagccactgaggtttcatctatcattataagcattacatttactatgctattacaattacttttaacattaagaacttctggtgggtgatgcccaccagtagtaaaggtaacatgcttttgaggttttggaactcagttgccagcatttacgtatttctgctagcttgaaaaggtatgatgaatagttaatagcaggacaacatcgtagcagcttccccaagattaacaactaaaataagacttttgctaagcaactttaaaataatgtatgaagaacgatgtcaaatgaagaccaacggaattgagctatagattgtagcagacaaccacagtgctagatcagtctgatattgggaaaaaaaaaaagtggggatttttttttaccaatgtcttgggaaagaccataaatcatagaggcagaatcttaaacagactaagttctaaatagccatctgtagttataaatagaaggcaatcttcacttggacacaacttaagaagagctgcttatcaggtatggatcatgttagccatacaagttgattagtttataatctttagttgatggtaaacacttagctttgtacttctccatcataaccctagctttcagctctaagtcagtttgtttgtttttttaaccacaatgaaggtacatttaatttttctaacataaatttttaaaagtttattgtagatcatttgaacatattaaaacttgaaagaagaaaataaaaactacctggaaaattatgtggatatattcaccagtaatgtttgtaaccatgttttcatatgtcccttcaagcacatatagacacacactttacacaggtgagatcatatcatggatgtttaaaatgctttaaaaggatgactttccccctacttttatctccccataatggcatctatcacacccagtttagtttgctaatatcctcatgtatgtccttctgtattttactctgtcctactgtagtcctgggcagatttacatatgaatgggaatatttttataattgttttataaaaattaaatcatattttacattctttttctgaatctcataattatcactcaataataatcttgaaaattgttctatgtcaccttgtatagctctaatgcattcttttcaatagatccataataatccataatgtgactatacttcaatgtatttagccatttccctattaaataccaactttgtttcctttgttgagagatttctgaacaatgctacagaaaacatctttaaacatctgtatctttgtatatcaacaatttcctttctgtgggacagattaccaggaatagacgacagggtcaaagaacaaaactatttttaatttaaatgggtgctgccaaatttttgttattgcataaaaatatgcagcatctaattacattactgcattacagcattatgtggtaaaagttactagacagggggcaagagttctttgtgtaggcccaactttgtttctagttagctgtacgaccttggggaagtcatgtcccttgtctaggtctccatcttcaaagttaaaaggctagagtagatgattcctaatgactttatctagttctaaagtttggtgatttttttcatttatattcaaaaagtaaaatctcagcaactctccagatataatgtccaataacttgaaatcatgaaatgatctaaaaaaattttagtggacaccaaccatgttttaggagggattactgctagctctaaaatcatatttttctctcataaatattgcaaactttcttaatcttggaagatgtttcagtctcatggcacccttagtactgggaatttctcaatgcaggaggaacttcaaactggaaaaaaattcaagtcagaattattccccatggcagaaacaacatttgtatctgtaatatcttactaaataataaaagattcctgtaaagttaaagattttctctaaaagcaacgataagcttatagaatgaaaaaatgccattctctctgtataatagatcagcatcctttattttgtataactagttccctccaaatttcacatacaatgaaacaatcaagccctatcaatatgaaatcttggatcaaatatataagcatatatgataattggtgttgcaataaattcaaatgtgtacaactttgaaagtcttttaaatataattctaaatgcacctgtcaatgacttcagttccagcatttacatatttctgctagcttgaagacaataatctacagggtctcttgtaatactggaagctgtattatacagttagagaacaatgagcagtagtagaatatggtctcgatgatttttcagtatcaatctgacttgactttgatttttgaacattcaataaatggtgaatcctctttcataaaattcaatgcctagctaagacttgttatttaaaatgagttttctgtggctgtgtcttgactcactttcaaaatgtcagttaaatttgactgagtgtccttgaccttgaacttttcatagttggttttgattgacacatctattcaaattgacctttttttaaactgaactattcttctatttgaatgttcattggaagattgttgctgtactctacaatgtaagcattgctttgaatagttagctttttctgacattgatgtgttttaattgcctcaattctaagtatttttgaagttgatgagaatcttcctgattgtgaaagatagtgttaaaatggatgctatcacccattttcttcttttgcagtcaggtattttttcattcagaaacttgtttctaagcatcagaaactttcaaagcaagcttggcaaaagaatactcagtatttggtcttaaagcacatagttgaaataatacagctacttgttgaagactatgcttattaaaatatttactagtattgccaaaaaagatgacaaatatgtatctcataaacttgaattgtgaaaaagtttgaaagatccaaatattaatttactggaaaatagtctttagaaatgctgatataaaattaattatttcattagtaatattaagttttgtaaaaaaaaatgtatgaaagttcttctaccatttttgttcatttctttcttttaaaatgtctgccaatatgcgtattccatagaaaactgtgtatttccatagcaaaagcagttagcctaaaatatatccctgaagggtaggggcattaggagcaaaatggagctagtcgtgctaggccttctttccactgctacaattgtgcttgaaaaatgagtaattctgtctttacaactcatctccctaaatacacagttaaaccagttggcaccatcagtcttcttcctgaaaatctccttacataaacccaaagttcatccatgatgaataatgtgttgcccacatgacctcaggtgacaatgttgccaaactttccaacactacgtggaaggtcaccttttcttcaaccatgaatacccatgtcctcactgtccttcagtccctgttcaacagtctccttgaggcccttccagctttcactagtagtgtcatcatgacccttccaacctttgcacacctaaccccgaagccaacgtcaagtgttttggctttagttaacagcagtaccccacttgtaggtaccacattattttatggttattctctgctgtacaagtactccaaaacctagcagtataaaactacaaagattttactctgcttcccattttgtgggcaagtaaatcaggcagataacagcaaggatggcttgaatatgcttcacagttgctaagccttcagctggggtagccaaatggctggagatggctgggatggctcagggggtgctatatgccagaagcctcagttgtggatattggataggttcccgagatcttctccatgttgcttctgccaagtctagaatccccagtgtgattttgttattcacaagtatagctgggctagaatggttaaaataactggaaatgtctggccttctctctttatctatgtaatctcccacctcactagcttagcctttttcacatgacagtctgaatgtagtacaatttttcttacattccccagaatagatgtcccaatgggcttagaaagaagttacaagccttcttatgatccagccataggattttcagtacctcactttttccacatgatattggcataaaaagttaccaaggccagtccagattcaaggagtaggaaattagagtatacctcccagtaagtcaaatggcaaaacatatgtggacattcttaatctaccacagtgaacaagtagttatatcctaggccgaacagattctttgtacaacactgcatacaagtagtgttaccataaagcacagcaactaatgcagtgtaaaacagattgtgaatgattcattatgcaatagtgtcatgttcagccgtaataaaatagagtatatctcaccattggctctagagataaattttaaataccccataatgcaatgcttagtcactataatggaaacaggaaagaataagtaataggaaagaataagtatcagcaagcagaaatgaagagaagctggggatattaaatgtaattcatatggagcattgacattccattccaagtattggcaggtattgtactctagagagaggttgtggattacagggcaggggcagaatcaatgccctggaaggaataaaaggcaaaataatatgcaaattggtcattaatcaatgagaggaggaaagaaatggaagtagaatgaacaggtggagctcttctagttttatgggacttagcatcagcctccctcctctatgagaccagagatcgaaggtgaaaaagaaattgcttttatctgtgagaccaaaccacaaaggaggtacacaaacaaactggcctcattccatgctaattcttagagttccatacaaaaatcaatgaagcacagagtggtctactacaatcccaagattttggatttttcacaataccaggtcaatactcattttaactgatgagtgagatgaagctactcatactctccgtggctgggctctgcttatttcaaggaggagttagaaaacctacaggcaggtatctgagtattcttccacacagccaggaagagaccagatttgtgttaagacactgactattctgcaatgtaaaaatagcagcagaataaaatgtaatttatcctggaagccagtgtaacaaaataatattaatcttaaaagataaattggaaatatgacaaaacaatctctaaattagaataaaaaagatatatcagtaaaatatcaattcatctaaattatgcacttaggttaggaagtaaaatttggccaattctttttccactaaagctgtgttattataaattacacatgactaactgaggacacgtcagttgtgggtcacatattgaaaattttcttgatactagataagtgtcacaataaaagtaaatgatggcatgagcaaatgaactaaatgggtcttgggtgttatcggaaaggtgatactgacatttcatagagctatgcagccttttatgcctagatgcggttgatgaaaacagtcataaaagcatgagcttttcaaataaacctatggttcattgaaataatttctaataatagttttatggtcattactactcaatgaagccattttatattactacacttgccaaatttgaattaactagtgcaagtgaatgaaattacctataggttcaagcaaaacaaggaggggtttcctagatggcacaggagaatagaaggaatacctgatcaaaaatcagatgcccaaagctttactcctgcctccacacttagcttgcccatggacaagttacctaaactcttcagccccattttctcaactgctatgggaattggttaggctacataatttatttatctttccacactaaaatcatttttttctgcaatgactttttgtactattacctatttcaacaaaacacatcacattacagctggttgttacctctaacattgtgttgtgagtttctcaaagccataatttatcttttctctttatcttgtagcatgtgtagatcaagtatgataaaaagatagcatattttatgccagcttcttttaacacagtgacttttatgctagtcactgtgttaagaagaatctattggttgggtcacagtacagccatgcttgctatgataaagaagaacatagttgcaaaagtgtcacatatttgtgattttctgtctagacaaaatgacagtctaccaagttcttgttaaataattacataattgtgcatgtgctataagcatccataaaatgtatagctactgtagaatgttataattctagacctttcctggtggtcatgtattactagctatttacaaagcacaagctaatgcataaatgtacaatttttttctgactagttctatcgcctttgtgtaacttcaatgagaggtattttatggagcatagacttagtgaaagatagtaagattattctattactagacagtgggataattcactgcaagcaaaaatgtgtattgtctgtcacaattgctaaaatcttcttacctaccagcgttgcctcattgagccaacctatggaccagctgttattcagcttagaagatgttattactgaggagatttcaagagaaagttgatccatcatacaaacactagagaggaatttctcataactttaatgatgtgagtttaaatactactcctgcctagaattctcttaaactggtttgccattgtacttacaaaactgccaatttaaaagtgaggttgagagtcccaacatggtcccttctacctctaggactgtaaagtttagaggagtcctcacctccattctttcaactgagatactgtcctctttcctttgtcattaacaaaccagtataaagtgaacaggttgaatctaatgatatgcgtcaatgagctttgtatttgcattggaggtccaagaaaaaagtagaaagaatatttggagaaaataacacataaatataccaacgcctggatagccttacaccaaacattcagtataaaatgtaacatatatcactgtagtttctaacacaagccttaagaagatgtattctatttctgtatttacatatcagcatacgctaaaaaaagacttcaagtcaataaagcataaaagagaaagtataaacattaaagcaggaaaggataagtgttctataatttacaaagagatgcataccagctcctcgatatttatctcaaagaccaatgtttcatagaatgggctaatgtttcagaagaccacaggaaatatcaatgtggattggagtggtgagcaggaccaacctcatgggcatgtaacccactgggcaccatactgagaagggtctcatacttgatatagtgcttgactgttaccattttgaagtcttcattttaaaacaaagaatcctgcattttcttatgcacaggggcccacaaattacgtagccagtcctggtggtctgtgaaacctttctgaaagagataagacttgaacaaggtcttaacatatgagatataatttgtagattttggtggatcactggggaactgcttgaaggttcagagactgcattttccaccatggtgagagacaagataggttgagtctagcctcatatgctagattaagaacgtggaccatcttgtaggcaaaagggaaccagtgatgatttttgaggtggtaaataaaatcagttttaaaggattaacttagcattggcatagcagatggataagcatgtgagacagagagttgatcacaaagaggatataaagacctcatttcaaagctactattaaaaatataaatttaggaatcagtgctcatacaatgattgctaaaactatataaggcacacaaaaagagaaaatacttttctccggactaagcctgagtattgtgctatcaaataacagatccatctctccccatgtctcttcaaagctcagatgtaggtatgaggaaagctggtccacactccctgccaatgtgtcttctgtcaaagctgaattagacaggaaactccttgagcacagattctatgcctgtatccacaaatcttagcacagcacaaatgaataccttttgtaattagtaatatactgaataaacaataaagggagatgagttaaacagtctcatcatcaggtaacacaaacttttgccatcagattgaatggagctacaagtcagcccaggaaaacatgagattgataaattatgtgaccttatctatttcagccctctctttaccttggaagcactagattaatacagaaatgctaccagcccttttgcattactcacttgtgttaatgtcagataaagaacttcccatttaccttgtggctagggaaaacacaattgtttctcctctttaatctatgtcaacaaatagaactgtttctgcatttttcttaggacttaaattattagaatatggattgaaaattaaatatcaagatcccagtcttgggatgttacagccctatttactcattttgagtcttcaatgtgttgttggctatgtttaatacttcatcataatacacataaatgttttgtcaaatattattttgactattttcttcactagtagtgattaatagttttacttctgataacatgttcagttattcaagcatgtaggttaaatatcatctattttctaaaaacaatattaaaacccatatcatccttaaaccctattctatgagtagtaaagaaaaaactataaaaagactgtctatgtattatttccttatcatagtagggtactttaaacaaattaccagctgggcgtggtggctcatgcctgtaatctgagcactttgggaggctgaggtgggtggatcatgaggtcgagagatcgagaccatcctggctaacacagtgaatccctgtctctactaaaaatacaaaaaattagccgggcgtggtggcaggcacctgtggtcccagctactcgggaggctaaggcaggagaatggtgcgaacccgggaggcggagcttgcagtgagccaagattgcaccagtgcactccagcctgggtgacagagcgagactctgtctcaattaaaaaaaaaaaaaattatcctcttggaagaagaaatactgttactaggaaaatattttaactccaagtttttacgtcagtaacattaaacttatctaaaaatctctgtctcatggctgatacccagttatttatgctagataagatttagaaaactaaaaatgcttaatacataaaatgcttaatgcttttctacaataagacagaaaggatgtgaggaatatttatatctaaaataaagctaggtatttccatagcttactctagctatggaaaatattgatacccagtttgctaagagagtgaataccaatttaaaaaccttcctcttggctaagagtgcaattatagtgcccttcaacagataaattttatcagacacttactatatgccagacacactgctatgggctttactcacattatcatattgaaactctgagagaagctctgagcaatggagtgattttcccaaggtgaatatctaataagtggtagagcagggattcacacaattctgtcattctagaacccacatatactcttgaggtgttttttccactgtctttttccatagtctttttctcttttcctaacttactagagaggaaaaggggcagcagggccagaggtattgtcagctacacacaggaaaggaagcaagccttcatgcattcatcatctcgcttaatgatccttggctgcactagtgctagctcagctttgggaatgcccatcgtggaccttgggggagacatctacgaatagcaagtgctgattcagagacatgaacaaagtgacattggagcataaacagagggaaagctaaggaagcctagggagagagagtccagaaaaacctctgagctgtgtctaaaagaatctttccaggaaaagaaaaaagaaagagcacctgcaacagaacaaaaaagctatgcaaacaggctatgggaagtatgcctatgtctaggtgaatgtaaggttggtgttgtagaatgacaggattaagttgcaggaggtagaatcatgctctaaagagctacgtcaaaataagaagtttggactgtattctaaaggcaacaagagccagcagacactttgaacagcaatgctaaatgagctttcattatttaggaatataattggcagtcttacgttggatgagcaggatacttagtcaaaatgcgagctaagaaagaattcgacttgggtggaaagacagcattttcctgttttatttcagtcattagtaaatgtcacagtaatctagcagttgctctaatgaaacgatctgaccaagatatgtaaatgacatacccctgttgctgctctaacagagagtgaacatacatcctgtttcttaaaaagccttcctttatttactcattcaacaaatagttattaagctcccactatgtggcaggtactatgcaaggtttcggcgtgttgtgttaagcactggttgtggcaaaattcatttgaagcaacaagtagcaggatttgttcataaggtcaacgaaagcagaaaaaaaaaagacagaaaataaagcaagtgtcaaagaaagcaagaaaacaaagggtaattcctaagagacaaaaagtgaaaatgaggtttaagtttaagaaagcaagcatctgctttaagtaaccatttcattaaaagtgcactaaattgtggaggttctctctcaggaactgcatactgtgagctgagatttagtataatgggctcccacatgaattcctctcattacttctcttgaaagatcagtaaatctactgaaagggtaatttaggtttagtgttcacaatctattctttttaacttttaatctttcctgtttaggatgttaaaaatatgatgtagatagaatctaaaagagaagaattgggcccaaaatgagacgattttaactcctcaaatggtcttgatattgatagctatgccacaggctgtagagtttttgcttctgatagatggtgatgtaactttggccagtttatagagcactgcacactgttaatttcaagaaccaagtaaaggacaacatagaaaagataatctatatctcgctctcctgaattccttggacatttttgtaattttaattacatctcttctttatctgattaaacttatttttcactgtaattccatggaaacaaacaggtttgaggaattttgtccaggagatatataaataaattatttgggaagacaaaagtctggaaaatgagactatcagttattaattacaggaatgtgattttatgacatttttcaaaaatgtgagcctgaaaaatcacttataatcagtacttttctactaaactgccaccagtatggtttgtgatattaaaaaacaagcaagcaaataaaaaaaaaagccacaaaacaacatcaacaacaaaaggcactatctttcagacagtgctatttccaggaaaaaaaatcaaatcctccctgatttgtgaggcctcaccttagatttacctttagacataggtcctattctgggcctgtagtgtgcacagccattcctgattaactgagtaccccattaaaagacctaagaaatccagagagaaagaagctaaagtgggcccatcttacccacagtggcaaatataaaaaagctcattcatacagtattaaattatattgatttgaaactaaattattgtttattaacatttagagtttgcttttatttccccatttaaaaaaatcaaaggttttaaagttgctttttctgatttgagagaagtaagcacttagtctagtgaagaagagaagatgaattcagttaggatttaaaagtagcaatttatcccaaagaaattagcagtgtaggacatttactggacaaatatcacattccttgaaagaattcttatgacattttaatgcattctcactatgaagcatgtccttgtaaatgactaaaccagaccatgtcttaacaattatttcatgagagaaaacttcaataccctcagaagttcagattataagactaacaggaaggcaaaaagcaaaacacaacagaaattaaataccagaaagaaatgatctaaaacatagtatatagtaattcactgaaataaatatttatgatttgagtgataaaaagttcacaatgactttgcaccctttctatgaaagctaagagaaaaagaaaattcaaaagatatctggaaatttgtctagtttttatgattttcataaaacccattggtctatctcaaaataaaggcaaacaactaaattcttaaataattatcaggatactgactactaagaacaaacacatcactttttaaaggtctgtaatctgggatgcctctctatgactttcattacatattatttcatgtgctcaattactgttagagaaaatttttgagttctttgatgtcatttcaagcagcatgcatcttatcttattccagtcatcgttagattacaaaatggaaactgaagggaatattggagttttgctatgtcattacctgaaaaataaaaacctcctgagttattgtaaatatcaaccagatctttacatgatcacgataaaggaaatccatctttcctgatagagtaaattaaagacaacactaagtaatggaaggtttgtaccagccattttaaagtataggaacatcacctatcccatgaactaaaacatttaaaagatatcctccatggtactcattgatctccctaactgcagtttttcttcaactgtgttctaatcatcttgcccccaacaagaatcaggtatttggagcttcctttgtgttttgtaactgcactgattaacaaagattcaggctgaccctgatccatgatggtagtggttatgggaggaatatgtctttgttaagtaaagacacatggctttgggaccagcactctttcaactgagcactgtctcattctgttgcctacagtgttcttaggaaaagagctattcaataaagtcacgagataatattttgattgctatcttttcacaattcatttcccacaagttgctgttcctttcaatacgattttcttgccacaaaatacacctgtctctgaatagcaaagcaacatttttgctcacggattatttctcctatacttttaaatatatgagtttgtgcatacttaaatatttttaaatatcttagctgctaaatcattatatgcaatattaaatgttcaacccctttattagcaattgttaaaaacaaaacttctatgtgttccttaaaaaagggcatgtttgatttctgaattgttgttagataaactgtaaggccaaaaatgggcccttttactgaatatgcaaagttcccccttaagccaccttgaactaggcagatttgcaacattttaaactggcacttcatccctctttcagcaagcatcctctgcagatttaatgatcaggaacatccttctgatgcatgctgggagatatggctgcagggtacagaccacagcagacagtgtgtcagatgaggcagaacttcttgttaggggtgagtatgctaatagtgcagtctgaagacatgatcaccataaattatcatacaaaggaatttaaatgcatggactttgagcacatcagtactgtgcattttactttcaattttacaatatatgttattttcgcttaaccttttgcctttgaaaaaattacatggaaaactcctccttagtaacagatgaaaaccaccaaactaacttcagagtccaaaacacctttagtagtaagttgtcactaagtgtttaacctaatgccaaggaaataatctaaacagttgagctactaagtcacttggactacagagataaaatttgtgtgtgtgtatatatgttttgcaaatgaaaagctagtggaacccccaggcatttttttcttctactacttctaagttgggcttccaaaaacagaaaaactgcatgtgtaagatggtggcatttgcaattgttaagtgacaaggatttttttaaagtctgaaaatgtcaacatacaacctctctatgcagaaatgacagttaaatggtttccagttatgaaacagtacaccaaattctgcaatcctaggaagctacatcttaagcaaatgactagagcacccatttcctttagcacagtattccacagtatgggaaatagagatcatagcatgcatttccttccttctttccttccttctttcttccctgcctctttctttcctttcctccttccttctttccttttagctttgtttgaagtacaatatttctacattttcaccaatcataagcatacagatgtataacttaatgaacaatgacaaaataaacacaccatataactatcattcaaagtaaaaaccagaacattaccaagatcccaccaagtacctcttcatttttcatcttatacgattatattttgagtagtatgagtattgcatgcttagatcccttgtatggtctgtacagataaaaacattatcatctatagcaagaaactatattttagattaactggtcttttattcatctggactcttacaatttaaatattaaaaatcttgaacagtaaacataaggcatagagtgagcctcatcatctctatgttttagttatatatatcaccgaatgtatatgggttttggtagtgcatccatcattggttcaagtaaaatgttgtttttaaagaagtgtgttattgggtgattggtagtttgttcattttttgtgtgtttctgttcagaaggctacttgatcttttcttcaaatttatatctagcatgtatatctgtgttaccttattataaaacaccaactttttaaagtattcatcctttcaatacattctattccatttagctaaaaatttctctttgtgccttctgaagttacaagactcatggaactgcaaaccctacactcagtcaaattcatagaaatttgctttctcttgctatgatctgttttagattatgtatatttattgtctgcacttgcctagtaatttagaatgaagctcttaaaattggagctttccaaatcaatatcacaatttagagactgataagaaaccaggtatttttactggactatagggggtaaatttaagtggcaaactaacattctgctttgtaagtaaaattaaactcaacagggtttagaatataattcaggttcagctttcatgttctgctcttttagcctttggctttatgcctaggagatgataaaatgcataaattttcggattatacccaatagcaatttcaaacaggttgctattgtctgaatattcatgtaacattcagcccaagctttcacttgaagtgagtttgatcaagtcaccacttttctattatatatttgcattacttttctaaaattagtaaaaatatcttgtcatttcttcctggtgagttttagacagatttaaacactgaactaagagttctggttctcttttaaaaaattttgtaagtttacagctcctggtaattcaacaagctttgatgtttgaatattgctgtttttaatgttggcttgcgaaataaaatttgaaatagttttactctgccagtctcccttctcacactcctccatttgttggtctgtaaactcatggtattctaatagtatatgccacaggaccaaagttgagcattctagatggagcttttctgatgatggctacaattctggcagcagaatacttaaagcacaattattcaaatatgtgtcacagagagatgggaatattaaaaacaatttccccattcatcttttagtagaatactaaaagtagattggctgagcagttcactttgctcaatgtcttcatcacaaggaacgtacttggatggcaaggattatgttcttatgattctatttcagtggaaatttaagggaaaaaatctatgttctctttgatggacgggaacaacttttttattgtcttccttcccatgagagatagtctataaaattattttatacattttaccaaatcctgcaattcttcaaccttgccgctcatgaacactaaattggagcacaggtgtgtagccacatggcctcatcattgcctatttagaatctgagtgtttctgagtagtaatgttccctgatactctccccattcactactttaaggactattttttcctcaactgctcgtttgcactttctcctcattttgcttgtgaatgtcagtgccattattcacctctattccaccatgatcacctttctccaaagattgcttttttcgtaaataattacctgaagcataaagtcacttgctttcccaaatttaatattcagtgaaccagcattatcacagcaccatgcataatctggagaaccataatagaatgaatatgttagaaaaaattattttgctgaaatataaaaggaaattaaagccacacctggacatctgtgcaccattttagtcacttaagtgtgctataacaatagagaaagcatgactaaatactgctatagggaacctttttaaagatgagtagaactcgatcatgctattaaggaaagggaggtagatatgtaagagataatctcactgaggaggatatacaaattgttaagaaccagtattcccagacaatatcagaagtgatcaaacacaaagtaaaagactctggagaaaggaatattagttttttgttattttattttatagaaattaatgttagaagtatgttttctaaagtaattataagggtaggaaactaaagaataatatgtgcttagctaaactagggtaactaggagtgatagcactatctttctattcagaagaagtgataaaaattcactttctcatacaacttctctatttgtattactctgcttcttagtacaaaacagtaggtcaagaaactttgggaatagtcaaagaataatcaataatctctcgagtccttctgaatacacagcctttcctcaaacttgaacaattttcacttcctgaattacaacttacatgatgaatccaaagtgtattaatagttgaatttgaaacgaatgaattaagctcaggatgtcacttgttgggagacatctaactgctttcaaccatccaccttgaaccccaccctatcacttcctattgctaacagatttcaacctgtctttcaattgaacttccttcatctgtccaatcaattcagttccatttattatttccaataattatttatttccttgaatatctaactttactctctcccaactcaaccacttttcactgcaaaagtaaaatcattaaaattttggccgttttgtcaataaaataagtctacaggtatttgcttataatttgctattcatttgttcacccacctattcattcagcacctgctctgtgtcgggcactgaagtcggcactcagagtggagagatgaggaagctgaggtctcagccctcggctggctctacatcctctagtcctccagtgtgagatgcctttggaattagggtgaggtgtaccatggaagttcacctgcgtacattctcagtgtcacagaggaaatagtgagagactaagataaaacataagcagagctgtggggctggatatgtaatctgtgaagaacaatgccaaatggaaacacaggaccccttgttcaaaattattaataatttcaagacagtgacagaaaggcattaatctaagcacagggccccgaacttgcaagttcgcagatcttgaactacacagctcacacaccaaggaagctagcgctaactaattatatattcatctacagaaataaaagcatgttagcaaacagagggggcaaatcacaacaaagtaaggttttttcatctataaaattagaatatcaaagcctacatcagcagtttattagctttttacacacacacacaaaatatttattttaccccatgagtcatatgttgaaagattttgttcgttgtgttgatgtaatcactaatttatgtttctatttgaattccagccaaagccttctatcatcataagatagataatgttaccaaactatataatttaattccagccaacatcaaagctgacttaccttttagctagttgtaaagtattattggtttgtttgtttcaaatggttgaaagtaacctgaagacaccagtttttacctggatagaaactaatttaggaatctttgattaaatatctccaaattctgtccaagtgctaatctttagtgattctcactagcaagagagaaaagtttgacttttctgcctatacccttggaaaagatgcaagtactatcactttcccaaatgcaatgggaaaataaagctcagtgaaaaccttgagcatgtttctaatatattgttagtttatttgagagttaaagcagtattaatgtgctgtatcttcacatctctcactgcactacccttgtgatccaattagattctaaattgatgtaaatgtctatttttagcatatggccacttctgaatgtttccaagctttaaaatgcacaaatactcaacacaaacatctttggagcatagaggttgcgtagttttccttttccaccattgatctaatatgtaagagcctattgtgcttggagagtgcataagccttcacatggttgagtaatgatttgaacgcaagagagtctccagtgaaaaagacaaaatccagtagttatgaaaaacaaagcttgttttgctaatatgctggtatttggagtcaaaaagacaatgacaaatgttttcagtataactttttaatcctagttaatattaatactaaatacatttgcaaataatattttagagaagaataaaatttattcagctaacataattatttttcaatatttttgaaaactataaaacacagctataaaatgtccttcctcttaaagaaaagctaatttcattcacgctatctcttattggaatattctgcactattgtagaaatattagatcactattattgctattattgtatgggattatttaaatagcttataccaatcacttttctatcttagactttctctaattagtgtgattgacacttataaaatttcttttagacactgaaaagcagttgtttcttttctcttatgcttttcatatggttgcttgctaacctgtagaactcttaaactgacaaaaaagtaacatttttttgtcagtcagatgttcagattttctgcaccagctttagtttggctcattgaaataatagttacctgaagtgatctgactggccaaaatgattaaagcagtttgcatgcatgtacatatatatctgcaaatatgaaatgagcaaacagatgaattgtcattgcacacagacaaccaatcaatacaaactaaatctcttgtattttattcccccaaatactgagtgcctgccaaaagccagactcttttaggcactgatatctccgtcaactgactgagacattctcaggtttcttgatgggagtattttgccattttgaaacaaatattctgacttcactcttcaaatttgagaaaagttctaatcaactgagttttatgtaatacacatttggatttataaattgtaagatgaaattgtatttcactatattttgtcccacagacttaacctatgtttcttacacatccatcctaatataaaaatacagtcacttcacatctgtgtaagtttgtggagataaattcttagtgtgtgggcttgtattttaaaatccaatttcattcactatttagtgagtgcttaccacatgccaggacagttctagagtgcgagagggagacacggtgggacaggattggaataaatgctttctgatgctatgggaaggagtttaactcttatgctacaagtgatgcatatccatcaaaggatcacagcaggaaagggacaggataagatgtgtctttaaaaagaccattcaggaaaatgttgagtgttttagaggacactgtgactagtggcttgctaataaagcagatgggacaataacggtaatcttgacaagaaataagaagggtcttataaaaggcaataatagagacaggaaggggtgtgtatatattcaaaagataggaaggaggcaggatctatagaacttgatggcccactggttatgtaaaatgagaacgagaaggcaaagaagattgccaattgcaatgcttgagtggcccatcagagggacaccgtatactctagttagttagactaacagagttccaagttatacttagagtgtcaaagtagttattaatgaggcccctttatcctcaaaattgtcctggtttagaagataaattttgtggtcccctaatagagaatgatcatgcaatcatagtcattcatgatcacgtttatataatcagaaagatgtggagataagtggatttgtagtaaaggaataacatttagggttctccattctattctattctaagcaaatagttgtgtagctgtggagctcaggagagaaacactggccttgacatccagatttgagcattgttcacattttaaagtcgggtgggaattaaattaaagagcctgtgaaggccaggcacagtggctcacacctgtattcccagcattttggaaggcaaggtgggcagatcacttgaggtcaggagatcgagaccagcctggccaacatggggaaaccctgtctttactaaaaatacaaaaattatctgggcatggtggtgcacacctgtagtcccagctcctcagtaggctgaggcagtagaattgcttgaacctgggagggggaggttgcagtgagccgagattgcatcactgcactccagcctggccaacagagtgagactgtctcaaaaaaaacaaaaaacaaaacaaagagtctgtgaagcataggaaggggaaaatgctggaatggaatgctgagaaacattaactttgaagaggaagaggaatttgaaaaggagatgtgaagttgctgtcagagaccaagagctactgtgtgaaaacccaagtaaatataaatcatggggacaaagagacaagagaaatagaggaaggagaaaatggacaacagtgtcaaaaccaagtgaaatacgaaccaattcacatatcagtgaattaagaaacttggaagtaaatgatggccttggcaagggcaagttcagaggaatgatgggtgtaataaccaaattatggtagatggagagatgcaagcaattatgtgtgaaaggtagcgcagaatcttaagaaaatccttggcttttaagtccaacagactgggtcacatacccacaagctcttactagttgtgaaactttgtgtaagtcatttaatgttaaccttgttatcccttcgttcattcagtacttactcatcaaacatttatagagcacatagtatgtggcaggcatcgagctatgatctagctaaacatgaacaactttattttagggaaaaacacatctttttacagcataatgtgagatgtgctgttacccatgtatgagcagcacattttgctctctgaccatcagcttcattactaataataaacatagctaacatttatcaggttcttcctatatgtcgggcactgcactaaaggctccatattataataattatttcactttatttagcatatcacataaaaacaatatgaaaaacgtactatttttagttccattttgaagataaggaagtcatagagaggtttaagaatgtcacttaaacctctctatgttaaaccacaaaatgtttgaatgtcactaacaagtagaagaatagtgagtagactccaggcagaccagcattttaaattactatactgccttccactgtcaattgccagattgtttcaatttcattgatcatgatatcccctagaaccatttagtttctgatacactatagttcctgaaaaataatacatgtttgtggaagggaagaaaaaaaggaaaaagagagaggtagggaaagagtagggtaaaagggaggaagaaagaaaggagtactgtaagaaacaagagaatggcgtgacaaactttgcctaggagtcagagaatttctatcaagatgatatactcaccgcaacttaaggatttgttgtcatttggtagcccaagaaagaatgaagatattctacattagcttgtaaagacagcactttgtcattaccatctatctctaaggataggtctcacattcacaaatcctctaaaagtaactaatctttgaccacatgaccatgagacaatagtattagtaatgactttctatgttacaccttggcctaaatgaccacaaaccttactgaaaagtctgaacttcctctgatggcccatatcttgccatgcatccaaaatagtaaattctactgactacttcctcagaacatcttgtgggacttcttatctaggtgccatgggttttgctagaaaggaagaacttcgttgccattgcttttggtgttttagtcaaaaagtctttgcccatgcccagatgggatctaattaaactaaagagcttctgcaaagcaaaagaaactatcatcagagtgaacagacaacctacagaatgggataaaatttttgcaatctgtccatctgacaaagggctaatatccagaatctacaagaaacttaaacaaatttacaagaaaaaaacaaccccatcaaaaagtgggcaaaggatatggacgcttctcaaaagaagatatttatgcagccaacaaacatgaaaaaaagctcatcgtcactggtcaataaagaaatgcaaatcaaaaccacaatgagataccatctcatgccagttagaatggtggtcattaaaaagtcaggaaacaaaagatgctggagaggatatggagaaacagggacacttttacactgttggtgggagtgtaaattagttcaaccattgtagaagacagtgtggtgattctgcaaggatttagaaccagaaataccgtttgacccagcaatcccatcactgggtatatacccaaaggattataaatcattctactataaagacacatgcacatgtatgtttattgcagcactagtcacaattgcaaagacttggaaccaacccaaatgcccatcgatgatagacttgataaagaaaatgtggcatatatacaccatggaatactatacagccgtaaaaaaagatgagttcatgtctttgcagggacatggatgaagctggaaaccttattctcagctaactaacacaagaacagaaaaccaaacaccacatgttctcactcataagtgggaattgaacaatgagaacacatggacacagggaggggaacattcacacatcagggcctgccagcagggtgggggtggttgggggctaggggagggatagcattaggaaaaatacctaatgtagatgacaggttgacgggtgcagcaaaccaccatggcatgtgtatacctatgtaacaaacctacacattctgcacatgtatcccagaatttaaaaaaaaaaaaaaaaaaaaaaaaagaagaagaaggacttctaaataaaatgccaccaggaaaactgagcaccgatagacttctttctgcataatctcttctcattctctcatttttaaattttttgcaattgccccaattctggggcaaaaccaaaactcccacatgcctgaaaatgtgcctgaccattcccattgctaaaattctttaactctttgatatttgttgtttttgcctacttatctgtaaattataccaagtgtcatgaaaacaaaacaaaatggcctttaatgttaaaaaagatggtcttaaactcacaaatattaagcaaaatattggaagtacattgtatctgttcatttgtttgaattgtttggaaaaatcatcccatttatttatatattttgtacagacacatctaaaatcagacttttttttctgaacgcattctgtttcctgtgactgtcacctagactgctttggcgtgccttttgaatactgagtagtaatttactgtcatgtgatgtaggagatcagtcagagtgatggagaaactatagggaaaggagcaggccttctgaaaggttggaaggctctgcatagcttcagggagaatagctgaaggcagctgttctctgaccctgaggcagagggcgaggagtatgctgagggaggaggaggcggtaaggtagatgatggttcttcctcccctccctttttaggctcttccgtgtagagcagggccaaagcagccctaactaaggcccataatgttaaagatattactgggacccattgcccttgtacattatgtcttttaagatttcttcccacttgttcccagagctctaggtctagtgtgccttcttctgggaaccatgggttatggaaaaacaacagtttgcattaggtcgcttaattgggcttcagagaccaaggctctgctagctttaagcagctgtttcaatacttttatatactgttgtcccatgatgaatgccctcgaacttggaaatccccagtgggtaccaattacttactgcccactcacttcactttcgttttttgagggttccgtcacaatccattgcagcattcctcacatggggcaccacctgccaggtctgtcccacagaccctggcctacgaatgaaatgagtactcagacacaggtatgcagtgtaagagcagctaggtgattgcctgactctagtggccagagaggagccctgagaagctggagctgcttgcttttattcagtgcaggcacaatgccaaaaacctggagtccatataacctgtaggtaattaacatttatttttccctgttcagggaacatcacgtgcacggatgatcaaaggtcaattcctagtcaacataaataaacaaggctgtttaagataaattcccccacactcccttgtacctactccttctttaagcactcactcattggggcagcgttaagtccagtcctgcactcccagagctggctgctctgagagagaggactgtgggccttccatctgaccgaggaaagccgctggcattgccccagtttggaacaggacatggaggctggcccctcatgaagtttcccgcctgactgcttaggggattgccatttttatcaaattttgacttgcagagatttgcccaatgtttcccctttttacattgggggcatataaaagggggttcttttcctgagtgactttggtctttactattggggcattcctgcttcacatgacctggctctcagcatagaaaacaatttgggtttttctcccatttcactttaggaggctttaatgccacagccaatatctggctttgtgtgtttcagtctccactagctgacatgctcctataagttccccgactgtagctgcctttcctctgattgcctgcattgccttcagctattctcccccgaagctatgcagagccttctggcctttcagaaggcctgctcctttccctatagtttctctcacctctctcactgatctcctacaattgtaaagcctggaatgtacagccttttagggaatatacacttcatatggcctgtttttgacaacccaaatgtggtcaccaagaaagaactccgctgggcgcggtggctcacgcctgtaatcccagcactttgggaggccaaggcgggtggatcacgaggtcagaagatggagacaatcctggctaacacagtgaaaccccgtctctactaaaaatacaaaaaattagccaggtgtggtggtgggcgcctctagtcccagctactggggaggctgaggcaggagaatggcgtgaacccgggaggcagagcttgcagtgagccgagatcacagcactgcactccagcctgggcgacagagcaagactccgtctcaaaaaaaaaaaaaaaaaaaagaaaagaaagaattcaagttccaagtagaagttactctgaaaggcaacccactgactgactggtcacatctcctaagaagacaaaagtaaaattggtaagttcactctagtctctattccccaatcgtactttatttcagtctgtgttccaaaatactaaattcttaattattttcttgatttggtgtaacactacatacgatgtagtctggtcccagaatgcttcttcactgaacaatacaaaatccatgcagattgaacagaggaaggactagcgttaattggaagaaacttttgctgacttttactgcagattgaattttgtcctcccaaacacctggcaaaggtaatgtctccgtttcactaagtactccttaatttggaattacaaagacgattagctctctaatgagttacagcaagtgaggtgaaagagtaggggaaaaaaactgaacaccagatgattctttttaatgccaagaaaaaaaaggctttttcttggttaaaaatcttttaaataaatttctctcctctttcattttacaaaactaaaatatataaatattattgcttagtatgtatgggaaaaatctgatttcatagaacattacatgtaaagattggctgtcatgagtacataggtctctactctgtattattgattgagtatatcagtaaatttacctttagaaacttatgaatctgctggggtacctaacaaattaggaagatgggaaaaatagttcctagctttagaaaaaacagttcattatgaaagaaacctctacaagattcaaaatgggtaggcattgtaaagatgagatataaagggtaattctcaggttatttatgggagtggaaaagtaaaggtgcataaattcaaggtgagcaaaaagtagtggagaaaaggtctgcttgtatctttgctgcaaatgtagaatcaaggtctttggattaccagaacatttagcactgggtttagtctattgctgatacttacttagtaaatattagttgaatttcagtagtttaattaaaaaatgactcaaaatttttaaaatgcctgataatctgtttacccaaccaatcagtatagcattagaaaaataacccaggatgggattttattctcactctggcactaactaaataatcaggcaagtcatcctacctcttttggacttaatctcctcacttgtcaaaaaaaaaaaaaaaaaaaaaaggagaaagaagaaggagaaggcgaaagagaagagggaaaaggaggagaagcagaagcagcagcagcaggaggaggagaagggggaagaggaggagggggtagaagaggaggaggaggagggggaagaagaggaggaggaagaaagaggagaggaaaaagaagaagaagaagaggggaaaataatatttaattttctggtttacataaaagaatgaaatgaggttacaaacagtaaattggtttttggtaactggtagatattgttgatattctcaaatctaggaagaatttccatgtcccttatctttaagattaaatagctgaaccattgttctttatggtattcataggagggaaatagtctatatttctccaataggtgatctaagctcattatctattgacagaaatatccaataatattctgattgttgtgtccatcttatttaattacaatttgataatacattctaatggtgatagagtacattttgactacctctccttcctcaggcatttgaatactgaacatgtctcagattggcacgttgataggcttggcataattgggttctctgtcagtttgctgtcattaggatgagctgtgaatcaccattagggccatctcagtatattcagttaactgagctgatgaaatcttgcattcgtttcctgaagttggttgcacatattaacatctatttatattattaaatattccattgtgttgacatccatccttgagcaaaattgtaatggatatcttagtttacagaaggacttttcatgtgtgaagtaaacactgaagagcttcaagtgtagttaaacaaaatcaccaagaagatataattgagtaaaaagaaagttaaatatataaattatatttcattctagataatatgtgtagaccacgtcatatttagaggtcatagttcaagggtactgctttcatatcagtgataatcatcactatatgcctatgtaatagtcatcaggtttatatcacataaaataagaaataaatatttattataaaatggagctaaatcacagtattcaatatttataaaatgtaaatatgcattctgttaatgtttacataggactttgccataccttcagttgacagtaaagcaatgcaaaaattataataaagagtagaaagcctttcaaaacaccaccaatgacactaaaagatttgaaaataattgcaaagtagaataatcaaataaaatagtcagattttttaaacaataaaaccgaatagtgtgaatgactttcaagttattctagaattgtctttaactgtaaaacattctaggacaaacatacaaaatctcaagaaaaggaaatattttgcaagttacatagggtaattatactgaagtgtcagcattctcatttgtcagcactctgatttggttaatttaaatgttcattaatcacaaaaaaagaatggcataaaacaagcctgcttgaattatatgttttgctcaagaggttattgattcatataattatttctttcatactaactcaagaaatagaactgttattagtaaacttcatttgaaatacttaatcactgttgcaaagatgttttatcacctgatctgtatgaatcagtaaatcaaagctcacatatttgtttcaaaacttcagctcacagatgttaagtcaagataataagcagcatcaatcatacctcactgaacaagatagtctgcattacagacactctccctgtaatccatccattatatggaacatctgttacaaattatcaacaccccgccccacaccccccgacccccgccagggactgctctatttaagtgcttctgcaataacccactgtctccatttctccaaatgagttagatggtggcatcgggatagtaccaagttcactgtcaccgtatgacagcagtcatctttcagtctgtgctgaactccaatggcacactgcataatggtaaatgttcttcctacagttgtatagcagaaatcctcagagcataagctagtagccatcaggaaaccactgacagttctttctccactatatatcagtcattgcctaagttaagcacttagtgtgtaatattcattgtttttcaagtccttaggagaatattgatttgctcatttagttaaatataaaattaatgagcccagatacatgtttgtcaactttggcttatttccatgatcatgaaacatgtcttgtagaacatgttggtttccagaaaaatcatgagaatctaaataaataaagcaagtacaaatttatactgcagaagaagaatattttttaaagtgccctagagtttacccatatattgtcaaggttgcacctgtcttaaagagaatgactttataaatgtgttgtcctagtgtgtcattggaaataacaatttcaaatttactctgtgataggtttgtgaaaataagttacaaggatatctattaatcattaataagtgaatagtgagactgaacaaatgtaaaagtccatatagccacactttattttcttgatgttagtctgcattgcagaattctaatgacacatacacagtaaacccaatattggatttatagaaaactttgtacaaacatggtactttccatattttagcacctcatatggtattttcctacaggatttcattagctcatctgttcttagtgtttatgcaatagtagtttaataaataaatttcaggatagcatctaggttgcgtgaagttttaaataaacaagttacctatttgtaattattcgtaccagtttgtaaaaatacatcctaaaatatctgttttccatttcaggatcaccttcgatggatggacagcattacttttatagtggactatataaagtgtctacaagtgtctacaacttcaactcatgtaaaactacattaaatatttatgcctactttactgcctggaaatcttgattaatttacctttcacctgaagtttgtgataactgaccaggaagtgtttgtttttataaaaaggaaaaaacattattaaataaacttttaaacatagtgctctagggagtcttacgttggcaattaaaagcttcagccaaaaatgacacaagtccttttggctcacaactcactagtctgaacctattacagagctacatacaaaatgaaggcatcagagttcaagtcttcaaacgacaatcacatattcacaaattatacttatcaggatcaatgtcattaaatttctttgtataaggcttgtgtggggaaaggatggtttaatttttgcttttgcttacaatgcaaatggaaaaataatcatgctctaagtaagaccgcaagagaccagcatgcaaaggatcctcagaaactatcactgtcattgaaaccatgctgacagaatctactgaaaaagtaactgcctgaagcatcacaatttacatttgttacaaaaccttactgctaagaaaaaatactcatatgtttttaatgatttagattttccccaaaacagtcctacagcctttgagagctttcatcaaatgtttgccttatcgtttcaatggcttctttctttggacttctctcatatgctatccagtggcttctgattcacactcaaaataaaatccaagttccttgctattgccttctaatccctgtataaactggcacttgctaatctttctgacattatcacctccactctcctcttgctttgctatgctccaattgccatactcattaacacttacaaattttgccattgctgttctctgcctggaaaactcttgcccatattgtttatgtggctggctggctccttcttatttatttctcaactccctatcaaatgttgcctacctcttccccatccaattttcaccacttttttttcttcattgcgtttgttactatctgaaattatctttcacttgtttattgactttcttctctttaaaagtcataagcagtcaccttccctatcttgtttactaccttaacctgagaaaagtggtttaattggctcacagttccacaggctgtacaggaagtatggctgaggaggcctcaggaaacttacaatcatggtggaatgcaaaagggaagcaggcacatcttacatggccagagcaggagtaagagagtgatggcggtgctgctacacacttgtaaacaaccagatctcaggagaactcaccaccacgacagcaccaagggggatggtgttaaaccatgagaaattgcctgcatgatccagtcacctcctaccagaccctacgtccaacaatagggattacaatttgacatgagatttgggtgaggacacagatctaaaccagattaactatacaaatgaatgaatatgtaaccccttttccccaaagagactaattacatttttaaaaatcagacaaaggaggaaacatggaaagaacatggagcagtcattgaataaacaataatcataggcatttaatattaaatgtattgtcatgtctgataacttgtcaataagacagaccagcagataccgcgaaataaaagggtaagatacctgagaatggtgtggtaggagagggtttttaggaattccctttgaagcttggcacttccacctctgtaatccttcagaattttctcacgctgcatcctactttccacctcaccctgttctttgtagtgtgcacgtgcgtgtgcacacacagacacacacatatacactcactcccacaagaaacatgatccaaatattaaaaattaaatgcagatagcaaagaacgattcagatgctgaattctggctacagggagtgtatagcaaagaaattagaaaatctaaaccaaaggcttcagtgttcactgacattttatgtgcaagaggggagttgctatactatcagttgatacatcaaccagctgaagaccttaaaatcttgcccaatttgcagctacagtggccctaacttgtggcctagaagccctgccatgtataccttgatctccaccttgggacaggaaacctctgacaacagcttctttaatctacttcatcaggtgctgcttctcatttatggagccttgccctgagtgtcacatagattccatttaatttgtgtggtcaccagctacacctaattaaattcctacctgaaactgctgacttccatgatacctctcatgccaacttttaaactcaattacttctgtttctgcacatgagcaaaccataaggcataaagaatcaaatgaaacagcactgactcagcaccaataaaattgtgtttttcacttcatatagattttgatttctgttcatcaatatctcagttcatgactgattccccatcatgtagtcatcacaatgattcctgaccttttgaaccctcttcagtctccaaattagcatcttctcacccctgtacttcagtatgatcagaatgtatttcaataaaaattaattttattaaattgaaaataaaacttctgagatcctcctccagactctccctttattctgccaatattcttccaatttatccaagtatgaaattttggaataatgtttcattctcattatttacttttcctttattaagcctaatgtctcagtccacctccagttcaaaaaaaaatgtactggtttccactatctacataattaagtaccaactcattgctgtggtgtttaaggtcttcccttaaccaactttcctacacctttatggactcttggttctctgatcaaacttaagccatcagcttctcctctcttcaaaatgccttagatttttcagtcttttggaatatttgtttacttattccctttttctaccaacaaaatagtcatctttttcctctttaactgctagcccagagcaactgttttcttggaatcctcactgaaaaactcatccctccagcctcaatatctaacaaactttttgagtccaagagatatggagtgaattcctaagtcacttagctggaaaatggcaaggcctgaatgaaaacctatgtttcatggtagctactcagccttcatctttcaaaaccttcaagtttaactttttatttctatcttcacatgatagttcctacaatccttttaggccttttttaaaatgaaggtagcagtggggagcacacaaaatattcagtcatgatttgtgaaatggggatgtttttgctctaaaattctttttctggtttccaatactttgttgaactttgtggtcataggaatatattgctataataggatatctgtaatatgtcccaagtgtctatctaaaagtgataatttcattatcctattggaaaattttcaatcatttaagaaattttactgcatattttgtttacctatctggctgtttgtttcggctagcttttctgtcagttttcccagttgatttgtcacttttaaattctaatggatttatctggaataattagataattggagatctttctttcaggttacttatgctaatataaccagtcttagcaaatataagaaattaccacttttaatcctttatcaactaaaggatttctcagttatcctttatatcttagaatgtgtccacttgtagataatataaagcctaactcaaattgacttaaacaataaagaaatccactgattttcatgacaggaagttaagcaggtgtttgattaatctagtggctcaactttttatgcaagggcccacaggtttgttttgtctctccactccatcatctacaattttggccctacactaaggctggtttccactgtaatcacagattgacttccaggaataacagaggctaaatctttcttgttcacatacaacaggagaaggagctagtgtatttctcccaaacttcatacaaacttgcatcgaaccatctggttataccattttagagaatgtgcttactcctgaacaagtctctgtcacaagaagattgccgtgatctgattggcttaggcctagcttcctgaaccaatccttagcaggggcacatgagattggcaggactgatataggctaatcaaggccattcatataatgaggaggaggcagaggggttaagtccttataccacactgagacaagtagagtgaatattagggagtcaaccacaaagtctactttatctttagcaagcagaggtagaaaagctacctcgaaattcattttcaatcaataaaaatattatttgcccctgctcataatttttaatcttctgaaatctacatgtcctgtctgtgctgaactatgtaaagcagttttatgtagtaatgaaaatcatggagttaaagctcatattcatatgcaaataagaatcagaataaaaccccggagccacttaaggaatgttgtttgacattaccttaggtgagttatctgaactttctgaggctttgcttttcatttttggaaaaggggtatcagtaccaaattaactataaaaattagaaaatatataacacttagcacaatgccttctacttgatagatgagcattaagtcattattatttcagtattttcccccattccattataagctccccagatggtagagattattgaatattccaatgatagtacattttttcatttttgaatgtttcacatattttctattttgctaaaatcaaatgtgatacatgcgttcttgttttcattgatttaaaaaaagggagcagtttgagattgatattgtcaaagttacagactagtgagaggcccagtcagtgctaaaatagtatttgtcatttagaaagtactttgtacatacatcaccctatgtatttttcacaataatgatataaggttgacattatcattctctttataaaatgcaaggaaactgagacttaatgaggttcagaaattttcttaaaccttttgcatgaaatagtactgaaataaaattattctgactctttgtccaaatctcttttctttagatcattttttcttgaaatatagagtacataaacattttctaggcatcttgtacaaaatacaaatcctggggctctagtcatagaagttgaaattcagtagctcttgggtacagctcataaaatttacattctttttttaaaacataccagaaattctgttgctcatcacagtttgaaagttactaagagtctattcatttttgtttaggaaaacagcatagaaaggtggatatctaattagtaacatttaacaaatttgagaaagcagcataatataatcctatttttaacataaatttagagtcttctttcagaataatgctgtaattttgtaaagatgtattactttttctcagattttgattggccaaaagtaaaaacatgtataaaaattaagtcaacgactacactaatctgttaagctaataaaaattattaattcaatgacttattataaatctatttcataacatactacgtgccatgcactgtcccctaggacctgagaatacaatagtgagaaaaaaatacaagcacaattctagccttcttgtacctaaaatctaaagaggaaagccaccactagtaaaacagtcacacaaataaatagaaagttttcactgtgatttcaactactgtatgaatgagagggacatggtactatgaatgtatgcaatacaggaattttacttaggcaaggcagtcagagaagtctgctccaagtgaaccctgagcatagattcaaaatgtgaagcctaaataggtgttaaataggcaaagtaaggagggacaggagtttcatgccgaggaatcaggttatgtaggtgatagattagatacaggaatgggcagaaggatagataatgatgatggtaacagatgaatagacagataataaaagttgagctcgatcaaattaattgaaagcaaaattgcttttggaaaaaaaggaaagtataactgtttgtttctcatttccattcttgactacccctggtataaagggttggttactctcatgagactgaaaacagtaggaagaggtcacttagattagattagtaaatagcaaacaaatgtaagaaagccctctaggcttcatgagtaacgtaatggtggtcagaaagtatctgaggagaaggtaaagaaggaatgacccaatcccacgtgaagttgaactctgccagcccgggatgtcaagagtatatcaggagacatcatcttgtataaaaataaatattctatcaataataccatacttcctaaataagggtataccataattcttcataactttattataaaggtgaatacatcagctttgcaggtattaatagctaatgtactatgaaaagtctagtcacattattaaatattattttttattgaaatattttttcatgactatttctacatatccttttccattgagtcaacacaaactggtcctttgtactggatggttcattgtagatgagtaaaccgcatgataaaaataagaattagtcaccatggcctgagtttttcaatttatctctctgcattaatctaatcttccagacagtagctaaacctccttttcacttggtattaggatgtgtttaggacattgcttccatgattgattgccatgcctgcttcccttttctccagagcatattcctgcatgtgtttggaagtgtctgtcctcaaacagtatttatagggttaaaaataaaacaactggataacgagcatatttgggatcaaaattctcactttaattttaaatgatttaaaacaaagacctgtttaatgttttgaataccagcaaatttcacttttcatttaaaactactatatagcagaaacaacaggggtcaggtagggtggctcgtgcctgtaatcccagcactttgagaggccaagtttgggactgcttgaggccaggagtttgagaccacactggttaacatagagagaccccatctctataaaaaaattaaaaaattagctgggcatggtggcatgcgcctgtgtctctagctactcaggtggctgaggcaggaggatcgcttgagtccaggaggtcaaagcaagagtgagctaggatcatgccactgcactccaacctgggcaacagaatgagaccatgtctctaaaaaaagaaaaagaaaaacaaaaaagcaggaaagtccttaaaatcaaataaaaatgaaaacaaacaatagacgtataaagcaaacagtaatgtataacaataggtgtatttgttgaatcagcaagtctcagaatttcacagaaaatatgatgttatctatgtgagaaaaagccagaaaagttgcttggcacggagaattcatcttagcattgtgcagaggctctaagaagcactcctcatgaaggactgaacaatcacaccataaggactctacagcctggcaccactagttgctgtctacaaggagaatgagcaataatttcacaagaagtcaatacacaactttctgtttgttagcacatgaatttatcataattggacaaatttgacccgttatcaagactaaagcctgttcttgcttcaatgattttaccttcaaagcaagaagactctttttgcctctgtttctgagggaggaattttccactttcaagtactacttcctcatctgaaaaataatatggtcaaactagatgactccaattaatttaaaaattctatgactctgtaacactgctaaattagtatatgaaattgtaggtctttatttcatattaccagtattatagtaagagctttaaagattccaaggagatatatatatatgtacacatatacattttattcacttttcagctttaaaagacaattgcttctcgaaggaagattttctaactgaacattaaatcaacagaaagagttgatctggtatcagtctgcaatgctggggaaccctttattgaggctagattgaatccatgagaacatggcttctgctcagggcttttgatttgtcatttgctcagcagtcctccccatgaagaaatgaacacactgtgcccatttttcaaaattgactatttccaaatacagtatttaatttagtgatcctttataatagcattgtccctgaggaggaaaaaacagttgtcagattactggccatttgacactgaatcattataaccaagtataaaatttaatgagatttctactgaatgagtggcatttgtgtatcatctggactgtcacacatttgtcatcactgagacgtttgcttattaatctatcttcaatgatgccttatgtaaattagctgaaaaagccttttaggagaacctttcctccctgatttattttaaaaagtcaaaaaatagcaaaagtagaatcattaacaggccttaaaaaacaaagatactgactatatcaataggttgatgtaattcactcctaaatatatacaagaagcttatgccaggcagcattcagtatatgatgtataaaaatattttttcagaaataaagtatcgataagccaattctaatattataacagtaaatcttgttttcacctttttatggttaaaatttaatgtctcttagaaggtaaatcacgctgccaattattcagaatatctgtacgttaatatgttcataaaagtatttcagatttaccatcatttagaaaagttagctgtccagaggctataacgctctcagtttctaataaggatcatccttattattaaatcatatgaaaggattattttcttcattcatggagcttgtctgtcatttttattaccactctaaacttggatgaaaaaaaaccctgttaacccaaatatagtttgatttaacaaaaatgaaacttaaatcgcatctccgtctaatataattatattttaaaacattcttttacttgttaattgttatacaacattccacactcaaaatataactcctctatcctttcttcctttatttatttttccttctttttttccctttcttcatctttccttctacaaatatttattgagggtctaattgtatgtcaagtaccatgttggacgttcagataagtggaagttacagaaaaataaataggcagtttaatggctgcctaatatttcattataagaatttagaatttaaacattacgtgattattgggcaatttgttgtttacaatggtttataattataaataattacacagccacaatcagtaccttggttatataaatctttgtccctctcactaattattttctaagaaccatatttgggcaaatagacaaatatcaaaaagaataaagaggatttattatgttgtaaattatatcttttgttccagctgaaagtttaaaaattatttaattattacctattatgaaagcaatatacccttctttaagatggctaatttaaacattttcatagaactttaatactcagagaggcaaattattttatttaaattaacaaagagttgtcttccacagtgtctcccactgagccttgcacataggcggttgttaaatgctctttgaagagatgaataaatagaatggagggaatgaaacagaataaatgtaacaacatagaagagcttaataaatgagtttgttggcaattattcctatatggacacgttagctaaatttcaagtctttttcataatatttgagggtcctcctgacagagtttcatactgatgaaaacactctttaggcaagttccagttagccattgctgccccaaaacttattagcttaaaacatcaatctgttattttctgtcatgattttagcagctgacaggccaggcaattcttgctcgattttctcatgtagatgctggctgaagctggagtcatctgaaagcttcttttgtttatttttttaattcacaaataataattgtatgtatcccaggatgtacatagtgatgctttggtacatatactgtacagtgatcagatcaaggtaattagcatattcatcatcttaaacatttatcttttctttgtgttgggaacattcaatatcctcattcttgctatttaaaactatggatattgttaactatagtcatcctacagtggtctatagccctagaacttattccttctgtctagctgtacttttgtatcctttaacaaatctctccctatgctattctccccctttcccttcccagcttctaatgtcctctgtcctttctacttctatgagatccttttttttagctttcacatataagtgagaacatgtggtgtttaactttctcttcctggcttatttcacttaacataatgtcctccatttccatccatgttgccacaaatgacagaattacattctttttatggctgaatagtattccatggtgtatatatatcacattttctttatccattcatctgttgttggactcctaggttgattccatatcttggctattgtgaataatgctgcaataaacataagggtaaagaagtctctgatatactgacttccttttctttggatacatgcataatagtggaattgcgggatcacatggcagttctctttgtagttttttgaggatcctctgtactgttctccatagtggctatactagtttacgttcccaccaatagtgtgtaagacttcctttttctccacattctcaccaacaatcgttatttttgtcctgctgatgatagccgtcctaactggggtgagatgatacctcatggtggttttgatttgcatttccctgattatcagtgatgctgaccatttctttcatatatttgtggtcatttgtgtgtcttcttttgataaatgtcttttcagatgtgactgttttttaatagcgttgtttgtctatttgctgttgaaatgtttgagttcctcatatatgctgcacattaatcccctttcacgtgaatagtctgcaaatattttcttccattctgcgagttgtcctttcattctgttgattatttcttttgctgtgaggagctttttagtttggtataatcctatttgtttatttttgcttttgttgcctgtgcttttgagatcttattcataaaatcttttccaaaaccaaggtcctgaagcacttcctctatatttttttctagtagttttattgtttctggtcttatagttagctctttgatacattttgaattgatttttgtatgaggtgaggggtgagaagtctagtttcattcatctgcatgtgaacatccaatttttccagaaccatttattgaaaagactgttctttccctaatgaggtctgatctgaaggcctcttcactgacatgtctggtgcctggacttggatggctagaatagctggatgcaagttggatctctctctccacagacctctctaaatagctaatttggacttcttcacagaatggcaatttccatgtaattggactgacaactgtcttttcctataaaaagcattccaggaaacctgtggtaaagatgcaaagcttaacctcaactcaaaattcacacacagtcatttctaccattgtctactgagtcaaacagtcacaggccagctcagatttaaggaggtgaaaaaattgactccaccgttcaatggcagaatggcttgcatgttcagggagtaaaggaagtgatagtggccaccttacacacaggcagacacaaagtgattaatgctttcttcaaatgccatctctatctctacaacataaagtgtggctgtatgtgttccctaacacatactttttctctttctttcttcagttgaagatactttctaaattaacagtgaaaacagtaaaggtctctgtactccttgcttccttccacaaattaggatttacaatcacatccaaatttaaatctcagctgtgctgttccctagcagagtgatttgagcaaataacttctcattagaatgaactctctgatacccagtgcctaccataaaacttaacatataataaggttattgactaaataatttattattatttattaactaagtaatctctttgagattctattacctcctctatgaaatggggataacaatgcccacctcccagtgacgaagaagtaaatgaacaatttaatgtttgcaaacacttagtaagcaccttaatacagtacaatacagtgagattatcacagctattagtattattatagttaatattcttctcactattaaatcattataatgtattgtagatgctcctctacattcctgtcaccacagtctaaaaacttgttagacatcttcttcaacacctggatctcatttattttctttaccttatccttagtcgctattttagtggcttcaacattgatattgggtgatgcaatagacatattttttcataaatcctagaccttataaaccctgtaataatattctcaactttgctttagataaacaaaaaccaacttcttactcaaaaccaccctacctctaaaatcacaaatctgtcaattttctcttgcaacacaattcctactcttatattttcctcccataacaatccagtctccttgactccttttttttattctagtctgtcagccccattctggcttcctctgacttgactccatggttacccacagcattgtcatatttgatgataaacaatatcagaattacaaactcccaagcctgaatggaccctactgactgctttcctggtcttggtcctgactttcctatctttactgaattggtcagtttcacttcaaaatgataccgtctaaccaaatttgaactctagtactattctagaatatttgtattttctcttcattgcaccctttcacttttatcatgtgctattccaaaactttcctgttatatcctccagcccccaatctaatttcccgcaatcaccctaactcttgtagacagtattatattcttaagtttaaaaaatgagtaccttccaaaatgagttctctcaacgtttccccttaccatctcgaaaactttaattattttgcttccttcatttatcttagaggaaaaaattgtcatttcttctcaaggttgccctctagacctttgcccacgattccaactttcggtcaccttcctgatagaatagtctctatcttctatatctttagtctcttgcatctgctggtggttcttctcaggtaacaacgacaacaaaaaaagttcgttccttattttctaaaaatgtcatttgccccaatgaggcttttaaactttttctccatcttactgaagctgtattgttgatactctctattcaaaggtcttcaccaactcctccatctgttcagcatgcaaccatttcttagggtttagctcatgtctcttaatcaacaaatccagagagcatttgtacataaagaccaactcagaaaatacttaaaatacttaagtttttgaaattcaaaataaaacattattgtgactttaattgtccatactatggaatggaagaactggcattgctttgtagccactaaaatataaatacctgtgcatttttaaaatactattcaaaatcaccactagaaataaaaacacaatggcacatttctcctcaaatctggttataattcgttcttaaagatgaagtccatatgcacacagattagtcaataatattctataccattctttcataatcaaaagggaattaatcctcctttattcactacctccccactcctaccaaggaaaaaaggaagctaatcatagatcacagtctcctttgaactccctacagaactttatgtatgtctcaggtctggcatatgtccttaccttgtctatactatcattatttcagaaccttttgcacctcccctgttagagtctaagctatgtgtacttgatagtacacatcatagggcttgtacattgtatgttctctgaacatgaacattagctctagccacttgtagtattttagtaaggatgagattttttttttgtctctgtagcactgcctatcattttctgttgctgcctctgtaaactgattgatttcagcagctgcatttgatactggcattcacatctttgtgtttgtttctcattattttttctttttctataaaatataatgctaattggtaactgcctctgggcacaaagtagcagaaagaaatcaaatctacaattaagtttcccccagaaatcctagactccaacttgcatccatgactttttgttgtcaattttaattactaaattcatatttcattaaggtgattacatagttggatgtgctacatattggaaatataatttctcatggctcctgataataatttgtgcttaactttatccattgcctttgacctataggacccccaggcccacctgggatagtaattgttgaggaaataaccgaaagtacggccacactgtcctggagcccagcagctgacaaccacagcccaatctcctcctacaaccttcaagctcgcagcccattttccctgggctggcaaacagtaaagacaggtaagaggcactaaagcaacatcagatataaccagagtggccttctatctcataagctatatttggctaaggtcttactatgatttttttggattctgaaatctctttgttatttcttacaatattgacaattctttgcttctttttatgaacctgagaagagcaaggtaccttgctttcctcttttcagttcccaaagaggaactatatcatgttggcttatttgtttgttgaaataaccttaaactcacatataagttgcaaaaatagtacagagttcctgtggacccactccccagcttcctgccatgataaaatcttacataaccatagtacaattaccaaatcaggagatgatgttggtgaattgatgttaactaagattcagaccttattaggatctcactagttttgatatgcaattgttttagtgtgtacttatatgagattctatgaaattttattatgtagactcaagtaaccatcaagacaatcaggatatagatcagtttcattagctcagttccttttgctactcctttctagtcatacatctcttttatttataaaaagaaaatctattcagctggcaagatggctgaataggaatagctctggtctgcagttcccaatgagatcaacgcagaaggtgggtgatttctgcatttccaattgaggtactaagctcatctcattgggactggttagacagtgggtgcagcccatggagggcaagctgaagcagcatggggcattgcctcacccaggaagcatagggggtcggagaattccctcccctagccaagggaagctgtgagagactgtgtcatgaggaacagtgcacaccagcccagatactacacttttctcagagtcttcacaacccacagaccaggagattccctcaggtgcctatggcaccagggccctgggtttcaagcagaaaactgggaagccatttgggcagacatccagctagctgcaggagtgttttttcataccctagctgtgcctggaatgccagtgagacagaaccattcactcccctagaaagggggctgaagccagagagccaagtggtctagctcagcagatcccacccccatggagcccagcaagctataagattcacgaaattctcaacagtctgaagttgacctgggatgcttgagcttggtcaggggaggggtgtccaccattactgaggattgagtcggtggtttacccttatagtgtaaacaaagccacctggaagtctgcaatgggcagagcccaccgcagctcagcaaagctgctgtagccagactgcctctctagattcttcctctctgggcagggcatctctgaaagaaagacaacagccccagtcaggagcttatagataaaactcccatctccctgggacagagcaccagggggaaggggcagctgtgggcacagcttcatcagacttaaacgttcccgcctgccagctctgaagagagcagcagatctcccagcgcagcgctcaagccctgctaagggacagactgcctcctcaagtgggtccctgacccccatgcctcctgactgggacacaactcccagcagggagttgtcaccgacacctcataaaggagagctctggctggcatctggtgggtgcacctatgggactaagcttcaaggaggaaacaggcagcaatctttgctgtcctgcaccctctgctggtgatacccaggcaaaatgggtctgaagtggacctccagcaaactccagcagacctgcagcagagggacctgactattagaaggaaaactaacaaacagaaaggaatagcatcaacattaacaaaaagaatgtccacacagaaaccccatccaaaggtcaccaacatcgaagaccaaagatagataaatccacaaagatgaggaaaaaacagcacaaaaaggctgaaaattccaaaaaccagaacacctcttctcctccaaaggatcacaactcctcgccagcaagggaacaaaactggacggagaatgaatatgatgaattgacagaagcaggcatcagaaggtgggtaataactcctccaagctaaaggagcatgttctaacccaatgcaaggaagctaagaaccttgaaaaaaggttagatgaattactaactaaaataaccagtttagagaagaacataaatgacctgatggaactgaaaaacacagcacgaggactttgtgaagcatacagaagtatcaatagccaaatcaatcaagctgaagaaaggatatcagaaattgaagatcaacttaatgaaataaagtgtgaagacaagattagagaaaaaagaatgaaaaggaacaaacaaagcctccagcaaatatggcactatgtgaaaagaccaaatatacgtttgactggtgtacctgaaagtgacagggagatgggaaccaagttgtaaaacactcttagggatattatccaggagaacttccccaacctaggaagacaggccaacattcaaattcaggaaatagagagaacaccacaaagatactcctcaagaagagaaaccccaagacacataatcatcagattcaccaaggttgaaatgaaggaaaaaatgttatgggcagccagagagaaatgtcaggttacccacaaagggaagcccatcagactaacagtggatctctcagcagaaactctacaagccagaagagagtgggggccaacattcaacattcaacattcttaaagacaagaattttcaacccagaatttcatatccagccaaactaagctttataagcaaaggagaagtaaaatcctttacagataagcaaatgctgagagatgttgtcaccaccaggcctgccttacaagagatcctgaaggaagcactcaatatggaaaggaaaaaacccatacagcctctgcaaaaacataccaaattgtaaagaccatcaacactatgaagaagctgcatcaactgacaggcaaaataaccagctagcatcataataacaggatcaaatttacacataacaatattaaccttaaatataaatgggctaaatgccccagttaaaagacacagactggcaaattggataaagagtcaagacccatcagtgtgctgtattcaggagacccatctcacttgcaaagtcacacataggctcaaaataaagggatggagaaagatttaccaagcaaatgaagagcaaaaaaaagcaggggttgcaatcctagtctctgataagacagactttaaaccaacaaagatcaaaaaagacaaagaagggtattacataatggtaaagggatcaatgcaaaaagaagagctaactatcctaaatatatatgcacccaatacaggagcacccatattcataaagcaagtccttagagatctacaaagagacttagactcccacacaataatagtgggagactttaacaccccactatcaatattggacaaaggaacaagacagagaattaacaaggatattcaggacttaaactcagctctggaccaagcagacctaataaacatctacagaactctccaccccaaatcaacaaatgtacatttttctcagcatcacatcacacttattctaaaactgaccacataattggaagtaaaacgctcctcaacaaatgcaaaataatggaagtaataacaaacagtctctcacaccacagtgcaatcaaactagaactcaggattgagaaactcactcgaaaccacacaactacatggaaactgaaaaacctgctcctgaatgactactgggtaaataatgaaattaaggcagaaataaataagttctttgaaatcaatgagaacaaagagacaacatactagaacctctgggacacatttaaagcagtgtttagaaggaaatttatagcactaaatgcccaccggagaaagcgggaaagatctaaattcaacaccataaaatcacaattaaaagaactagagaagtcagagcaaacaaattcaaaagctagcagaagacaagaaataactaagaccacaatagaaatgaaggagatagagaaacaaaaacccttcaaaaaatcaatgaatccaggagctggtgttttgaaaagattaacaaaatagataaaccactagccagactaataaagaagaaaagagagaagaatcaaatagacacaataaaaaatgataaaggggatatcactactgatcccacagaaatacaaactaccaccagagaatactgtaaacacctctttgcaaataaactagaaaatctagaagaaatggataaactccaggacatctataccctcccaagaataaaccaagaagaatttgaatccctgaataaaccaataacaagttctgaaactgaggaagtaattaatagcctaccaaccaaaagaagcccaggaccagacagattcacagccgaattctaccagaggtacaaagaggagatggtaccattccttctgaaactattccaaacattagagaaagagggactcctccctaactcattttaagaggccaacatcatcctgataccaaaacctgacagaggcacaacaaaaaaagaaaatttcaggccaatatccctggtgaatatcactgggagaatcctcaataaaatactggcaattcaaatccagcagcacatcaaaaagcttatccaaaatgatcaagtcagcttcatccctgggattcaaggctggttcaacatatgcagatcaataaacataatccatcacataaacagaatcaatgacaaaaaccacatgattatctcaatatatgcagaaaaggagtttaataaaattcaacaacgcttcatgctaaaaactctcaatgaaataggtactgatggaacatatctcaaaatagtaagagttatttaggataaacacacagctaatatcatactaaatgggcaaaaactggaagcatcccctttgaaaactggcacaagacaaggatgccctccatcaccatttctattaaaaatagtatcggaagttttggccagggcaatcaggcaagagaaagaaataaatggtattcaaataggaagagaggaagtaaaattgtctctgtttgcacatgacatgactgtatatttagaaaaccccattgtctcagcccaaaacctccttaagctgataagcaacttcagcaaagtttcaggatacaaaaatcaatgggcaaaaattacaagcattcatatataccaataatagacaaacagagagccaaatcatgagtgaactcccattcacaattgccacaaacagaataaaatacctaggaatagaacttacaagggatgtgaaggacctcctcaaagagaactacaaactactgctccaggaaataagagaggacacaaacaaatggaaaaacattccatgctcttggataggaagaatcaatatcatgaaaactgccatactgcccaaagtaattaatagattcaatgctctcctcatcaagctgtcattgactttcttcacagaattataaaaaactactttaaatttcatgtggaaccaaaaaagagcccgcatagccaagacaatcctaagcaaaaagaacaaacctggaggcatcacgctacctgaactcaaattctactataaggctacagtaaccaaaacagcatggtactggtaccaaaacagagataccgaccaatggagcagaacagagacctcagaaataacaccacacatgtaaaaccatctgatctttgacaaacctgacaaaaacaagaaatggggaaaggattccctatttaataaatggtattgggaaaactgactagctatatgcagaaaacagcaactggaccccttccttacaccttatacaaaaattaactcaagatggatttaagacttaaacgtaagacctaaaaccataaaaaccctggaagaaaacctaggcaataccattcaggacataggcatgggcaaaaacttcattactaaaacaccaaaagcaatggcaacaaaagccaaaattggaaaatgggatctaattaaactaaagatcttctgcacagtgaaagaaactatcatcatagtgaacagccaacctacagaatgggagaaaatgtttgcaatctatccatctgacaaagggctaatatccagaatctacaaagaacttaaacaaatttacaagaaaaaaacaaccccatcaaaaagtgggcaaaggatatgaacagacacttccccaaaagaagacatttatgcagccaacaaatgtatgaaaaaaagctcatcatcactggtcattagggaaatgtaaatcaaaaccacaaaaccatctcatgccagttagaatggcgatcattaaaagtcaggaaacaacagatgctggagaggatgtggagaaataggaatacttttacactgttgatgggagtgtaaattagttcaacctttgtggaggacagtgtggtgattcctcaaggatatagaactggaaatatcatttaacccagcaatcctattactgggtatatatccagaggattataaatcactgtactataaagacacatgaacatgtatgtttactgcagcactattcacaatagcaaagacttggaaccaacccaaatgcccatcaatgatagcctggatgaagaaaatgtggcacatatatgccatggaatactatgcagccataaaaaaggatgagttcatgtcctttgcagggacatggatgaagctggaaaccatcattctcagcaaactaacacaggaacagaaaccaaacaccacatgttctcactcataagtggaagttgaacaaggaaaacacatggacacagggaggggagcattacacactggggcctgccagggagtggggtcctaggggaggaatagcattaggagaaatacctaatgtagatgacgggttgatgggtgcagcaaaccaccatggcatgtgtattcctatgtaacaaacctgcacgttctacacatgtatcccagaacttaaagtataataaaaaaaagaaaatctgatataaaattacactgcacagcattttaatgcctacttccaagatgtttgcattatagttgcattattttaaaaattttttcatctctaatcattttcttttcattttacaacttcccatctctctccaaatgtggctgtccagcagggatatgtaaaatcacacttactggatagttactagacacttatttaacatactggtatttgaaaagtgtacagtaagtctacagaagagaatctttagaagcaattgtccatactgagtaacaactgtgtttttgttttaaactctaatgacctctattgacctgttttgaaatatagaaatcagtaaaatatttgcacgcagtaaccttaaaactcaaccagaatattatgagggtaaagtggttcattttattgtgtaggtaaatgaaatttgagtttttgtatgaaacactgtaatatcagaaggagaaaatttgtttatctatatgcagaatttaattcagaatttatttgatatttaggctcctgcattgttagacctcagtttgatcattatagtgtctataaacatatttattatgcatatatacatatttattttgtattatagataattgctcatatcagcctcattcctggatccattataaccctgtgatacctttaaagacctcaaaattggagaatttctaggtatggtagttaattcaggaaggacacatttaaaccacatgagcagatttactcaaaaattcttataaccttcaaccctgtgcttcaatcttattcttagtatgacagcttaaatctttggctctgcagccaggagatgacctcaccttcagatctggtgttgtgcactcatctaattcatcctcttgcctacagccatgctccctgtctgctcttgccacactatccatgcagcttacttttggagaggttttccttgtggatacattgcaatacatgtgtgttttactactcatcctatgcccatagcaatccagtacctatcttctacctgctacatccatgcttcgctagttacacttatgttctgattctcacctatggttttctttctcagttcacctgtttttactttttgtttatatatatacatatgtgtgtatatatatatgtatataaaaacatacataatcatgtatgtggaggatttaggcatttgaattatttttgtgtttgttttagaagtccctactgtaaagttgcatctttatctttctaatattatttgaatgctagaaatatttttaaatttttattttactttaagttctgcaatacatgagcagaacgtgcaggtttgttacacaggtatatgggtgccatggtggtttgctgtgcctatcaacctgtcatctaggttttaagccccacatgcattaggtgtttgtcctgatgctctctcctcccctcatcccctgacagaccccagtatgtgttgtttctctccctgtgtccatgtgtcctcatttttcagttcccacttatcagggagaacatgtggcatttggttttctgttcctgtgttagtttgtcgaggatgatggcttccagtttcatccacgtcctggcaaaggatgtgaactcattcttttttcatgactacataatactccgtggtgtatatgtgccacatttcctttatccagtctattatttatgggcatttgggttgcttccatgtctctgctaatgtcaatagtgctgcaataaacatatgtgtacatgtatctttatagtagaatgatttgtattcctttgggtatgtacccagtaatgcgattgctgggtcaaatggtatttctggttctagatccttgagaaatcaccacactgtcttccccaagggtcgagctaatttacattcccaccaacagtataaaagtgttcctatttctccacagcctcaccaacatctgttttttcttgactttttagtaatcgccattctgactggcatgagatggtatctcattgtaattctgatttgcatttctctaatgataagtgatgttgtggggtttttttatatgtttgttggccacataaatgtctttttttgagaagtgtttgctcatatcctttgcccactttttgatggtgatatttttcagagttcttttttaattcaattcagcaagaacaacacttctaaaaacccaagaattgtgctgtacttatacaaaagttttccttcagaaaacgatttctgcaagtgatcaattgtatttacccttcatggtgctagggctatcactagatgtgtcctcttctaactcatttctccaaaacgcaccattaattgcagctattggcagaggcatgctgtcctcagggaaagcctgatgaggagctgtccacaaggtttgcatgctccaaaatagctcttttagatgcttcctggttttagtaccatgctcattctcacaatttctttcatgcctgtgatggggaaataagtctctctggagccacaccagctccactaggtcatgggccttttggtttcatagttgctccctcattctaaattaatttcaatcaaaattaactctaatttaacaatatccattagaaaaaaaatgaatctggagtttaaactcgctgacacagttaatgcaattgataatctactacttgaaaagcatttaaaatataccaaaatgagcataaaaaataatgtctcatttttggcaaatgaagtgagaggttccacatgaaccctctagctgagcacatcttggatttaacgtatgaataccgcctcctgcaaatgagactaaaatgtaaatgggaataacttgtttattttgaaaaaagtatgcaaacagccataacatctcacttgcagacctcttttccactcaagcaaatggcttttgacttagaaacctgactttcttttttatattactgagaagcattagctgacatagtttttgattatgtctacttaggaatataaaattgcctataatcatagaattcattggtctttgtttacttaactcagatatgcttcttaaatattctatcagtggatatgtcttctatctgtggatatgttttgcacagattggttacatttttcaactgaacagatttatttggtattttattaattaaattggtggctggatttgggtggctcatacttgtggtctcagcactttgggacatcctgaggtgggaggatcacttagggccaggagattgagacgagcctggacaacagaaggagatcttgtctcaaaataaacagtcttagatgtgattcttttgcttggaaaggcagttcaaaaagatgctttccctgagtcactataaggtcttccactgtctttcgttgctgtcatgttctctctgatgcacaatgttttctttgaaaccaagttgtccctaaagttctggaaataataactttataaaaagatgctgcaagacttttaaaatacttactttggtataaatcctccattatccttaatctccataatattgcatttcaaatcaaaaccctaattgtataaaagagaaagtttttactttctttcatattgcattatatttcaccaaaaataataataccttcaattaatacttataattattttatatctcttacaagcaacagggaatttagaatttccaaatctttttttttttttttcactttaaagagaggaatgaagggtggtggaaaggatatggacttggaaagggagtctttaaaatctctagttatgaccaagaggatataaatatgcataactttggaaggaagattatttttatatgtattttacataaagcttataataattacatcaagattcaagcagaattaattaatattgccaattctgatcacactaggcaatttgaactctcattcatttaataaaagtttaccaagcgccttttaggaagtgttctaggcacatgcagtgtatcaatgaacaacaccaaataaataaatccttgcccttgtgaagactgtattcttacaggtgaagacaaacaataaacagagaacataataagaaagtaaattatatagtatcttagaagttgatgagtactatgggggaaaataaattaaatggagtaagaggaatcagaagtactatggcagggtcagtgtatcagtcaactcaggctgctataacaaaattccatggactgagtggattaaacaacagaaatttactttattacagttctagaggttgggagttccaacatcaagtggccttctttgttttcacatgaatcaaccacacacacacacacacacacacacacagagagagagagaaagagagagtgagcaagctcaagtgtcccatcctataaggacactaagatcacagccccactcttatgacatcatttaactttaattacttccttagaagctctatcaccaaatgcaaccacattaggggttaggactttaatagatgaatttcaggaggacacattagtccatagcaggaaggttgtaatttgaaatagagtggtcagggtatgccttaccgagaaggtatatttgcatgaattttataagaggtatgaacttagctatcccaatatctaggggaaggcagcccaggtataaggagcaactagagcaaaagtattaggaacatgatatgcaagagcattagaggatcagtgaggcaggagcagaatgaggtttagggagaaatgtagatgagttttgagagatattggcaagaccagatcatacagtacttgggttttcaccgtcagagaaataagacgtcggaggattgcttttctaagtcttatgttttaatacagtcattcaagctatgtgaaaaaatagacttatgggaggggtaagtgaagagtgactaaactatttaggaagctgttattatgattgagagatgatggtgcttcaatgtgacagaagcttggtgacgcaggtcactgatgcttttatgacagaggtcataaaaatggtcagaatttgaaactatttgggtggtaaaaccaacagcatttgctgaaaaactggatgtaaacagtatgagagaaaaagaattcaaggatgactgtaagatttttgacctaaccaacttaagaatggagttactgttaagtgacatggagaagcctgagaaaccttcataattggaacagattgggtaggaatgagataaagagttccatttgagacacattaagttgatgtatctgttagacatccaaatgggatttcaggtaggcatttggatatataagtatggtgtttaagtgagaggtttagcgtaaagttattggcatataaataatttaaaatatgagactgtatgtcaactccaagaaagtaagtataaaataaagaataaaaattatgaaaataacaccctggagcattgtaacagtaagaagttgtggagaagagaaccagccaaaggcggcagaatgaaagcaatcattgaggtaaaaggaaaaccaaaataatgtcatgccatggaaaataaaggaataaagcctatcaaagaaaagggcctaatgagctgtgtcaaatgctactgagatgtcaagtaaaatgaagactgagaattgatcattagttttagctatatggaggtcattggtaaccttgacaatagcagtttttatgtaatggtaggcatcagcatcaaagtccatcaagaatgagttccagagacaataggagaaaaattaatatagacaactcttccaagaaatctttctgccaagataagtggagatatcaacatagtttgaagtcatagatgccataattttctaatggattggagtgagacaggggagaaagaaaggagtccaggacggcccgaagatttgggatacaacatctgtaagaaagcaattgtcattccccgtataagaataccgcagaaatctattcaaatagtaatgtctattaataatatgccactgaacatatgagtctgaaatctagggaagaggttcattaaaaatattagttaacagcatagagagtatctaaaaccatgaggctggataaatcaccatggaataagaaaatggaaaacagtagagccatttgcatcaggaagacaaaacgaaatcagcaatggagactgataaggcgtagtcaggtgggagagaaacagaagttaagttttgaaaagtgtttcaaaggatgatcaactgtgtcaaaggatgatgatagttcaagtgagatgagtaatagagatctggccttaaggtttcagtaacagagaccattcactggtaatcttgacagaagccagtatgatggaaaactggaggtaagagtctgaatagcatgggttcaaaagagaatggaagaaaaataattgcagacagtaagtaatagcacaaacagttctcaaaagagtcagagaaactgagcgaaggctggaaggagaggaaatgttaagagaccttagttttgtttttcagagaaaaacacctgcatgcttgtatgctgatgggaaacatccattagagatgtgggagagagaggaaaaaagggctggttctttttctccgtgatatcttaagaggtccaccccttaataagggtaaaatttctttagtttctattggagtaaaaagttgtaggaatgcccagagaggagattaagtatataggggattttgctaatgacagatcataaattccaactgtcacagtggaagaacttcaagaatgagggagagatatgtgctgggcagaagaggaaattggcagaattctcaggaggttagaataaaagggctgagcatggtccagatgtctggagttacttgagatgacttatataagtaaatgaaacagtgatgttaagtcctggtgctcccaatgcaagtgttggtgatacagtgtaggttctgggctagagaaggctgagcatgatctgggaatgccttcttctcttttgtatgtttgtcaagcatagctcggcatttcaccaagctgtggtctgacagtggcctttccctcacccacctcttagactccaagcgtactgctcagttgccagtgcagcaagagggaacagagttgttttttgtttgtttgtttttttccatgtcttcatgtcactgctttaaaaaaacacatcagccctgcagtgctgtgagatttgtcgggcagctcacactgcctatgctctgagcattcacctttcacagagctacttatttggtaacattcttttggtacctttcagaagagattttcatggaaaatccaaggcgatttcattccaccttgctgtggtaaaaacagaattgagtcctcaaatcaaaatccccaactcccaccccggctctactgccatgcctacaaagaaatccaagaatgatataaatccagaggatctttgcatgctgtaagggagattctccacattctgccttttcactcctgtaacaaatgtttagaaacatttcctagacagcagagatgagtgaacaagaaaagcagtcccaaataaagcatgcatgccatgtaaaaatacttcactaatggtaattgtattgacaaacaatgttatgccctgacaaaaatttaaatgtagtacaaaaatgtaaaggtagtacaaaaatcactctaagaattcaatgtttctactcagatatcacaaactgtgtttttaaattagagagatatattcttaatttgctgcttggaattaccaagtgactaaacatgtttgccagaactgggagagcaaactgctcaagaaatttcctagaaaatgaaagaaaactgtttaaattatagttctaattggccccttatctggggctgagggattgatgaaataattattagtgtacataatggtgaggtttgtgtaaagataaaatgaaagagtcctaattaactccaacaaactttgacatatgtaagtgcttactccctgaagattgattttcattttactaatgacactggaggtgacaccatgaccacgtgtcgtgaggaaatatgcattagccttctgattctgtcagtagcattaatattcttgattgccatttgtagcatttttctagtcctcataatgacatgaaatttccttcctttctatagtcccagaaatcataacaggggacatggagtcagccatggctgtggacctaaatccctgggtggaatatgaatttcgagtggtagccaccaaccctattgggacaggagatccaagcaccccatctcgaatgatccgcacaaatgaagcaggtaaaaatttggaagagtcagattggatttggtatgcttctaatcgtcttgaaagtgagttgaattaaccatgattgctccattgcttgctttagcataatttgtcctgattcatttacctaaacatcataaaattattttctttaaaataattatttcattttatttgttctcagaactttttctccctgtttccacaaatacagtcatctaaatgcttcaattttctcccaatccttgtactcatcttcaggttaccatgaaattaaagcagttcatttattcttctaataatatactcattcaatatagcatacacttaagatttagaataaatcggttcaccttctttttttccagtgatactttacttgaattacagtgtacttccttagaactcttttatgttacccttcaccacaaaacccatataaattacactttgcaaatagtaaacattgcccttccttgacctactgccttcctgaagtctatatgtaaaataaataccaatctgctccttgactttgaaaacattacattattctcagcttttagaaaaagcatatctgataaaaggtttctaatgactgaggaattaacagctctatttgaattttaagatatcttgcctatcacctggaaggtgcagaaaaataaagaaataaggaatacagaaattttctgagtagatttttatgactttggacaaagtctcattgaggtcttttatgtccctctaatgttgtatattaagaaagtatctggttagacatttacttaggggaacacaaacatgaatgttgataagaacaatatgaaaacaatagaaagaggaggatcagggataggtatagggaggaagaaataacaaatgctaatgtttttatgctcaatgataatatatgagtctcaaataaaagtgcactgaaaatgaaggtttgtcatatatgttcactgccctatactgaaacctagaacagtgtttggtactggtactcagcatgtcatatttttaaagggaacaattttttcctttatgtccccctacacacaccagtacataggtcagatacacatatacatacaagactaagaattaactgtgtccattgtgtattatagttatagaactgaaccaaaaatatgacttttgacctctaacaaattaaacaaagcttataatcattaaaataaactctcaaaacagttgactttttctctaaaacatattatggccctctcagaaggaaggaaggaaggaaggagaatggaggaagggagggagggaaaagaaagaaaaaaaaatcccaagatggcccactagactcaagacaaatggaacagctcctactgagggacccagaggactagagtgctcctaacagatcttcacagggaaggcactgagagtggacagagggaaaacacagaggttgggctgattgggggaaaacgttgggacccctacgcggggctacagcacacccggatttatttctggcccccaacagctctgggggaattggtgagttgaactggcaaggagcaacccactcttgccacaggcctctggaaccccagcagaaggagaccccctagaccaccacggactctggacttggcagggagagctgcatacagaagtggtaggagctgcaagccagctgatgtggagcccagagggtttggtgcaagagcatctgtagtgaagcatggtcagggatggccatccccctaggttcgatttgctccataggagactttagccctaggggaactttctgtctgtcctgaactctgtaaggcagttttgcccatcagatggggccagtcccacctaagcaacaccttagtctgctggcctctccccgagcctcagtatggccacacctgcttgcagggcgccctcgggagccttgagaggcctcacaatagcttctcctctggcagaccctgactgaaaggcagagagcttaagcagggcggctcctatggccactcaccagcctgcacagtctttccccacactgcagccgcagcgtccccgacatccctccatgggacaactcccacatgagtttgctgggcgtgtctgcttaggggtaggggtggggatttgggtttgctttccttgccctgacagcgcctggtagtacagtctgctccccttcccctgccaaccaccgttgcagacagagtcttagtgggtacagagccagcaagccctgtcccaacaagtaccccacccttgctttaagaatgcgcagatgacagcggatcctcccccaccttgagtgacccctccagcttgcagagcagagaaggcacccagacctgcacctgtcagtgccctgcccccagccaacaccacctccagtgcaagcaggcacacagttgtcatcaggcacccgctaccaccaccatcgctccaggcccaacctcaactgcattgcctccgccactgtggtgaatgtccccagggagacaggcacccaggaacccgctagcactcaaaaatagaaagattcaatatcattaaaatgaacatactgcccaaagcaatttatagagttcatggtatttctattaaactaccattgacattcttcactgaactactaaaactattttaaaattcatatgaaccaaaaaagagtcaaaatagagaaggcaatgctaagcaaaaagaagaaagctggaggcaacatgttacccaacttcaaactatactacagcgctacagtaaccaaaacagcatggtactggtactaaaacagacatacagatgagcggaacagaatagagagtgcagaaatatgaactaactcctacaaccatctgattttcgacaaatctgacaaaaacaagcactggggaaaggataccctattcaataaatggtgctgagataactggctagccatatgcagaagattgaaactggaccacttcctttcactgtatacaaaaattaactcaagatggattaaagacttaaatgtaagatacaaaactatcaaaatgctagaaaacaacctaggtaatactgttctggtcataggaacaggcaaagatttcatgatgaagatgacaaaagcaattacaacaaaaacaaaaattgacaaatgggttctaattaaacttaagagcttctgcacagtgaaagaaactgtcaacagagtaaacagataacccacagaatatgataaaatttttgcaaactctatatctgataaaggtctaatatccagcatctataaggaacttaaacaaatttacaagaaaaaaacaaacagccccattaaaaagtgagcaaaggacatgtgtagacacttttcaaaagaagacatacacgtggccaacaatcatgtgagaaaaagctcaacatcactgatcctcagagaaatacaaaatgcaataacattaaaaccgcaaatgagataccatctcatgcctgtcacaatggctattactaaaaagtcaaaaaataacagatgctggcaaggttgcagagaaaaaagaacacttatacactgttggtgggagtataaattaggtcaaccattgtggaagaaagtgtgacgacaactcaaagacctaaaaacagaaaaaacattcgacccgatactcccattactgggtatgtgctcaaaggcttaatacctgggtgatgaaataatctgtacaacaaacccccatgtcacaagtttacctatgtaacaaacctgcacatgtacccgtgaacttaaaagtttaattgccaaaaaaatccacatgatcaaattatcacattaaaagtaaataacaatacaaaagatgttcagtttttttccatataaaaattaaacaaccaaaaaaaaaaggtaaaatggcttaaatatgttggaaaaggttcatccacagaaaatccaacttctccacttttgtgatttgcctattataagttgtttttttctgctaccttttcaatagcatgaattttaaattaaacattaattgcctggttagattttcatgcatccataaaaccagccatgctttcattgtgtacaggtgttcattaattaagagcataacaggttagttgttcttcattttatgtactcactgtgcagctactgaaatgactgccaatagtagtacttatgctcacatattttctaaaaagcgctgccttactttgcatattgttaattgtgtttaaacaaaggcaaagattactgactaattcagaggctctctataaatattcatttcaaaaataaataatccatttgggatgaataatccttttcaactttttatggtatgaatctccttgtgctattaaaaagcattttagcaagatcacttttacatttcaagctaaagtgtattcagattgtgcattttaaaagaatttctatttctgcagctacctcaatcatgtattgcctgtctctattttatcatgagttctatatacatgacatactttagtccattaaaatcttatggaagagaagtagcatgaaaaatgcacgaagtactctcctttgaaagtgagttgaggaaggtttgtattgcatcctttatgcttcctgtactgtggtactacatagggttagagctactaatggtgttgagccaagtgttgagttatgtgcctgttttgtcaggcagcacagatttaaagagacaccaatgtctggagacatcctctcaaatgatgcactctgcctctattaagtacatatccagtattttaaaagataatgctgctctaaagagccaactaaactttgaaaatagagctgcttgggagaaaaaaggtctcacattagggatgttgaattgaaagtggtatgcctctttaaggttcacttatttaatagaatattctaaattccaaagcagtgcagtgaactattctgtcatagaattgccccttttctgcatgccaaaaaacagaatttttctttacaatttttctgaagagtatattttgaattttccggtcatcaagaaatactcggtcaggcacggtggctcatgcctataatctcagcactttgggacgctgaagcataggtatcatctgagcccaggaattcaagaccagcctggccaacatggcaaaaaccatctctgctaaacatataaaaatcagccaggcatggtggcacacacctgtaattttagctattcagatgactgaggcatgagaacccgggaggcagaggttgcactgagcagacattgcaccactgcactccagcctgggtgacagagtgagactctctcaaaaaaaaaaaaaaaaaaaaaaaaaggaaagaaacactcttgatagtcagcaaagctaagataaattggttcagtccaatttcttagtattaggatgtcaaaatcataatacaaatatatatttttatgcacacatttcacttttaatttatgtgggtatacagtaggtatatatattttggggttacatgagatattttgatacaggcatacaatgcttagtaatcatatcaggataaatagggtattcatcccctcaagcatctatcctttgtgtttcaaacaatccaataatacacttctggtcagtttaaaatgtacaattaattttttttttttactatagtcaccctgttatgctagcaaatactaggtcttatttattctttctaatttttttttatatccattaaccatcttcccttccccccaacccccactaccaactacacttcccagcctctggtaaccaaccttctactctctatttacatgagttcgattgttttaatttttagctcttaccaatgagtgagaacatgtgatgtttgtctttctgtgcctggcttatttcacttaacatgatgatctccagatccatccatgttgttgcaaatgacaggatttcattcttttgtatggctcaataatactacgttgtgtacaagtaccacattttctttatccattcatctgctgatggacatttaagttgcttccagatattggctatggtgaatattactgcaataaatgtgggagtgcagatatcacttcaataaactaatttcctttctttggatatatacctaggagtgggattgctagatcatatggtagctctatttttagttttctgagaaacctccaaactgttctccgtagtgttgtactaatttatgttcccaccaacagtgtatgagtgtttccttttctctagatcctcactagcatttgttattgcctgtcttttgaatataagccatgtaaactggggtgaaattacatcttattgaagttttgatttgcattcccctgatgatcaattatgctgagcacattttcatatgctcagacttatatgtcttcttttgagaaatgtcttttcaaatcttttgcccattttatgaattgggttttttttattttttttcctacataattgacttctttatatattctgtttatcaatcctttggcagacaggtagtttgcaaatattttctcccattctgtgggttgtctcttcacttgtttactgtttcctttgctgtgtagaagctttttaaattatcctatttgtctatttttgctttagttttctgtgcttgtggtatattgctcaagaagtctttgcctactccgttgtcttgcacagtttccccaatgttttcctgtagtagtttcatattttgaggtcttagatttgaatctttaatacattttgatttgatttttatatggcaaggtataagagtctagtttcacttttctacatgtagctatccagttttcccagaactatttagtgaagagactgtcctttctttgatgtatgttctgagaatttttattggaaataagttcattgcagatgtatggatttatgttggaggtcctctattctgttccattggtcaatgtgtctgtttttatgccagggccatgctgtttttatcactgtagctctcaagtataatttaaagtctggtaatgtgattccaccagttttgttctttttgcttaggatagttttggctattctagctcttttgtgatctgatataaacttaagaattgttttttctatttctgtgaagaatatcattgttattttgatagggattgcattaaatctctagattgctttggatagtatggacattttaacaatattgtttcttacaattcatgaacagggaatatctttctattattttgtgtccttttcaatgtattgcatcagttttacagttttcattatagagatatttcatttatttggttaattcctaagtgttgtattttatttgtagctattgtaaataagataagtttcttgatttctttttcagattgttcacagtttgcatataaaaatgctactgatttttgtatgttgattttgtatcctgaaaatttactaaatttgttcatcagttctaattgttttttgatggggtctttagattttcccaaacataagattatatcatctgcaaacaagaaaaagttgatgtcttcctttccaatttggatgccttttatatatttctcctgtctgattgctctagctaggacttccagtactatgctgaaaaatagtggtgaaactgggcattcttgtcatgttccagatctaggaggaaagactttcagtctttccccatttaatataatactagctgtgagttcatcatatgatttttatgatgttgagttatattccttctatacccagtttgttgagaatttttatcatgaagagatgctaaattttatcaaatgctttttcaacatcaattgaaatggtcataggtgttttgtccttcattctgttggtataatgtatcacattgacttatttgtgtatgttgaatttgccttgcatcccagggataaattccacttggtcatgatgaatgaactttttaatgtgttattgaattcagtttgctggtattttgttgagaaattttgcattgatacttaccagtgataccagtctataggttttttttttcttttttgatacgtctttgtctatttttggtaccaggataatactggcctcatagaatgaatttggaagtgttccctccttctctattttttgaaatagtttgagtaggattggttttagttcttctttaaatgtttggcagaattcagcagtgaagccattgagtctgaggcttctttttttttccctctggatgcccatttattacagcttcaatcacacattatcgatctgcttaagttttgaatttattcatagttcaatcttgataggttgtatgtgtctagaaatttgtccatttcttctagatattccaatttattggcacatagttgctcatagtagcctctaatgatcctttgaatttctgcagtgtgagatgtaatgtctcctttttatgtctgattttgcttatttgtgtactctctttttttcttagtctggctaaagatttgttcattttaactttaaaaaaacctttttgttctattgatcttttgtattgttttcttcatttcatttatttctgctctgatctttattgtatttttcttctactaattttgggtttggtttactcttgcttttctagttccttaggatgcctcattaggttgtttatttgaagtttttctttttcttttttttttttttttaatgatttaggcacttatagctatgaagtttcctcttaggattgcttttgctgtatcccataggtcttggtatgctgtgattccattatcatttgtttcaagaaatttttcaattcccttcttaatttcttcattgacccatgggtcattcaggagcattttttttgtgacctaacatatggcctatccttgagaataacctatgtgctgaggaaaagaatgtgtattcagtcattggataaaatgttttgaaaatattaggtcgatttggtccacattgtaaattaaatccagtgtttctttgttgattttctgtctggaaggtctgtctagtgctgaaagtgaggtgttaaagtctccagctattattgcagtgaggcgtatctctctttccttacctctcataatatttcctgtgtatatctgggtactcaagcattgagtgcacatgtatttcaaattgttatatcctcttgctgaattcacccctttatctttatatggtgaacttctttatgtcttcttatagtttttgtcttaaaatttatttttttctcatatgaatatagctactactgctcttttgtgatttccactggcatgaaatatgtttttctatccctgtgttttcaatctatgagtgtctttataggtgaagtgtgttgcttgtaggaaacaggttattgcgtattatttttttgaccattcagccactctgtcttttgattagagaggttagtccatttacatgcagtgttactattgataagtaaggacttactcctgccattttattatttgttttctggttgttttgtggtctattcttccttctttcctttcttcctgccttcctattagtgaaggtgtttttctctagtgatatggtgtaattttcattttttgtgtatcccttgtaagttttttgctttgaggttaccacgaggtttgcaaatactggcttataaccaattattttaagccggtaataacttatcactgtttgcaaacaaaacaaacaagtaaaaagaaaactagtaaaaaatctacatcttaaatttaatcacctcctttttaactttctgctgtttctatttatatcttattgtactgtctatgtatttgaatgttgttgtagttattattttttattggttcatcatttagtctttctgcttaggataagagtagtttatactccacagttacagtgttataatattctgtgttttcctgtgtacttactattaccaatgagttttttacattcaaatgattatttattcctcattaatgtccttttctttctgattgaagtattctctttagcatttcttgtgggacaggtctggtgttgatgaaatccctcagctttctttgtctgggaagcctttatttctccttatgtttgaaggatattttcaccagatataatactctatggtaaaagttttttttcattagcactttaaatatgtcataccgctctctcctggcctgtaaagtttccactgaaaagtctgctgccagacatattggagctcctttgtatgttatttgtttctttctcttactgtttttaggatcttttctttatccttgagctttggaagtttgattattaactgtcttgaggcattgttctttgggttgaatctgcttggtgttctataaccttcttgtacttaaatgttaatatttttctctaggtttgggaagttctctgatattatccatttgaataaacttcatacccctatctctttctaccttgtctttaaggccaaaactcttagatttgcccttttgaggctattttctaaatcttgtaggtgtgcttcattattcttttttcttttgtctagtctgacgtatattttcaaatagcctatcttaaagtttactaattctttcttctgctagatcaattctactattaaaagactcatgctttctccactgtgtcagttgcatttttcagctccagagtttgtgttggattctctttattatttcaatctctttgttaaatttgtctgatagaattctgaattctttcttggcattctatttttttttttttttttttactttcctcataacagctattttgatttatctgtctgaaaggtcacatatctccgtttctccaggattggtccccggtggcatatttggttcatttgctgaagtcgtgttttcctggatggtcttgatacttgtggatatttatctgtgtctggccattgaagagttaggcatttattgtagtttttgcaggctgggcttgtttgtaacctgcctttcgtgggcaggcttttccaggtatttgaaaggacttgcgtattgttatctagctgtatctgctttaggggacaccccaagcccagtaatgtagttcttggagactagtagaggtactgccttgataatcttgaagaaggtctgaaagaattctctggattaccaggcagagactcttgttctctttccttactttctcccaaacaaatggagtctctctgttctgagccacctggagctggggatgaagtgacataagtaccctggtggccaccaccactggaactgtgctgggtcagacctgaagccagtccagcagtcgatctcacctatggcctgctataaccacttgctggtgactgcctatgtttgctcaaggccctggggctctacaattagcatgtggcaaagtgagccaggccagtgtccttcctttcagggtggtgagttcccctagggcctaggcggatccagaggtgccattcaggagccagggactacagtcaaaatccttagaagtctacttggtgttctattgtactgcagctgagttgacactcaaaccacaaggcacagtccttcccattcttccctctcctttccaaaggcagaggagcctcaccacgtggccactgccaccacaagcccacaggtagtactgccagtctactgccagtgttcccttaaggcccaaggtctcttaagttagcttttggcgaatggtgcctggcctagaactcacccttcagggcaatgggctcccttctgtccctgggcaggtccagaaatgctgtcaaagagtcaactcctgggatcagggaccccaagagccctcttagttctctacacctctgtggctgagctggtacctaaggttcaagacaaagtctcctttacttttcatagcagatgattaatcctgccaagactgggtctttcccttcaaggtagtgggttcctttcttgcccaggatgtgtctagaaatgtcatacaggagctagggtctgaaaagagggcttcacaactatgaccagtgccctattctcctgtggctgagctggtatccaagaagcaagaaaaagttctccccactcttcctccttctctcctaaagtgggaggaaggtatctcttatggatctgcaagctgtgcagcctggacttaggaaaggggtggcatcaacactcccctagcactctaccccagctcacattttagatgccacatattctccaagtccactatctctgagcccagttcaacacaggacttgcctaggagttacagtccttgtggcctagactacctttcaagtttatttagggccccagagcacttgagcctgtggtggtgaggctttcaggaattcaagttctgaccactgatatggaagatttccctctggctagggatggtttaaatattccctccgggccgggcgctgtggctcacacctgtaatcccagcactttgggaggccgaggtgggtgaataacctgaggtcaggagttcgagaccagcctgaccaacatggtgaaacatcgtctctactgaaaatacaaaaattagccgggcgcggtagcgggcacctgtaatcccagctactcgagaggctgaggcacaagaatcacttgaacccaggaggcagagattgcagtgagccaagatcgggccattgcactccatcctgggtgacatagcgagactctgtctcaaaaaaataaaaaatttaaataaataaataaataaattccctctgtgggtgggcatcagctgaatttggtctggttttgctttcttctataaccaagcgacactgaatttaatgtctcacaattgttgcactctccctctcccaagcaaacagattttctcttctgtgttgtggggccactgctggggaatggaggagcggtggtctcagtgattcaagactgtttttcctacctcttcagtgcatctttcagcaatatgaagtttaaaccaaatactgtgagtgctcacctgatttttggttcttacaaaagtgagttttatgtgtagcagtgtccttgccaaggggacaatcagtggagccttctattctgccatcttgctctgccaccatctcctatatttaagctatattttcttacaagttttagttagagattagatagattgataaataaagatagacagccctgtgtttaatttttgaaatctgttaatatcatcaaaccaatatataaatttgggatagcataatgtaaatactttctctattatttaaaaagatgacactcaggacaaaaaaaatcacatttggggaaatgaatctgaaatacacactgtgggtgaaatggaaaaatacataaagtaaatacagcattgtcaattttgtcatttaattgaattttaatattctatacgttacatgttcttaatacggttgaaaaataaatgaaagggagaaaagatatagttaactacgtaacttgtcattcagaaaggtctgatcttctctgtagtataaaatttcaattatcttcaaagctactggtataaatctcaatatttgcagtttatttcaaattttaatgaattatatatacacacatgaataaatatacatatatgcttatgtgtgtatgtatcttttaaagaaaaagaaattgcacctataatgaaaggttggagtttcaacctggattaacgttctactgtgccacttaatagcagggtggacataggcaggaagtatgtcatttaaggcttgaatttctcactcataaaatggggataccacaacctactccttttgaccattctattaaataagattttttaaatgcatgtaaagagcttagcatagtgcctggcacatgataaatgctcaatattattggaagatattttattgtatcacctccatcattaatttaaatgagttattactttattaaatggaaatttacaaactagtaatcatgaaaaagtatattttttcatattgagaaaacattttcagagttaaacacgtttgttgatacagtaagaaccctacggtctcttgacttgcagctctgcagtcaacttcccaagataccctcactgtgagaagtctccactgcagacagccagcgttccatcatgccctatcatccagcccactagaacaacaggagagtcaagagaatgttttagcacatggcacactccacagagcatgcatgccttctaaatcatccttgcaaacccgtggctggccttcccatgatgccttttcatcttatctaattagtactatttctcaatatgtagccattttctttggttcttgtagcacagacaaggcgaaaggagtagaggaaaagaagtgttgaatgaaagactatgctaacacatttttccacacattcaaatgtctttgctttctagttatttttttcctacactgtattccgtcccttcattctcttctgactcaaatggaaaattatacacatatttctggccacaaaaggaaaaatactgaggagccaagatggccgaataggaacagctccggtctacagctcccagcgtgagcgacgcagaagacgggtgatttctgcatttccatctgaggtaccgggttcatctcactagggagtgccagacagtgggcgcaggtcagtgggtgcgcgcaccgtgcgcgagccgaagcagggcgaggcgttgcctcacttgggaagcgcaaggggtcagggagctccctttccgagtcaaagaaaggggtgacagacgcacctggaaaatcgggtcactcccaccctaatactgcgcttttccgataggcttaaaaaacggcccaacacgagattatatcccgcacctggctgggagggtcctacgcccacggagtctcgctgattgctagcacagcagtctgagatcaaactgcaaggtggcagccaggctgggggaggggcgcccgccattgcccaggcttgcttaggtaaacaaagcagcagggaagctccaactgggtggagcccaccacagctcaaggaggccagcctgcctctgtaggctccacctctgggggcagggcacagacaaacaaaaagacagcaggaacctctgcagacttaaatgtccctgtctgacagctttgaagagagcagtggttctcccagcacgcagctggagatctgagaacgggcagactgcctcctcaagtgggtccctgacccctgacccccaagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacacaacagaaaaactggaaactctaaaaagcagagtgcctctcctcctccaaaggaacgcagttcctcaccagcaacggaacaaagctggatggagaatgactttgatgagctgagagaagaaggcttcagatgatcaaattactctgagctacgggaggacattcaaaccaaaggcaaggaagttgaaaactttgaaaaaaatttagaagaatgtataactagaataaccaatacagagaagtgcttaaaggagctgatggagctgaaaaccaaagctcgagaactacgtgaagaatgcagaagcctcaggagccgatgtgatcaactggaagaaagggtatcagcaatggaagatgaaatgaatgaaatgaagcgagaagggaagtttagagaaaaaagaataaaaagaaatgagcaaagcctccaagaaaatatgggactatgtgaaaagaccaaatctacgtctgattggtgtacctgaaagtgttggggagaatggaaccaagttggaaaacactctgcagaatattatccaggagaacttccccaatctagcaaggcaggccaacattcaaattcaggaaatacagagaatgccataaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaaggaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccgctgcaaaatcatgccaaaatgtaaagaccttcgagactaggaagaaactgcatcaactaatgagcaaaataaccagctaacatcataatgacaggatcaaattcacacataacaatattaactttagatgtaaatggactaaatgctccaatttaaagacacagactggcaaattagataaagagtcaagacccatcagtgtgctatattcaggaaacccatctcacgtgcagaaacacacacaggctcaaaataaaaggatggaggaagatctaccaagcaaatggaaaacaaaaaaaggcaggggttgcaatcccagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtgcttagtgacctacaaagagacttagactcccacacattaataatgggagactttaacaacccactgtcaacattagacagatcaacgagacagaaagtcaacaaggatacccaggaattgaactcagctctgtaccaagtggacctaatagacatctacagaactctccaccccaaatcaacagaatatacattttttttcagcaccacaccacacctattcgaaaattgaccacatacttggaagtaaagctctcctcagcaaatgtgaaagaacagaaattataacaaactatctctcagaccacagtgcaatcaaactagaactcaggattaagaacctcacccaaaccgctcaactacatggaaactgaacaacctgctcctgaatgactactgggtacacaaagaaatgaaggcagaaataaagatgttctttgaaaccaacgagaacaaagacacaacataccagaatctctgggacacattcaaagcagtgtgtacagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttccaaaaattaatgaatccaggagctggttttttgaaaggatcaacaaaattgatagaccgctagcaagactaataaagaaaaaaagagagaagaatcaaatagacacaataaaaaatgataaaggagatatcaccaccgatcccacagaaatacaaactaccatcagagaatactacaaacacctctacgcaaataaactagaaaatctagaagaaatggataaattcctcgaaacatacactctccaaagactaagccagggagaggttgaatctctgaacagaccaataacaggatctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgagggcagcatcatcctgataccaaagccgggcagagacacaacgaacaaagagaattttagaccaatatccttgatgaacattgatacaaaaatcctcaataaaatactggcaaaccgaatccagcagcacatcaaaaagcttatccaccatgatcacgtgggcttcacccctgggatgcaaggctggttcaatatacgcaaatcaataaatgtaatccagcatataaacagagccaaagacaaaaaccacatgattatctcaatagcagcagaaaaagcctttgacaaaattcaacaacgcttcatgctaaaaactctcaataaattaggtgttgatgggacgtatctcaaaataataagagctatctatgacaaacccacagccaatatcataccgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaacaacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacagacaaatggaagaacattccatgctcctgggtaggaagaatctttatcgtgaaaatggccatactgcccaaggtaatttacagattcaatgccatccccatcaagctaccaatgcctttcttcacagaattggaaaaaactactttcaagttcatatggaaccaaaaaagagcctgcattgctaagtcaatcctaagccaaaagaacaaagctagaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctataacaccaaaagcaatggcaacaaaagccaaaattgacaaatgggatctaattaaactaaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaacagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggaatgtaaactagttcaaccattgtggaagtcagtgtggcgattcctcagggatctagaactagaaataccatttgacccagccatcccattactgggtatatacccaatggactataaatcatgctgctataaagacacatgcacacgtatgtttattgcagcactattcacaatagcgaagacttggaaccaacccaaatgtccaacaatgatagactggattaagaaaatgtggcacatatacaccatggaatactatgcagccataaaatatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggaagggggagggatagcattgggagatatacctaatgctagatgacgagttagtgggtgcagcgcaccagcatggcacatgtatacatatgtaactaacctgcacaatgtgcacatgtaccctaaaacgtaaagtataataataaataaataaataaataaataaataaataaataaaaaatataaataaataaaaaattaaaaaaaggaaaaatattttttctacatttgaaaactcaaacgccaataaatagctgtagaggttaaaacaaacaaacaaacaacaacaaaaaaaaggttttttcttctcccgccattgctctccactatgctcaatgtgatcccaaacctcagcctcaaataaatcctaagcacttttacgtactagagcagtcgcattttcaggtatttaaaaattccagtttaatttaattaaaaaaatttaatctcacatctaattccatggtctctcattccttcccagcacagacctgacccaacagctatgatctgtcttttctttcttctttccactttattttgtactttccagcggtgctctggtactttccaggtcagacaagaaggagaaaagcttccacttagatggtacaatttgtggttctcacatgggtgttaaatgttcaacatgatggcgtttatccacatactgctgctttctctcatggggtgcattgagttctttgaagacatcttgccccctagcaggcagccttattgggtgtgatcctaacaaccctattcaaacctatcttcatgaccacttggttcacagtaaccatttcacattcctgggctgccaaaatctagaattataggatattctcaggaactattatttattgttcttcatttgaagtttcctcaagtagctcagtatgaaattgaggtattctagaaaactccgaaactcagtacaaggtgtgataggtaagcatctgaacttctctatagtggttgtcttgctcctgtccttatttaccttgatgaagaaataatatccccacttctctattgacagctggggttggagggagatgccatagcaaatccatcttctaaactgacaaccttgttttaagacagcattacttgtgcatgtatgtatatgagttggaggcaggcaatgagaaagagtcataaaattggtttccctaattcgtagcgagactagttttcttcagccactctcaattcagcatctgagattacatgtgactcattccaagttcagaaaacagtcgtttaatgtcctcttacaatttcttaagttgtacattaccttctgacacctacaaaggatcctgctctgttgacatttgtattttcacagttcttgtccatgatggtgacttagaaaattcccttgagttcaaaaattatggaagagacacaatggaatattattataagatgggctggattagttttatctgggggtatgtgaataggctttgtatatatttcttcttgccttttctttctcccctttttagcaacaaatcttatacaaagattattttacctattctttgcatttagttcattgtggatccatataaacaaagggaatatgagttgagataaataccattcattttgtacactcacctcctatcttcttgactattgccacttacaaggaggtttataaatcagaaaattcttacatttcctgaaatatcctagcaatctctttcagaaattcaaataggtattttgcctagatttccagattgaaacaaactatggcaaaactgaaagcataattcctttggtactaccaaaacaatattattggaatatccaagaaggatattctgtttcaagattgcgtgtgtatagactcacgatgaactttcagcacttctcatagaagacttcaccactttctctttttcgaatctaaacagaaaataatattaagtaatatttattgattataattccgggtactgtgatgaataatcatgaaaataaccttaagaaacaggtataattagtatctccatgagacaatggaaatacacgttaaaaaatattttcagccaagcaattagaggggtagaactaggattcaaacccagatctttcttactcccacttctcactcccacaagaaaacctttaccgtttgtacataccactttatctaccctaataagaataaaagcattatgtaaactcttaaggaaataacactggtttttctgggcgggttgggggatggtgggcaaggggaactccttcaatttaactctttctgtaaactaagcctgagttagaatcaattaattgaaattttcctgtgctacatacttcaatttgagtagaaaaaaaaattattttttaaatgttcctcttgacttctacctttgctatataaactccctcccttccctcttttcattcttcagcacctttctttccaaaccaattgccagataaccattaagctccaaaattgtatggcctgtcccaggtctcgaaaagagctgtattttttaatgagtggggtaagcgcttactgtaatataaattggaaatttttcaggtaaaaaaagattggtaaatgatttcattacattttattttagttaaacgctaattaaagcatattattagtgtgactcactttgttcaacctactgagaagtcctttgatattctgccgtggctaaactaaggtagtacactatatttttttcattctgtgtttacaagaatgctttcaatgtttaagaggaaaagagacatgagtttatatttcaacatgccaggtaagacttaaaacagctaggcatttgtagcttgtggataaagtatcaattacattatccactaatggatgagctttgctcagaaagaaattcagaagaatcagacttaaacctgctaaccatatgtataaacttgattctctaagctaatatgctcaagacatttatcagtagttgactgaggaagaagagtctagctgcttaatcctggattcaaattttattaattatatttaaaatatattttgttttaaagtaaatatgtatttctctggactcagcaaaagcatttattagatatttgattatattaattttgtgcttctagcaagaattatagaacttttacaccataagcgctccgaaagattaagtcaaatcccttcagatcaggaatatgttgttttataaagggatataattaaaaccagtggactccatcagtgcagagataataactgtgtgccaccaacttgaaaagaaaatgaatgtacatgggtttcgctgattagctgcatgtaattaggaaatttaagccaattggaattagagtacccaattcaaacactgtgcccatgacaacaaaacactgcgtgagctgcagctattacagcctaaagttttccattagtgaatccgattatatctagtaaactttttttaaaatttgagtagctgttacttatacacatatgctattaaaacatggtgagccataatgcctctcttgtcagttattgttcattaaaattggaggtaaggtaagagaaggatgatcttatttctttacattaagttgaagatgggctatcttgtcttgaaaataaattagcagcagtaagaaaacctcacggagctgatttcaagtagtaaaacaaatgtttttaaaacttagatcattagttgaaatttgaaatcacatactttcaaaaaatgaattaaatagaagtgaatcaaatcatagaagaaagccctcttttgctttcttagtttctcaaaatggaaattttccccaaaatgttcacttgtttttttttaattttttactcacaaagttaaaacttttaaaaatctaaattggtaaattgtttttttaaaaataaaagtatcaatggatgtgaaacaatactaccaaagcttcaacagttttgatttcaaatagttactttgttttattctattaatatcttttaaataggcttctagatgttgactagagagcctagagcctactctaaaactgtaatctagagtttctgagcatcctttttttttagatgatgttttagggttgaacaaagtagaaaaggatcttcaatgcctagtctttccacagaaacttatgatcataggaatgatgtcctcaaagaagaggattcaaagccctaaatttagagtacagatttagtccaatttaatagacaaagtactgggtctggtatacattacccataatgttatttaaatgtgagttttcagagataaatgtgaggagtgtatgtgtgtatgtatgtgtgtgtatatacatttaaaaaaacaaaaatactaagagaagcagtaatggcatgatatcactaaattattaatatattttatccactatttatttgactatgctttgatggtcacaatattcagaagtctgagattagcaaaaaaggcaatgtttgaaaatttggatccctgtccttttacatatacagttaaactagctccattcttgtgtgtcttacccgtaacattgagcagaaaataaatttagactaatactacataacagtggtttttcagacatggttataaggcatactgatatctcacagtctgttacatgtggcaacaactatgactactaatacgtaactcaataaatgatttgtttgctgttcatataaattaggtcatatttacagttattgctctaattgcatcatttttctcagttgaattccatgtgatttcttgaatgagagaaaaaaagggtatccaattccatgcaattctgagggaatccgtgagatgaactccacatatgaataatcctcagtatgtatgtaacagtgaaagaataaagattggtaactgctgctgcataatcctatattggtagcagctgcatgtgcctgagcaagagaattgtgttcatggagaaaagggccaaacgatactgaaacgtagaccctgacaaaggaaggttatttatttcaatggagccaattatatattcacaggttttgctcaccctcttttctggcccaaggagaatttgttttcttcctttccaggagtatataaattccacttcagtttttctggtgtataaaaggctgtgtgaatacctaccagtaattaatagcctttcattccaagtaagtaatatataggagtgaatttattgtttatgagtatatcaatatcgtttaaaaatgatatgccggaatagaaaggcaacactgaagtgtaaaattgttaatgcaggctcatagcctgtaaaatgatttcttttaatagttttcttcatttaaaagttcttcatttgaaaatgttccctttcaactgcagatttcatggtttggtgcaatgaaggggaaatttattcctttgacacatttattcttttaatagttattcatttgaaaaagtttcactggttgcctataaattttgcagtttgcagagagattcattcttgacagattttttaaaatgtttattcatttaagtagtttctcactccatggaattgttgctaaggtttaacaacaacaaaagaaatgtactgaagcttcctgggggttctggtaaggcagtaatgctaatcttgacctgtggatttttcagtggctctgcaagccccgggataacaaaaaagagtcacgtcattagcaaagaggataacagtgagcaattttaaggacaaaatttacctaatcattattagatgttcttagctatagtgttaattattatttagaaatcactaccacagagcattttcaagaggcatggtgcaataagtggtcatgaaaaaaaaagtgtatcaaaatctgccacatagatttgaaagcagggtgtttctgtcaccaatattttgttttaatctttaatatgaccattctgacttcaaacaaacttctgacttatctcaggattttatccaacgtaggttgggagtttttttctcctcactctccacccatttttatccacagttccgaagacagcacccaccaatgtaagcggaagaagtggaagaaggcatgagttagtcattgcctgggaggtaagaaaaacacatcctctcacaaattactccacgtgtttgtttggcttagtgtgatatttaattattttatgattaagcagtccacttgattcatttagaggctaaaaacagtgggaggaaggaatgaaccactgctgaataaatgccacgttaccctggttatctcatttaacccatacaacaatcttatcagttggaatgattttcttcattttacaaatcatgaaactgaggcactgttacatattttcctaataaacagaattgtgactttgattacaaaatttgtgtcattttatctatctcatcatatgcctccaaagtatcatttgtcaaggaaaaagagtggagatgaagggggagggggtgtgaagaatacatttattttccatgaagccaccttccttttttgatgttaaataaccttattattaaatgtaaatagctcacagagatcttagaatatatagaaatggaaatgcctgttagagtaaatagagcaactccttgacaatctctaagaacaatgagaaagtatacagagatctctttttccagtaagaattattccatgagcacataatctgtcctattttttttgtccattcccccttttcttcgataaaacttcatatatttttttgatgtctacagaggtattaactttccaatagctgaccttcactgagaccagatctctctaaatggaattgcctttccatgtaagctttaatataacgggctttgtttctttgccaccactcaatacatggcttttcttcatatcaaaattcaaggaaaaaaactacttagcaaatatttattgagtatctagtgtgtgtgaagcactgtgctagacagtggctggtaacttttccacattgactggtcaatcacaattactcctttctatggtgtgcagttgaagcccatgtaaccaatttaaatctaagccatatagcacaagaagcttcttgaataccatagtccaactttttcatgtcagtaaccataaaagcaattgcaaagcacactacaaaaaaggttttaacatcattatatcttacttttgtggtctaaagggttctgcagagcattaccagtgacaagatattcccgaccaccagaccataggacaattttccccaacatgttaatccaaagatcttcatttcatatacatgactaattggagcaaatttgtttcacttcaaaagttttcaattctcttgagagtttttgtacatttcaactgatacaatttttcttcttttacctttaaagctttttaactttcaaagaagtgccaaagtgattgtactattttggcttccaatgtagtataaagatttgagattctccctttctctagctatctataattttttttaattaagaatttggagaaagtggatttttaatcaatcattttgctgataattaattatatttttcttctttagccagtatctgaagagtttcagaatggggaaggcttcggctatattgtggctttcagacccaatggaacacgtggctggaaggaaaaaatggtgacatcctctgaagcttccaaattcatttatcgagatgaaagtgtccctcctcttactccctttgaagtgaaagttggcgtttataacaataaaggagatgggccttttagtcaaattgtggtcatctgttcagctgaaggaggtcagtttttttattcctattatttttatttaacattttactttgttatacaaataatcagacacctttgtacacatattagaaaatacaaataaggcaaaataaactcattcataatctcactaaactttttggatatatatttcccaaactttttttaattttttaaattaaaagttgattattccacatatgttgctttaagtttttcacatcctaacaatatatggcaaacatatatccatgaaaacaacaatatcagtaatccctgcagtgtattcctttctctgggtggacattaagccaatcctctttggtttgaaatttagatacttttatatttttcaatatatatgtaaagtagatttaaataaatgcttcatttatgtgacaaataaatatttatttctaaccctatgcataaagcactgtactaataaggaagtttcagacagggctttttcttggaaccttttcaaacacatcattaaatcctatggaaatcttatgaaatagacattattgcctccgttatgtagaaagagaaattgactttcggaaaagttaaagaacgtgctaaaggttacactgcttgtaactgagaattaaatccaggtttgtctaaccactaactccttgatttttgtataacttgctgccttcatatgcatgaccatgtttaattcacaagatagaactcataggtaggcagtaccgagtagacaatatacctattttacagatgagtaaactgtaaagtggttatactcaatacatgatagagctacagtggaaaccctgcttcctacatcaaagatactgaattatttcaagttttaatataaaaatgcaattttctgggtgaaagtataataatagatctagccccctaaagttagcttttcctcttagtccttcttttattcaaattcaggatttcagttaaccttacaagtgggggaaaaaaatgagaaaaggaaaagacagccttatgtttcttaaatttacaaatgactgagaaaatgttctaccaaaggcagcattcactttccccataccaataagtgtggtaaatataaactaacccttatacttcctctgtgcccacatgtaggacttgaacagctcaagagtattattcataattaattattatatccccccatgaagctatgagcttcacgggggatataaatatagtcatgtgaatatttaaaaacaaagataatgtttgatttaaggaagatgtagtttttcaatagtaagctgcctcatatttttataatatagagccaaattttaaagcagaatcagaaagtttatcttagcataagaataaccagggaagtgaaaaatcaagtaatggcaaggaactagaggtattctgatgagataccaattgcacttagcatctcagatttctgatgtgttttcagataaagtccatataccatgttacttatgttatctaatgtaaaggttaaaaccaaatatgaaattggaatctcaaaccttaatctacatttcaggaaactgagtctcagagaggttaagtaacatgctcaaattcacaccagtaagtgacagttacaagaaatgatagtaagtgacagagctaggattttaaccaggtctatatgactggaaagcacattttttaactactacactatactgcctcatcaggaatgtacacaatagtgatattttctattatttattgctcaaaagatctattttgaagtatatgtgttattcagaaagtacatattctttttccttttaaaatgttggaaactaattatcaattacatagcaccaaaggtcgcatgagagattaattggagaagtttttgaacacgctttgtatagtaacaacagtgctgcctttaagaaattcagctttgtaatttctttgtcaatctttgctttgaaattaatttatagcagccaccatgggtttttttacattgtgttttcttaaacttgaaatggcttgcctttggaaatttctctttcaagctagatagaaaatatgcatattttcttttaaagacactgaggttattcctgtaacatatttcatagtaatgtaacacttcatttattttaatcaactgaaatatgaaatatattaggcaaattaaatctggatagagtcctttgttctgacactgaaattcaagcatatatttggcattcgcttactaattaagtttacaaatgtggaactttatatgtaaatatgagtaaagtgttagcatcattagagtgtgtcaaccaagaaaggcaggacaagggaaaagaaaagcattaacctgagctcaaatctgatcacactaactagaccatcttgggcagtttattcacctctctgaggcttagcttcctccactttaaaaatgaaggtctcaaaatagaacatctctggaatcctatacaaatctaaaattaaaaccctgtcaatttattctatattctaaaacattattttagctggagcagtggcttatgcctataatcccaacacattgggaggttgaggcaggaggattgcttgagcccaggaatttgaggctgcagtgggctatggcaatgatggcttcactacattgcaaactgagtgaaagagtgagaccttgtctcaaaaaataataataataataagtggattaaaataaaacattctttgtaacaattgtcctaacatagatagcaataatagatcaacttttgctatacaataaaaagggaaaatcaacattcttttttagtcacttcgcaatttgctttacttaaaaaggagtgagcatttcaaaaattaaaccattttaaaaaagagtaaaggcctgaaataaacttgtaaaataatatattatactcttgccagtgcaggtttctcccctcagtgtctatggatgttcatacagcttcacagtgtgtcttttatcattatactcttgcccaaagcccaactaatctgagcgaaattgtatttctccaaaagacaaatcctgcttccttattcttccattaacccaatccacttgtttatcaccttgaaattcctccacattcttagatacagtaaagaacaagaggagtgagactgccttactatttctgtttatgggcttagttcctcctcttcctttcaagcttaccagatacatgccttaagcactgtgaaaaagccaccttttcacagccgacaccaagctgggaagaaaaatgtcaaatgcagctaccagaatttatgttattgggagggaagcagagaacagaaaaacttacaaggcacaccttacagtactacttctcaacctatttcccaatggaacatggataatagatgacattcatacccagaacatgcttttataagtgtgtatgtgcattctccactctatccctttcttttcctcccaataaagcgtatcagaatgcaaataaaattaattattttagagaaaaccttgaattgacatgtttttcaaagaaaaaatcatttgcaaatgttgatgcttgatcaataaatcacttgggatatgaccttaactctcacaactctgaggtttactattgccctagagtactgtcagaaaaagtttcaaatggtttttctgctaacacccgtaagcctttgaaacctttcaatgttgccacaagagaagcaaaccttaatgactctgtcagtgccaagcagcatctgacataagccctggaaaaagagatatttgcctgccaagatatccatgtaccctgtacatgtgtcaaatatctttgtcctttaaaccgagcaaggtttatgtgcattcctaatcctgacttcagacctctagggtatgatataattctatacaacacgctaattttggaaacaattccatttttaaaaaaaaagaatagtgaagtttcaaaataagttctcaaaatgcatggtaaaactgataaaaattaatttttttccaagataaaaaattaaattggctttttcttccacatttcaagaaataatgaatactcaaacataccattttccacttagttcttctcaccataacttcggaaatgaaaagaactggagcattcaattaaacctaatagaaaaacagaagaaaaattgatacagttaattataggttgaaagatttatttacttgtgatgcgctttatcctttatcctttatcctttctagttttcttggcttttgccttatctgtaaaaaaatgtcctgctcatatatttattaaacctaaaaagcctgtcctcatttgcagaatataatagacaattatctcattgcaagtggagctaccacagctcaaattaaaacctaatattcctaaggtgttattctccagatccatccttagctgaaactgagctcactgggatttatgtgaacttgaaaattaataaattgacatgttagttgtaaaatacaagaaataatttcctgtcttttccagatgatctatttggattagtgcctataaaagttcaactacagctgtcttcactgaatttttaaataatgaaaccataccctttctctcaaggagtttattaaagtctcttttgattaatgctgttgctctaagggtctcttgggaagggatctcttggaaagtcagatgtataatcaatattacaagcacatacccccatattacatgaagaactccagctgctaggtcacttaatacaaatgtatcatcgaaattcatgaacacggtaatgctgttcaacatttttaatctatcagaaacaaacgtatcaatcaacctgtccactacatatcccaagattacagtgaaggagttagccatggcctaattaatatcatcacaagtaacagaaaaaaaaagaggtttccctctaagtctttgattccactagatataatgctagtacagtctcagaaataagtttctaaacttttattaaattaccccagtgtaatagatgggagtgagagtggcagaaaacatactgtgatttagagatcagaagagttttagagatgcctgaatgtgacatgactgagaaggagctgtgcagctatggttcaaaattaccaaggagtcagtgaaacaggaatcaaaggagttaatagtgagcctgtggcagggttaagtgggtgatgacgggggtctagatggtttctggcaagatctagaaatagcccaaatggggagcccaacacaaacattcttgagagaagttagatgtggagtggcaaggggaaagagagaaatagaaaaggaaaaagcatcaggtaagtgtaacatagacataggcacagaagcagaacagtgtagtgctcagggcctgactacctgtattcaaatcctccctccacatttaagcagctgtgggatcttgagtaagtagcttaacctctcttctgcttgatttcttcatctgaaaaatgctagtagtagtaatatggttgttgggaagactaagacatggaaagaattaagaacagggtttggaacacagcagagcctcaataaatggcaattattagtatttcgagttatccccacatctattttgcctcttttttgtttacttctaatcttattctatccattcctctgtcagttatttggaagcaaccaggcaacaaaagagggaactatctatgttttctgtaaaacttattctgtgacttaaaatggaccctaggagatgaagaatgagccagcctctttctttatgccaatttaaaaacagaggaaagagcatttgagacccaagttctagctttttcacagctgaaagtagagtctggataaattaacctctgtacgttttacttttctaatctgcaaaatgagagcatggatttaaaacaggtccattactccaaagcacataggagtgaggtaagaaataaaaacaataaagtactccttgtgtgagacaattgtgagtgggaggaactctggcatatgtagaagcacatgcccagactgagggagtccaccactaaccctcatcggccaacactcaagaattcaggcttcatactgtctccttttatcccccaaaagaagccagaaattcttattttcaaatgttggcttaaattaatctaacacatgatgtagacaaacaaaatatgactaaagacccactgcccctgcatttgtgactttggagccaagtgacttctagagtcctttccatttgcaactttccatcattcagttacaatgggatgcccaaagcgaatggccagtttcaatgcaagccagatgttctgtgatccagttagctacttgtgtctgcagaccaatttttgacccagttgaaaatgttcacttgggtataaatagtacatactaaaatttctgggaaaatctgacagaggtcactatttttacatgctgaaatgtctaattcaggtcaacatagatcaacttctgataccattcagggatgttcaatctttggcttccctgggccacactggaagaagaagaattgttttggaccacacataaaatacactaatactaacgatagctgattagctaaaaaaaaaaaaaaaaattacaaaaaaaatctcgtaacgctttaagaagttcacaaattttggggggggcacattcaaagctgtcctgggccaaggctggacacacttgattagattaagagggtgaaaaaaaattaaaatgattcttcagttcttgtttgattgattcactgtcattcagttatatgaaattataacatgcagctccccaaaatgcaaatgtgaaatgtaggtgtggtatgaccctgatttaaaatccttagagcttttaaataaaagttaaggtgcttgtttgagaggcaggttcctgaacatttttatttactttaacatttttttaaactttctatttgagaaatacttaaacttgtacagtactactgaaagttgatagagaaataattcctttctttggagataaagagatatggaaaggttgctaccccaccacatgttttgtgcttctgaaattatttatccccctgcaatcttctttgacaaagatgtaattgcttcagcaatataaaagctgaaagaaggcatttggcacacaaatctctgtaatgcatttattctgaagagaagtaaaactgctacggaatagcaaacgatattcaaagtgtggtttcctttcaaataaactgtatcctaaatcccagagatcaagttgtacacacctcagaaacatcaacattctttcatttacttgcaaaatcaagaattttaactcccactaaatagcatggggaaaatgtccattgcaagtctggtaatcagaattctagaataagatagaagatttttccagaatgcatgttttaaattggacagatgcacaaataatagggagttggaaagtgagatgagggaaaccacggagcaaaagaaaataataaaaaatattcaaaaggtgacagaatgagaaatttcaacttataccatggcaggaattaatgtcagcttctgtgtaaaaattaatgtgaatttgccaaagcactttgagatgacacaattatagcaagtgtttttaacaaaggtttggccaaaagaaaatcattgcttggtgcaaaggtggaccaaccaagtcttttgcaggctccttttgcagtaacagggtagatatttttgactgatatatttcaattaataatatataaaagcgttccagacacatgtatgactagcttctttcagaaaaggaaagacctcagaaaatgattatgtcttcaatgttcgcctcttaacatttttatttagaactcaatctttgctatatggttccataaattgaaaaaaaaaattcatagatgaagctcaactctaatcagtgataaagggttagtaccaaaatctgtaccatttttatggggtagaattttaatagactttgtacagaactgtttgaactaatgtatggcctttattctgccatttcatttaacttgtgtttgtgacacagtatttatgattcagccatgtcaacactagaaatattttgttcctcacatcaagtgcagcctcgaataaagtacaccttttgatggatgccagtcagaaattgtgtatttcaaaaaaaaaaaatagtgtgaaaggtcactgaatgtagaaacaaatgaaaaggtggttttgagccacggcactgaacccttcggggacttttctttcccacctgcacctgtcttaaaagtcaatgcatgccttttaaatatcatgattcataacatattccttatataatcatgaaaatgtagtcttgtggttggaacaacaaaaagtatctaatgaaatttagatacacagaataaaaatttagatgcacagaataaaaaataaaataataataatatggtattttgtgaatgaacatttttaacgccaagcacagtactaaatattttatatatacattctaattaaagccaacctttaaatctatgagataaatactctcattatagtcatgttatagatgagggaactagggcttagaaagagataaaacaacttacccaaaggtaaataaatagctaaataaatgttttaaggccaaaagcaacagcagtgcaacaacaaaaaaaagcaaacactgactccatagtccatttttataggaattatgctagactggcagaaaatttaagttccccagaaatgtcttagctaatccaaggattaatgtctttgcctgtcttgctagatttgtcatttgtcattggtaaggtattgatgagatttgacccaagtatagaaatccaaaaggatcacctttatattttgttgtgttttttataactaccacagcacttcatttcaaaaataaggtaagaggaatttaacacctgacagactcaggcgcaatactttgatggacataaactttttataattgtggtttattttccttcatacagaacccagtgctgctcccacagatgtcaaggcgacaagtgtgtctgtgtcagagattcttgttgcatggaaacacattaaagagagtctaggaagaccacagggatttgaggtatgaacagaatgattgaaaataagccttattgtttcttctgacatcacattctcctaaagagaggttttggtgacacctcagaatttcaacagaatttcttagaaattttgctctatgttaaagaaactaagaaatactattttactgggatgtgttatgttgctcattaactggtttatttttcagtacagtagcttccgtagcactatgcaaagatgtttttaaaagatgaaatagagttttagacaaaagcaggagctacaggtagatatttaattgtatccaatttactggtcattttaaaagtttttgtgtcttcctttctaataatttaatgtataaatacaagttttccttttgtactttattggtatctcttaccctcagtgctgaattatcaaattttgcttggaatttaatgatctgtattgtatctatgtattcagatagtttttttggtcccttaaatgttgctatttttaaacatagttattccagccttataatggtgaacatttcatatcaaatgaataacatcaatgaaattttagcctccgcagagaatagcagattgtgagtagtctgtgaacatgaatattttatgataacaaggtttggcttctcacacagctcttgttcttgttcttgccttgcttggccagtcatggagaggaattagggggataatgtctaaaagaaaaaaagaattagcatctgacccaagactttagttgcatttaaaaaaatttattcttacttttcctctgcttcagttcccattaagagaaaatcatcttgtgtcttgaacaatgatcaagtataggacttgtatactaacatggtttccaggctgaaacatatttttaattctatttgagttttcaaataatgcccaacaattatttgattaacatacagctggcattaaataatgatttctatgataaaaaaatttatacaatctttctaagagttacagcaagaacaatttatgggaaaccattacctacttatacaatatcatggacttatttctacaatcttgcttcaattaattatttggaatgataatttagtatctcattatgattgcatgtttaatgtgatgaatatttctgtttctcccaatccatgcttcagggaccatgtttgttcatcattaaatctcagcaaatgataatatatatatttggcccataactgaccacaataaatatgttgaatgaataaatgtttgtgtggcacaattagcccctttctatccaaccgtagaagacactgtggtggtttgtccagtttcccttctctatggaggagggacacgtgcctcctccaactgctgtgagtgttgactgctaatggttctcagctcccactatagataattgccctccactgaggagagctacattgcttggaaagtgacctcgccacacttagtcagcctaagatcaatgactgactgatacttgtctcttacctcaaggaggaaagaactttatggtgtagtttatgatacagagccttgctgcgtgcatcaggccaaagccagatttcctggaaccacattcttgctcagctccccattctgagttcctccctttttaaacctgtaagcatcctcacagtaaataatatgcaccaaaatccctatctcaagctctgcttttggggacttcaactgaaaagaactacattagtgtgaattcactctaaacctctgaatcggaacatctggggcagacgtctggtgtgcatacctttcagaaagccacaaagtatattctggtgcacggaagagtgacaacccaggctcctatatctcaaagggatgttccccttatatagccagtcaccctcaagctttttttatacctgccctaatagcatgacactcagataaccattatgattcaccgtgttgacatctctctgtgaggtcctgcaaagatcacatgtgcacaattcttctcttcctaaatataaatcattcattctttaattcaataaatatttatgtagacctattaagtaccagacaatgagctaaatgccaggaacaaaccaatgagcaaaacaaagtccctgctcttctgaagcttgtattgtagtagggaaggcacacaatcaacaagctaagaaataagcgcatgattttttaaaaaaaatatgagatacaatttcagttgatgatacagactatgtagaaaaaatagggcaagaaggtaaagagagagagtctgatattttatagaggtttgagaaatcaacctttctgtggttgcgacatgtgagtagagacatgatgtaatgagagacggcagagagaacggcaagcccaggagctctgaagtactagcgtgctggacttcttcaaagaataggaagtgaatgattttggtgagagtagggagcacagggagagtgggagcaggatgatgatgaagagattagcaggacaaggaacaggtttctggggccttaggaaccatagaaagaagttcagatttcatccaaagtataagaagtcataaagtatttcaaactgggagggacaagtcaagatctgacatatttaaagcctctctcaatctggaaggtagataatagaccctggggagggcctcagacagaagagcagaggggcagctgttccaacctcagtgacaatgaggttgctttcaactagagtggtagcagtggagttgataagaagtggaccttttaaaatatattttgaattgaggtgagacagaatttgacaataaattacatgtaggctatgaaaaagatgagacaaagataattgcagagatatttgacccaagaaactaggtaaatggcattgtcattcacagagatgaggaactcacaaagaagagtgggttttagagtgaaaatcaaggattctgtttcgggtgttttaaattttaggaactttttttatttctaaaaagagttctcaagcaggtcttaagttaagaggaagactggggatggaactataactatgggaaatcataaggttataaatagtttgtatgcatataccagctaagatcactgaatatttggtaaagaaggtgcctgagaattgagctctggggtggcccacaatttggaactcaataaaggagaggagagggtctggctgaagaaactaaggaggagacactgaagaaattcagaagccaagagaagaatttcaaaatggagagaatgttccatgctgtcaaatgctgctggggaattcagaaagatgagacctgagattgccagatggattcagcaatgtggagaccataagtaaccttgatgagagagattttatggaatgctgataatgaaggcttaactggaggttaagatcaagattactcaagagtgacagtcaagaccatcagagcacaatgttttcactagatcagcttcattcaaaataacttattgcaagcaaaaatggaatatatttgaaaacagaaagttaacaaggatgaatcaaattctgaaataatcatcacaatgacatttttgaattaaaataaatcaacgaaaattctgacaatgactttatacaaacaaaccgggacagaattcatggacatagtaactattctatttcatagcgcattataaattgtagtttcaaaatatggcatcttgttaccagaaaataaaaatcaacatctcattaattgtgaaattctttactttttataaacagaacataatgaaaactttggctaaacatgacattaactgttattttaagtatattcagtgaagactatttttgatttatactgtttcataactgaatagctgcatgtagatttaacactaaatatgatataggtgaagctatcaggatctctcttttcctctcttttctgtattctttttccctcgaaagagagttctgcctctgtccttcaccaaacacatctggaacttactgctctcctcttctccccacttatttttctctatcaaaaatgtcacttagtaaaagatttccctaattattactaaaatataatgaacccataaagcttaacaattttgtttacttttatccctctttttcactctatccctaccacaattctacctatatttactgatggtcgaattcagagcatggtgacaataaaacaaatattgaaacaagggcatttgtcatcaaaaccaaaatgatcaatttcacattttatgtacttataatatcagtcctatgagtcacttttctagccataattttaacttcacatgcaaaatctaaaacagcaagctactacaaaagcattaactatgaaccactttgaaactagagaagacagtgttttcagctgcccctcttatttttcctgaatcagaacatcaataagatagataaggttctgatcttatgaatgttacatcctaatgggggaaaacattttttttaaaaatcaaggaaacacataagtaataagataaactctgataacaatacacatagagggtcaaaggtatagcaaacctggttcctgtgagaacagaaagaaagtgaagcactgggaaattaaaatagtttgagggttgggtagagacaagatatgtatagatatatgggttatgaaaaaaagtttgtcttttatttgaagtgcagtagaaagccattgagacaatttaaggagggaagtcacaatgtccgatttatgtttttcttttttttaatcactctggctgctcttatatgaagaatgaaagggagaggaaagaaaggtcagagaattgaagttaagagttatcacaataatccaagcaagaaatgatggtgacctagacttcagccaaagcagtggagtgggagagaagcagatgtattttagaggcagggctggcaggatttgctgattgatctgatgtggaggaaagagaaatgatgattcctgcatatctggcttggacacataggtaaattgtgccatttacaaaaaaaaaaaaaaatgaaggaaactgaacaaagaacagatttgaagctaggaaatcaagagttctatttaatcacattgaatttttgatgcctattagaggcatctaagagggtaagtcagataggcagtagaacatgccagtttggagtcaaattgagagaacagggctgaaaacatagagatggccattatagaagtggtatttaaatccatgctaccataggaaagcatctgaggacaaaatttcaagagaagaggagagaacaagagcagaggggaatgaggagggtcctgctgtgtcctggcacactcagcatttagaagttgagctgaagaggaagaatcagcaaggaggctggcaagaataaatcagttttgtagcaggaataccacgtatgaataaaaaaagttaaaggagttgaccaaaaagagggaactggtcaactatgcttaatgctgccaagagatcaagtgagataaagagggaaaagtgcctgtttggtttacaggttattggtgataacttccacaatcaaataaataatcaatatcccttatgttgtcaattagtaacttcaagttgtagacatttagtaaccttaataatgccactgcttctaaagaatggttggtggaaatagtttgagggcaagggaacgtcatttcagagctctcagcccatcagcaccttacttgatgtggaatttcctgtattttgtcaggacaccaacaggttttggtattcattcttgtgttgagaatcacagctctccagtgttggtatcagaaatggttaagagcaaaattcaacatctgaatatatttttgcaccacatattataatgtgagtataattagccactgcagaaaactcttttagcctcaaaaagagtgaaaagaagtcaaattgagactttaacatggtgtttcccttgatgtaccaggtattatagagcaggtaaattagaaacaagatatcatttctgaagtcatgtacacagatttatttccttctagaatatgttttctgtcaagtccatacccatgttccactttgaaattgatgactgtatccctggaatacatagcgtggtgttaactagtaacacctcaatgcattttccttaataaataatcaaactggaacctatttgtgattcacttgtctctgaaatctttgtattttcttctctactaattgagggaagctacacttgagcaagagtcatttggagagaagacggcatcattaagggcagtaaaggccttaaatctctaacagccttacctgatctccctcctgcaagttgctatcattaggctctcccttcccacttctgactgcaggttctcctgatttggctgcagcctgactctgattctgaccctaagttggcagtcaaatttcatctcacatttccctgacctggctttctgtatgtttcatttgaatctcatttattatttatttaactagtatttattaaatacctgctatgttttgatgcaatattcaggctgaaacaataaatacaactgagttcctgaccttatgaagtttgcagtctagcaagggagactatttctgctttcttgaatttttgtattttgcttcaatcctcaactagggtcttgatcctaacttctggtagctccttttgctgataacttggttttgataatcttttccctgatgcagtcctgcagaacagcagtaaggatctcagtcagaggcttcccctggtagcatttgtcagtaatctacttacacttggcattttggcctttcgcaaggaagcttccattacatcttaattggtttaagaaataataaaccaagcattttgacttaaacttttcatttttaactaacccaacactttcaagtacatgaaacaattcaaatcaaatagtgattgatttttgttattaaattgatgaattgctttatctaatagaatggtcatggcaattaagatgctaagaatagttttgcaaaagacaaggtcagaatgatgacagccagacaaagtgatcaatggtaaggggcttgaggacaatttagcaattttatccctttctgtttctgagtggatccatctttagacattttaaaaggtaacaattaggctacatgagaactctactgtacaaagaaaaatggtggtcttttcctttcaaccagctgcctcctgaaagaatggcagtacctcacaaaaatgaccatctgaagaaataagaaaaaaaaatatgaaattccaaatgtagacattaatccatctatttgtatctttcaaatatttgagaaattttgtcaacatccgcttagaaccacccatttgtaaattttggttacctacatggcattagcttgaaattttatggtagcagggactaaatgtagaaagcactgacactgagatatgtgaaatgtctagcttatgatatgcagcatgattgaaaattgaaagtgggctgtatttactgaacaactttgattcatgaataaccatgactgtcccatctggattgccatctctgtcactagcccatacaagtaaattattaggttcagttttgaatttatgaacccaccagcattaagtgtcctgtgtatggtaatctctgaatcctagagcagagtccctcaagcttttcagaacataaaaggatttttatgtgcatacaaattcagagaagatgccagtctggcaagaagggagggtaaaggataaggccaaatttcataatcatttctgtgattttcccagatcagcaaaacagacaaagtaaattgtgataatggaatgttggatgattcatttttttcactccttcactcatcaagcatttattcagtatcgggcactatgctgggcaatgggaatgtacatataaataagatctagtccttaccctcaaaaagctcacagtctaatattgagggaggtttatgggaagttgaagtaaacaaaaaagaaatacgttggaacaatataattctcgtgtctataattaccccaggatttcttagcatcctgatcctctgaagaaacagtgtgaataaatctgtgccaatgccttacatgggtgtaagcttctctgttttcatgagaatatgcttctgtcctgaaattttcctttattttctaaataagtcaacaataaaatagttatattaactgaataaaataaaaatgaaacttttttcactagaggtaatttttaaaacattcatatttcatattctgcctgtggaacaaagtcttccatgattgccaagtttatggtgcttgtattcattcatcccttcttgtaagataattattaactgtatttttatctttttaatagctggactcattttaacaataagcaacaatgtattttgtagcaggagtttaagtgcacactgtcctggtttcagttctgaacattttagtgcttattatcaagaaaaaacaaaagacaaaacagcttgtcccattttacaatactcactaaaaggcacctctagcaacttctttgtttgggctacgtgcaaggttcacatgtgttcattttaaaccttccagaggatatgcaactcagaagttcattttagacatgtcactaaagccatttccacttattgattgcactgaaaggacagcaattgtgttttgctctataaaagatgtcgtggtggggattccttcaggggagaagcgacaaggctgttgttctttattttatgatctgactctaatcattagagaaggagacaaaataaatgggcctccctgttctctgacaataactcatgctgggcagattgtatttactttgtatgggggggaggaaatgtatatgtgtgaagatggactttaagatacaagtaaaaggggaaaaagaagctaaaatgaagctagttaccagaaagctaacaaaggttgttttattttccatatgctgtgtgggtagccgccattttacagagcctctttggctttttattaatactacattaaagtaagaatataagaaactaaacaataagaaaaaataaaatgccaattttatcctttcttttctgaaattctgaggactctcatttaaatcaaagagcttttatgtcactatcattagatttctttcttggcttattttcatagactctgaggccaactaaaaattacgttttctgaaaatcatcaaatcaaaagcaaattgaagtaatatttcaattgtttaacctgttcttttcttgtcctattgaaacacaactctataatttttatcaaaaatagttactcactttactgtgtttttgtttcatttgattctagatgcatggcttcatggttgaaattctgtaactaaaacaactttaaaattttcttttctactgaaattttgacacaaaccattttaagactcttaggatattttcctgaacatattgttgaaacacaaatggaaccaaaaaagtattgatgatatgttttatcatatttagaagtatttctcggctgggcgcgatggctgaagcctgtaatcccaacactttgggaggcccagatgggcggatcatgaggtcaggagatcgagagcatcctggctaacacagtgaaaccccgtctctactaaaaatacaaaaaattagccgggcgcggtggtgggcgcctgtagtcccagctactcggtaggctgaggcaggagaatggcgtgaacccgggaggccgaacttgcagtgagccgagatcgcgccactgcactccagcctgggcaatagagcgagactctgtctcagaaaaaaaaaaaaaaaaaaaaaagtctcatttttttcactcttcaacatgaatgtgaatttattgcaccacctctaaacaggggtttctcatccctaaacccagccatccatgagttcatcaaatgtccatcctcagtttcactgtattatataatgcacatttgcacaagcagagcatccacgcaaaaatatgaaatcacaaatgtagagagcaatttatttataattgacattgtcaattactaattgactaattgccaattagtaaagtgctgagacattattttccaaagggcaaagctttttaacaaatctgcacacagaaaagtgcaaaaattattttattttacaaatatttgaacatttttggtgaaattttctgagaacagcccatttaaaaatttctaaattgtgaaaaaatcttcttcctcttgagggctgggtttataccttaagcacctgacaatgtacttgtgatagaggagtactaaatctatgagtgttgcacagatacatacagacatgggcttgcttaataaactaggaaatgaagaaattgtataaagtgtttaaacacaaaaagaaaaaggtttacaaaatctatatttagcattgtaagaattctaattgctaattgactaaatgccaattactaaatagccgagactttattttccaaagggcaaggcttttttctttaaatctgcatacagacaagtgtacaaatcataaacatatagtaatagctgaatgaattactatgaagtaaatacacttgtctaaccataatccagtccatgaagcagaacattactaaaccccagagacccagtttgggtctcctatagtcattatccttattcttacccccaaaaaaacactatcctgacttctgttttctttttcttttctttttttttttttttttgagatggagtctcgctctattgcccaggctggagtgccatggcgcaatctcagctcactgcaacctccgcctcctgggctcaagcaattctcctgcctcagcctcccaagtagctgggattacaggcacgcaccactgtgcccaggtgatttttgtatttttagtagggatcgggtttcaccatgttgcccaggctggtcttgaactcctgacctcaggtgatccacctgcctcagcctctgaaagtgctgggattacaggcatgagccactgtgcccagctgacttcccttttttctgacagatgaaattatatggatttatcatgtacatgctttgaagtatatatacatcatacaatgactaaatctagctaattagcatatgcattattgcacatagttatcatttttaggtgagaaaatccactctcagcatttttagagaatgcaatatattaattagagtcacaatgttgagcttattgatcttacctgaaattttgtattctttgaccaactgctccctagtcccagccctcccaatcattctcaccctgataaacaccattttgctctccacttttatgagatcaactttcttagagtccacatatgggtaagaccatgtggtatttgtctttctgtgcctggcttatttcacttaacataatggtctccagattcatttatgttgttgcaaatggcaggatttctttcttttttatagttgaatggtgaatagaatttcgctgtgtctatataacacattttctttatctgttcatctgttgatggacaagatatgattccatatgttggctatcgtgaatagtgttgcaatgaacatgagagtgcagatgtctttttgacatactgatttcattttattcgaatatataccaagtagtgagattgccagattatatagtagttccatttttaattttggggggagcctccatactgttttcaataatggtggtaccaatttacattcctatcaatggagtgcaagggttcccttttctctatttgttatcttttgactttttgataaaagttattctaatgtgtatgcagtgatatctcattgtggttttccttttcatttccctgatgattagtgagattgagcatttttccatatacctgttggccatttgtatctctacttttaagaaatgtccattcaagtcctttgcccattttttaatcggttaatttgttttcttgctattgagttgagttgcatatatattttgaatgttaatcccttatcaaatgtagagtttgcagatatttttgcccattctgtaggattttttttcactctgttgattgtggcttttgctgtgcaaaaactttgtagtttgatgtaatcccatttggtttttttgtttgtttgtttttgcttttgttgcctgtggttttttttgggtcatatccaaaaactcattgcccagaccaaggtcatagagcttttctctacattttcttctagtagttttacagttttatatcttatgtttacatctttcatacagtttgcattgatttttttacatggtggaagctgaaggtctaatttcagtcttctgcatgtggatatccagtttttgcagaaccatttattaaagagactatcctttccccattgtgtgttcttggcacctttgtcaaaaatcaattgatcataaatatgtggattaatttcccggtgttttattctgtttcattgatctatgtatctgtttttataccaatagcatgctgtttttgttactatagctttgcagtaaattttgaagtcgggtagtttgatacctccaattttattctttttgctcaagattgctttggctatttggggacttttgtagttctctatgaattttatgattgtgttttctatttctgtaaaaaatgtcattagaattttgatagtacaatgactctataggtccttttagatactatggacattttaacattaatttttccagtccatgaacataggatttttttccatttatttatgtcttctttgatttttttaatcaatgttttatagtgtttaatttagaaatccttcaccttcttgcttaacttattcctaagtatttttttttttttttggtagctattttaaataggattggtttcctgatttctttttcaggtagttcactactggtgtataaaaacactactaaattttgtatgttgatttttttatcttgtaattttcatgaatttgcttatcattcctaagagttttttggcaaagtcatcagggtttcctatatgttagattatgtcacctgcaaacagggacaattaacttcatccttttcaattctaaagctttttctttcccttgtgtatttgctctggctaggacttccagtactatattgaagagaagtggcaagagtatgcatccttgtctttttccagaccttaaaggaaaagccttcggcttttccctgtttagaatgatgttagttgtgtgtttgttatttacggcctttattgtgttgaggtacttttcttctatacctaatttgttgagaatttttaccatgaaaaaatgttgaatttgtcaaatgcttttttgcatttactgaaatgatcatatggtttttgtctttcattccagtgagatgatgtattacatttattgatttgcaaatattaaaccatccttacatccccacacttgataataatgaatgattatttaaatgtgctgttgaatttgccttgctagtattttcttgagggtttttgcatgtatattaatcagggatattggcatatagatatttttgtgtgtgtgtgtccttgcctggctttggtatcagggtgatgctgtgcttgtaaaatgagtccgacagtattcccttctctttcactatcctgacttctaacaacactagttggtttttaccagtttttgaaatcatctggagctttttatgtcttgttatttttcactcaacactatgttggtaagagtcacccatattgttacatgcaactgtaggtaatgccgtctttttttttttttagacggagtctcgctctgtcgcccaggctggagtgcagtggcgcgatctcagctcactgcaagctccgcctcctgggttcacgccattttcctgcctcagcctcccgaatagctgggactacaggcgcccgccactacgcccggctaattttttgtatttttagtagagacatggtttcaccatgttagccaggatggtctcgatctcctgacctcatgatccggccgtcttggcctcccaaagtgctgggattacaggcatgagccactgcgcccggcctcgtaatgctgtcttctaaactacatcgtaagagtaccccacaagtaatttatcattctaccattgacatacattaaggttgtttccagttgggtctgttatgaataacactatataaagcaatttcaggagaattatctattttaccatattgagtctcctaattcataatcatggtatattccacttttttttaagccttctttgagctttgtcagtatacaggtcttgatagtcttttcttagatttttctctgttttactatttggtgccattttaacttatcctgtatttaatttagatttaactttgtgttatgaaaatttttaaaaatatctgatatataatatacagaagagtatagtgaatttctataaacttagcacttaccttaatctattatgaatcaatgaataatctgttttgtgtataatgccacttagtcaatctcctatattattttgaagcaactgtcagccattatattgtttcacagaacatatctcattaaaaatctctaaagtatatgctttttaaaaattgccacctctctgcttcctgagaacatgcaggttagaaaatgtcctcagtgtaaaaagctgcgaactaaaaaagcatacctaatgtaactctgtcttcaatgtttctcttggtctctgcctacattactaggttctccaatgtttatctctgagcaagcatagtttatcattcagccaaggatttaacaggctttatactcagattgtggctcttatcctttctcgcttcttgaatttctattttgtgttttcaacggctctttctgattaacttcctttgctactccaactgatcaagctgcaatcttttgccaccattgccagagggattgaagaacattcacaaacaaaataagccacaaactcacaattcttactgttgcagtttcagactttcaagagtaaactctcctctagcttctgtctgcttttggatgcttgccatgattttaaaattctcatttgggtcggggtttgtataatcatttcactcatccacatttccatcattttcttaatatctgtaagatctgtgggatattttctttctgtcagtatttatatgtcctcctcccccccccttcttttcatcactcttgattaaaagagatttacaaaatatgtgatcttttcaaagcattaactttgtctttattcattttcttaatgtttctttttccaattcattttgttgttcctgtcatttttatatccttctttctactttatttaggtttaaaatttattgctctattttgaacatcttaagatggatattcactgacttttggcttttatttttttccagtatatatattaaggctatacatctccaaaattctctcttcccagcatctcatacagactatgtcatataatatcattaactagttagtaaattttaaagattaatattcttctacctgaaagtatttcagatcaaaacttttgttctttcattaaattaagatatattaaacaatattgtaatatgtcaacctaaaaggaagaagcttaggaaaacgaatatagataaagtgttcatttgggccaagtttgaggactgcaacccaggagtatagattcaagttgccctgaatatacactctgattagtagcagtaacaaatagatttttaaaggcaaagaaagggcagcggtgggaagggagtgggctgatacaaagtcctttctcaggaattctcatttatttacagaaatagcattgattagtgaatggctatacattgtgaagctatagggttatagtgtctgatgtggcattattaattagtagctacttgtagcaatagcaagcagtttcaaaagataaatacattgctcaaaggggaagtggggcatggttgcagtctcattttaatgtttctctggctataataatcaaaaggacttgcgttcctcaaataaaatttcttttctcaatttacaggtcatctcacaaaacatattcaagtacatcagttataattaaatgctcttagaattttttctattcaatattctctctttcaaaatgtttcaataaagaatatgaagaaggcaactaatatttgtaaaagacatacactgaactacatgtgttaggaaaatatttaattatatttatagctaatcttcagtatattttctttatgcagcaataacagcttctaggaaaaataaatacaaatttattcagtaactaatatccattattatgtttcttctgcattttaaactttctcacctcatatcatctaatcactgttgaactgcctcataaatattcaaaagtttaactaagcatcatttatttattttatgtaactcattaaattgcatcctttatggtaaaattacctctgggcacaaagtaactaatatgcatgcaatttaataatactgactgccagcatatctcaaagtattgattgtgaatagccaatttaataactatatctagtactaaattcaagagtttgggaaactggagatgaactaaattgacgcaagcagggactttgccaatcaaaacaaattcaactttcatggaaaatgtgctccccacatataggattttgaaactcttagtagaaggacatgcctgatcttagatgctgtataagacaggaagaatgtaaaaagcaatctaaccactaacaggaaaaaggtcatgatattccaaaatatatctgaaggtaaggaattagtagtgaaactatgctatcagtgaaatatctgtcctctaaccctcaatttaaattagttgcaacttttgtgttagaaatgacagtaaattgaacgaaagcatgtaaaaccaactttccttaattcccccttaaagcacccatgaaaccatcagaaaagacagtcctcactgcaatcacagtgagtggtataaaacaaagttatcagagtgttttctaggtttttctttcctttcatctttgtgcagtgacccagcctcaaaatcccattttctaggttcaagcaagcaatgaaatagcctctggccctttatcttttcttcaacaaaacaacttcactcatacatatgaagctgtggttttcagcccaaacctggttagatttctttgggttgtttgaaaatacgagtagaggcttataccaacaaccaataatctggcatctccctgcacagcatagactactggtctgggagataaagtctagaaatggatgtctcaccattcaaataatccttaaactcatttttagaacagttgaagatcagtcagataagacacaaaggtgatgagactgaaggaaaatctttgaaagagaaaaacatatagaagaaaaaccttagaaagaaggaaatgaatgattagctttagtatgaattccttttcctagaaaagattttcttgtaaatcagaagaaaaattttaaatatatagttctaacctcaatgagataaacgagaatagttcttttatatttaaagaacaattcagaataggaagagaatacaataaaatcaaaatcaaagtgactaaaatattcattggaagcaataagatgtaaacttgatagtattaactatttaaaccaatgcttcagagtacaaacttgagaaataattgtagaatgcaaagtaaatcaataagaaaattttatttttaagatgtgagagaaaatggtagacgtgaaagacagaatagatttggctcatacataataggtatctgcgaagaagatagaatatatggaacaaaaggaataacagaaaaaaagtgaacaaaactccaaaaacaaagcaacaaggaaaaaattctgacatttaagatagagaaattccaatgtttcaagaaatattaaaatcttaacagccccatctttgtcactcccataattaatccatcaccaaagactattgattttatcttctaaatatttattcatccatacacatccctatatcttccaccatgcccctagtttaagctacgctcatttctgaccaagactccagcaacatctcctaaaagctcttgatgtatccacactaacccgtttccaatctgccctttatatttcaactgtttattcagtaagacaaattattgagtgcctccatctgctaccataaagcaatcatgaataaattaggataatttcacatgtgatagttgtaataataattatattaaaaattaaaatgatgtgagagagagtgactaagggaggggtggtttctttaaagaagtggccaaggaggcttcttggttaagctgaaacctatctgaaaagaaggagatagccatttggagaactgtgaaaagagctttcagtcactgggcaccaaaagctcaaaaactctaaattgagaatgtgattgaacgtttgaggcccattttgctagaaggcagtggacaaagtgagatgcagaagtatagagactatatcaggtagagccttgaagccatggtgagaagtttggaatttattctaagtgcaaaaggaagcctttttaacaaaaggaagtttttaacaaaagaaggatctaatttatgtagtttaaaacaaaaactaacttgataccgctgtgtgtatcttttcaaaacacaaacctaattgtgccacaggcacactcccagcctcatcctgcttaaaagcattccatgtgttacacttgcacataggacatttttggtttttactaatcctagctccttaacatggccaactacaagatctggctccatctatgactccagcatcaagtgcaccacacacggatcaccctccacatctgcctaactgtactttcttcagccccacatccccctctttccagactgcacacaggatgcctctgccttccctctccctttgcctgctgaactcccaatcatctctcagccttcaatgtaactgtctctgccttagtgaagacttccctgaccagcccctgcccacggagtcctatccctcaagttagatctgtatcaatatatagcttcccataaacctctgatcaaaacccgagttttacatttgtgggtgtgatcatttattcaacagatcgtgccctaagtagactgtaactccaagagggcagggacttcatctattttgactcaccattgattctcagttggccctaggcacagtgtttggtaaataacactgagtcaaaaaataccttcgaatggatagttgaattaacaagtttttagaactcaagacctggtaaaatatcaaatttcaatatgcattttcattaaaaataaaactgattaatagaaagacaaaatttgattattaataaaaccaattagtagaaagacaaaattactctcaaagatgcaaaaatcaaaaagatttttcttctacatttaataaaagcagaaaatagagtggtgtctactaaatgcagggagtacaacattgagttagcagtgatcactgagtacaattaaaggtatagaagtaacagaatacaagtgctaagagttgtatttttaaaacctaacaagcaggccaggcatgatagctcacacctgcaatcccaacactttgggaggccaaggcagtaggaccgtttaaggccaggagtcctagaccagcctaggcaacatagcgagaccatgtcgctaccaaaaaaaaaaattaaaaattagctgggtgtgttggcgcacacctgtagtcctacctactagggaggctgaggtgggaggatcactctagcctaggagatccaggctgcagtaagctcagatcatgccactgcactccagcctaggactaatacaggacaaataaaatgagaccgtgtctcaaatgagaccgtcccttcttgcaatcctatgaagaactacctgagactgggtaattgataaagaaaaaaggtttaattgacttacagttcaacaagctgtacaggaagtccggctgaggaggcctcagcaaacttacaataatggcaggaaggcaaaggagaagcaggcacatcttacatagccagagaagaaggaagagacaggtgggaggtgccacagacttttaagcaaccacatctcccgagaacttattcactatcaaaagaacagcaagggggaaatctgtccccatgatctgatcaactcctactaagcctcacctccaaattggggattacaatttgacatgatatttggatggggacataaatccaaaccatatcagaccttgcaaaaaagaaaaaaaagaaaaagaaaaacctgaagatggcagataggtggcagaactagcttgcagctcctgctcagatggacagagcagcatgtgaaaactcacatggtgaacttgtgctccaagaactaccaaaggaacataccaggaaagccaagagaatccacagtccctttgaaggaactggatcaccactgaaagctccttgagatgctaaaaaactgagtcggcttggtttttcaacgaggaggcatgcagtctgggataagttctcagtcttgatcactggctgcccggaaataaactcagtgctattggaggggggcgtggtgggagtgagaccagcctttaggactgcaggctgtgtaagagcaggttgaggcttgttactgctgggttttccctacttccctggtgacctgtatgactcagcagaggcagctctaatccccttgggaatataactccactggactgggaaccacacccccattctccacagcagccacagcaagccccactcaaagagaggctgagctcagaaatggctatccctgcccctacctggtagtctttttctatccaccctggtagccaaagacaaaggtcttaatttcttgaaaactctaaggccccagccactgcctgagaaacctgaatacttaaacagctgtgcttagggcaagtttgcatcctccctataggactgcagctggtgtgctcttgaaagtgccaccacttggctggaggccaactaacccaaaaactgcacactaaacaaaagcacaaccaaggaccttcacagtgtccacttcactccccaactaacaccactggagcaggtgctgatatccaggctgcaagacctgaagatgactcacatcacaggactctttgcagacagcctccaatgccagccagaataccagtagccctgctgggtggctggacccagaagagcaaaaacaataactatggttcagttctcaggaacccttattgctagggaaagggagagaacaccacatcaagggagcaccccataggacaaaagaacctgaatagcaacgctttaatcccagatcttccctctaacatagtctacccaaatgagaaagacccggaaaaaacaattctggtaatatgacaaaacaaggttctttaacacccccaaaagatcataccagctcaccagcaatggatccaaaccaagatgaaatctctgcattgccacaaaaagaattcagaaggtcaattactaagacaatcaaggaggcaccagagaaaggtgaaggccaacttaaagtattcaaaaacatgatacagaatgtgaaggagaaattcttcagtgaaatacacagcacaaatttaaaaaaatcacaacttctggaaatcaaagacacacttagaaaaatgcaaaatgcactggaaaatctcagcaatagaatcaaaaagcagaggaaagaactctggagctcaaagacaaggcttttgaattaactcaatccatcaaagacaaacagaaaggaatttttaaaaagaacaaagccttcaagaagtttgggactatgttaaatggataaacctaagaatacttgatgttcctgaagaagaagagaaatctaaaagttttgaaaacatacttgagggaataatcaaagataacttcccaagcattcctagaactctagacatccaaatataagaaactcaaagaacacctgggaaattcatcacaaaaagatcatcacctaggcacatagtcatcatgttatctaaagtcaagacgaaggaaattttaagagctgtgaggcaaaagcatcaggtaacctatgaaggaaaacctatcagagcaacagcaaatttatcagcagaaaccttacaagctagaaggaattggagtcttatttttagcctccttaaacaaaacaattatcccccaagaatttcatatccagtgaaactaagcttcataaacaaaggaaagatacagtctcttccagacaaacaaatgctgagagaattcaccactaccaagccagcgctacaagaactgctaaaaggagctctaaatcttgaaacaaattttcaaaacacaccaaaatagaacctcctcaaagcataaatctcacaggacctgtaaaacaataacacaatggaaacaaaaaacaaggtattcaggcaacaaatagcatgatgaatagaacagtacctcatatctcaataataacattgaatgtaaatggcctaaatgctccacctaaaatatacagaatggcagaatagataaaaattcaccaactaagtttctgctgtcctcaggagacttgcctaacacatgaggactcatataaacttaaggtaaaaaggtggaaaaagatattcaatgcaaatggatatcaaaagtgagcaggagtagatattcttatatcagacaaaacaaactttaaagcaacagcagtttaaaaagacaaagagggatattatataatgataaaaggactagtccaacaggaaaatatcacaattctaaatatatatgcacctaacattggagctcccaagtttataaaacaattaatactagacctaaggaatgagatacatgacaacacaataacagtgggatactttaatactccactgacagtgctagataggtcatcaagacagaaagtcaacaaagaaacaatggacttaaactaaaacctagaacaaatggacctaacagatatctacagagcattctacccaacaactccagaatgtacattctgttcatcagcacacagaacatcctccaagatagactatatgataggccacaaaacaagtctcagtaaatttaagaaaatcaaaattatgtcaattagtctctcagaccacagtggaataaaattggagatgagttcaaaaaggaatcctcaaaaccatgcaaatacatggaaatcaaaaaacctgctcctgaatgattgctggctcaacaacgaaatcaagatggaaatttaaaaattctttgaactaaatgatagtagtgacacaacctatcaaaacctctgagatacagaaaaaactaagagataagaagaaagttcatagtattaaatgactagattaaaaagtctgaaagagcacaaatagacaatcttaggtcacacttcagagaactgaagaaacaaaaacaatccaaacccacatccagcagaagaaaagaaataacaaagaggagaactaaataaaattgaaacaaaaaaagaaaaatacaaaagataaatgaaacaaaatgctggttctttgaaaatataagtaaaatcgatagaccattagcatgattaaacaagaaaagaagagagaagatccaaataagttcaattagaaacaaaacaggagatattacaactgataccacagaaatacaaaagaccattcaaggctatgatgaacacctttacatgcataaactagaaaatctagaggagagggataaattcctggaaatatgcaaccctcctagagtaaaccaagaaatatagaacgtctgaacagaccaataatgagcagcgagattaaaatggttatttaaaaattgccaacaaaaaaaaagtcgaggatcacatggattcacagctgaattctatcagacatttaaagaagaattggtaccaattctactgacactactcaaaaagacagagaaagagggaatcctccctaaatccttcaatgaagccagtatcatcctaataccaaaaccaggaaatgacataacaaaaatagaaaactacagatcaatatccctgatcatcatagatgcaaaaatccttatgtcaaaaagataatacaccatgatcaactgggtttcataccagggatacagggatagtttaacacgtaagtcagtaaatgtgatacaccacataagcagaattaaaaatcacatgatcatctcaatagacacagaaaaagcatttgacaaaatccagcatctctttatgattaaaatcctcaacaaaattggcatacaagggacatactttaaggtaataaaacctgtctatgacaaacccacagccaatattataaatggggaaaactcgaaaccatttcccctgagaactggaacaaggcaaggatgcccactctcaccacttctattcagcatagtactggaagtcctacccagagcaatcagacaacagaaagaaataaagggcatccaaattggtaaggaggaagtcaaactgtcactgtttgctgatgatatgattgtatacatgaagacaaaaaagctcctagaacggataaatgaattcatcatagtttcaggttacaaaattaatatgcaaaagtcagtagctctgctatatgccaacagcagccaagctgagaatcaaatcaagagctcaatgccttttacaatagctgaaaaaaataaaaataaaatacttaggaatatacctaaccatcgatgtggaagacctctacaacaaaacactgctgaaagaaatcatagacaacacaaattgaaacacatcatgctcatggatgggtagaatcaatattgtcaaaatgaccatactgccaaaagcaatctagcaattcaatgcaatttccatcaaaataccaccatcattcttcactgaattagaaaaaaaaaaaaaaaaaaaaaaaacacctaaaatccacatggaaccgaaaaagagcccatgtagccaaagcaagactaagcaacaagaacaaatctggaggcatcacatttgcctgacttcaaactattctataaggccatcatcaccaaaacagcatggtactgatataaaaataggcacatagcccattggaacagaatagagaacccagaaataaagccaaatacttacagccaactgatctttgacaaatcaaacaaaaacataaagtgggaaaggacacccatttcaacaaatggtgctgggataattggctagccacatgttgaaaatgaaactggatcctcatctctcaccttatacaaaaatcaactcaagatggatcaaagacttaaatctaagacctgaaaccataaagattctagactatcacctcagaaaaacccttctagacatcagcttaggcaaatacttcatgaccaagaaaccaaaagcaaatgcaacaaaaacaaagataaatagatgggacttaattaaactaaaaagcttctgcacagcgatagaaataatcagcagagttaacagacaacccacagagtgggagagaatcttcacagtctatacatccaacaaaggactaatatcagaatctacagagaactcaagtcagcaagaagaaaataaacgatcccatcaaaaagtgggcaaagaacatgaataaacaattctcaaaagaagatatgcaaactgccaacaaacatatggaaaaatgctcaacatcactaatgatcagggaaatacaaatcaaaaccacaaagagataccacctcactcctgcaacaatgaccataatgaaaaaatcaaaaaataatagatgttggcgtggatgtggtgaaaaagttacacttttacactgttggtgggaatgtaaactagtacaaccactatggaaaacagtgtggagattccttaaaggactaaaagtagatctaccatttgatccagctatcccactactaggtatctacccagaggaaaagaagtcgttatacgaaaaagatacttgcacacacgtttatagcagcacaatttgagattgcaaaaatatggaacgagcccaaatgttcatcaatcaatgagtggataaagaaaatgtggtatatacaccatggaatcctgctcagccatattaaaaaaaagaatgaaataatggcttcacagcaacctgggtggaaatggagactattattctaagtgaagtaactcaggaatggaaaaccaaaaattgtatgttctcactcatatacgaactaagctatgaagatgcaaagttataagaatgacatgttagactttggggattcaggaggaatggtaatgggtggcaagggataaaagttctcgcattgggtgcagtatacactgcttgggtgataggtgcaccaaaatctcagaaatcaccactaaagaacctatctatataatcaaacagcactggttccccaaaaacctgttgaaataaaaaaaatggaaaactaaaaattagacaatttttttttaaaacttgataagtaaaaaaaaaaaaaaaaggttgataagatgatgtgttgttgtacattcatccattatagcaaatgtactattctggtgaaggattttgataacatgggaggctgcgcatgtgtagtgggcagggagattcaggagatctctgtaccttcctttcaattttgctgtgactctaaaatggctccaaaaaaaattttaacaagtgtgaaaaattggacaagcaaagacaaaatattaggaagaactactcaatggttttatatgactgaatgaaaatgtaaaagtaggggaaagttcacaactcacccagtaatcaacagctgcatatggcagaactcatgagttttagattttataacttcatgtaaggaaactgcattgtgcatgacatgaatatcatagaatcgtcacaccagaaaatcaaatacactacctgcacagttaaaataatcattatcttggagaatcagctttgggaaaaatagagtgtctactaagaagaaccatccttggtcaggcacggtggctcacgcctgtccagcactttgggaagccgaggcaggtggatcacttgaggtcaggagtttaagaccagcccggccaacatggtgaaacctcgtctctattaaaaatacaaaaattagccaggcgtggtggtaggcacctgtaatcccagctacttgggaggctgaagcaggagaatcgcttgaacccaggagctggaggttgcagtgagctgagattatgcaattacactccagcctgggcaatagcgtgagactccatctcaaaaaaaaaaagccattctctttatttaggtttgtctctatactctcctacaggtattatatgagtcagaattcatacttcctgtctgccactaatattatgtacattataattttaaataaaaataatatttgagagacaaaaatcagaaaaccaaaataatatgaaggattaaaaaacatatacttacaaataataaaaatcagaaatattaaaatatcaagaaacaatggctcaagcagttgaacagcaggggagctctctaaaaatcattcacaaacctaagagaagtactattttctctgttatataaataaagatgcagagattcactggtgaactaacttgtcccattatatgtggcttaaaataccaaaagtaaaattcacatatagaccttctggctttacaactttggaacccataatcttctttctggggtctattctgggaaattaatctaatatgtggaaaacagggtatatgaagatttccatggcagcattttaattaaaggagcaatatgaatatttgcacggcagcattttaattaaaagagcaataattagaagctatccaaatgttttacagtaggaccatggttaaataatatgtggtacataggcatatgatacaatgttatttttaaaataagaaaatatttctatataagagaatgaaagcaggacataaaaagtataattattttaaatacataaaataggaagtgatacacaaagaaaataattgtatgaagatattaaaatgataagctgtctgtgctctaattttaattattgatatctttttaatgactttaatttggtttcaagtgattttacatagagagttcaaagttcatgagctgttgaaatctacatctgaggaaacaaactaaataaagagaagtttcaaccttagaaagtgcatgtgacttgtgaatattgtgtaacctcaattccagcttaagaatcactaaaggagagaaaagtagctagagcggtacggcagcctccggattctgaggtgttctgcgacttccccagaccctaaccttcccggcctcttccccagagaatcacaatctagatgtggaacagtggatttgaaagctatagcagcaactcatagggcagccggtgaatacatgcagtccccggtaggctttggatcgcgggcaccttcttaggcagaaaagaaatcaagagccagagcacagcacattgaacccacacacatctcagctgctttctgccactttgattgatgaagtgttcaaaattggcaatgctgagatttcacaaatcactcttgtagggatcatcagacatgcagagaagacttcaaccaacattgtttacaaaatagatgacatgacagctgcacccatgaatgttcaccagtgggttgacacagatgacaccagcagtgaaaacactgtagttcctccagaaacatatgtgaaagtggcaggccacctgagatcttttcagaacaaaaagagcctggtagcctttataaatcatgctcctggaggatatgaatgagttcaccatacatattctggaagtgatcgatgcacacatgatcacaaagcgaacagccagccctcagcagagagagcacctatcagcaatccagggaagagtgaagcagcctccctgtggcccaaaatcaggtgttgaatgtgattaagtcttacccaagacctgagggactgaactttcaggatctcaagaaccagctcaaacgcatgtctgtatccccagtcaagcaagctgtggattttctgagcaatgaggggcacgtctattctactgtggaggatgatcattttaaatccacagatgcagaataacgggaactaattgggtacctgagattttttacagctggacctagcttcacaatctgttttctccagctgtgcatatgtttagccaggtggcttctagaagtcagtttcatctataaaaggtctccaccgacatccttttgaaacttactgctcttctgttttgtttgaagctcagagggagatgggcaattgacagggatacaatcccaggtggaattgcttgaggaagttacaaataagcttgtttcatactaacataatgcaaataactcttttataaatgaaaacatgctcatgctctccacaacagggagaaccaaagaaagtcccataagtcaatttgtcccagtcatcgtgaaaccttgccccttctctagggaactacatcagaaagttacctaccaataacacgctccatataaaatatcagaagaaatgaagaggctaaagtaatttaacatttataaaaacatacaaaagacgaggaagaaaatgtggctaattactgtggtcctcacttcataaaggtgtagttgcaatttgtaacttccttcttcctccttccatttcttgttccttttgctttcagccagcactgaggttggttaaggttcttaatatgtcgtggtagttaaaatgttcattcttgagatcagagcctataatggcttcctatggtcaccactggaagaggcaatcctagacatgttccagaatgtctccaaattccaattaaacttctcactggccacagagtatagcagcacccttagcacccttagctgaaagagaatctggaaaatatgtttttggctttctagactccacagtacacaaaacatgaaggaggatgaaatgggtgcagtaatctactatttccaccacagtaattaagttgggggaaaaaaaaagaattactctcttatgaccttcgccgcagtaatgcaggatttttctcggccccttcatcagacttgtgacaggagtgaccccatttactcggcctgccgcattcaagcctttgtgggagggagcacatgaacaagctccatgtggggcccacagccagaacaggcacatgtggataaatgtaagatcctgccagccagttcagctgctggcaggaaaaatctccatgtgggacccatggcagtgcccaggtggtgctaggtgcctgtgacccctaagccccagagggaatgttaacagtgctctcttagctctgctgtccccggacagctgtgtgttagcagctcagctgacagaagcaagctctgtgtggggcctgcactggttcccaggtgagagtgtctgtaaccctggaaccccagagggagtgttacagtgctgtcttacctccactgtccatggatggctgtgtgttagcagctcaactgacaggagcaagctctgtgcagggcctgcggcagtgcccaggtcagggtgcctgtgaccctgaaaccccagaggatgggttacagcattctcttagttctgccatccatggacagctgtgtgttagcagctcagttgaccccttgcctcatcacatggggcaactaccctccactggcaagggcaaagggctggtgtgacagactatctgggtacctgcactcggtgggtcccgagctcttgtctggtgtccaagaagaatgaggtcatatggatgaactgaatgatggggaaggtggaaaattttactgagcaatgaaaatggctctcagtggagaagggagctggaaaggggatgggaagggcaggttgccttccctaaagttaggctatctctcctctgaagtgcagccctctctcatcgcttctgactgatagtgggatgtttctctgcacaggacggtgggggtgggccataggtagttttgaaaaaggcaagattcaattggtaaaaaggcattattcagaaagaacaaataaggagagaatgggcaaaaaaggaatagaagtgctcacttcaggccatgggtttcaggcttctcagcttgaaggtgcagtttcactggggacccatttctgtctgcctagaatttctctgcctccttcctctatcaacagtaaggaagtagatgggagaaagctactctttgttgcactgatatgtagttaagttctagtgcctaaacagagtaaatctttagcttaattgtgggacagtcattgatctcacaaagggatggagtttgctgaagccagttaccataagctcctaacgaggaaagatgatctcaatgcataaaaagggctttgacagaaagctgttcctttctgcctccctccaccctccctacccccagatcctgacaatgctgtttctctacattcaaaccattccagagtatccagtgttctaccacctcttctccattaaactgatacagctcgtgtgattcatctttatgtgaagctcaagaggaaatactcagatgccacatactcagataattcatttgaagtttcatggttttgaatggtaaattgttctgatgacctatgagagaaaagcactccaatttctttgaatgattcttctttaatgtcaggatgcattttcactccttcaggccaccaggctacaaagtagcaggttttgttgttttgctgagtactgctgtagtgctgcaatttacacagatgcaaagcagacagtgattaggaatgtgttttggccttattagtaagacctgttaattgggtgatataggagtgatttcttcctatgggtggactccagcaacatccaaaaaagagaaaaagttcaagcagccacaagcacagaggaagctttaaaattaacctgccatgtgataatttgttgataggttggttactggaaagacatggaacaggaagatacagcagaaacagtcaaaactagagggaatgagtctttcgtcatcctaacaggattagaaggaaatacgttatatcacttcacagtgagggcttacaatggagctggatatgggccacctagcagtgaagtgagtgcaaccaccaagaaatcccgtaagtgacctgggctttttgtttgtttcagacaaaggggaaacatcgtataacatttctcaaagccacgtgaggtgcataataagcagagtcaaaggggagttttgattcatagtcttgcttcagtgcttagatctgaatcctcaaactagctcagaaaattctgcattcagagtagacaaaggttatcttcctgtgaaacaaggctaagcgattttgacacagaagggagataaaagaattcaagttcaaaagctcagcagagtagctattaaaatgacactcctggagcaaaaccctccttatctgactccagctggaaggaagcctagattgccagccaactactaagcaggagaaaagattgagatactcacaaagaattaaatgaagaaatgtatttaagaatccttgtcagttcactttcactttttattttgcagctcctagtcaagcacctagcaacctcaggtgggagcagcaaggctctcaggtttctctgggctgggaacccgtcataccattagccaacgaatctgaagttgtgggttacaaggtcagtatttcttcactcttttgcatagatactcatctccgaaattgttattatgaagatggaaaattaataaggcataaaaagacccattaaccaacctattttttctcagtcattttctatctgtatcttagaaagatagccttcctatagatagagaagccaaggcagtcaaaattagtttcaactgcacaaggcacagaaagggaaggagtaggaaaagtagcgacaatctgaatgtagtgtgaagatgactctgtgaagcatgatattaggaccagcagaatttaggcagagaattctggcatattcttccaggagactaactttgctggcagctgacaaatatgggaccatttcgttttagtggaaagtctttctattagcaaggaaacagaagaacaaaaaaaatgtaagggctagaacactagaaagaaaacaaaaaatccagggagagacacagcaagctccaaaacagagccaacattcacatacagtcattctgttctgtgacagtaagatctggaaatttgataacatgtgcaatttgtttttgaaaaataactttgttatctgatttttaaatatatgtgatctatgtattgaattggcttaatttcaaattcttgttctataatgtcagattctgtttgttgcattaaacttcacacagaatcattagttgaatattcacaatatttttaatataataaaatatattaagtataatattttaaaatatttcagtgataatatttcaactgaaagctatcattataggtgggttttcaactatcagagatggtaacacagtattcagtacataaaatgctaaaatttaaggagctaaaaactgaagaagttataaatggaatattttaatttccattaatattatattacacaaactagcatttgttacctactgtaattaggatagatcacagacacacacacacacacacacacacacacacaagtccatcagtaatggtcgggaatattgaatttgatcttttgcagggagtgcagatgggtcattttctataccattcccttactcctctttccatacccttccccaaaagaccatatcctcacaacttctcctcttagggaaatatactgtttaatgcttagggatagcaggcgagaaatatgatagaccattcaggaaccaatctaatatcattagaactatgatgaacaatatcccaaactggagaggcaaagtagaatgcaagagaaaaccagataaacgtgtatggtcaagtggaaggctcatatggtttaggtacctttcaagtgagaatagagaaatactatataactagaaaaatactctattgagcttgggtgtagggatcccaggctaggtgccactactctttgttcacatttgacacctctttcccagtcattgttcttactttttatatatgactgtctccccaaacagactgaagtcctcaaaggcaaggactttatcttacttatttcttgttcctaatgtttctagaatggatgactaacgttggcccagatagaaatgtcttatgcagttatttatatatgtgtattatcaaatatgtatttttttctagcataaccttgccatttgttgttgcttagaggaaaaaatatcactggccactgattcagacagattttagttcaaatcctagttgagtaatttaagtaagttgtttaaactttatcagttttattttcttaacttcacaaatggcagaaatagcaataataatacatattatacaggattttctaaagaataatttgtataaaatgcttggcatataaaatgttctcattaaaaaacagataccatttcttagtgttgttggaggagcatgtctcattaggtacaatttttaaaattttaacaaagaaactgatcgttaaaagttgcctgccagttccctcttaataaagatatcacaagtcatgttggaataccttgttgctgagggaagaatcactagcatagtccattttagttgtgtaaattaatgacaagtaggcacacattgcaaaagatatttttttccttttattttcttgaaatggttgcacttccttatatccctgagaaggaagaattgattcgtataaaaggagtctgctgataacaaatggagtgagacctcaaaaccttctcctttgcaactaaaccttatcggaacctttctgatgagtgggatgatccccactgagagaactgctgacaggaaaggcttcctgagggaaaggggacttcagactggactgggcttaacccagagtttggattctcctcagaacgcgggttttcacagggcagccaaggatgaaagctcctcctgacacaatgggacaggaatatatatttagaaataatagctgagaatataaactaaagagctataacccagagaacacaagcttggagcccgtcttctgagtatgacgttgaagacagctactgcacccttggcaaggatccccacacagcagtgaaagaactgtaccatctgaaggtgcacactaatatagaatgaccagggctgggcatgatactcagaaggagaatccttttgattcctactacatcccaaaaattactgccaaccaagagtggcaccactataatagcgggccacctcttcttaagcacaatgtgtgtcacttacaaaaattaataaaatagggacacaggacactaatcatttctcttcccacaaggtagtttgaggcgggcttgacccattaaaactgaacttgcccctaggattcttggaacatttgaagcagaaaacttcttgctcatcggggaaagggagagtttccatacttaattggaatattaaaaagggaggtcacttaattttcactctttgtctttgcaaactacttcacttttgcaagcagaaaggatcactggaaatgcatattgtgtggaggtttgaggctgagaacttgggattaatgcctgaggtttaaaatgcagggaatatatattccaccttttacattaagtccagtttaagattgaagaattcagaaaagtatttatctgggagacttctaggttgtgaaagttattgaaacataataaatgcagaggaaaaagtagatattttccccatatattcagtgcataaataatgtaataaatgattcttttgtatagttaagctgctatatacaggatagacattctgaaaaagtgcactagaaactggatctcataaagatagagactggtggttatcagaggccaggaaggggaaaggagagtgaggaacaaagagagcttaatccatgggtacaaatatactataagatagaagaaataagatctggtgtttgatagatcagaagggtgactatagttaataatctattgtacacttcaaaatagctagatgagaataatttgagtgttcttagcataaacaatgataaatatttaaggtaatggataacccaattaccctgatttgatctttacacatcatacacatgtatcaaattatcatattaccctgaaaatatatacatctattatgtatcaataaaaaatttaaaaagtaaatgatataaaggaataatacattgtcctttaatctttagtagttgaactcctttcaggcagataaatgtgcattaatacctctaggaattttaaaatttattttgccattttccatggaatataataagaacactataaaaaatatatcagtacattataaaattttaaagcttatattaataaagtaattgtaatcttgaaaagtaaactatagaaatagcacaagataaaacagcagaatttgacatttgagctccccattgtccaagaaagcactgtcttagtccttttgcgctgttataacagatatctgggactgggttatttataaaaaacaaaaatttacttctctcagttctgaaggctgagatgcccaagatcaaggctccagcaaattctgtgtctgatgagggtccacttttggtttccacaatggtgacttgaaagcagtatcctcaagaggggaggaacaccgtgtcctcacttggcagaaggcggaagtgcaaaagggccaacaaccacgagaagcctcttttataagggcattgatcatactcatgaaaggagaagtccttgtgatacaatcacctgttaagggccccacctcttaatactatcacactggcaacacctgaattctgcaggggacacattaaaaccatagcagcatagatcttactttcttactcgatttcagacattgaggtgtcagcaacatatataactagcagatattactagagaaagatgataacagaaattttgctaacagatattaaaaaaaaaaaagaggtttccctatcacaaaatcttgtcagggccttcaaagtgaccaagaatatcatgaaagatagatggaattgaaccacatataattgcacaataggtaacacattaaaactgaattcatttaggtgaacattaagcagtacctagtggtgaaactttccactgatttttttttgagattgtctatgagatgctgggcttcttggaattttgtttaagaaatccagatttaatagtaataatttcaagatatcatagttttcactaacaagtaaggactaaaagcatagagaaccagcaagatgttggaaaggattgtctgttataccaaataataatacaaataatttccactcaaaataactttccatttgagaagctgaatccaatttggtaatttatttagcatatttatgacttttcttcaggtcaataaacatgtgccactttattttgttgtatttacattccccaattcagaatcaactgcctattttattaatacattatatataaatgattgggaaaatgaaacaaaaacttcaaatcaaagttttcttaccttgacttattttttcaaataaatgtttttaaacaaataaaattttatttttacaactcctataatttggggtctctatctagaatccttactaattatagcacgtaagactcaccattactggtgttactaaagaaatgccaaaaaagcttattgactaaagtatattcagccataatttttaatgatctcaaaaatggaaaatatttttctttacacgatgaaagtaatttacccaggttataaagtaaaaacaaccattttatctccaccttattttcttcacacagacttatgcttgagtgaaagggaaaataaaactcaatgttcaggggctatgctttcacttcagcaaatgtccccttccccacaaacaaaaactgttatcccttcagaaaagacacaagcagtcagaaagaattcaggacctcaggctataatccaagcaaaaactattagttttcaaatctgtatctagaaaatagcctttcctagatatacaaccccttcaccaaatatctcccctcacccatatctactttctacctgttaacagagctagggcaaatagaaggaaatcaggcccaaagtttactagttattatacagtccatcaataccgtaatagtccattttcacattgctaataaagtcattcctgagactgagcaatttgtaaaagaaagagttttaatggactcacagttccacgtggctggagaggcctcacgatcacggcggaaggtgaaaggaacgtctcacatggcagcagacaagagaagagaacttgtgcagggaaactcccctttataaaaccatcagatctcatgagacttactcactatcatgagaatagcacgggaaagacctgtccccatgattcagttacctcccaccaggtccctcccataacatgtgggcattgtgggaactacaattcaagaagagatatgggtgagaacacagccaaaccatatcaaatacaaacagaggttctcatttgtttatgcaacttagatatcagttgagattccagattcctgagatatatgtacacttgggttgatactgttttacatacccactagaactttgaagcccatccctgtatttctctagcttcttgggaactgtatagtctatagccactctagcctctgatttcttttattttgtagctcctccttcatcttatattcactctaaataggagactcagccttcttttctctgtttccacaaattaaaaagactcacatataatgacttaagctggaagataggtacatgaggttcattatagtatcctctttacattcatttatgcctgaaatttctcagaatttttaataattgaaatagaaatggctcatgtcacatgcagtatatatatgaagctgactttttggaaatgctggggagatagagttagaaaggaacaacatgcaagcaaacatctgcaacatgcccaaaaagaaatcttgttgttaaaattgtgttcagacaccctgcaggcagtgaattctcactgatactgtgtctcccaacttctattcatctaacttccattgtcttactgactccttccttcccatcccattgtcaccgaggctttagattcctcaccctttttatgaagagcagttgtacccatcaattcttccgaagatgctcagcagaggaataggcctttcctttaatatgagccatccctctcaggagtagtttgggtataaccagcaaaaatttattctgtcatatttttagcacactctcctcaatattctactaccatcaaacatatagaatagccattttcagatcatgcctttgagaatagcaataccacaatcactttctatttaggatcatctctttagataacccactgctctcagttttttttttaataccaaaatttgagaatagtcttgacaatacattagacaattttctttatgcataaacatagctgtcattgcaactgtcaatctataaatgtccatattctctaagaactctctggactccttactgtcaataactatttttttctatgtcttgataacttcttaaccttctcatagttctcattctcatgcatcttttctaaatcaggattttaaaatgagccaacattctctaaagcactgaagattaactattaatttaatgtatctttttacttagtagatctacatatatgtatagcactccatctccctggatatattggcaaaaggccacacttaatctcaaactcgttttgacaccactaactgattttttccccgtctttacctcttaatcctaaatctcaactgatccacaaatttttcttcaactctagaacattagatatgcattgctggatgtatttttctttgtcataagaaatgtaatttattgaaccataataacactgtcctctaaaataatcactcccctgccaatcctcaccaatttacatactttcccattcccataaatttgctttctaattacctcacatggatgatcagaattctaattcatcacgatgctccagacgaaatcaaaagcatacagatatatttgtcacattttaagacaaaagaagctgcttaaggcatcctccaggaagtgttcctgatttccccaatcttgactaagtacccactttgtgcattaccatagcatcaaatatatttcccgctgcagtgcatatcacacttctttgcattgtctgtctgtcttcaatattagactataaatgccaggaagactgtaaccatgtggtcttattctctgatgaatctccggtatgtagtactatgcctggcctgcatgagatgtccaataaatgtttgataatgctgttatcaccttgcatttacactgaggctatagcatccttcacaataaggatttccatagataaaattgttgcacatcataattaaatggagaattcacttccctcccaagaacatgaagtagatttaaaattaaatgaaaaaaaagaaagtgaaatggagggagcatttattactagaattcagagggttcaagtacacgcaggcttcaatatgtggaaatattgcttctctaaagtatttttggatttttttgtatgtaagttaattcaagctcaaaacacattttctgtaagaaaatatatgtcaataattatctaatttcccaagtcagttcatattttatgatgcacttgaaataccaaccctttaacagttaataaacaatgatggcaacagaaggagtagctttctctttttaagcttatcatacaccaggtcctgtgctaggtattctacaggcgctttctcattttactcccctaaaacactaaaattgttattatcatctctatcatacagtagaataaattgaagtttacaaaatttagtaacttgcccaaattttcccagccaggaaggtataggagattttgttttctttgctatgttttgtaggaaactgtttcatatccagatctgtatgaatacaaagccatttttctttccattgtacacttataataccaattatgaaaaagcacaaaaaacagtgactctgaataaaaacacatttaaacacatcttaactgccactacttgactattataccaaaaattttacttgactatttttggaggcaagtaatagtacaatatagtaaaatagctctgaagtgatgatcaaatataaatcttctgatgagatttctaccctaactagccacacggtcttgtacaagtcacctaacctttatggccttcattttctaatatgtaaacccaggattatcctgtgtcctgatttgcagttccaaaattgttttccgtgcatgtatgtttaattataataccacaacagatgtctaaaaagctttagctttgctacaccatgtatccaaatgccgattttaccaaaaagcaaaccactacaaaagcaaaaattaaaaaaataaaattttcactttcaactgtttcctacattgttaaggatttattattggtatgtttaacaaattttgtttactcctttcaaactatttgaagatgagctttccaaacttccttaggatatttcaataaccaagcataacagactctccatgatctgcctcctctctacctacttctctagcctcattcctcactattcccatatatcccctctccattccctgctctcatgccattgtttcttattgcttagatgtagttattaattttatcttacctctttctggaattctccctttctcaaactggtccactctatcatatttaagtatgtagttcagacatcacttcctctggaagtccttcactaaacccctagacaaaattaaactctctcctgtacctccatggcccttttgtgtacttctactgcagtagactgcacatgtattacatttgcttatgtatctgtctaaactgtaagctccttgtgcttatctcagaatgtgacacatagtaggcagtcaatgtgcatttgtaatctttcatatcaaatgtctaaaccttgttattactctcaggttttttataggcaagagggtcacagcaacagccaagttattgaaacacagaaacttcaagcagtagtaccactcccagatgctggagtctatattattgaagttcgagcatatagtgaaggaggagatggaacagctagttctcaaattagggtaccatcatattcaggtaagttttgacacagtagatttaatttgctgacaaccaacaattacgagatggtatgaaagtcacgaaaattgatgtgatagatttcatggttcagagattttgagggatttctcctctctgatttttatattatcttctgattaatatgaaccatagtaatctgctcacaattgcagaatttctacaaatctagaaaggagttgacattttcattagaatatactgatttgtgaaatgtccttgcctctcctggtctcaagcagtaccttgctagccatttggtttttggagtatagcttttaaactgatattacactggttttgacatacctacatttctgtagttttgattgcctttattgttagacaataaggaatttaaagagaagcttttaaaattgaaatgtgaccatatttattgatttctaaacaaattataaattttattgtacattattattaacaatattaataattgctagctttcactgacccttattatatgtcaggcatggtcaaaagtgctttacatacatcatctaagtttagtaacaatcatatgagataggtgacatttttactgttttgcagaaaacatttaagtaacttgcctaagaccacactattactaagtttcggaaccaggatcaaaacctgcgtatgattgtctccaaaaccacatatctccatcaccaccatcattattacataagcaagggaaaactgattaaaggaagcaagattttagaaatttagaagaaagcaaccatttcgtagagatagtaaaaaaaaaaaaaaaaaagcaaaaattaggcaaatttctaattttaaaagtattagacaattttatgagaacattatgaaacattttctcatgtacaattagtgggtaattaggaacatcatttgttgagcaatcattgccaagcagaattatcaacctacagggaagtgtcccgtcatgctctgtatgtggccctatgttatttaacgtatttatcaacttgaagtcagaccagaggcattgcttgtgatttttttttttatgccaccaagtgaaatgggagataaatacagtgtagaaaagaatgagacagactggaactttgaggaaaagctactgacataatacttgataatttttttaactttttaagttcaggggtacatgtgcaggtttgttacacaggtaaacttaaacttgtgtcatggggttttgttgttcagattatttcatcacccaggtattaagcctagtacccattagttatttttcctgatcctctccctcctcccaacctccaccctctgataggccctagcgtgtactggtcccctctatatgtccatgtgttctcataatttagctgccacttacaatacttgataagttctcacatgaaaatacaggataaggaacattattgataattgataagatttgcatacctgtaaattagatattacatcaacattcatttcatttttttaaaaaactatactgtggttatatttttaaaagccttatttttaggaactatacattaaaatattttgaggaaaagatgcatcatatctgctatctgcaattcatttcaaatgtttcaaaaaaatgtatatatgtacagaaataacaataaagcaagaatgataaactgtcaacatttaaggaatctgggtgaattccttagtctcacaacttttcagtacacctaaaagtatttttaaatgaatagttaaaaatacaaaacataagatgggagaaatctgactttttcagaaattctggtgaaaagatctaagaatttaaattttattgtggtcacacaaaaatttaatatgctttatggttcatttataaaagtatagttttaacaacaagaaaagttataatgtctctgcattaattatttcacaattgaactgttcagatgaaggctgaattttcaagagcatcttaaaagactatttcctgaaaagcaaaatatacgacaaccttcctcttgcttcagcacgtcagattcctagacaacaatacagtgagcatttactgaggcctcatcacgttcctgggattaaactaggtgttttctatatattattttatctttctagcaatcctttgggttaggtattttattcttctctgactctctaaggttactttcaactccaacacaatcagattctatagtattatctgaataagatcagcctcaaccttggaagtacttatgacaaccttaattctcccatttatattttaaattgtaacttctactccaagaaaaaaattgtcaacttttatatttcagttaataaaatttgggcagtgcaacccacttcctgagtttcagtatgggaaactcttacactattgtctaccttagactcagaacctgagtcatgattggtttcatttttatcatattgcaaaaaccaaatgcctaagatattgaatgacttgcccaagtgaaacagctagttagttttatagctggggcaagaacttagtctaatgttgctctttctgttgttttgtggggttgttttgctgtatgaaagtaatatgttttagctttgtagattctatttgaaatttgagacacagaccctacttagcattctgaaagtgagatatttttataaaagtgtcaggtaagttgatttaacaaagatgcagccattcccaatagctagaaaggatgtgttcttgttttttatttattaagcatgcacatacgactccagtgagtctttgtcatctcgcctttcttatagctcacaagtggctatgtgcttcacaataaccccattttgtacaagttgaaatatatgcatcattctccaatatgttgattgataagttctagtagtgtattagctgtaaaatttttcaaaggaaagatttacgctttttgcatttgtgtgtgtgtgtgtgcacgcccatgtgtgtgtttaccaaacaaattattctctagctcttaagcatcaggaaaataaattcagactctatctttgcaactaaaactacccccccaaatcccattacactcagtctagccagagaggattaccttgacagaagattccagcaattgggtagtagattatagtattattattagggttttaactaaggccaatcattgttttaagagagataatacacgagtatctaaatccactaattcctacctcaattactctaagcaagtttacagcctttctaagccccagttccacctgcaagaggagaataaataattgtatttaccatataggaatgttatgaggatcaaataagataacatatataaaaagcttcgtacagtatgtgacatacaataatcatttattaaataatcaattatgatcatgatgcttcagaagacttctggcttgaagaaccactcctgatgttagtatctaaaagtcacttagtttgtggttatgtagggctattaaaactacttcagaccaatcaaccttggatcagtcagtttaatccaacagcgattctaatatattagctgcatacaatgtttttgtctcataaaagatcctctcctgggtataagaaagagtgacgaaagatcaccattttttgccaggtttggcatgagaacctagaatttaagctcactcaactgaaataatcaagaacacataaataaattcagtaaataaaataatgttattagattttaaaatttactagagtaagcatagtcatgtatttcttaatgatgaggataagttctattaaatgcatccttcagcaatttcattgtgtgaacatcatagagtatgcttacacaaacttagatggtatagcttactatacacctaaggcatatggtatagcctattgctcctaggctgtagacatacacaacatgatactgtactgaatactgtaggtaattgtaacacagtgctatttgtgtatctgaacatagaaaaattacagtaaagatatagtcagtataaaagataaaaaaatggtatacctctacagggcagttaacaggaacagagcttgcagggctggaagttctgggtgagtcactgagtgattgccaagtgaatgtgaaggcctatgactttattgtacactgtcatagactttataactgtatacttaggctatattacatttataaaaacaattttttctctaataaacttagcttactgtaactgttttactttataaactttaaattttatctcttttgtaataacacttaaaacatacataatacagattaaaaaaacattttctttatatctgtattctataaactttttaatattttttattttattttgtttgctttttaaactgttttgttagaaactaagtcacaaacatccacattagcataggcttaggcctaggtcaggatcatcaatatcagtcttccatctccacatcctgtctcactagagggtctacaggggcaatcatacacatagagctatcatctcttgtgataataatgccgccttctggaagcccttctgaaggacatgcctgaagttgttttacagttaactgttattctgtaagtaggagtacactaaaataattactaaaagaatagtaaatacataagccaaataacagtcatttgttaccattatcaattaagtactgtacattatacgtttatacaactagcagaacaggtttgtttacaccagcatcaccacaaatacgtgagtaacatattgcattacaacattctaatggctacaacattactaggcaataggaatttttcagttccataataatctcagggggccaccatcagatatgtagtccatggtggactgaaatgtcattatgcagctcatgactgtaaattatgaattcatattgccacaaattttgtaatttttgctccattttctgaactatgcactatcaaaattattttattttttatatctgaatttggaatactttcatcattggtgaaaattaaatctcatgattggatgtgtttgttagacatgacatcaccttttcaatacaatatctcatatatacttgtcccttctatataactttgggaacctcagataatgtctgattttataaatataaagaacactctcatcagaaacaggagcgatcttgcactcattagtcttacatactaaaaacaattctgtcctagctcaagcaaaaccaagataatttgctccatttgatgcttcttttttcacaggtggaaaaatcacaagtgcacagtcgacccttcactctctctccacatcttcgtcatcagtcaccttgctcttggcattgatgattccttcaacttcctggtgaaaactgctgacttaatttgcttttgtttgctttagcttggtaacagcggtgaatagagtgtagtgtaagtggagaaccaggatcctgagatgagcttgagctttaaaaacttgggactatacatggtgaacttacaggaggttaggggggaaatattacttatccatcaggtttctctttggtttttgtaaacggagaggacagttcttagtccagtaaaaatatgcagattgtatgtaatgaatttttgtaaacaaaggtaatttctgtcaaatgtattctttacttttttaatatgttgggattttattttatatctgatgactccgagtgtgtgccatccatttgttaagtaactggcctttagcagatctgtttcaaaaacaaatacaaaaatgagaatgaaaagtttgcttaagactaagtccagtgtttttcattttccctttggctgaatatttcaattgacaaaccagcaggacatatgaaaaatgcttcagtgatgtggtccattataagataagtacacaaaaattttcttgaaaaatattgtatgattgcatagtgaaatagcaagatttgtcaatatgctattctatatgcacccctagagcaagtcattagggtagggaataagccatttacattagtgcaagatagaaagcgagtccagatgaatttcagtgctatagtttttcataaagtactatgttatctagcagcaaatataataaatatttatttttaataacaaaagatggtttaacatcaccaaaaaatatgatcactaaaaactgcagacatgctggcatgggtgctaacttaaaaatgagatgaatatgggacagagcgtttccatttctttacctactgccaaaacagatgttgaattaggtccaaggttttcttctaattgcaaaattttgcaaaaattttaagggcaatgaaaatttgttgtgcaaataattatgcatagtctgtagattaaaatggttcaagtataacaaataagttttgatttttaaaaacagttccatgcatcacataccactgataaaatcaactagtaaaataaagacagtctttcttggataaattgaatttttaattaagctgtggaaacatggcatcagtacagggattcagctagtctagccagctatgcactgtttgattctgtggcttgggaagtaatccttatttgctatttcaaagagtcatcttgagcctgagagatcctagagagttgttggaaaatgagatgaaaattttctacttgatgatatcttaaagaagttctaacaagcacaagaatgtgccagagttggcatcatacccatgaagatgcgtgaaaggatagttattgcaaagtcatatgccagagaagagcctggagaaactatggttttataggcgatgttaacaagagaacaaaaattggttttataattttatataatttaaacttgttaactgtatttgcttcattaataacaagcaaaatgaaacaatatggagctcaaattgctagctctcaaggttaatccttgtagaatcagagaagtgattgaagtttctgttctgaacatcctgaaagaatagtttcagagccacagtaaaagtctgtatgtaggttacatattctctttggggaaatgatgtaagacaccctaaacaaacaagaaattagttaaaagactcactcaatgatattatagtaaatactacagatggtaagtatttaagcctgtaagtaagtaattatgaccaagtggcctttcttgaacgcctcctttaaagtgggagaggctggactttgcaaaaacagggatgctaattgtttagctggcaaaacatgagctctcccaagtatagtttacctttatgaattgtgcatctgaataaaagacagaaagaatatttttaatgcaaaataattttacgtatttcatgaatcaagccattttcttcattttccatggtggtgtacaccagatttagtgaaggactttaagaatcaacttcttacttacactctcagaaagcaaagcccagtaaaatattaaacaaataaaatggcaaatttaaattaaccaatatttttaattagctgatggatggtacgtatctgacagagtatttacacatatagaatgtctgatgtattcttacaggaatcagagatatggaatgtttttacttaacatacacagaatatgtattttgcatcataaacctatttaaaaaacaggttttcaatgtttatgtacttatgtgctgcatatctgttactttgtagaaaccagaagagcattcttatcaaggtacattatttttcagctacagtactgagttttttctgctatgggatagtaaccacagtcttaaatcactaaagagactgtatttttgtataatgtccattgaatatgaagaaagcaacagtccttataattagaaatttcatgaaagcaaaagttttgcatacccaaatgaaggtactgtggaccccatgtcaaactgttaaatatattgtgtacgatctgtatatatactatatataaggcatataccgtgtggaaggcacagtcaaataatagttctgtgtactgttcttgtaacattagatctttttaataaataattctctttttattgacttttatcttctctcctgtcaactatatgaatgacattatttattttatgcagaccacagaatgccaacgattacagtctgattttaacactgaaatatcattatgttatgctgttatgatttgaggttcaaaaatctccagaaatgtccacggtagtcccaacttgaaaatttgaagctatatcaaaaaataaaacaagaaatgaagcaaatccagatgggataagttcggggttaaactcatgattttcttttcaggaaaagagactacatgaaatcagtttcataaagaatttgttaaatgcatacttctgcttttattataaacagttaatcccaatctattctaagtacaattctcataggcattgactctttttttgtcccttagccctgttatacatctcaactataccaataatcacattataatgatttgttttaaacgcttctctccaactatctagtcactgggattgcccagggaaaaatacattattcttggaatttctctcaccagtgtctagcacagtatctaacacatatcaaatgagcaataaattgtcagccttaaaatttcctttggaacgagctccccaaaactgggtaatcgtccaacacagctgggaacccaaatctccaagttctcattcagtaggtccgagactaggaaacccttgtttttaaaatcttctcaaacacaaaataatacaactctattaaaggaaatttggcaatatctagtaaaattttatatggatttgcccttttacctaggatatccatacctagggatctatctattcctaaaatagatacaaaaatatgcaatgttaagtggataaaacaagatacagaagagtgaatgtatgacccttttgtgtaaaatacaaacacatttactaatattctgaagaagaaataatgcaagcataaactaatgactaataaaaaagtgttaccgattgaggagggagagaatgggatgcgggaacaaatatgcaagcaaactctttttcaatgtacagtactttttcatagttttgattttggaactacacaaatgttttagatgaaattaaactttaaaccaaaaggaaaaaaaaaacaaagcaatctcctaacattgagaataaatagaagcaaatgaacctgaatatctatcaaccaaacggtgggtaaattgtaattttgctctttttttaaacttttattttagattcagggggtacatgtacaggtttgatacctgggtatactgcatgatgctggtttggggcgttaatgatcctgttacccaggtactgagcacagtacacaatagttagcttttcaacctttataacccagctctctctcccagctctccctctctcccagctctagcagtaccaaatttctgttattgctgtgattgtgtcaatgagtacttaatgtttagctcccacttataagtaagaacatgtggtatttggtttccgatcctgcattaattcacttaggatcatggcctctagcaacattcatgttgccataaaggacatgattttgttcattttatggctgtatagtactccgtggcttatatgtaccacattttctttatccatgtattgttgatgggcacctagactgattgattccatttctgtgctattgggagcagtgctgtgatgcacatgtgagtgtctgtgtctttttggcagaatgatttcttttggatatatacccagtaatgggattgctgggtcaaatggtagttctaagttctttgagaactgctttccaaactgctttccacagtggccaaaataatttacattcccctcaacagtgcataagtattcccttttctccacagcctcaccagcatctgttgttttttgactttttaataatagccattctaactggtgtgagatggtatctcattgtggttttgatttgcattgctctgataattagtgatatggagaatttttcatgtttattgaccacgtgtatgtcttcttttgagaagtgtctattcatgtcttttgctcattttttgatgaggttattttttgcttgttcaattatttaagttccatatagattctggatattaaacctttgttggatgcaaagtttgtgaatattgtctcctgttcagtaggttgtttactctgttgatagtttcttttaccatccagaagttcttttgtttaattaggtcccacttgccaatttttgtttttgttgcagttgcttttgaagacttagtcatgaattctttcccaaggccaacatccagaaaggtttcctagattttctactaggattcatatggtttgaggtcttacatttaaatctttaatccattttaattttttatggtaaaaagtagggatccagtttcattcctctgcatatggctagctagctagctatcccagcaacatttatagattacggagtccattctccattgcttatttttgccaactttgtcaaaggccagatggctgtaggtgtttggctttatttctgggttctctattctattccattgatctatgtgtctgtttctgtacctgtaccatgccatttttgttaccatagccttacagtattgtttgaagtcaggtaatcttaagtctttgtctttgttctttttgcttaggattgctttggctttcttggctcatttttggttcccaatgaattttagaatagttttttctagttctgtgaaaaatgacattggttaataggaatagcattgaatccatagactgctttgggtggtatgcccattttaatgatattgtttcttccagtccatgagaatgtactgtttctccatttgtttgtgtcatcgatgatttcttttagcaatgttttgtagttctcctttagagatctttcatcagcttggttagatgtattccttagtgtgtgtgtgtgtgtgtatgtgtgtgtgtatgtgtgtgtctattataaataggaatacattcgtggtttgcctctcctgttgaacattattgttgtatagaagtggtactagtttttgtacaatcattttgtatactgaaaactttactgaagtcatttatcagttctaggagccttttgtcagagtctttagggttttctaggtatagaatcatctgcaagagagatagcttgacttcttattttcctgtttggatgccttttacttctttctcttgcccgattgctctggccagtacttccagtactattaggttgatgcaaaagtaattgcagtttttgccattaatacttttcaccgcaattacttttgcaccaacctaatatgttgaataggagtggtgagagtggacatccttgtcttgttccagttctcaagggaaatgggctttcagtttttgcccatttagtatgatgttagctgtgggtttgtcatagatggctattattttgagatgttccttcagtgcctagctggttgaaggtttttatcattgagggatgttggattctatcaaaagatttttcaacatttattcagataatcatacggtttttgttttcagtttggtttatgtcatgaattgcatgtattgatttgcatatgttgaatcaatcttgcatcccaggaataaagccaacttgattgtgtgaattaactatttgatgtgctgcttatatgatatactagcacttttttgaggatatttgcatctgtgcttatcagagatacttgcctattgctttcttttttcattgtgtctttgccaggttttggtatcagaacctaaatggctacctaaatgcccagtatcactggcttcatagaatgagttaggaaagagctgcctcatcctcttttgggtgggatagtttcattagaattggtaacagttcttctttgtatgtctgatagaattcagctgtgaattcatctggtccagggcttttgttgttggtggtgttggtaaggtttttttttgttttgtttttgttttccattactgattcactttgcgaactcaatattcgtctgttcaggatttcaattatttctcaattcagtcttagaagattgtgtgtttccaggaatttatccatttcttccagattttttactttgtatatatagaattgttcataataatctctgaggatcttttgtattggtagaattggttgtaacgtcacctttgtcattgttgattaagcgtatcgagatcttctcccttttttctgtgactctagataactgtctattaatcattttattatttcaaaaaagtaacttttggtttcatggattctttgtgtagatttttgggtcttaaatttgtttagttctgctctgattttagttatttctttacttttgctagctttggggttagcttttcttttcttttctcttgtttttttttctctagatgtgatattaggtattcattcaagatctttctcactttttgaggtaggcatttagagctatatcgtttcctcttaacactgcttttgctgtattccagagattttggtatgtttgcctgttttcacttctaagatttttttttatttataccttaatgttgttgtttacccaaaagtcattcatgtgaaagttttttcttttccatgtaattgtgtggttttgagagatcttcctggtattgatttatatttttattccctgtggtcaaaaagtacagttggtgttatttcagtttttaaaaaatgtattgatggctgggcacagtggctcacgcctgtaatcccagcactttgggaggccaaggcaggtggataacgaggtcaggagttcgagaccagcctgaccaacatggtgaaaccccgactctactaaaaatacaaaaattagccaggcatggtggtgcgcacctgtaatcccagctactcaggaggctgaggaaggagaatcacttgaacccgggaggcagaggttgcagtgagccgagatcacgccactgcactccagcctgggcgacagagtgagactttgtctcaaacaaaaaaaaaatgtgttgatacttgcttcatggctgagcacgtggttgatcctgaagtatgttccatgtgcagataagaagaatgcatattctgcggttgatgggtggactattctgtgtatgtctattcagtccaattggtcagctgtcaagttttaagtccagaatttccttgttagttttctgcctcagggatctatctaacactgacaatgggatgttgaagtaccccactattagggtgtggctaagtctttttgtagatctaaaattacttgctttatgaatctgggtgctccaatattgggtatatatatatatgcttaggatagttaagtcttcttgaattgaaccctttatgtaatgcctacctttgtttttttattcttgttggttttaattttcttttatcagatacagaatagtgactcttcctcttttttatatttcattttcatgttagatctttctcaaacctttgagtttataagtgttgttatatgttagatgggcctcttgaaaacagtagatagaaaggtcctattttactatccatcttgccactctgtggcttttaagtggggtacttagactgtttccattcaaggttaatattgatatgtgaggttttgattctgttgtgaagttgataactggatcttttgtagtttctattgtgtggttgctttatagggtgtctgggttatgtacttaggtgtgtttttgtggtagcaggtatcattctttcatttcttatgagtagtgcttatgtttaaacttcttaaggatttcttgtaaggctggtctaataataacaaattatcttagtgctgaattggaaaagattttatttctctttacttatgaagcatagtttgattgtatattaaactcttaattggaacttctttaagaatgctaaaaaataggtttctaatttctgctggcttgtaacctttctgctgaaaagtctgttaacctgatagagttccctttgtaaatgatctgacctttttctccagctgtctttaagatgcaaactttttcttcaggtgcccttttctttagcattgaacctgggtagtctagggactatattccttggtgatgctcatgctttatagtttcttgcaggtgttctcttgatttcttgtatctggatgtctgtctctctagcaagattaagaaaattttcttgagttatcccctcaaatgtgttttacaaattatttgctttttctccttctctctgagtaatgccaataactaataggtttggtcactttacataatcccttatttctcaaagactttttaattctttttttttttaatttttgtgtgactgggttagttcaaaagtccagtcttcagattaaaattcttttttctgctttgtccagtctattgataaagctttcaactgtattttcaaattccttaactgagtttttcaattccagaaactctaatttattgttaagatgtttatcttttgtttcttagattgctttagaagcttatttgtgttgatttttcaaccttgttttagatctcattaagcttccttgcaatctatgctttaaattatttatctgtcatttttgagtttccattttggttaggaaccattactggagagctagtgcaatccgttagtggtgtcagatcattgagatttttcatagtgccagaatttttgcactggtttcttccagctgaagatactgtcacttctaatttttaaaattattttcatatggctagcaattttttgcatctctttccctatgatttttgttttcactttcctttttccccttccctagggggttacaactgtagagaatgttggataaggtcttctggctttgcttctgtagccctatgcacttgtttcagcaggttttatattgagctatgcggttttacctacaaacccatagatggtggttataggtaaaacccagctgtggtcaatgtggattgtatctatttgatctttgtttactggcaaaagctctgctgtctcaggtaattagctgattcatgaaatgcaatcagctgagctccctgatcagccctgggggtgtggggtcctcactgcacatgacctgtatgcatggcagttatgcatacaggtctcccagtgtcaggcacaacacttacactgagggagaatccagtgggtggccaccaagtacccagagcctaggcatggatctcgggaaacttctcagccccaagttctctgcacagggatggtagtggtggcctaaactcctaatccaggagagtggatgctatggatgcctggacttcttcctgggtatgaggctgagaggacttccctgtactatgagctatacccaggaaggttaggatggctcaggctgctgaaccaggtgaacaggtgccacaaatgcctggagatctgcctgcacacaaggcagaggggggccccctgcaccacgatctatgcccatgaagggtaagttaactcaggctactggaccaggaaagtgagtgctccaaatgcctggatttctgcctagggttagagcaaagagggccttactacaccacaatctcagtggagcaggctgggcacctagcaatggcatactcagtccagtgctagtttaccaagctggctctagttgcaagtcttgccacaaaggagaaactgcagctaaaggagctcttctcctactccaggcttcttatgtggtagagcactattccagcatctactgatagtgttttccacagttctgactgtgaaggcccctaccctgctccagagtgggtgccccaatctcaggcctgagataaaaatacctct

SEQ ID NO: 255 - DNA, 910049 bp, Homo sapiens
acaacattttgctttttttctaaagtcttctttaaataaataagtgctccatctttttcccctgataaatttttatggctttattgtgcctattctttttggttgtattgacaaaaaattgtctttactgtgaggcattgcagtttagtttctgaaacttgctattaattttttcagaaaatacatcatcattgtccactagaaacaagtttccagacacatgtgaaacatgtagaaaatgtgcactggtcacattctaaatatcttgtttccccaagggagtgtgattttttagttcgtttgtttgtttttattttttttagagacaagttctccctctgtcttgaggctgaagggcagtggcgtgatcatagctaacttcaacctcgggatcctgtgctcaagtgatcctcccacctcagcctccagagtagctgggactacaggtgtgtgccacgtcacctggctaattatttttattattattattttgtatagacaaggtcttgctatattgcccagcctggtctcaaactcctggcttcaagtgatgcccccacctctgcttctcaaggtgttgtgattacaggcatgagctaccgtgccctgcccataattatcatcaatagagacaatgactatatgatcttgccacacttacaaagctttgctatgagagaggcaacaaaatattcccgacgaaggcttgctgggtgttaaggtgtcatatttagtgccacctaattatcagtaacagtaactatttaatgagtgctgcaggcactaggcattgcatttcatttacctcacctctgattttcacaacactttgtgatttcctgccatcccattttacagatacaaataatttatataatttgccttctatatcatatatgtcaagtgaggtgaaaagcatgtgcccaatactctgaatacgaaatctcaaatccataagtttctttgagtaaagtgttagaaacacctaaagaaaaaacatacgttgaatggagaagcaacacattatctcactgtaattactaacgcatctataagaatttgtttatctgattagaaatgacctgactgacttttggagccaaacaactatgaaatataaaaccactagccactcccctccttaaaacaaacaaattctccaataccagtttcttcttcaacaataaacacaatatcaaacccttcacacttacatagtctggctcttagctaaatcacctatccacttggtggtcacagtaattctggttgtcttccttctagtcattctgtttccatcctgaagtcaactaaccacacaagcacaccatcctcctcccgtctctcagcccaccacataagtcattttttctgggaatctttcctgaccccaagatgaggtggagtcctctttgaggtgtgatcacattcctactgcactggagttgttctccttgtcatgtaatgtaattgtaattagttgtgttacagggacaaaacttactaaatcatgagttttcatgagccttcatagttgttctccttctgtttgtccactttctgtgctttcgttgtgttgatccaggtattgggcgagttggagacctggataaactgtagagatttttggtcagagagagagagagacagagagacagattgataaatattaagaaaataggaaaaaatgtttaaaaaatgctaaaagtggccaggcgcggtggctcacgcctgtaatcccaacactttgggagaccaaggcaggcggatcatgaggtcaggaaatcgagaccatcctggctaacacaatgaaaccccgtctgtactaaaaatacaaaaaattagccaggcatggtggtgggcgcccgtagtcccagctactcaggaggctgaggtaggagaacagcatgaacccaggaggtggaggttacagtgagccgagatcgcgccactgcactccagcctgggcaacagagcgagactccatctaggaaaaaaaaaaaaaaaaagaaaagctaaaagtaaaatgacaacgggagttctttatactatttttgcaacttttctgtaagtttgaaaatatgtcacaatactaaaatataagtattcacaaaaacatgcagtgatactgagctgtcagaattttttggaaggtaataaagactgatcgataatcactaatcctaagatatcagagaagtgataagcactgcatgatatttattctatatttttaagggaagtgagatgggtaataatttgaagtctcaaatgcaacttggtgagcagaaatggtttcaaccccctgtaataggcatcactaaatctacatatacagcctgtattttctaagatttcagagatagtgttgttagtcttatcccacagtatctggcacatcaaaaggtcttgataaaaataaaaaataataataatcctgaatggatgaatgaaccatcatgccccctaatgtatagtccttctatacgttgtatcctattctagtaggatacacttactagactctatcagaggtcaacaaaccttttctggggagtcagatagtaactaatttaggctttgtaggtcagatctttttttttttttttttttttttttcggagacagtctcattctatcacctaggctggagtgcagcgctgccatctcgatctaggctgactgcaacctccacctcctgcaacctctgcctcccaggttcaagcgattctctgcagatcacatagattctgtggtaacttctgaacttcacaattgtggtgcaaaagcagctgtagattaaataacacaaacaaattagcatggtaatgttaaaaaaaacacacaatttatggtggatttgaatttgaatttgaattttatgtaatttgcatgtgtcacagatgttattcttttcttgattctcttcaactattaaaaaatgtagtgatcattcaagcttacgaacttacaaaagtaagcagccgaccagtttgggcttgtaggacagggtttgctgacttcttgagtatgtcatgtttttctttttttcttgtataccaatcctctttcttaaattgaatgaagcttgagcacaggtacgtgtactcctagcatttagttatacattgccagatttacaaaaaatcttgtgcaaattgaatcaatatatgctccacttaaatgatatcatataactgactcttgaaaacctccctattttagccatttttaattaaagatgtattaggtcattttatatattacttaccctttaaaataaattttccttcatgcaaaaggaaaaataaaagtatattgaccgcacagcaagtttctctgctgtttgaatgccttttgttttcagtgctacatcatgatctactaataatatgcacagcctaagtccaattaaactagtatgtttgcagtgcctccaacagggctaaaatcgagaagttttccattgaaagaggcaggtggcatatttaaaaaataacagtaaaaataagatgacaatttgtattcaatattttgggttataaataattattattctaggtcttgtgtgatttcttagtagatgtaacatcaaagatataaacaacaattttaaaaacatcatcagcagatttgtttttctgtttttgatttgtttttgtgctttggtgccttctcctgcatcctttccccactttcccacaaataaacaagaattcagcagccttcaaagtttttcacagggctgcttcaaatctgctctacatttttttcttcctactagtcagcacaccccctgctggctctaggctaacattctttccaccttattaaaaatgccaataaaaagcaaattataaatgtttttactgtgctttgtgtgctgatttaaattcaaaagggataaaaggacataaatactagggattaggttatataataagataatcttttgaaatcagctccttcttcttccaaataatttattccctgaaaaatacatccttggaaaattttgtaaaagagttttcctagtagtggctatcacagatcatatgtttagatgtcagcttgacttaaaaatcagatgtgcacctaggatagaacagatacctgctgttcttcattaattgcctttaaaaaactgagtaatagcacattggctgtgaagcaagctattccctgagagacagaaacaaggcctttgtaacactaaaaataatttttatagaagtcaaattgtcaatcatatgtggactcaaatgatcagattaattacacacacacatacacacatactctacaaacacacagaagatttagtacatttatttcatttgtgaacacttgtggcaccgagcaatgacgtgataacccaaaaatctggtatcagaaaacacaggttcagatccttgcacttctaaataatagctttgtgttttggacaatgttacttaaatttcaggagtcttaaaaatatctttatatgccaaatgtagctaatgatactgacttcagaattttgccatgaattctaaatgaaaaaacaaagtcaaaatgcctactgcaggttgatatttaatgaacactgtttcattttcttctagagaaattaacaagtagtagcttaaagggtataaatatttatggtttttgagtagaaataatttaatgttgtgataaagattcaggaaatgtccatctttttttttttttctcatcttgtagtcttggccaactctttaggttcctaaattggctattgtcattacaaacctcatcccctcacaagatattgtacatgctatggggaaaactgcaggagcaatgacctttttattcccactcttctccttttcactaagaagatctctttttcctcttgagtttttttggtcagaactgagtcacacagcaagcaccagataatcactctgaaaggggtatgcaattgctatggtaggcttactccaattgtgatttctttaccagcctgttttggaaccaaggaaaaagttggaattggctgttgaccaggacctcaatgtctgccacttggatggacttgaaagatacaggattaaattgttcctctcctataagcacttattacttgtgtttgtacatgtcaacttcccagctagaaattgtggaaagtataaaaaacttcagataggaccaggtcattgatgacatctatttgaccaaaaaaaaaaaaaaattatacaaggctaggcacattagtgttgctcaataagttaatgttgagttaattaaattattgtgattattttgagaaaaaatcttgcaggtttccactggaatgagtaatttttagatgtttgcacttattttttagatgtttgcacttacttgaactggcaaataaaatgcattagaaatcctgtgattatggactgaataaattgtcttctccaggctaggacacagcatttacaacttgtgtccatataacaaaagtatttttaaatgtatgattcctttgaatatgcacaaataccaaagccagggattatcataattcacaattcacaggaatggaaatggaatctcaaagagaccaagttatatactccaggcctcgtaatagtaagctgcaaaccaaggctaatacttagaatttcctattttaagctctgaattatttttatttaattatcccaaacaagtttctcctgaaatgttatatatatcaaaatgacttcttggtgattataggcaggagttcttttagagagagacagaaataaatgaaaaagaaaaactatttttgacatatgtttctggatgtggcatggctagatttgtatcaatgcaattatatagatactttagagggtaaattccttcagagaaatgaatctaaatattggagaaatatgtgactaggaaaataaactatcaggatattaaccctaaactgcattttcagtttttttttttaatatagttgacatcttgattttaaggtaaataaggataaatgtccttaaaggagcctctgcattctggtgcaaggagtggattgggggatcgttataacccctgaaataaccgacaaggactttttgtagctaacattatcagacatcaactattccttgaaaatctactatgtgtgctgaaaactcaaagttaaatattcttcagggaactattcttgagaaattactgagttcaggaaacagagaattgttagtggagtttggacttgaacatttgccagtgggaatgaaaagtccaggaaaagaggaaagagcagtatatgcaaagagcacagcatcttaccagctgaaaagcatgcacacccggcaaaggcatctaagagcaatggccgttgtactggcaggaggcagatgacagaagataactatttttgatagaataggggagggggggaaccttcattttctgtgcccctatgggttggagccattaattctgtgtgacatttatcatgtcaatatccatctcctcttagtatcctatccataaaatggagatgaccaaacgtgccttctatatgcctcacaggagaattataaaatcaatgagatgaaccacttgttgaatattccaatgctaagattccatttgatgaatgattctttcccttctgtccataaggaagaataggtggaagtgctcaagggaaaatcaaagaagcaatgaaatgccatcctacccatttcatttccttttttaagatttcaaatataagtttgtcttgagaagatggtcagatttatcatcttgaaaatatagacattttccagtttcaaaattgtccattttttccccattttctgttagtattcaacctgctccatccatgcagaacttttaagcctcttcaaagcagagtgctctgcaaaaacgagttatttttctatatggagaaacatgggggagaaaagggagtttactcagcttctacttcaccatttggaaagtggatttatcagactaaaagctttacaaaatagtttcaataggtaaatatcaatctggctgaaaacagtttttatagtgattaatattctactgctaataaatacttgctggcaaaatgcccccagaagatggcattgtttacactattgtctgagaggaacagctgtttacccctcactacattcagagctgcagtattcttactaaaatgttaacaaatattagacaaatgtctcacatttaaggctcaacttgctctgagaacaggtgtgtttgagggagaggaaaaaaaagctacaactataaataggagtttaaattaggtgaaatttatacactgtgtctgcatatagacatataaatgcagagtttcaatatttactaataacttgaataccattcacagttcgagggcttcatggcaaaaaatttcctaattgcctgttaatatctatcttaagcacattttactggcacagataattaatttaaagccattctgctggaagacaaagccaacatattctataacttttgaaatgttatattaaactaagcatttttggggggtgatgtatagaaggtggaattatatagtggaacattaaactcagtgacaaaagatctgtgttgtctatcatattcctattcataaagagaggggtcttgaagtgttgttagggatgtggaactaggggaaatctcacacactgctagcgggggaggagacttataaattggtaccatcattttaagaataacagaaaatacctggtaaagctgaaaacaagcatttcctatggtccagaaattctactcttcagtatatgagcaagaaaaactaagaggcaggtacaagattgtacttttttaagggaaaaatcaacaaccctggaaacaatctgtagattcatacataaaagaattaatgaatatattttggcatatttatgaaatgaaatacaatacagtagttgtaataaaataactaggactttatgcagctggatgcatacatttcaaaattataatattaagtaaattgcaaggtgcaaaatgaaagaacatgacaccgtttatgtattggttaaagacaaagcactcttacatattgttcagggagataaatacgtgtggtaaaagtttaaaaacattatgtataggaatgatatacaccagataagtaaagtgtttacttctaggtatgatggcagatgaatgggatcagagaagaatgcaaaaggagcttaagttatatctctaatattctacttttaaaaatgtctaagtgtttgcatacaattacaacataccaagctgtaatggctcagtgtattcctctagatttcttagtatgattaatagccagatagatgtttttcaccatgggatcctcaaaggctaggggttgggtggcaaatcctgaggaccctaggtagaaggaaaaaagaagcccatgcagctcaactttgaaccccagccctctcctctcttcagaccccttccagctgccaacagggcagctccttaggtcacctcagcctggatatgttgacattcaccatcttctgggtgtggtcctccactgcaccctaccatgcaccccaagtaaagctccagctgggaaagtctttcagtttgctcaggaatctagtgacttacataattatctttagttagaagcttagagagaagaggatcatttatgtataagtgataggaccctcagaattctttcttctctaataaaataatgaggtcactaatccagttgtcattcaactgtctcttaatatttcaatgatgtgagtctagctgtaaccaaaaaacacaaggttaacctcaggattcatgcagaagctgcttgaaacctagtcccatctatagtcgtgcagccaggattgtcaggagtctgcagtgtcaaataaggcagtataattgcttctgttgaaggtaagaggagggtggggagagaggaagacatcaaattcctctgaagcaggtagagttcatcaaccctaacttaattgtaagcttcaaataggataaatcattatggtccctcattttgttaaggtttgacagctttctgacagcttccaataaaaacaaaataagttgatttatgataaagcaggagagtttccagatatatactagaagccaaaaacagaaacaaaatttgtaagcgggggtgtctagaaagaaaccaaaatcattctttccctttttcaaaattcaaatccctccagcagagcccttatattttggattcttacgagctaacccgggcttccaccctgactctcatcactaccacacccatgtgtctttcctctctccgtctccctgagacgccagtgaaccacctgggcttggaatccagagccccggaacaccttgcagtacttgcccgaagcaacgcgccaacagcgggagggagacgcagacgcgaagaccggcgagaggatgtgcggtgggagtagctgcggggtctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctttgggcaaaggaaacggaaaaaaaatgctgatcagtgtggttccatcactccaaccatcccaaaagttagtagagctcaaatgagccaaccgtgctggatttcctcccttcttccgttatcgcaaagttcaagggataaggaaaggtttctcttcccttaacctcctgctagctccgcgttccatgcctgcctgatctcagccagtgctttttccggagaagggcccctggttcagacagaatgcactgggagctgagcttcctgggatggagatgctcccagccaccgtgctcggtgacagtggctcatctctgaatgcagtgcctcggatttgcagtataccaagcaccccacgatacgtggctctgcgttctgccctaggcagaaggctccagttggggtatcttgcaaccaatgggcaccggtttaacaggattgggagttttggcctaagagtcatggaccaatgttgttaaccacaagatcaatggctgcccctattacaggaggaagagctttgatgcataccccaccccaaaaatctttgtgcctgtgaacactaatgagtatgcactaagtgtacactctgtcgtccaagctctaacctcggcaagtgtaggacatttaatttaataggcaagaagcctgggctcccggggatccaccaactgcactatatatttaaagaatccagtccgtcaaacttgaataaatctctggagctatgagaggttcaggctcaattcctcagctgcctctctaggcagagaaagggaagtttttccagctctgggacttcctaaatgagaaagaatgcaattaagccatctgtgttgtttccaaagatggtttatcaaggtccctcaagtttctgggcttgctcccatatcccttatccctgtcatgaagctcagaaatattacccatattggaacagttttactttttagtttttgtaatttgcactatcatggttggttagagaacagtaggaagattacttaccacatagggacctttctacctcactctccacccagttaggtcctagaggaccctgtgcatttatccccggagttatgtctcaagggaagacaattggacaaatgtggtgtatagaaaaatgttcacaactgagccagtgtttctgtctgtggtcggaagttttggagggccagcatctatagttagtcataatgccttataccgattgtattaaagtttgtgttctacaggaaggctaaagggatcatcctctctaagggagtatccaaagggccctggtttagaaattatttcagagaatatgtaggagccgttggaatctgagtttttttcttttacttcttcatctcattctcttccacctccttctttttcttcttctgtggaattgttcccgtggtgctttagaaaaagatctaagtggttagtaagaggaggtaaggcacagcgctgggctatttttctccaccttctagaacactagaggtcagtattgtcctaatgatacaaaggcgtggcagcaagctagctgtgttttcccttcagcacagctgcctatctgagaagagtgaatactttgaaaagccacaaaggtgggggtgagagataaggataaaaaagacagaacatactccacacgcatatggctgtggactttctaatgcaacaccttttcttaagagccaataaaacaaatattttagaatagcattttttgtaaattaattgaattatggttaatgtgttttaaaaatgctcataaaacctaaatgacatggatttaagactcatgcttatcattaccgatgtagtaataaagctaattctgaacatttaaaatgaaactttgtgataatgagctttagtattttatcagtgacagtttaatttccctatttccaatcaacattttaattgaatgctcactgcttgctaaatattttgaagtcagcgttcttaaggaataattattaatgatcattatgctgtacaaaatctattaattgaataatagaacagcagaaaaaaattagctctgaacttgatatattttggtgtcttcataacctatgatgcagaagctctaagaaatatgcattaaaattccacaattcctttagatttctactgaccacactctttattcattaaatataggacttgggtttatttttatctataatcaattaatatttgtatacatatactgaacattagcaatttattttcaaatagtcactttataaaagtttatttggaaatttttttacaagattattcttcctatattttgaagtaatatgtcgtgacatttgtgacagtagccttgaaaatggatttactaacccaatattttccatagtatatagttgcactgtggactttgttcaggtatacataacttctaattgtttttattattcttataataatatgttgttggtggttgttactatggtgtggtgtgtatgtgtgtgttttgtgtgtgtgtgtgcacatgcatttacatttctcataatctgaccgaaacctgggcttttaacttcaaaggaaagatgaatgcttgcccaattatagattttataagtttctaattaaacaaaattaaaataaagtcaggttagaagggccagcttcagtacagatattatgaatctgtgcagagaacataattacttaccagtaataaaaactgcagaaattccctcatttcagattttcaggatattaaatagctacaattcctcctctgggtttatcctgagggaattagttaacatcaaatgtagatatagtaggccaatgtttaatgaaaaatcattttacatataatattaactcttttgacataagaagaagtgatatgacttgatagttggttaaagtgaaactgggagttagaagagctgaggagttctagccctagttatgccacagctaagcgttcaaatacctattatgttattcaaccttatagtgctcacaggcttgagtataaaacagcaattgaggtatgcgtctactccaaaacagaacagcaggtaaatatgttactgagaaaattatttaaatattaagtatggtaagagatgattgcactgataaaatgtgcattcagaagatagcaggaatacatggagcacatatggggtcactattaactatttttaacaataagtataagttgtgcgattataaagagctttaattttgagcaatacatcactttgaatgatttccatgtgcagtatctaagtttgttgctacatattagggtcacacaaatacagcattgagagagggatcaaaaactcttcattctagctcattcatcatatgtagaatttcaactaagatatatgaggacttcaatcagattcataaagctcttcaaataaggagatgaactatactttgagttatccgaagcttatgcacaaactcaatcaatagataatattaaaaataaacaatcacgctggttttttcagcagcaactttttgtggcatttacagtcaccacaagtaaaggaagcactccaatgctcatttggaagagtcctaaagattttccttttgttgaattggcttatctttgacagtacctatgagctctttttcctttctcttcccatagtcccccatctcaaaactaaattgatatttctgcaattgggaaatgtataccaaaccctggactagcgatttccacacaagttcaaaattatgaaaaaattagttttattacgaaaaccttactctctccttgctttatttttgttctaatgaatgactatcctctaaattgcagttttctttctttttcctttgttcctctgcccaatttcattgctttctttactggatctcggtttccctttactgaatcactttatttcttaatgcccatttgttaaaaaaacaaagtaatgcgatatcatttgaaatgcccctgaaaccttcagttggtgattcagagtcttcgagttgataagccagaacttcactcaaatatttcctgtgtatacaatgataattatcccccttagatgagaaggtggagaaaagatctagttacctaaaatcccagaggacaattggaattcactcaataggactttattgaaaggttgcagtgtacatatttggagccaataatgacatttttaattcataagggaaggtttcttcattcatcaaaactctgccactttctggatggtgaccttgtagaggttacttagttaccccaatgatcttgctgtatgcaacgaagaaaatggattagatcattattattaacatcctatttacttttaatgtaatttgtctttaaatgctgatattgcctactggtcattttatttggatatttctgggatgattatattctaacattgtaaagcaattataattagaataacaatatagtagggttttaattcttaccaacttctatacacttatctctcacctcatattgtgtccacataaattaccaaggcagtacagctaggtatacttacagatccagtttacagatgagcatattcaaggttagtagaagttaatgatttcctcaagatcacagatctaaacaataaaaaatcaacatctggacctatatttatctattatcaaacaccaaactctttgcaagatatgaaacttactccaaaacattcactttgacactgtgtatatacatatctgtggaaacttgacatgggttctttatggttaatttctgtagctctacccatggcaaagggcatgagagtagcagttagcaccacagccaactccagagtcacatctaaaagaaaaaaaaaatggagatctagatttgatgcaaaatgctaaacatcacaatgaccaaagataagagcctcatctggatgagcacttgatgctttattttttatgagctttgatttaaaaagttgatagggaaaggacatagccttgatgaggacttgtgaatccctttcctacacatacagaaacacacagtaccatgaaaggcacatgttgacatgacgggttgtaagtctacagatgtcagaccaacaagtattaattaactagtagttatgaattccttgtcctagcacaggactggccctgatctggctctgctaaacctcatcttcaccactcctccaacacaaagttatgaaactccttcacattccacaaacaagctatgttgtttcaaatcttgcatttattttcatagactgcctgcttggtctagaataccctttttctttgttatcttctctcactctctccccgctatacatacacacacacacacacacatgcccagaaatatttttctcaggcatatcaagtgtccctatatattacatttccatagtattaacaatccttgtctcctcaactaggatgcaaagttctctgatggtcatattttatttgaaagtctatattcaatgcgtaaaacattgggcaagtgaaaggatgagagaataaatgattggtttcctgctaagaatgcttatttctaaactaaaattctctcttggctctattgctagagtattacttttaaaatttgttttatgtttatttttgaaacaagtacaactcattactgttttggaaataccaagaagcggttagctattaaaggaaagaacagaagttcagatcacctgattggatgcgggagctgaaaaatgagcccctgcagctatagaagctttcatatttccatgacttcattgctatgatggtcttatttatgtatcacatggccatttgttcctaacagaggaagcctctccatccactgacttcagtatcaagttggagccaattttattaacttgctttatggaattttaatgagtgttgcttatagaatctaaaaaaaatacataatcacattgctataaaaactattttatagcccaaggatcagtataaaaaggagaagtttgggttatactcaatggggctttattaataaattattgaaaagatctctctttttttattgcaagcctacaccattaccctgataacatgattccatgaatcctatgtcatctttttaagctgtggtcaagagcagatttaaatgttaatagtttttttgtgtgttatgcatttgaaaacattattttagaactacagtttctctttgctaaactcaagtttgtctatgaatctggagaaataataatgaataagaaaatatagtccataacctcaagaaactttgaacacttggtagttagaaaaataaacctttagtcatgtcagagtgataaatgctatgataaaggtaaacacggcatgcactttaaggcacaaaatgagcatctcatactggctggggcatcaaagtatgctctttgaggaaaaacaaattcatctaagatttcaactgtcagattttgctagctggagaaatgggaggggggcagttattacttggtagaaggatagaagaaaaaattagagttgtaggtaagcatgagagtcttttatttttaaagctatggagattcattgaatgtttttatacaggtaatgattatagtcagatttttttgctttaaaaaaattactctgtgaaggatagactggaatagaccaagactggtggcaagaaaaccagttaagagatgattacaataactcaagtgacaattagtaagaccttaaataaagaaggatagatatatctgaatctacaaaagttacacagcattggaaaaaaaaataatggccaagtaaatttaagacctaggcatatatgagctagtaaactcacagaaggtacagatttgtattctgcataatgtatagaatacattttacatttgtaaaatgtattctatagctgtttcgattgtttttgacaaatgagagggatagatgctagaaaaggtactcagttctctgaaatgaagttcttctctgggaataccaaacgaccatattctcagtgcagtatatttcatatttgcatgacattgtatagcacatgctgtctctatccatcatcctgatgcatcttctagtctgtaaattatgctggtttttgtcagcagagtgagaactagtcattaaggaatgtgtaattaaacctcaacatcccagttctcattccccctctgacagggggataaaccagggatcattactgctatcaggggctgctcagtggaaagagaaacaaggggaagttgggtgtgctacgctgatgtgctatcattggtaattgatttgctggcgtaaattccatgtctctacatttctaattgcttttgtgcatattcttgggggttgattaatgccatctgttcacaggatcagctgaattgatagagttttaaaggatgacaacagtaatgttgaagatagaaagaaagtgaagggaaatgccaaaacactgcttgtgagttatattatttttaactatccacctttagaagcagaaatatccttctaaaggcaatccaaagcaaatagcagtctaaagaaatgtgccaaacagactgatgttatgtaggtattagtctaggccactatttactgaataggtgggttcagttgtatctctgttttcccctccctcccttcttctcacactttcttcttctcttccccattccttttcttctatcttgtgaccatgtggtttgtgtattaccattgacttttccctgaggagatgattctctttcagatgtacgataaaagggtaagaagtctttgagattccagtgctgccttgctaaacaacatgggcatagtcatcaaaagtgaaacttccagacaagacctgttactgatgcaggccagacatgggcctggtgccacagggaacctgggaaggccccttgattgcaatgctccatccaactctgtccccaaacaacccttctgctaactccattaatctcctgaatctgtaaatatgggtagagttgtgtggggaagggagccttccaattcatatagataagctttaagacacagaaccccactgagtataggaaagcaaatctatactgtacttgacagagaaacagaccttttccagaaaaaaaaaaaagtgtgtgaaagagatagtactgggtatctggaaaagggaggataatgttttgaatctggaaggagaaagaacagggatgttctaggtgtgcaaaacaagtgttgctgctttcctatttttgcccaggctgaaaccctccctcatattacatggccaaaagtacagtagatggccaatggggagatgaaaaaggacagtgagaagggcatatgtcacacagtttgggattgatttaattctcattctgtgaatatgttctgtgtatactaacatgcaccttgcaaagtctgtaagtatgagtggctctgcataaaatacatataatgtggacatccaatcattatacctgttataattattaatgaaactcagcatggattttctcataataactaataatacagtgtagggcaaggacagctacatttccattttcaaacaaagtctggcccacttccccttcatctgggtaatcggatgggtgagtcactgctaagacaaatacaaatttgttctcattttatctcccatgtaaacagacaatgagtagagtctaccttcacctggcagagaaatatcaccgttctggatccctcacttagttcctgggttgggtcatagcataatcactgcttctaggccttggccagtgaaactgctagctgagaaactcacaaaaggagccccataagagtgggggaaacaagcttcatctagagaagtgaggagcacagcccctccaaaaaactgaagagggcaatggagaagatgtcagcattatggcagaaagatccttaaacagaccttaggtaaacccatgatcctgggaaggagtgtgtgtgacaatgttctcagctccctaagaccaccatttgcaggagattcaggcagatggacctagaattggaaagttgagagagccacattaccctcctgtgtactactgaagtctgtttctggtgaataaatggcattaagtattcctattttcctgttgattttgggttaaaaatcaggtactgcatcatgatgagttattaagacatgttatccacaagtcctccctcccctcccctcccctcccctccctcccttccttccttccttcttcagatatttatgaaatgcctagtgcccatccatttatctgtacacttctgaaatatttttgttcatgacaaaacacttgataagaagaaagattagaattgccatccacatagctccagagaaaaccaaaacaaaaggtaactgtaccatctcaaaggaaggtcatagcactgtgactcacccttccatcattcctttactcttgctccatgtatgaagtatctcttattttttaagtcttttccccctgctcctttattttcaatattcttccccaagttgctgatctgctttctttctaatcctcttttcttccttctctttcctctcgtctctcttccccatgttcttctactcctttcctttctatcttcttcctctccatctcttccttctacctcccttccctcactcttcctgttgcaattaacttttactaaatgtcttgtttttatgttttatggcataagttaatgcttttcaaactttccactgaagtgctgctcaccgggaaatagagtgcacgggaacccaggggattctatgagctcagcttcaaatggccactgaagcatgtaatttcttaaattttatcttcaacactcaggcaaatttgcattcagctccatattatatccatgtttatactataataaaatattttccccaaatccccaattaaaattgatgacccaagtttattagcttaacccatagcagagggctgcataatcccaggggcaaaggcttcagttttttggctctttctccacatttatgttttccagtattcctgtgtcacagagtcctacttcgtggtctctctcctcatctcagaacaacaggttgctgcatttcccaggatgaactctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcccaggatgaactcttaatctgtgaaccgcatattatcattaatcaataatggggagtaagaaggacttattaattcacaagggaaaaggaaacccacagactggcttagtgaacagaaactgttcactaagttttggatgagctgtgggttacaagaaaccccagtcccaccccaagtcttcagatactgctcgcccctgttacggtcacctgggactatgctgccacatccatgagttgtacctttgagtgaatgtgctctgtcagttgacagtaatggggtcaaccagggcagatgctttctgataggctgaaaccaccaggatattaaaagattaatgcctctgattctgcaacaatcaggaaccctttgacacaatccaaagaaatgaaaccaagcagattggaatgctggaacactggagattagagataaagttaagtaatgtgcttctttctcggcagggtttcaaacctacactctgtgccaaggttggtacttggtaagattttactctatttgttaccaacagtcctaagagacagttgttcttttccccattctaggctgaggatatactggcttggatggtgtggtaatttacccaagattatatagctataggtggtcacactgggattttaacccacttttccttggctccaaaactcatactttgaaaaattttatctgctgtttcagtgaactcaacacaaagacttagctattgttaaactccagcagataattcgtcctagcaaagacagtctttccctataatccagggtgagaaaaccctcatgtgtctagacccacagattctgccccaatcttcaggccatcttattccagtcttgcagaaggctccttccccatatctagaagtcactatgtcaaccagttcctgtaggttagctgtttataaaagttgcttgtattgctcactaaagcttttcaccaactttttgtggccaggcttcatgctttcactgatggccttgtggattccatgatcactgcccactattagtgtctgttcctgagactcctcctgtcactaagtgcagtatttttatcactacataatatttcacccctaaagaatactgcagccctagaatttgtttcatggattttatctttaaattctgctctcccatgttcattgcagcattatctacaatagtcaagtcatgaaactaacctaagtgttcattagcagattaatggataaaaagtgcacagtataaaaacacaacagaatctagtcaaccttgaaaaagaaggaaattctgtcatttgtgacaacatagattaacctggaggacattatgtcaagtgaaacaagccagtcacagaaagacaaatgctacacaaactcacttatatgtggaatctaaaaaattcaaattcctagaagcaggaggtaggatggttgttgccaggagctgtaggtgtggggagggatgggagatgttggtcaaagggtacaaagtttcacttagaaaggcggaataagttctagagatcttttgtacagcaaggtgactatacttaacaataatgtattatatacttgagaattgctgagagtaagatttaaatatttttaccatttcacactgtatacatatatcaaaacattatgttgtactccacaaatacatacaatttatatagaccaattaaataaacaataaaattttgtactaattagaaaaaccttattcctgacactaagataatagtttcaaacaaggtaattattggatgcattcagatctgttctttgtcttcacgctgcaagattcatccccaaatccagactgtaagctctttttacccaatagggatagacagaaggttaggtttgacaagtgtatacccaattccattatttttcaccactgattatcactgactagtgctcagtgatgggaccctgtccgactggcttcggaggatcccgttggtaggcaaggaccagtgcttgtacatacctgctttcattgtcagctgtatagaaaaccacagtagtaaatgctttgttttattctcaagttctcatgagtttgagaacttaggcctgctgcttggcttggttgtgaggcctgtctttgggtctcctgtatcttctatttcagctattgtcttgactcagaggacctgcttgcttgggtttagagaggcaaaataatttgttcaatgtccagtgccttacagtcttgcctctcttctgcatcaacaacgggagctatcaaaaaaggacacagagtattctgaggcttttcacactgaggcaattaatcaatgtagtgttctagctctcaaaaataattagcctttcaaggaatgaagccttaaatatttaaattttgttttaaaagcagaacttttggtttactaaatgaaatcttacatatgattttaatatgtaaaataaattacaagagcggctttgaagaaaatagaatgaagggcctagaatcctaccatccagcctgcccttcttctgattcttcatgtaggtaccgtgtgaagacttctgccttattcttaattgcaggaatctctaagcctacaatttcacgcaaaagcaactaggtacaagaacatttgaggaagagtggggatggaatcccacctcagtcatggtccatgcctggctggtgcacagcagcagagccacactgggtgtgccccacctgcctctgcttgtattggtccgggagctgatgtccaggctgggaaatacttcaaatatgatctctgccctaagttacactaaataagcagacgctttattctaaaccattgtaaatctgatatatcttgctaccattcatatgagtgtcagggcaagacaatcttattggaatttactgatttgaaaagatggtagcttgtcaaatacttgtgtccttatcttgatatccttagtttgtggttaatagctgtttgtattttaaataactgttttgtgaaagcgcttgcattatctacctgcattccaggcattcccttgggacctcctccaaaaaaggaatctcatgttagctgtgattaaattgcccatatatagcacagtaaatggcaaaataactacttaataaattgaattgaagcacaacaggttaggtgaaacccaagcatagacagaaagcctggatgagggataatacggggcaaacccctgagtgttggcttatagtgcagtgctccctccaccgcttcaagcctctgtctcccaacatctgtgaaataaatggacctttgggctccatcagcgaggctatctcagtgctccctgatgttaagtaatgtgagtagaagtgatgaaagtatacaaattaaataaaattgtcacacacctggattcagtcttcatttctgattctggtcagaatattaattttaaacacatccttgagtgtttacttcgggtgccattcatcacaaaatccttttatttaggtctacactgcgctctctcctccccccagtgaatcccaaatgtccctgctttgtatgggtaataaaatttaatatgagcaataattaaatataggatggtatatttaatggattactcaaaataatttactaatattaaatagtatgcacacatatatatgcatgctcagatttttaatgatttatttttagttttttttcatggttagtgcacctggtggaattgtacatgtgcatatccgctatgtaaaccacttgttctggtaactgtcaagatttattatcccccaaggtcaatattgacttaggtgtcacctttgtgaatatttacctctctagatgatgaattgaaatggtcatttggatggaaattaatatctacttattttctgaaatcaaatgctgttgggaggtgtgcagacatgctccaccgtgtctgcttgtttcagggtggcgttcaataatcattctttgcattctgatttactgtggttatttttatacctctttcacatggttcttttgcctaacagatagactgtgaacttcaaatgtattcggcttgacatttcaataccacaatcaggagatcgtgatatttgatcatatggatagtaagtacacattggattagtgagcaccttggccttggagtttatttagggcaagatactgttacctgaaaaacacaaagctccttcaacaattatctaattatataaagaatacaggaagagacataaaattacacagtagttcctttggttttgaggtattgattcgtcgttttcagataaccttacagtatgccatgtgttttgtaaatataatgtgtttgtacatatatatatgtatgttcatacaaatataatatgttcaattctgtgtgcctgtgtgtgcctgtgtgcctctgtatgcctctgtgtgtgtgtgtgtgtgtgtgtgtgtgtgtgtgtaacagtgcttacttctttactggcagaagacagagacatctttggtagagagcttttaatatatcaaaccacaaattctaaaattgtgagactacaatagaaatatttcctgttgttcttattataactgttgcattaattttgcgtactgggtcacaatatatatactgagaaatgttcaaccttaaaataaggcatttaaatacaagtataatggtgacagttgctgtattttgttgtatatgagtggaattcatctatgcttttctatacaaatattcataggcagtgcattcttggttttgtcctttacaaacaaggagtattagtttgtcatccccacaaatctttcctagccatgaatggtctgagaaaagacctggacttaggcaaacatatcataattaagcacagactgtggcttagtagtcaagggaatcaaccactgtaaaaattcattagtaaagttaatccaaaaaacatctgagcaactgaaacaaaatcaatcctaggggagaatgcataactctattgatgttctcacccttgttgatacattgtttagagtaaagatttctatgtcttctgcataaatatcaatttttgttggcaaattcaatttgacttattgggttcctatagctaagtgttttgtggttcatcaggaaatgatgtcattttgtgtatgaggaaataaaaatacctcacttgatggccaatgaaagtctcattttacacaccatccactgcttttatgtgctgggaaggtttgagtcctagaagaagccaaagacattgggtggtttcttcatgcattatttgcatgtgtataggcacacatcctacacatagcaaacatatacacttactgtcaattagtttagtttgtgcttctttttttaaaaaggaattaacgtggagtcagattagtggttttcaatcagatgtaactttgccccaggggacatatggtagggtctggagacatttttggttgtcacagcttgggggtttctattggcatatagtgaatagagatcagagatattggaaaggaacattctacaacacacattgtattatatgttgtcttttgtctcccacaacagataattatgtagctcaaaatgtgaagataatcaagggttgagagactagtttagatctattagtgatttatgcatcatgatgtgtcaaattacatatatatatatatataatttgagacagagtctcactctgttgcccaggctggagtgcagtggggccatctcacctcactgcaaccaccatctcctgggttcaagtgattcttctgcctcagcctccgaatagctgggattacaggtgtgagacaccatgcccaactaatttctgtattttcagtagagaagggttttcaccatgttggccaggctggtcttacactcctgacattaggtgacccacctgcctcggccccgcaaagtgctgggattaccggcatgagccaccatgcccagccaattaaaaatttttaaaagaggttttcttccagcatttagacttatagagagatatataaaatagaagagaaatatgatgacatatactttcatcctggttctgcttactggctatataaattccttttcattatttcacaccttttcccaaaaaaggtgatgataccctccccaactattttctattgtgaataacatgagataaagaatatttttaagaaggtgtaaccatgattttgctgaaatcatatttattatacttttcattatttggaggagtaatggcctggctgtactgtcctcataggctttagacagacaaggataacatggaggacatgggcacagtgcaaagagggactgagggtacatatcctggacttggggtacgtatcctggactaggaactgcaaaggtaaattttataccagttttaggttttcaaagcatttttaaggttggtttaaatttctacctctgtttaaaaattatctggtcaggacatcttttggcagggtgcatgtgctataatgcaatcactgaagtctgtttatagtaaagcacattctgtcaaattttttctttttgtagaccccctcttgcataagcgtaactctctatcatctatctatctatctatctatctatctatctatctatctatctatcatctatgtttgaaaaatgggataaaaactaaaggtgccgaagttgcctatgctttggaggtgacgtaactacgtgactcaggaaaggccatgaaccaatctatttagatgacactctctaccttatttagagctcaaagatcagttagataataatcctggctttgattgcttatcttctccagtccaatattcaatttttaacatcaattacattagaaatagtctttaatttgtcttttcaatggaaagaagatggatggccttggtctctactggatgtctgccttttgaaaaaggaaagtgataaaatcagaagtaagagactgctgggttgggaaaaggaccttggaagtgatgtagtccagcctaccctgcataatgtatatagatcaccacattccctaaaacattccagatagttgactattctattttacttaacctcctaagtgaagaggtgggacctcacaagacagctcagttcctcaacaaaaattatagttggtaggacattctttcttccactgtacataagtctgcttcaagtaccaccaaaccactctccttagctctactcactggacatctcaaaccaagccttctttgtcttcatcataattattccacaaatacctaacgatagccaccacacttctctcaatcttttcaatctttttatatcttcttttacttaattttttctatgacatgattcctttcccttggacttcccatcatcatgttctcctatttgtagtgtattccattttgccaatgttttctttaaaatatgatgtctggaatagaatgcaatcctgatttgtgcttaccaacctgtgtgggctacaatgtgatggtcataaggaatcctgggtgggagagaagattcagtgaagtttacaacaacataaacctcaaagtctaaaatgaaagtaccaaaaaattgtgttgtggaaaggacattgtctctactttctctcactcactctttcacttacttggccctcaactaatgtaaatcagtctctttacttttttcagggataactggtacaattttgggtttctcccaaattaagtgaactttgaactcacatcttacctttatctgcccagatcttccccatgggccagttcttgtcctctcttctctagtcttaattagtatgactgtcctctaaatccttaatgcttgtacagtatacattacatctttaagccctgtattatatgctgtcttttattggcttccacttctattttcattcagagtacattgaactgcaatcaatgagaagaattacatttaatatagcctctgtctatagcaataggagtactgcttacggtgtgccagatcttatcattgacatacattactactaatctggctcatgaccctatatggttaataccattattcttactttttagatgaataaatttatgtttagagtgtccaagtaactttcttaactttatacaattattaaatagtttgcctgaaatccagccctggtctctgaacccaaagtactgtgtcctttacgctggagaaaagatttcacaacccaggtaggatgtgagctcctagcagtttgtcaatatatcattctaattaattgggggaaattgtattcattttacaaatatttttagaacaccaattctaaaccaggaactggtcttagatattggtaaagaaagacattcaatttctgaatataaaccatggctattttttttcaaactgtggactacagagagtcccacaggtcttgggttccaccttcccacggccacccttatggaggtgatgatttatattggctcttttctgatagttccccagtgtgctttttctcttgcttaaatatttcataaagccatatggttgcttatatctcctcaactgtcatgatggtggatgctgtgaaatgatcttggcatgtttgaggacacatatccttcaggttgaccttatctcagaaactaaacttcttaattgtagctgtaatcccaaccccgccacagacggaagcaatggtagtgaggaaacacacacacacacacacacacacacacacacacacacacacatgaataagtgaggcccatcttcctggaatgtcaatttcatccaaagagtaagaaatacacattatgtgtatatcttaaaaaatacaaatatgttctggagtagaatacaaaatttcaggaaactttcaaataaaacatgagatttcaaatatgtctctggctccaaaatgtgttcacagaaacttgatatcaatgaattcactgttttcccacttcaagatgcctcagggaaaaagcaaacaagcaagcttaataacaaatacccctgattcaatttctgtgggtctaggtaagtcttccacattggccttcatttgaaaataaatgtctttcgccaaactttgattttcttttcttttccttttttttttttttttaaattttgagatggaatctagctctgtcacacaggctggagagcaatggtgcaatctcgttcactgtaaactccacctcccaggttcaagtgattctcctgcctcagcctcccaagtagctgggattacaggtgcccaccaccaggcctggcaaatttttatatttttagtagagatggggactcaccatgttggtcaggctggtcttgaactcctgacctcaaagatccacccgacttggcctcccaaagtgccaccgcaccaggcctggttttctttaagccagagttactagatagtgttacaacacagaatgatgttatagttgtatgtaatgtcttatctcttaacaccctccgattttaaaaatgcactgtgtagacaataataatattaataaccttctttttattctaatgacagtttttagacaatctctattactggctttatgtgttggggaagaaggtagaatgaagtaatattgacagaaaggccattcctccacttcccccttggcaggcctctcacagagagtcttgctatgggtgccacattaggacccttaaaaattcacattctttgtttaagaggtgttgtgaatcccctgaaattgtgcactcatcactgtgtgtatatctgcatatttgcatttttcttggataaaggtatttatatttcacccaatttccaaaacgcatccatgacccagaaaagatgaagaaagaaaggctctgagatcctcattaccctgaacatcctcagggaggggaggaggggacagctttattctagatgctggaaatttaacctaaatgtgcctgagtggtgtgcccttttctagcacctgacggagtgagtgtgagctctggggtgctgaagagagtgggaaagagccccccaaaagggaaaaagtcttctagaagataaaagacaatgacagaaaaggaaaacttcagagatgtcacaatttgccagtggcaaagtaggcacattgcaaacaatctggaattaataggaatgaacatttttaatacaaagaatacagattttgaagaaattactcagagcctttccctttgtcctttcctccacctcccctgagatctgctcacaaaagagagaaaaaaaaaaaaaaaacagagaataacaggttaatatctagaatttgcaaggctctgaatagccacctgacaacagccgcctcctgctgagaaaccactgaagcttaatcattttcctttgcatcagaaagaaggtggctgaagtattcattttttccttgaaatgtcaggtgcccacagcaattaactaatcatgttcctaccaggtcaagttgcaagaaaagaagacgattgggtttttaatgctaaggggacattttagacattttcgtacaagaaaagaagacaattgggtttttaatgccaaggggacattttagacatagggattaaaaaatggtttcataatgacaaaagctccactgacatgcctcaacatcccctgagtgataccatgccttgtacagaggaagtgaagaaaggctgaggctggactgggaaaggagatgtagccttgggcacacatttttttcttgagtgaaaacatggccttgaatggccattaaggtctccaattgtaagaaatttctttgatacagaaatctgagaaattcctagaacagctttgagagagcggcttgttcaaatgatccatcttaagtatcaatcacagcctaagaatcgagtgtttactagataacagcaaaaataagaccaagacaagtgatgaggatggcctaacatttatccaacacttactacagactagaaacaataccgagctatttacatctattagtgccttaatcttcataataaccccacatggtaaaatatgctgaatgtttacaggtaaggaaatagaggcaccgaagggtagtcacatagctggaaagtgaaatgtccactcagggagactgcctctaggacttacagtcttcaagtcagaaggtcagtgtttagatccttattttacagaggagaaagtgaaactgggacaggtgaagtatcttacccaaggcttatcactggtacacagagagcttggacggatctggccaaagccaagttctgtccgacttcacatacattttcccattcaacatcacttcacatgacctgcatattgtgtataatcatattggaattcatccctaggagagatactggattctaacactggtgcctaaacccaatcaagtagtaaggctgcagcccaactgaacctcattaattctgttgctctggaagcactccacgcctcctgcgatgacctccatgttatctaggttttctctgtgtccctggtgcatgaaaaagtgcagtcagtgactcagctgtaaatggttcaaggtacagactccttactcagccctcctctcttttttcagctctatcgttccttgcactccatggtatttattgagtgtctgttgtgtgtagacagtgttcaatagtggtaaagagctagtacctgccttcatgccacttagacccaggatcagggaagcccagagcattgtttctggtgctctcagtgtctttatactgctcctctagcacaagcatgcacatgtgcatacacacactcaggcacatgcacacgcacacacacaggacttctttgcttagctccgtcataaacatttccaagctacactgaaacattcatttctttattttatttagcacgatttctctgtgtctctaacacattctgcctgttttactagtattcttgtcatatgcatatctttaatcttccccaaataaattgctccttgaagctagagacacttgctacccatctatgttgttctgtttaaactggcagcatggtgtcatgggggaatgctttccagaatcaaacagaactggagttaaccagctctactctaggaatgtcagcttgagtaacctcttaactatcctatttcctgtcagtaaaatgtgagttcttttcttcctcgtatattttgagcacattcttgacagttaatactgatatgccatttaatggttgctctttcctttgcgtctccatttagtaagtgtccatgaaagagttttattggtttctcccaagatattacctgataacattttgtttgtttctaatttctgtttagagatttgttaacttggttggagtggtccattggacatttgagggctctctatacactttcttaaattgtttgccaaattgtttttgtgccctgttgcattcatcatactttcaaaggaatacaaattcaaaaatgaaaagattaatgagtatcttttttgttggtaaatatgctttctttttaggcagtcttttattccccctttaacctgattcacctagatggaagtattgacagtgtgcatgctcagacagggagctagtgataaacggggtcatccaaggttatttgagtccccaagaatgctaaccattttggatgtcctcataagtatacagcagaaattggacacagtgtccttgaagaatatcactaaggcaaatatttacacacatttatttttatgagtgttatgcaatacgttaggttacatcaaatgcaagtttgtttttctttctttaatggcaattttctccaatgcttttgatatatcaatgtgcaagggaggatgtctaaaactgggatagtatagtgcttcccccatttgcttagccaaatatctcatctcacgacccaggcttgctgctctgcagaggtcactttgagaaacgctgatttcagggctttttgctttatcactgttaacgtccctatgatctccttcatttggtaccacaacaagactctgagtttttgtccttttattccctttgaatgtctgcggcaacaaggaaatgaggtgggaaactattcattgccatcaggaaggcttcatgttgctctgtgtctctggaggctgcaatacgaatgcctcagaaaggcacaccgcttactcacatcccaagagacatgcagaggtggcagtagttcctgtctaagtcttaaagatgatgttcttgctaggaatgattctggtgttgattttcaacctgaacagtcaaaacttttatgtataacttagacttttcagtatacagaactatattttttaaaccataataaaattatcaggcctactttacttcctattagaggaaaacaaaataataaaaattaccagtttaagggtcaatgcatctgaatttaaacacaggctctatcactcattagccttgttaccttctgagcttcagtttctttactgtaacatgaaggtaatgatacctaccccgatgattaaggagagggctaaagaagctaacaattgcattatacctaaattaatatgttttggcttctataataaaataccatagcctaggtgatttatatacaacagaaatgtattttttacagttgtaaagcctggagaatcctaatcaaactctgagtcaggcagattcaatgtctaatgagggcctgcttgcttcttggtttatagatagaaacttcttactgtaatctcacatggtggagggagcgagaaagctctctggggtttctttcttaagaacactaatcccattcatgagggctctgccctcatgatctaatcacctctcatagtttctacttcctaatagtgtcaccatggggatgaggattttaatatgaattttggggtacacaaatattcaaaccatagcaataccttaagcatactacttaatatctagtagctgttcactcattgatagatattcttaatacaattgttattattaagaataaagaaatgggctgggcatggtggcttatgcctgtaatcccagtaatttgggaggccaaggcaggtggcctcacttgagcccaggagtttgaggtcagccccggcaacgtggcaaaaccccatctctacgaaaatacaaaacattagctgggtgtggtggtacgtgcctgtagtctcagctactcagaaggctaaggtgggaggattgcttgagtccgggaggtggaggttgcagtgagccaagatctcaacagtgcactacagcctgggagacagagcgaggccctgtctcaaaaaataataaaaaaagaataaagaaataactagattttgttagcaagatcttagaaagagaaaggaaggtcgggataaggggcatatctactccacttctgcactttccggggtgctccagatttcaaaattccctcatgcctgccatcctgttgactctgcccctgcctctgtgtgctgcagtccctccttacatggtacctttgacacactggcaggtgagctgagcagtttgggcacctggttcctctaggatcccagaatatagctttgtactttgatgaagaatacttctgactgtatttcaattgatctgaaatatcagtctcacacactgtttgcagctgggattgcactttgcatactctgctcagggcactggcaagtcctgaaacaaaatttatagtagggaccagcccagagacatcctttcttcaaagtgtgttagtcctgaatgaaataggcaccaggataacatctagagtgcttaatctcggatgtgtagagaattttcctggactgtagcatgttaaatgtccacagttaaaacctgaaacagaagtatattcaatcattcggttaatctaatattacagatggctgaggtgggataggatcagagataatgacatgtgacaaagtgtttcttggtgatcttccagcctatttgaacatctgcaatagtttgaggccttaaaaataaataaacttagttttctttccatctctttcctcaaaaaaaaaatacacacaaacagttctcagagataaaaagaaaatgtctcatcagttcaacaggtggtctaaggtttgcttgtttttagataatgatctgatgcaggctccactctaattgacagcatggcctgcttatgagaaggtctgcacttgtttttcccagagtatttgatgctgctgtttacctctaaggaagcatgttaataacaagggcactctagggtgttgccaatcatgcaccacatactggaaatcaatgttgtgtctagtgctgtgctaggaattatagacattaaaaatggcatatgacaggaatcctgatgttaatacaatgtccatctcttcgtgatgccaagcctaatttcagcactaaattatacgctttgtagcagagaagcaggaagtattaagaagagcattgatggtggtggtggtgggggcttacatagatttgaagttgattccaacccagataacctgcacacattctcctagccccagtttgttcacttgcaaaatggctatagtggtgtccatctcacagagctttggtgaatgtcaagtgagacatacagtttacctgcttgacacagcgtagtcactcaaaactgctagggtgattttgcttgatttccttctgctacagcattccttttgccacatgaagtagaacaaggtgtctcaaactatctgtgataaaggaccaacccctcccaaatctctctttctggctccatccagcacagactaatatttttgtaaaacacaaaaagatgaactactagaaaagtagaataaagaaaataacaaagtcaaagaaaatacaagccaactttttactactagattccacatagatgaaatgatgcatctggattgtgacaggtttctaagtgcttatcctcacattctgtacctattttatcctggagtggtgacaaaagtccctgggcccacactggtctgcagataacatctggagtagcatgaactggaagacagtgatatgatccttaaatttcatcagattaagattagaaatcacctagttactttattgaaagtctttacttcaagctagtattgactgaaagaccaaccttcatctgcaaatgatagtaaaaactctgacccaggggagtagtcatacaaacagacatcaaggacaggagcgaggaaatgctcagatgtgagttaacaggacacagcaccagagttgaaggaatgagaggcagcctggatgtttacgttattccctctcaaccaagggtcccaggatttaaagcagagaggaagggtaaattaatgcaagcatttgcagtgcagaactttcagtgtttgatagatttccattccaaagttcccattcaacaattattactaacccttttgctttcttgagggggtggagataattggacttgtgttctgagctttcagctcctacctcttactgcatcttccccctgagttcagaatgatctatataaaatggatacctgtgcgcgtctctcctctcatgcagcaaataagaacctaagtagcctggttttggctgacctctctgaactcagccctcctttgcagctctgaaattaggtctgcattttgtattccaattattctgaactcttggcagttccctgcccacatgtcatttttccatatctttgtgccctcctttgctaatgccattttctctgcttagcccagtatcaacccctccttgcctggctgacttctatttatccttcaagacatggttcagaaagtcgtccagaaagtcttccctggccctccctcccccgtccctgctctgtgggcccataccttcctctgcgtaccttgatcactgaaccagccacattattcggaaaccatctgtttgtcctcatttattattcatcagcaaatgcccaataaatgtttgagaactgtctataactgaggtagatgtcctggctgcgttgagaggcactcaagaacaaactgttaaggacaagcagaaaactaaatttattgtgcaaatttggctgaggtgaagcagaaccaaaaatcatcagattcagccactagaaaagtgagaaattcataaacaaggtaatctctgtattcacctctttctatttatttgttctgcttcctttttctgatagaaactaaatacttgtacatacattttaagtgcagccatttgagcaccagcccagagagcatcaaccacgaggacaaaggtttctgtcttgagacaggtaaagaacatgagagacatgaggccccatctgggggcagaatacctggcttaaattggagttttggccttgctatggataaactcaatgaacatttgacctttctgagtctctgagtctctatttcttcagctgagaaaaccatggcaataacgtatgtcacaggattactttgagagttaaatggcatggtttacataaacacctagtacagtgtcaggtacaatacatggtagctattatgatcagaggtagctatttatgttctgtttgaaagcttgctcagtgttactctgctatgcaatttctcacatcctaatgttgcattactaggagatttggggcaatataatccagaaggcccatgaaagcatatctctactcaatgtaaaaccagccctagaaattataacaagcatctgatcttaggaaatgtttcttagcctgccgcttttaaagatgctggaaaattctagtttctccaagttgtggcaggccttggaacccatgctgaggaattggaatgaaacaaagtgaagagaaagaaagatgtcaacatgatttactggaacaaagtggcatcgtattggcactcaatcaagagcatgtagattagacaaggatcgacttatcacagttacagatcctgaaacaatttgacttgaagaacaccaagaagcaaacagaggccaaaaaatccctcaattcaagcataaaagagacatgtgttctttgccctcttctgagaaactatgtgcacttggctttttgtctggatgtttgggttggttgtctttttaaactgtatatttgggtgaggggagatatgggcatttgggcagtgggaaaatgcttatggcttttaaaggaatatgatggaaaaaatagcagtgttaaaaatgtattttttaaaaattagagctgatgcactcggatccctaggctcctagggtcctataccctcactctcgacaagggtggacctaagtcatacttcaaaagaagcaggagcctcagggacttgtctactgagagcagctgtcaatgtcaccactccacttccagcagcctggttgaaagttgcccgaggcaagacctgcagaaaaaggagtcaaaaagcatgaggagagagggaagtaaaaaagaaattaagttctgtgggatgttattgctgttcaaatcccaagtttactatagcagatctcagccccgtggatcttggtaacccatgattactcttttcataattccaaaagatatggaaactatataactcacagcactcaagccccttcctgctgttcgttagtaaaattgcctaccctcacctgctctgggtgaaagaaatacttgccttttctatttcccttcctgcaacagccctagaacttttttgattttcaaaaattattccagctagcagggcaaaaagagaagctctctctactgtacacagaggagctctggttgggaagttcatattgatgtacttccatgaattgtgtccctaacagagttttgaactggagccaaatgggtgggagtctgggctctcacccctctgcttcctatctgagtttccttagccaaaatgggcataatacccatcttgcagagtgtgttgaagattacacatactgtatgtaaatatatctgcaacacagacaagaagccaaccaaatgtttcctttttcctgacatcatgagatacagctggatgtgaacatctgtaagcctaagaaaggatgcttgtgaagccaatggtgacattttacttttaaaactgttatcaagagataaagtccaacttcttcatctggtgtggagttctttccagaaactaagactcatttaactctactttccaacattccctggaaggatccctgtcctcctcctcatctcctccaaccccttccgctgctaagttacagcatgtggggaatgcttttttatgttctctggttactccttcttcttggatagctttcttccccttctctgccagcctatatcctgttcaactttcacagttcaccccaagcctcacatctttcatgaatactccccagaatgttctcgtccagtgactccttaccagtgggatatgatcacaggggctgtcaacagtggctgtcagttgctgagagttacctgaccatggaaactgagagaatcccaagtctttgtccccatcctgacctggacctcataagttgcccagccaggtttctatgaccttgaccacctacaatccaatatcctctgagggattactccaactttcatttcctcgtgtttaagcccttctttttagcaccagactccattattttcagactccatatttttcctaagtcatcaagaagacagaagccatttgcctggcaggaccttcgtcatcttccccccatttaacaacatacttatttctatcctcaattccctctcccgcaccatccatgtccactgccatggctctgattttgactccctctgtgactgtaaaagtaaaacacctatgcctctttcccttgcaccttcatctccctctctgctggctctttcccatttgaattaaagcatacttctttcccttctcaatttcacatcccttcatctcatgttacatttcttttgctttcagagacaaggttttagaaaaaatcatttacatgcagtgctgttattctacctctcttatatactcttccacttattggatacaagttcgctgattatttcatccactcaagtttctagaaaggcttccaaattagagagaagctggtcggaaattgaccatctcctctcactagccatgtgaacttgggcaattacaaaaatctcttttctgtctcagcatcttctatacaactggagtgatggccaggcacggtggctcacgcctgtaatcccagcactttgggaggccgaggcgagcagatcacgaggtcaggagatccagaacatcctgcctaacacggtgaaaccccgtctatactaaaaatacaaaaaaaaagaaaaaaagaaaggaaaaattagccggctgtggtggtgggctcctgtaatcccagctactcaggcggctgaggcaggagaatggtgtgaacatgggaggcggagcttgcaatgagccgagatcatgccactgcactccagcctgggtgacagagcgagactccatctcaaaaacaacaagaacaacaacaacaacaacaaaaactggagtgactactcctgccatgtggtcatgatgagaatgcaaagtgataacatacatggagcagaatgtggaggtcactggacacatcgagtcattgtgaatcagtcatctcagcagtattttatcctatgggccagtccacttttcttggaattcacttttgcttttgccttcagtgattcatctctatcgtagttttcttcctctgcttttctggttacccattctcagcattttctccaagttactgttttctatcaaaagctatgttctccaaaattcagttgttgtttgtttcctttattttttaatgttttttacttacctaggctgtgaaattagctagcattaattgattgataattactcaatggccatgtccaatactaatctcatgagccccattaaaccaaccgacatcacaattgggaaggacccaggtatggaatgcccgttttgggctcagttctttacccaattaagcccattcattttcctgtgcaccctcactgtgtaacaccaccattttctggtagttatacctttatacctgactctttctttctccttgtcccctacatcgaataaattaacaagtccatttttttttttttttttgaggtggagtcttactctgtcacccaggctggagtgcagtggcgtgatctcggctcactgcaaactctgcctccccggttcacaccattctcctgcctcaccctcccgagtagctgggactgcaggcacccaccagcacggccagctaatttttttttttttttttttttttagtagagatggggtttcaccgtgttagccaggatggtctggatctcctgacctcgtgatccgcccgccttggactcccaaagtgctgggattacaggcatgagccaccgctcctggccaacaagtccattcttaattcatagatatattacttcttacccaggttgtggaaatagcctagtgaggagccactgtgcctccttttttgagctgcaatccaatctacaaattactttaccagaatgaatcttttaatggataaacaagaaggatggtaacagaggctgggaaggtaatgagagggcagtgtgtggagaggtagaaaatggggatgattaatgggtacaaaaagtagttaattgtttgtaatacaaaggagaaatgcttgagggggcggataccccattaccccattcaccctgctgggatcattatgcactatatgcttgtatcaaagtatctcatataacccgtaaatatatacacctactatgtaaccacaaaaattagatttaaattatttttttaaaaattaaaaaataagttaataagcatagctaactctccaagttgaaattattttagtagttcctggtcagcagtgtcttttgggattgtgatcctgaaactacatggaagtgaatgacctacagggattgttaaatatgcaaattcctagacatcaacacagatcccctaagtaagaatttcctggttggatcatgcttaagcacactaaaatttgggaacgtgtaacaatagaataaagacaaaattttatggaatgttatataaggttttgcataatccagcttttgactgtctctccagcccccttgaaaaccatcctgtcatatgattctcatgcctgttgcagggtctggtccatcatgccatcatgcctttgcctagtatcaaagtccttccactcccgattcacctatcacacttgtttatccttctaagaatagcccacatcaatcatctctcccttagtaagagtttgctgagattcctaatttgcacccctctgatcttagataagtccattttccatgctttcaaaaattcaagtgtatcaatccctctcctccctgtactatccccaagtctagtataccattgtatatatctcactgcatttaaatgtttggtaatttgcctgtcgttgtcatcagcctaaaagcttcctaacacttgaaaaaaatgcatggcacatattaggtgctcaaattttatttgttaattgaagaactctctctttaaatcatgatgtctaccagttgtcttctaccactcttatgagccaaattttgtccatcaatgaccttctgaaaatccagtccttgcatgggaggtttttatccccatgttgagtcctgctacatctgagcaagtgctttttcaagttgcttcctgctgatccaatctgccagggatatttaattggccatgtgcctattcccctggtactctttaaagtaagctattgtatcaccaactctggtgatggaattattttttatctcacagggtattttttttaagttacagaagtaaacttattatcaacaatataattaacagcaatgttattggaatttcttccactaatattttattgttacttcttcatattttaagtcctagacgtaaaatgtgttttcaacagcactaacgcattttaaagtttattgtatttattattttctcttacttaggtagtaaaagttatccttaacagtattattaaaatttccaaaaactaatggcctcactagatttgtttgtattttaaagtcgtaactataaaatgaattcaccatttattgaattggcaaagatatcacatttctgtgaacatcgaataaagtaaataaggtctccctctaatcacataaatgtctacaaaaaagctgtgtttttgctttttctgcccaaaggaaaactaaatgctgaatgggctcagcatttcaagtcaaactgagccagccagtttgtgtcctcttctgtaatctactacctgtgtggttgtgatgcacaggatgtcattcctgaccctcagattttcctgtcaaaataacctgtagcagcctttgtcatacacggcacatattaggcactcaataactgcattttcttttttttttaaattgattttctagcatggtagctagtatacttgtttttcatagggctgttaagaaggagttggggacactcctgccatttccctggcatgttgctgtcagccttgattgtcttctgtttggcatcagcgtagagtttttcaatatctgtgtggctctggtcttctgaacaagatggcgagttcctcaagggcaagagcctgtgaattccaagcacagagtgtatgctcagtatataaaaatgtctcatggattctagttttagaattgccaacatgatattatgaaaggaaagcaatgttatgctggaaagaataatttttcttctcacaaacatggttttcttaaaatgatgaggtgaaaaatgaaaatacttcaaatattttccaactgtaatagtcgatgatttgtaagatgttttctctagttggctggtgtccataacctctaaggcttgacacttatgagaagtttaagaaattctattttagtgtgttcagggtggcccctttacctttccaagacttgctactttggaatcgatgactccacagagcgtaaagtggaattaaagctgagagatgcctatacccacttgtatcagaaatccgtccactatgaagatatctgtcatgattaataaggctaggcagttctcaataaagaaagcatgagtgagtttgttttactgcacaggcttgccctgatcatattaatttgaaaaacagctggaggtggcaacttaccaggtaaaaacagattgggggaccgataaaattattcagatgctcatgggcagctcctctgtaattcacaggaaagcctacacttacgtctgagaagcagcattacggaaaagtcccagcagaatttgcaaactcaggtagtcaacagtttgaactacaagtattctatttgtgggtatacccgtatgggcctttatggacctccttaggtggagaagggcctgccagtgggtatacaaagagcaagaaatctgacattgggcaggctttagtttggaccacatgggaatacttctaagcgtctttgcattattagcagaacaagcatttcttacagaagacaaaatccatacctggagattcagaaatacacttaagataaaatggggctttctagtcaagctctcttaagtctcccaggatgtctgtcagtctctcagagctgtgatttctgaagactttgacctcattcaaattaggtgaacaaccaagttaaacttgtcatggtgtttttttgactggaaattttatgacagaaaaaacatgcagatacagttgacccaacagtggatggactcagccaatgtcatttaagtctgtctttctgagtagaccctgtgaaaggtctggggctgccagtgccatttactgcatcaaccaagatctgagcacattccccttccgttttttttctggaaatcaagtgccgtctccattagaaatgcatgttcctgaaggccagggaagcctagagcgaagccatgtcagccataacacatcatgagatcctccctgtgccccattaaacaaagcctcggtatttgccttgttactgcatttcacctttcagtgtggaagagggttctctaaagcagcgaagcttaactattgtctttaatctatcacttgatctaccttttctttttttcttttttgcctacataaatcattcaaaatttgtttttgtgtttaaccaaagtttcagtaatcctctaaatttatattagatgtctgactagtggtattcatcatttcactttttctaatagaagctactctgaccttaaatctatgagaaaaggaaaatgtgaaggacatggactttggaaaagcttgttagtctctgtaccgacaggtcatgtcactggccactttcctaaaagaaagaagaccatggggaggacattctagtaggtgcttttcttttccagctgataatacaaaaaaaagtggaatacatttcatgactgtaagagtttgtaattaggttgtatatctaagacacacacacacatcattgacaaataagaaaaaaatagcacagttaaaaaattagttcaaggctacctaactaaataataacagaattgggtttaatacttaatctctgaattcagccttcccagttggcccaaatttaagtcaatatctcctcttctcaacctgctatttcttttcctgagttttatcttaaggattagcactattgtcctggatggagggaatgcaataattcaaagccatcctttgccctccctcttcatgatcctactatccaatgagcaggaatctggctgattttacctccgcaatgccatccacatccatgccttcttctacacgctgctggatattccagggatttttcatctcttacttgggctgtttccacagcctccgagaggtcttgttatcttcagggctacctatcaactaaatccagccaccacatggccaatacttgcttttattacagaattaattctgtttttgtttgtttagcacctctaattttgtccattatttgctatagtttatatcacaaaacctttgtcctacatgcaaaactcttcatgatttggcttatatgaactgctcctattattataaccatcctttccatatattccttgctacctctctcctccctcacaatctactcctctgcatctttattgtaccattttctttggctcagaatgctcttctttaattctgcttaactcaatcctgttattatacttcctacaattgtactcagttgttttctccttgaggaagttgcctctgaccccagcatgggctataccactgtgattccttagatttgcatatgcaatgtgtggaactgttttgccttctatgttactctctgttaaaccattacctcactgaaagctgagaccccattttaatctccctcccctactctagtacctattacgggctccagagcatagtagatgctcaataaatgctttatatacacagtgaaagaactcttatgacaggtgtcataagaagtttaaggatagagtggtgcctgtggatttagaaccagtggtaagaaagctctaagttgtctgtgtggggaaatcctatcagtcgaggccgtgaagcaggacacacaaagttagggtccctttctccttgggagtttttttggtgtggtttgtttgtttgtttaacaggaaagaaagacacaaagggtccttttggcattttttcatggaggacacagcagtcatatttatctctgcatcggtagtagagtctgggagagtatatcacattcattcattagagaatgtatctaactgaagactagaaaatcttctaatattagtgataaaagatgtgagttattattggatttgttgttttgttatgtttttgtttcttttcctgtccttactgattctctcaaattggttatgttgttccagcaaaaagatcaagggaatattgggggcagtaaaatctgttttgttttttaattccccaccgaaacggaaaaactaatacagccaaataatgagctcataaatactaatttatgagcaggtaacaatcatgacacctaacaaaaagtcattcaacactgaacttgaagttagaaaatcatgttttaatttccatctctgtccatctagttatgtcatcttaagctaatttgtacatagttctacgtgccactttcctctttcatgaaataggaacgttgatgtagatatcttttaattctatgacttcaaatcctacaactctgatttaaatgatttcaaaaacatttattgaaaccttctcatgcttaggaatgccagccataaaataagaaggtctggttcttgttcttactgagttataatttagaaggagaagtttaaggtataaggagcattaaatgacaattatggaagtacttaaactctgtttaacatccaggacgcaacacgtatttcttacattcagcaaatataatacttctcaagtccttctatatgtctggcactaaaataagtgcccagaatgaaaagaaaaagagaccaaagcctctgcccaaatcctgtaaggcaaaccatttccaggcctgataatgaacgtggagatggagtaagattcacaagacagaaatgatgtcatcaaagtagtggaataaaggtgggcacaggacattccacattagatgattactttaaggcagcatagtatgtccattcttggtgctagatatttgtcagcttatgcccatttaaccaatgagatgaaaagcaaaatctgctatactttctgagaaagagaagtcaggcactttctattgctgaaaatcctaagaaaacatattgctcccgttgctgcagacaactatgttatgaacacacagacagccagacttaggatgaagccgttgtttgtaaaaagaggagaagtatggagagaaactcaatctctgatgacacaatgcagtagctaaattagcgacttcgaaggcctattcttcctttagattcctgatatctgagatcaaatccccctgtattaagtgcatctgaatcaggatttctaccacttagagtagaaagaatataactgatactggaaattggcctgttacatgctttaaaggcttagaataaagagcactatctgatggaggtcactcgctatagggttcccatagtttgtttttcaggcatggtgagaaaggttcagacaaggatccattgccttttttcccctcattagccatgtctaatcaatccccaatcctgtcaattccatgacctttatacatcttacctgcttctctccatttctattaacaccaacacagtccaaaccagggtctttgcatacctggatcactattgtggatttctaactggtctcctgcatccatcaattttcactcctctattttattctctatcatgcgaatcttataatttcttgacttacagagcatctttaatggtagctcattgctttttgataaagtcaaaacttcataaaatgtcttatgactgtatcaataatgtctacctctcccatgtcattattcagtgttccaccaccctcccgtgactaccactgggcttcagctattctgaatctccttcaaatcttgctaatgcatgtgtgttctcccatggggtaaagcatgtggttttcccaccaccgggaatgccattttctcatgtcagtctgattcctatcatctttcaggtttcatatacaatgttacttcatgtggaaagtgggttttgaccctagtgtagattgctcctttctgctaaaggctcccgtgacccctctgtacttacattatctcactctagtataattatttgttggattaattctttttatttttgtaggtcctcgtttgtgttgttcactgttgtaatcccccagtacctctctatagtggatacgccacatatattgaagagctgaatggtttgagtacatggagaattatgcagactaccttttaaaaagcagccagggaaggggaaagtacagacactgaggataaataaaagcagttagaattcaggcagaaaaacagcagttactgaatgttctgttttagagttgaacaaataaatggccagagattgaagtagacagttaagaagctgataaacaagataaacattaaaaaatatatacacataacactggtatcatacctgattcagaccttgagccattcagctaattctgactgattccaattggtctggccagttttctgtgtgatgcaaaggtaatttatttaatgtattctgtgggtataaaaaaccccccagcagctctgcccaccactaaagatgagctacagtatcagtagagacatgaatgagtcacacagggtcagatgccagctctaccaagttcaagcatcttaacttgaaactgataataattcgttaaacagttgtacaaatccagactctgtatgcagagcagcagctataatgtccccaaaactgaaacttatcattataataacacaaaggatccaaatttagaaccctggaagaatggctgtaccaaccaacagaaataggaattcaagtgctgagcaatgtagccacctcctctcatggttggtgttctcagtttaacacggttgagctacaatccacaaactggatgactcaaaatcaaaagtaaaaaatccaatttagttcacagtattgatactaatgttagtctccgtctggaggtttatcagcttaaagtccatctgctttataaagctaaaaaaggacgatgtattcacagtctggttttggtttcaaatggagaaatatattctgaagctattaacagtgagtggatatgctctcgaggtagagtatcagagcagccagcacaacaatccaaggaacttcccactgcagtctgcctgagtgcttaggttcaggaaatctccacttagctgacactgggtattggttcagcaacatctctaactgggtgtggggtaagaaagtagggttaatgggtagggtgccacctgagagagacagtttttttctttccccacatcttgaaaagcattatggatactcacactaaaactctggactgtttctgtttaatccaaatgatttcagtttagtcttgatcagaacaaaagccagattactttttgaaaaagatcatattttcttaaatctaatgtagacttcatttcacattgtacatttggagattaggatatacgtagttaatctagtgatgagttttttcccctctgaaactgtttttaaattagtaatatcccattagatcaatggcatctgagcattggataaatatggcatacattcttctatgtggcaaagtttcctgtcctgcaggagaagatatctattattgtgcttgggaccttcgatgtgaagaccccacctggtcagacacttgatttctccttggtgttacttttacatcctgaaagtgcttctaactggcactgaatccagacaatttttaacaaaaaaaaaatagtttatcttattatttaaaaaaatcaggacactggaaaacacttaagaaaacagagattaaatagacatcataaacccactacctatggaaaactatgaagaatgccccaatcatatgcttcctgatcatttttgtgcactgtaaaaattatttaatggtactgtccttttaatatatctatacatgtcaacatagctccatgtcagtatgtttgtttacaaccttgttttaaatggccaaatggtatcctactacacaaatatgctgctgtttgtaatcaagtgcaggaatttgaagaattcaagactacattgtactcttcaagaccacattgcaactctatttacctctttgtttagactacaagtacctagaagacaggagccttgttccattcaaactgtcttctagatgctttgcacttgatatatattcaataaatgtggatttggattaatcccacaaacaaaaagatacttgggtgaacacacaaaatctggaagtatagtctattggtttcctgtggcttcagcataacaaactgccaccaacttcatggctcaaagcagcagaaatttattctctcatagttctggagagtcagaagtctggaatcagtaccatgggtcagaatcagggtgttggcaagaacatgcttcttctggaggctctagaggacaatctgtttcttgccccttctggctctggaagctgccagcattccttgatctgtggctgcatcaccccaatccctgcctctatggctacattgccacctcctcttctgtttaaaatctccctctgcctctatcctataagataagtgtaattgcctttagatccccacagataaccctggataatcttcccatctcaatatcttgcaatcgcatctgcaaaggtccattttgccataggggataaatttacaggttcaagaaattagagcatgagtaactttttttttgaaggttgggggacatggcattttctgccaataagtaagatacataatttcaactatactttttaatcgttgtgttttcagaaaaagtgttaaggcttgagaaaagtgggaatggagaacacactgttcaattatctttttcttgagaaagctttggtgtttgccgaagttagaacttgtattttccatagttagactatactttcctatcatttaaaagcctaagtgacttgatattactcaattctattaattgaaataacagtattacatttacttttaactataaataaaattagtgcatatagcctggatatatacagtcatattggagaaggaggaataaacaataaaaccaaagaaaaagggagtacacaagtggagcaaggaggcagaatagaaagctctaccaattgtcctcccaccctccccaccctcttcaagaacgcttttaactatctgcatacacaaacgcacatttacaagaaccaaacatcaggcgagaatcacactacctatatctttcttcatatggttggaagaggcattgaagagactaggagagtcagtcttgaatcattggcactacccctttctaccccctggcagtggctgtgtggcaccaagagagaatctgtatacctcagggagacagagcgcagcaactggtggactttgcattgaactcagtgctgccttgtcatagcaaagagcaaagccatcttcgactcagccagcactcatccagggcccacagaaggagcatttggaccaggcctagccagaggagaattactcagccctgaggctgcaacttgagtttcttagaagcctcacctttgtggactgaaatgctctatggtcctaggtgaatctgaaaggcaaactaggacacaggaatggcatttcttaggcacgtcctgatgctgtgctggtcttagagccaatggactggggtggtgcatgacctagtgaaacaccagacatgactgctaagagagtgcttgcaccacccctccttcaacaccaggtagcacaactcacggcagtgaaagtgactccttccttctgcttgaggagaagagagagaaaagtaaggagtactttgtcttacattttgaataacagcccagccacagtaggatacaacaccaggcagagttctgaggcccctatcccaggccctagctcccagacaacatttctagatataccgtaggccagaaaggaacgatctggtcctggagggattcatcacctgctgattaaagaactcttgggccctgaattatcaacagtgatacccaggtagtataccatgggccttgggagaaattctgagacatactcacttcaagtaccagcttggctacagtgtagtagagcaccaagtgggatcttggggtacccaagtccaggcctaggctcttggataacattactggacctgtcttgagccagaggggagcccattgccatgaagggtgagtcccaggcctgtcagcattcacaagggccttaagtgaagagcccttgaaccctgagtgaacattagcagtggcctagcagaactccctgtgggccagtggttatggtggccacgatgagactcctctgactgtggaagggggaaggaagagcaggaaggactttgtcctgtggtttgagtgtcagcttagctgcagtagaatagaataccaggtatatttcaaaggattttaacttgaatacgtggctccaagtcagcatctctggccctgcttagggtctgggggaacttgccaccctgaatggaaaggcacaaacctggctgacttcactatctgctgattgtagatccctagggacttgaataaacataggtggtagccaggtagtgattacagcaggactcaagtgagacccagtgctgtgctggcttcaggtctgaaccaggataatttcagtggtggtggccataggagtgcatgcatcaccctacccctagctccaggcagctcatcacagagggacatgctatttgtttaggagaaagtaaggaagagaacaagatcctgtgcctgataatccagagaattctttcagatcttatccaagatcaccaagctgtgggatttcttcaacaccagaactgttctacaagaaatgctaaagggagttcctcaatctgaaagaaaaggatgttaatgagtgataagaaattatttgaggtacaaaactaactgggaatagtaagcgcacagagaaacacagaatattataacagtgtaattgtcgtatataaactattcttaagtagaacgactaaagtatgaaccaatcaaaaatactaatggcaacaacattttaaaacatatatagtgccataagatataaagagaaacaataaaaagttaaaaagtgggtgggtaaagttaaaatgctcagtttttattagttttctttttgtttacgcaattagtgttaagttgtcatctctttaaaatcatggattacaagatagtatttgtaagtctcatgataatcttaaatcaaaaacatacaacaaatacataaaatataaaaagcaagaaattataccatcagaaaaatatcactttcatttaaaggaagataagaaggaaagaaagaagcaaaaccacaaaaccaccagaaaacagataacaaaatggtaggagtaagtcctcacttatcaataataacattgaatgtgaatggactaaactctccaataaagagaaacagagtggctgaatggggaaaaaaaaaaaaaaaaaaaaaaagcaagacccaagtgatctgttgcctttaagaaacacacctcacatataaagatacagactgaaaatgaaggaatgaaaaatagatattctatgctaatggaaaccaataaaaagagcaggagtagctatactggcatcagacagaagagatttcaataaaaaactgaaaatagagacaaagaagggcattatataatgataacaaagtaaatacaggaaaagaatgatgattgtaaatatatattcacccacccaacactagagcattcagatatataaagcaaatattattaacactaaagagaaagatagacttcaatacaataagagatggggaattcagtactccattttcaggattagacagaacttccagatagaaaatcaagaaagaaacatcagatttaatctgcactgtacagcaaatggatctaagaaatattacagagcatttcatccaatacctccagaaaatacattcttctcctcagcacacagattattctcaaggatagaccatatagtagacctcaatacaagtcttaagatattcaaaaaatggaaataatatcgagcatattttctgatggactaaaagcagaaagcaataacaagaggaattttgaaaactatacaaacacatggaagtaaaacaatatactcctgaattaccagagggtcaatgaagaaaataagaaggcaattgaaaatttttttgaagcaaatgataatgaatacacagcatatcaaaacctatggaatacagtgaaaccatattatttcttcatactgaagagggaagtttatagctataagtgcataaataaaaaaaataagggaagcttcaaataaacaacctaacaatgcatgttagagaactagaaaagcagaaacaaaccaaacccaaaattagtaaaataaataataaagattggggcacaaataaataaaattaaaatgaaaacaatgcaaaaaattaacaaaatgaaaagtttgttttttgaaaagataaacaacattggcaaacatttagccagactgactaagaaaaaaagagagaagacccagataaataaaattggagatgaaaaataagaaattccaactgatactgcagaaactcaaaaaatcattagtggctactatgagcattatgagtgactatacatcaataaattgtaaaatctagaagaaatggataaattcctagacatacacagcctgccaagattgaaccatgaaggaatccaaaatctgaaaatctgaacagaccaataacaagtaatgagatagaagccataataaaaagtctcccagtaaagaaaatcctgagacccaatagcctcactgctgaattctaccaaacatttgaagaagaactgataccaaatcctactcaaactatttcaaaaaaatagaggaaaagagaatactttcaaattaattctaagaggccaatttatgaggcttctcttaccctgataccaaacccagacaaagacacatcaaaaaagaaaactacaggccaatattcaagatgaatattgatgcaaaaactctcaacaaaatactagcaaaccgaattccacaacagattaaaaagattatttgttatgaataagtgggatttatccccatgatgcaagcatggttcaacatatgaaaatcaatcagtgtgatacatcttatcagcagaatgaaagacatattatcatttcaactgatgctgaaaaagcattagataaaattcaacactgattcatgataaaattcctcaggaactgggaatagaaagaacatacctcaacataataaatgccatgtatgacagacccacagctggtattatactgaataatggaaaaaaaaatggaagcctttcctctaagatgtgggaaaaaaatacaaggatacccacttttaccactgttattgaatatggtactggtagtcctagctagaacaatcaaacaagggaaagaaatagaacattcaaattataaagaaagaaatcaaagtactttgtttgcagacaatatgatcttatatccagaaaaacaaggatttcaccaagaaaattattagaactgataaacaaattcagtaaaattgcagcgtgcaaaatcaacatacaaaaatcagtagcatttctatatgccagcacggaacaatctgaaaaagaaataaaataatctcatttataatagcaacaaataaaattgaatatctaggaatcaaccagaaaatgaaaaatctctacaatgaatattacaaaatattgatgaaaaaaagaggacaccaaaaagtggatagtccatattcatgcatcaggtgaatcaatattattaaaatgtccacattacccaaaacaatctacagattcaatgcaatccttatcaaaataccaatgacatccttcacagaaatagaaaaaagaattctaaaacttacatataattacaaaagacccagaatagccaaagctatctcagcaaaaagaacaaaactggaggaatcacattacaggacttcaaataatactacagaactatagtaaccaaaaccagcatggtactggaataaaagcagacacatagaccaatggaacagaatagagaacccagaaatgaattcatacatctatagtgaactcattttttacaaagttgccaaggacatacattggagaaaagccagtctcttcaataaatggtgctgggaaaactggacatccacatgcagaaaagtgaaactagatctctatccctcaccatacgcaaaaaatccaatcaaaatgaattaaagccttaacttaaagacctcatactatgaaactcctacaagaaaacattggagaaactccccaggatattggtctgggcaaagatttctatagtaatacttcacaaacacagggaaccaaagcaaaaatgaacaaatggtatcatatcatgtttaaaagcttctacacagcaaatgaaacaattaacaaagtgaagagacaaccctcaaagtgtgacaacatatttgcaaactacccatctgacaagggattaataaccagtacatataaggagctcaaacaatcccataggaaagattgactgagatctgaatagacttttctcagataagacataaaaatagcaaacaggcatatgaaaaggtgctcagcataactgatcatcagataaatgcaaaggaaaactacaaggaagtatcatctcaccccagttaaaattgcttttatccaaatgtcaggcaataaccaatgctggcaaggatgtggagaaaagggaacgcttatatacgattcatggaaatgttaattagtacaaccactatggagaaggtttgaaggttcttaaaaaaactaaaaatagagcaactatatgattcagcaattccactgctgggtatatactcaaaagaaaggaaatcagtatattgaataggtatctgcatttccatgtttattacagcactattcacaagggccaagatttggaagcaacctaagtgtctatcaacagatgaatagatgaagaaaatgtggtacatatacacaatggagtactatttatacataaaaaagaatgagattctgtcatttgcaacaatatggatagaactgaaagtcattatgttaagtgaaataagccaggcacagaaagacagactttgcatattttcacttatctgtgggagctaaaaattaaaacaattgaacttatggatatagagagtagaaggatgattatcagaggctgggaagggtagtggggatagtggaaggcatgtgctggttaatgggtacaaaaagtagttggaaagaatgaatgagacctagtatttggcagtataacagggtgactgtggtcaatagtaatttgattgtatatttttaaataactaaaagaatataattggattatttgtaacacatagaatagatgcttgaagggatggctgcctcagttaccatgatgtgattattacacattccatgcctatatcaaagtatctcatgtaccccataaatatatacacgtactatgtatccacaaaaattaaaaaaccattattttaaagggagcaagtgagaacaaggagaggaataatgtcatggcgaggctgttgcatatggagaacagtgcagaaacaccaaatgggaccaggggaacccttgccctctccctttggcatttatcagtgtcatgggtattgactcctagacagcacttaccagcctgtgatctatatttctgagtggagaatgtggaatggagggaatgggtaaagcaggatctataaatttgatcatcttgtgtctaccatctccagcaaaaacattgacatcagatctattcatcatcatcatcattatcatcatcatctattgtcattattattatgattttatgcaactgccaatattactcctattgttatttgattcctaagcctcatttactgtgagcaaagcatggtgctattccattttacgtagtttgatttaatcttctggcaatgcaggcagtgttccttgtgtctgtgaaagctgaaattgcatcaaacacaataatcaacatgaaaaagtgcagttttctgtgacttttaaaaaattgatgtcaaacattaaaaatgtactttttttacaattggggataaatgaatagggatatgaaaaaatataacttatacgtatttagtacaccctaatttaaaaatattagaaacactgataactaaagtgtttcatttctttattaaaataatttacctaagacagctagattagcttgcctcctttttgtcatacaacttactacacaaagcaggcatcttttctaatccttggtgacctgtcatactcctttctaagttgagatccacttctaacattttatcctctgcactttcgatgccatgaaagatctctgataatccctttcatgtgaagttttttgccatcatcagtaagtctgggacattttcaacctttttgtcacaatcacttttctcatttatgttgataagttcatctttgctaagttcttagcctgcatgtctacagtcccttgaatggcaaaatgtcaaggtttctaaggtcagctgtttggtctccatttggcttccatttaaatcttaatcccagtgttatcatttttcatttctttgctgcactttcatctctgtttcccagttctgcatttcaattaccaatttttgtaaatgtcacatcgatttaccaccgggagagaaggaagcaacacaactacacattttgctgtctgtgtgtggactgattagcagatacccagtcagcaatcactgaaagactttggaagaagtgatgtgactggccactggtcatgctgtgcatctcttatgtatgtggtgatttgtgaactaaagagctagcagcaaagtttgtactttatgcctttactcaaaattcatataccatagtaattaaacattgagccatgtttttggagggctttgtcatttacctaaactgtgataagtaaaacttgtgcatctcagaaatgtgcacaaagtgaggactgcctatactctgaagtaggaattatgagtttgcccatgatatggaaaagaaaattgagtcagaccaagattatatgattaacccaatgattatatgtattaagtggtaaaggctgatttagattttaaaattcaggtagcctcattacagatattatagcttaacttcacattgtttggcatcagattgaatctcaaaccctgacttcacattctttgtctcgactcgaaccctgactgtgatctctgtcaattaagcttcctggaaatatagttgattttgcagcagctctggttaatcaagaactctacctcctgctaatgacagagtctccagcttctcaaatttcttgaaactgtttctcaagaatcaatttacttaagactgttttcaaagactatagtctattacgattataatattacagtgtactacaggtactatagtgttcacatttgaagctttttcttgtatccttcaactccctgattatggcaatttggttgacactttgaagctttccttctttctcaactgtcctcctgtcctgggcttttaccacaaacactctcttggtgtctttaaagtttttttctcagtaatatctgccagcaaaggaggactatatgacacccctattttcttcccaggttgtccctttgcatttgtatattttcaggagagtgcattaaccctgttttggaaaggcaagaattcctttctaatctgtagtcatttcagtttgttattcactctgaaaaatggtaatgaaagtggagaagacagtggtcaaattggcactatgcaaagctgagatgctagctagtgacagctccagaatgatggtcctggagctgcagccagcataatataaaagcaatcagcccaagtataagacctataatctccctataaaaaacagctccatcatctgccatctctgtgacttagggcaaggagcatttcagaacctcagtgtcctcctttataacataaagaaaagcttgaactctcattaccaacatcagtgaagattaaaatattgttactattaagtggctgatacatgtaaaagtcacgcaaaagttagattttattattagggcttgaaagagtgaggcacagtggcatatacaattatacacaaagatgattgattgattgaatgatagcatccagaagtcttttgcagtgtctcccaaaatctgttctctaatcattgttgtgaaggccactttataactacaccgtggataacatacctctaaatacgtctcggtgtatcctccttaattttacaggtataaccagataattgcaatcagtattgtaagccttatttgagaaaagatacttgctaataggtcattctcctaaactaagctgtgtgataaactagagataactcccaaattcaaagtccagctctacttttctgacatttgtgttgtcacaaattattgggagtcctcacttaaaaacaatctgtctacctgtggccccatagcagtgtctgatgaaccaagcacatagaaaagtatatgttgacataggccatctcttgctccagaagtgttcactacaggaagcctaaccatttgtcacacagggtcagatctcaaagtcctttcccttattcttcgagttttaatttttatttagttttctctcaatgccatcatgcctgtgtttaggctggtcctcctgattctttgtcctcaattaaaatatggataaataagatggtctctaataccagctttatagaaagtaggtagaatcaggcaagattctctctagtttgtcatacaacttgacttgaatcagctttgtgagttaggagtttgactgtactccaaagagattcaaactgagaactattcctttgggctcctttgttgtaaggtccattaaacacaatgagggcatatggacatggtttaccatttcttcacaaaatccactgcagagtttctagtgaagttgcaagaaaaatgacaatgaagtcaaatgtgttatttgttgagttaacttaagcaatatatgttgactcaggaaataaaatattacaaaagatagagacaaaacccagaagaaaatgccaagcaaaacctcagattcaatccttgaaaggacaacaattctacaaattgtagcatataatcatcaaattctgttttcttatgaatatatgtacattttcccatgaagataatatgtttacaactagaattgtggtctacatattgaatagaagactgttatttttatttaacaatatgttctgaacatctttctacatctgtaaatgtattttgttatgcacttgtaatagcttattgtatataggcacaatgatttcttttgtacacatcctgaattatacccttcaaataaagcctcagaaaaaataattctgggttgaagtctataaacatattcctagttgctggtacctatggactgacctgagtttgaattccagttcttgcatatactagtggtatgatattagctcttaatttcaaattatgacttggcctaaatacattggttttattcctcaaaagatcaccttcaaactgtgatggaatcttcagttttgaacaatttacaatttttgccagctctgatgcaatatgcatccactagagatagaatatactttctgtcacctaatcctcaaaaccactgttatgtcagttttgtttcttttaattcatgctattctgatagcaaacattgagacaaggaattgggtgcaggtattttatttgtgagattgtcccaggaagtaggaggaagagtgtctggagagggatgcagggaaggaggaaacgtcaatatatggggcatggccgagcagattctgaaggcaacagggactcagttgtgtgggacctctgtgaaaggtagagaggaatctccaggtttgtcctgtttctgacataggaagcaggggtgattacatctaaacgaaaaccacctccctgtgtaataattcctcaaaatgcatggtgttggatctagcaattccaagtgcttcagaaaagacacagggctagatgcagaaacaggactgtcagggtgagtctgggcttaagtgaaactgttcactggaactgtggctgaagtcataagtaggacaaagatgcatgatttggggcagcaaaaacacctgttacgttagtccagtgtaataggcagaaaatttgatctcaaagagattaattaatttgcttgagagcactcagccagtaattggcagaaacagccttcaaactctggttttctggctccaacccccatgttcttcccatcacaccacgcctcctccaagaaagcccagcactttgtgcttgtatggaagctccaggcactctgctctgggccacagctgtttgggcatagcacagtggtgtgccctgctgtataccacccattcaacctctaaatcccctacagcctcagtgttcagacataagggctctatcctttttatctatctgaacccctgatttttcccttcacagaatcagtgaacttgtacaaatcgtttcaaacagtgcattgcaataaattgatgggttgtgaaatcagtttagtgagacttgactagcattttaaaaataaaatagatgaaaatatcagaagtgtgtggtttctgtcactttatcaaaggaaaaaatgtttattcatgtgtatgtgcgtgtgtatgagcatgcgtgtgtatgtatacgtgtgtgtgtgctgagtctctacaaggaatttatttcatatgatgggacatggataagaaacttggaaagccactgacaaataggttcaaaatgcaggctcaataatgctcaaaatgcatgggttcaagtcccaactccaccacatactagccagatatgtttcagtcttcctatccataaaacatggctaacctcaagggctgttgaagaataaatgaattgctactcatagaaagttgagaagagtgcctagcacattaggattactcagtcattgttacttttcattgtaaaagtataatcaatatatgaagtacaaagttggcatgtaatttttgtttaatatggaacaagggaaaagaaaatcatcaagtattttcaattatttggaaagacatactatggagattgagttaaaatagcattttccttacatttattttgtgctctctcccaactgcccctcactacccagtgttctagccctataaacacagtatctatcaacttaaacaatgcaggtcttaggaaaattaatgtaaaatatttagtaagctaaaatttcattcaaaaatatgcatttttctagttttcaggaggataaatgaactgtataagacggtcttgttccataaatagtcttgcagtctaaacaaatgactcttaaattgccataaactaagacaggattattataccttccggctcagaaagaacactgtaactcaggctttgtgaaagagccagtgactttgaaccgctgcatgaatgtgggtgtgttctgtttatgtaatctagagtagtcatttctgaattgattgcacacaaaattcatccgagggaacactgaaaatcatttccaattgcattgggccaattgcatagaaaacactgagagtgtccccaaatccattctataaaaaatgctcctagaaagtgacagtggattgaaagataagcagttttgaaaataccttgactgaaatttgctgactgctcattcttggcttgaaataatgccattataattatttttagtgtatctatctgaagcaattatacaatacattgattttcactgcctcttcaagaacaaccttaaaaaccatagacacggagattctgaaatatcaggagaagatcaagagaatgctttttccagggccccagtcacgataagaaccctttccctagcatccttgacatgtttgttagaggtgattgaaggattctagtgataagtagtcatttgtctccaataaaactttacagttgcaatcataaacaggcttcaaagttcttgtagtcataaatcatctggacttttatttgcttatatttttctttgaaaactgtcttataaaaattaggtgtatgttaatggagagtatatatgccttactataagtaaaaattttgtgttactagatgtactggttttttttttctaatacacacttaaatgagaaaataacaattaacatgaaatatgttagttcttacaccgtctaaaatcatctattagaaccaccctttgggaaacactctttatgactaagaggaaataagcctcctatttgtctcacctaacagcccttcaaatgcatagatctgtgaacatttttcttcctcaggggaaatatctataacttccttaactgtttcttatgtgaaacaatttcctaactgctcaccatcctagcaaccttcttttaggtgctctctgctttgtctaagtagcttttaaattgtggaagcttctctaaggtgataatttcttatctctggaaaatgtaggcattcctctatagcttccttttctgagtcataggcctgaggaactcacttctagaaaatgtgaatgaatcagcagaatttcttatggctcttgagcattatctttgtgtttctttgataggggatgtggtagcaagtgagtgcctttatatgaagatattgggcaaaatatcaaagttttttacaaggaggactagcataaggcaaaggatccactcattccttattttaattgacctgttcattttgagatagttgtagattcacacgcggttgtaagaaatagtgagagatcctgtgtttccattaccagtttctcccagtgtcaacatcttgcactgtcctgtagtacaatatcacaaccatgatgatgacattaatgttgtcaaagtatgagaattttatatcaatacaaaatcccctatattgcccttttatagtcagtttcttctcaacctcaacatctggcaatcactaaactgttctacatcctgtaatttttgtcctattatgaatgttatataaaaggactcacacagggccaggcgcagtggctcatgcctataatcccagcactttgggaggccgaggcgggtggatcacgaggtcaggagattgagaccatcctggctaacacggtgaaaccccgtctctactaaaaatacaaaaaattagccaggcgtggtggcaggcgcctgtagtcccagttactcgggaggctgaggcaggagaatggcatgaacccgggaggcggaggttgcagtgagccgagactgtgccactgcactctagcctgggcaacagagtgagactctctctcaaaaaaaaaaaaaaaaaaaaaaaaaggactcatacagaatccaacctttgagattggcttttatcatttaacttaattctctagagatccatggagttgcaagtatcaactatttatttttcttttctttcccatttacttatttcttttccttgctgagtagttttctgtggtgtggatgtaccacagtttgtttaaccattcacctatcaaaagataatacattgtttccagttttgagccattacaaacaagactgtgaaaattgtgtacaaagctttgtataatcataattttttatttctctgaatcagtgtcaagaagtacaattgttgggccatatggcagtggcatgtatactttttaaataatctgtcaaactgtattccaagtatctctaccattttatattcctaccagcaatgtatgaatgatccacattctggagagcatttggtgttgtcactattttttactttagacattctgatagctctatagttacatctcattgtggttttaatttgcatttatctactggctgatggtgttggacatctttaatgtgtttatttgccatctgaatatcctgtttggtgaaatttctctttatgtcatttgcccagttgtaactggatcatttacttactgttgttttaagagttatatatactggatactaccccttggttagatatgtggcttgaaaatactttctcaggctgggcgcagtggctcatgcctgcaatcccagcactttgggaggctaagagggcagatcatgaggccaagagttcaagaccagtctgaccaacatgacgaaaccccgtctctactaaaaatacaaaaattgactgggtgtggtgatgcgtgcctgtaatctcagctagtcaggaggctgaggcaggagaattgcttgaacccgagaggtgaggttgcagtgcagtgagctgagactgtgccactgcactccagccctgggcaacagagtaagagtgagagtccatctcaaaaaataaataaataaataaataaaatattttctctcattctgtaacttgtttttcattcccatgtttagggtcttttgtagaattaaagttttttatttggtaaagtcaaatctgactttatggattatgcactctttgtctagtattatagataccaaatagtttttactgtttttttctaaaagttttagagttttaaaaagttatcttttctctactgaattgcttttgagttgtcaaaaatcaattgtccatatttttgtgggtttatttccaagttctctttctttttcattgatttatgtgtccctctttctaccacgttcacagtcttgattgctgtagacataagttttaaaattgagtagactaatttatccttttattttttcttccttctttgttgttttccttctttccagctttccttctttctttctcattttttttcaaaaattgtttcagctattctttttttgcctttctatagaaattttaaaataatagtaatataacaattaattacagtttttgtaagtgaaataattgaatacaaaaatatcttgctgggaatttgatcggacttgtgttaaacctgtaaatcaggtttggggacaactgacatctgtactatattgaattttctaattcatggacactgtgtatctgtccatttatatagatgtttggctttttatcagtgttttgtagtttttagcataaaagccctggtcatgttttctttagatttaattactaactttctgagtgattgcaaatgatattttattttatttttatatgtgttcattgctagtatatagaaatacaatttatagttttatttttatcttgaattctgcaacctttttgatctcatttattaattccagaagtcattttgtagaggttttttttttttcctcacagcgtctcgctttgttacccaggctggagtgcagtggctcaatcttgcctcacttcagcctggacttcctgggttccagcgattctcctgcctcagtcccccaagtagctgggactacagatgcatgccatcatgccaggctaatttttgtattttcggtagacatggggtttgtttcatcatgttgcctggtctggtctcaaactcctggactcaagatccatccacctcagcctctcaaagtgctgggattacaagcctgagccaccgtgcctgccctgtagattcttgacttattgcattggctatacatacatgtatgtgtgtgtatagtatgtgtctatatatgtgtgtgtatatatacatatgtgcttgcatatatgtgtttacatatacttaatgaaggtatatgtatatatattcattaaatacaaaaaaatacattcatgtgtatatatcttcattaaataaacggtgacatattccacctttcctatttctctgttttccagaagagatagtttagaattgatgttaatttatcttgaattgttttgtataatactccagtgaaactatctgtgtctagagatttttttggggatgttttaaaaattatgaattcaagtttcctgtttttttttttttttgagacggagtctcgctttgttgcccaggctggagtgcagtggcgtgatctcggctcaccgcaaactctgcctcccgggttgaagcaattctcctgcctcagcctcctaagtagctgggattacaggcacccaccaccacgcccagctaatttttgtatttttagtagagacggggtttcaccatgttggtcaggctggtcttgaacccctgacctcgtgatccacctgcctcggcctctcaaagtgctgggattataggcatgagccaccacgtctggccgaattcaagtttcttaatcgttacaggactatccaaatgatatatttcatgtttggttgtgatattttgtatttctttaaagactcactcatttcgtcaaagtttcagatttatgagatacagctgtttgtggcagtcctttattatcattttgatgcccgtagtgacatacactgcttcattcctgatattggtttttctctctttcctttgtcagttttgccagagttttgtcaattttattgattttttttcaaagaagtagctctttacttcattaattttcctttgttattttttaatttcattgatttctgctctcttccctcttccttctgctacctttgctttcctttttctaagttcttgagcttgcagcttggatgattgacttgaactcttttctagtgcatgcagttagtcctgtaaatttcacttagcattattttagacatatgtaacaaattttaataggttgtatcttcactgtcaatcagtttgatgtattttttattacacctgagccttcatgtttgatccaatttattatttaaaagtgtgtcgttttcaagtgtttgaaaattttcctactactttctgttattgagaatctgtgatattctatttccgtcaaataatacacgctacttgatttcaattatttttaacttgttgaggtttgtttagtggcccacaatatggtctgtcttgacatacattcaatgaaaacttgaaaagaatgtacatttggctgcgattgaagactgttggttaatggtgttgagttcttctgtaaacttgctgatattctgtctccttgttgtatcaatcatgtagagaatgatgtggacgtctcaaactacacttgtgaatttgtctatttctcctttcagttctatcgatagaactgttttatcagttctatcagttatttcacatattttgcagctttgtttttggtgtacacacttttttttttttttttttttttttttgaaaccgagtcttgctctgtcgcccaggctggagtgcagtggcgccatctcggctcattgcaagctccgcctcccggctcccgggttcactccattctcctgcctcagcctcccgagtagctgggactgcaggtgcctgccaccacgcccggctaatttcttgtatttttagtagaaacggggtttcatcgtgttagccaggatggtctcgatctcctgacctcgtgatctgcctgccttggcctctctaactgctgggattacaagcgtgagccactgtacctggcctggtgtacacacttttataattgctacaacttcttggtgtattgacccttttatcagtatataatacatctctctggttctggtaattttttttgctctgaagataagatatattatctatatcttatcttctaagtttcctttgattaatacttccatgagatatctttttccatcctcttaatttcagcccattttgtcatatttatagtaagttttttgtaaacaacatagttgggtcatggcttataatcctatctgataatccctgtcttttaagtggtaaccttaggccatttatattttattttattttaatatattagaatttaacatttaatattttgttttctgtgtgctgtttgtctcttctctgctttctttttcttaacttattgtggattacttgaacatttatttaaaattccattttgctttattcatagtgcttttgaatacatctttttatatagctttattagtaactgctaggtattacaccctattttatataggtaacttgtcacagtttactggtgtcatcattttatcagtctgaataaaatacagaaaccttacttctttttgtgcccctttatccttcgcctttggtcatataattgttttaattatttcctctgcatacacttagacttagaagcacattatacgacattacaatgtttgcttcaagtgtcccaaacataatttagaaaactcaagacaaaaacgaaagcttactgaatctacccacattttttgtttactgtgttccttctaccttcttgatgttccaaagttccttcttttattttttctttctatttagataatagagtatagtcattattttaggataggcctgctggtgacaagttttcttagatttcttcatctgaggtttttaaaattccctctttacacttaaagaatatttttggctgggcgtagttgctcacgtctgtaatcccagcactttgggaggccaaggggggcagatcatgaggtcaagagattgaggccatcctaggcaatatggtgaaaccccatttctactaaaaatacaaaaattagctgggcgtggtggcgtgggcctgtagtcctagctactagggaggctgaggcaggagaattgcttgaatctgggaggcggaggttacagtgagctgagatggtgccactgtactccagcctgggcgacagagcgagattccatctccaaaaacaaaaaatatattttcttaaccacactaaaagtattgtgctcccttttttctgaactccatggtttctgatgggaaacctattgtcacttgatttgttttgttttgttttcattatgggtaagatgtcatttttctcaggtggctttcaagatgtttttctttgtttttaaaagtttaattatgatgggtcttgctatggattcattggggtcgatcctatctttggtttcctcagctccttgaatctgcaggtttatgtcttccattgaatgtgggaagttttcagccattattcaagttattttagccccaccctctttcttctggaactctgatgacacaaattttaaaacttgttactgacccccagtcactgaagttctattaattattcttcagtctactttctgtttttcagattggataagttttattgtttaatcttccagttttctgattctttcctctatctccttttctgctattaagactatcaagcctgtcctctgaggattttattacatttctatttttttagttttaatattatcatctcgttttttatcttctgtttatttgctgatacttttctttggtgaggctcttttccagtttttcatttgtttccagcgtgttcataattgattactgaaacattttatcatggttgtttttaaatttttgtcagcttattctatctttcattttgatgtatgcatttattgtttttgtcatactatttaagatcttaggttcttaatatgatgagtaattttgaattcaaacttggatattttcatattatgttatgagatcactaaatttatttaaaccttctgttttaactggctttttttttttacactgtgctagcagtcaaagtgggaagtaaaattcataattgccttgtgtatataaaaatccaagcattctattcagtctccattggtacctgactggtgggttcctcattactgccaagcatggatgaaaattctggctctccatggagtctgccctggaactgtctgtagggagcatattcctgccagtgagttcaaagtcctggctccctacttggctttatttgacaccactcaagtgcatcttgataatctcatggacgtggaagtgcaggttcaccactcggcctttgcatgagtaaagatagagccacaatattttctgggtgtttaaccagtcacagtagttatttttaagttttctgacttgttagattgctatttccctggccaacttcctagagagaacaggcttgttttggggcacttttcatctacctcatttgtaattccagattctagcttcgtcaactcagagataaatgagggaaaaacaaaactcaaggcatgcaccactgtgtcctttctgaaattccctagacaatcagctttgttctctacaattttcagtcttcatatgcttatttttattagaatgtccaggattctccattgtaattactaggcgaaagagggaaaagtctattttctccaccttctcaaaggctgaagaccccacctattttttttttttaagtacaaaagaagaaaaatatttcgttggactactctgtactgggcgtttgacttgtagcatctcatttcaaatttttactacactcttggtgtttttccagttgtacaaatgaggtacccaggtcacaggaaggttaggaaacttgccccagctcatacagatggaaaaggagagagctggaattttgagcccacatgtggctcacttaccagctccattatgttttgtactctccattcattaatttctctaatactttcaaggtagcaaaagttttgagaattattttctcaagtgttagaatacttgtgtgaggttacttaaaggagaaattatttatcaaaattacagaatttaagaattagaaaattatttgatttacagatcttgctcccagtccagatcttactctatgctgcattttctgctcccataaaaggactatgagttcacttatttatcattgagttgcacacatcttagttgatcatagctctgaagtgagaacagagtgtttacaagggcaatggatgcctggaatttcctggcctcactattatcctagctgttctagccctttcatgcacatgcttcaaatctcagcctttgggttgtgaagcacttcagagctaagagtgcacatatgtcattatgaccatcacctaatgctgagatggcttctctgttagtctgtctttcccccacggagtgggaaagcactgaatctttccatctttatattcctggcaccagaattgaccattatatcataggacctcaagagacaatattgagtaaatgtatggatggatgaggaaaataaagtaaaatcagcaaaaatatcctgcatgtgagaaggtaagttctgattgaataatcctttatttagcaaagtcatatggcctactttgaaaaataatttaggatgattataaaattacacaaattaatcagtttcggcatgttctattttttctgacctttctcaaaataaaaaaagaaccaattactctttgggggaggatattgcttttctttaataaaaataggaataaataaaacttgcaaagcacttcctgagggcaaatattttcatgggattatattgattactttagctgctgctgaagataagaccattgatttttctcattatctatgagactctaatcaataccaagtatttattgactagctcttttatgttttataagattctaaaggctaaggtaactaaagaagaaacaaacatatgcttccttcttttatgttacttaccttgtgtttgaacacacggttttcatggaagaagtaatgataaataatataagacaatgggattggagcactggcttgcattagacatattacataatcacaaatgatagctttaaaaaaagaagaaggaagtaggtattgattgtctaccattgtattagccatgatacgagaaacttttttgttatctttaaggaaaactttttcaaaccattattatcagccataatttttacctgttagaaatctgagactttgagaagctgaacaactagattaatgctgcacagtaactgaaataagtaggattcaaacagagttggaaagaaaacctgtgctctgttcaatacattaagcccattgagctaaataactagtaagtgtttaataagtgtgtttcaaaagtaaaagaaaaagagtaagaatgagacagaagtgaagaaatccacctgggggaagtgtggagattaaagatgtgtagggtttggatgcatgaggaagcgaaaatgcagggcctggaaagagtcacaaagagtcccccaaacagcggagtacagaccagtctgatcaggaaagagacacagtgggaaacaaataagacctcacctggtagggtgaaatagtgagcagggagtgtacatcgcacctgataggaagaagaacggatcagtataaaagtgtggtttcagtaaaagagagcaatttagggtgggggcaggttgtccaggcctgaatttagttaactacggtgagaaaggagtacttggttccctgagggattgcttctcagatttggatgatggacagatgtgagagaaggagagagaaatgacttgcaaaattcaaactggggtgattgctagaacctggtaagctacatggcaaagaagcttgcagtcgtgatctcatcacttattagtttttatcactttgaacctcagttttaatgtcatgaatatggggttgccaggcaaattcagtgaaataaaatatgtaaagaacctagtccacagtagctttccaataactgtgagtttatatccctgggtgaatggcagtgtttttcaaaaggaaaagaaagcacaggtgactggaatgattgagtttaccttgggagctctaacgttttcctggagagaccccacacacgtttatagaaataaatttgatctggaccctgaaataggtcagaggtcctcaatccatgaaatcagataacaagctctgtgccctgagattcttaggtaaaaacggctaggagctgtcggtgcctgtgatagtgcagatggcttctgctgagccagctggctgaattgaaaaccccaagtaggtcaaatacacattacctgaaatttctggggaatgtggagccttctgctttgcataaggcaggtcctcggcttctgtgccttctttgtgtcgatctgggctggtgcacttttgaactcagaggaatggtaattctccacaccacttctggtggcccctatctttttatcgtattatcctttctgagtacccttcctttttcctttaactctacaatctctttctgggctttagaactgtcctgttacaaggttatcttacattatacccattatacaaggggataaactaagagacagaaaggttaagggatttatttgcgatagcctattagagtaaagccagagttacatttctgtggggaagatgaggtcttaaaaagacgatagccatcaagtagtccaggggttggcaaactttgtaaaggattggatagtaaatattttaggctttgtaggctacatatcatccccattactgttgttgctgctgcttttcctcctccacctttaaaagagtaaacaaacattctcagcccgcaggctgtacacatatagtccatgggccaaatttggaccaaagtttgccaaccctgaagtactttaatcctttcaatgtatagatgaggtgacaaaaagacagatgagtttagtgaggcacccaggtgtcaccaagtctagagagtggtggagctgggctagacctcaagtttcctcaacatttttctctttgccgtagttcaatttctcagacacttgccaattgtaggaagtagttatttacctatttaaattccaaaatgggccatttgaaaggccatggagactgaggtaccaaagttggtctcctcacctctgtatctatgcttgtctcttgctttttaatgtaattttcactgcctaagtccaaagattgtttgaggtggtgtaaaaaagtacaaatagttcacaataataaatacatgataaaaatcacgtgatacaaacaatgaaacagggaaatagtaatgctaacagaaagattagcagtaagtattgaactttgcctctggcttcctgatgcctataacaaagagaagttcatggtcagtcacaaaagtcagcgttcacacatttaaaatgaatcagttgtttgttggagcacatattttgtgattttaagaacaagtagtcatttctccaggggctctgtgtgaacagtgcactatataaagccatgttcaggttttatgtctcacaattagtacatatcaggctgcactgtttattggttagaccatggcttgtggagctgacaacctgtgttggaatctcattctggtacattcttgcaatatgaaattggcaagtcctttggcttttcttatcctccatgtccttatctgtgaaatgggaactaagaatagctacctgagagcttgtggtgaggaatggtaaatatacataaagcctctagaagagactggcacatgatcaattcaatgagcagttactattatgattgctgcctgtagattcttgacttgcattttgaaggagtgatgattgttaaagcacagacaactcagaactgatttgctattagatgaatgcttaatgattcttggtaaatgcctgaatatgaatgatttgatgctagatgtttcaagtttatgtatgagacgatgggatcttatttttttaggaggaatgggcacccatagtcatattaaaaaataaagcacatttgatgttgttaaggtaaagcccaacaaagccacagctgatatttcatcttgcaaatctcgaccttgaacttatttgttcactctctctaatcttcatacttgggtataagatagagaaaatactcatggaataaggacaacaataataaaagcattgcatttgcatgtcagcttgatagaggtgaaaataaagaagcttatttcaactcagtattatcttgcatgatttgtattaatgatatcgcagcctcagtgtttaaagccaagtttggaaatttgcagatgctactaaattatgagaaaacaacaaataatgaggcacaacgtattctgatggaggagaaatttgctcatttgggcacctcaggctaatagagagctaatggatggcaaatacagtttgtttagataaatgtcgaataatgagttttgaaacacagactaaagggagggaatgcctaatgaactgaaagtgctttagcacaataaatcaaagaatgttggtgtgtgaataaaggggatggtctaaacgtgcaaactcaaattgttttttcttttcagcaaagggcagaaatggtcaccagaagtaaataacacttttaacatgcagtaatcagcatttcagagtgcagaaataggaggaactttgaaatctgtcctatgtgcatttaatttctgctccttttccaaaattatacgatttggagtaattctgttgatctacctgaactccattttcttcatctgaaaatgagaatagtagtatttgtcagggctattgatatggtgttgtcaggtgaactgcataagggtctctgggctgagaggccatcacccacattgcaaatgtcatagatttgtctaatacatttatagatttgtctaatacatatatatgtctaatacatttataaaatacatttgtctaatacatttaagcaccatgctctttatagatagactcaaagtttcatgtttgttcattttgtttgttttaatcaatatatacataataaaaacactgctgtatagaggcaaaatatgttgaggaaggggtactttttttcttttctaaattgctaaaggcacaacagcaactggtgtgggggctaaagatttcctggttggaggcatgcacagccccagggggatgagtttttgggtgagatgggcaccagctgtgaaggcacctctctccagattggtgctgctcactgataagagatgactgctttgccaggggtcagtgtgagactatggaacagtacagggaaaatcaaaacactgggagccacagaaagaatccaccatggtgggcactgctgccctcagtgctcctgtaggattttacctttaaaaagctgcactgcgtgtgtctttatagtagaatgatttacaatcccttgggtaagacacatgcacacttatgtttattgcagcactagtacaatagcaaagacttggaatcaacccaaatgtccatcaatgatagactggataaagaaaatgtggcacacatacaccatggaataccatgcagccatgaaaaaggatgagttcatgtcctttgcagggacatggatgaagctggaaaccatccttctcagcaaactaacacatgaacagaaagccaagcactgcatgttctcagtcataagcgggagttgaacaacgagaacacatggacatgaggagggaaacatcacacactggggcctgtcatggggtgacgggctaggggagggagagcattaggacaaatatctaatgcatgcgggtcttaaaagctagatgacaggttgataggtgcagcaaaccaccatggcagatgtatacctatgtaacaaagctgcacattctgcacatgtatcccagaacttaaagttaaaaaaaaagctgcactgcaattgccaatttccttatctggctctttccctttcctgtgagctccttggaaggctggaagctaaccctactatccctccttccacaggaaagttcctgaagcctgtgtgacacttggtacattgtttctgaaaaagtgaggaatgagtctctcttctgttgcctcccatggaggtcagtgtcatatttctaggcttagttattttaaattgccttgattttttgattttaatatgcatctttttttttcttctattctgaatttttggtttgtgtcagccaacatttattgaatgcacaatgtatgacaatcattttcatgctttattttaatctttagttaatctttaacactcttatgagataaacatcgttagccccattttctagatgaataagttgaggcttagatagaaaaatagtaaattgctcaacattgcatagtgagcagattgcagaggagagattcaaaactaagtccccctgtcttcaaactgctcttaaagatttttctcagtgggtccctgaacattctttcccgtgctagtctcaaaagttattctaatattttcttattttgctcgacatacacaaacatgaagtaattacaccccactattgcctcatgtagctccaaacattccagtatccttgccctgtaagtaaatcaacattcactatttgtctttagttcccatttgtgcttagatgaataacctactctattagcctgaatttttttcatattttatatctatttttcaaatctcatttatagaaacatatgggagccctgctgaaaggattatagaaaaatccctttgggcaagaggtgtgcatgaaaaaatacagttttatttcatcactctcatgcaaaaattttcaatagctccttcttgccaatttaatcaactcaattgctggcaacttagtatccattctttaggggactagacattcatttctaaatgcacttccttcatattctatgacacaaactccctcacatgaccttcacatgtctagctccccaagtagcctgtatgctcttcacagataggaggcatatcatatatattccaatgaactatttggggaactgtattccctagctctgggaaaattgttttcctctctgtggcccagagaagccaaatcttcttttattattattattatttatttatttattatagagacagagtctcgctctgtcacccaggctagagtgcagtggcatgatcttgactcactgcaacctccatctcccgggttctagcaattcccctgcctcaacctcccgagtagctgggactacaggagcacaccaccatgccgggctaatttttgatattttagtagagacggggtttcaccgtgttccccaggctagtctcaaactcctgaactcaggcaatccacctgcctcagcctcccaaagtgctaggattacaggtgtgagccagtgtgtccggccccaaatcttttaacgtactattttctttgttgaactggaccatctactcatctgccatccaaacatgacctattcctagtaataactcgaatttgggtattcttttagagcttggaaagcatgtttacatatattatctcctcagattctcaccgtatccctatgagaaaaatattttaagcatttttatttttcagatgagaaaggtagaggttacctgatgtgtccagggactgccaaactaatgaaggctttggatgggatcctgacacagacgttgtgattctaaagtccacattctaaagcactgtcacactatcctaccccaattccatccaccacagagatgttgctttctaatcgtcctctcaacctctatacactttgatagcatcaagaagtttttatcatattaacaaccaaataaatgcacaaagtgaaacagtatgcatattctgaaaatacagattaagacaaatcttttcctctcccattcccctcgccactctcaccttggaaccaagccccactgtaaggacatgctggcgccccagagcctgtgtggtccttagcatgcaccaccttgcaggaatgagctggccctttgtccattgtttccctatgctctacttgaagaacagtaaagacagcctctgaagcacattcagttgacccttggacatcgcagggtttgggggactgccccaacccggtcaaaaattcacacataaattttgacttccggccaggcgcagtggctcacgcctgtaatcccagcactttgggcggccgaggcgggaggatcacgaggtcaggagatcgagaccatcctggctaacacggtgaaaccccgtctctactaaaaatacaaaaaattagccaagcatggtgacgtgcacctgtagtcccagctacttgggaggctgaggcaggagaatggcatgaacccgggaggcggagcttgccgtgggccgagatggcgccactgcactccagcctgggcgacagagcgagactccgtctcaaaaaaaataaataaatagataaaaaaacaaaaaagcctttgactcccgaaaaacttaactactattaataatagcctattatcggccagaagcctcagtgatcacgtaaacagttgattaacacatatttgtgttatatgtattatttgctctattcttacaataaagaaggttacagtaaagaaaatgatactaaggaaatcaaaaggaagacaacatatatttattatttattacctggaagtaggacatcataaaggtcctcatcctcattgttttcatgctgagtaggcttagaaggaagaggggggaattggtcttgatatgcaggggtggcagaagtggaagaaaatctgggtataagtagatccatgcagttctgacctgtgttgttcaagggtgaactgtactcacagtgcgggtggaaggatcaacacaacttaggacataacagctaattgctttactgaacatatactatgggctagagatggttctgatgatattacgtgtagtaaatcataatcctgaagacaaccctaagaagtagtgtcccattatttcccccattttacagatgaggaaactgaggcacaggtaaaaaaaattccaggggcacaactagtgttagatttgggttatatcttcaggcaagcccaccagagcctgagccgtactctctgtgtctggcgttgagaaaaaacaaacaaacaaacaaacaactgataagatgccagcttgagaaatggcgtagagcttcagtctgactttatgcctctgggaaacatcagaaagggggataaagtgtcaggaactccactgcagtgatatcacctacatgaggaaattgatcctgtggacgcagcatcacttaccagcctgaagacactgcaccaactgcctgattaacagcaataatgataataatactaacatccaccatttattgacaaattcctattactgtcaatgtctccctattgttataaattaagcccaagctcctttgtgcagtgctcaaggaccttcgtaacacaagatctgcctatttcttcagactcatgccgcatatatccatcctcacactgtaagctccagtgatattgatgggttcattgctcctctgcacccttcaatttcagggcttcacttacactcttctcccatcttgaacgtcctttatgctctctacacctacgcaactctttcagccttgattcaactattcccatatccaggaagactccgcatagcacacagcttaggtgaaataccactcctctgggtctctagagcaggaagggtttacatctgtcttcatatttactgactataataactacctcagtttgtacatctaacattcaccaagtattgaaattctgagggcaaaatctgtcatattcacctgtaccctattgtccagcacagcacctgcacaggctgtgtcaaaaagtgacagttggcattgtgtatcagaccctgggtatggcaccttgaatccagttctaatctcagtataacctacgagtttgagattatcgagccgtatgtactagttcattctcgcattgccataaagaaatatctgaaactgggcaatttatgaagaaaagaggtttgattggctcacagttctgcaggctgtataggaagaatggcagcatctgcttccagtgagacctaagggagcttttactcatggagggaggcagaagaggggcaggcaccttacgtggcaggaacaggaccaagagaacaaggcggggggcagggggtgccacacacttttcaaaaaccagatctcatgaaaactctatcacaagaacaggaccaaatggttggtgctaagtcattaatgagacctccatccatctgatccaatcacttcccacaaagcccacttccaacactggagatgacagtttgacatgagattaggtggggacatagatccaaaccatatcactgtattaggtcatttttgcattgctataaagaaataactgagactgggtaatttataagaaaagaagtttaatttttctcaccgttatgcagcttctgcttttggggaggcctcaggaagcttccaatcatggtggaaggaaaagcaggagcaggcacttcacatggcaaaagcagggatacgaggggcggaggggcgacacatttttaaacaaccagagcacatgataagtcactatctcagggacagcaccaagaagatggtgctaaactgctcatgagagttcacccctgtgactcaaactcctcccacaaggctctacctccaacattgaggactacaattcaacatggcatttgggcgaggacaaatatacaaactatatcacaaacctactttgcttgtgaaaaaatatgagctcagaaaaataaagtaatatactcaaaactgcatataataactaatacgtataataagaagtgttcaattcaggattcaaatctagcattgttcagagtctggaattttttttctaggtctgtattctctatcacactaactgtctccttaagaataaagtaaagttggctgagcacagtggctcacgctcataattcccgaactttgggaggttgaggcaggtggatcatttgaggccagaagtttgagaccagcctagccaacatagcaaagcctcgtctctacaaaaatacaaaaattagccaggcatggtggcatgtgcctgtaatcccagctactggggaggctgaggcactagaatcatttgaacctgggaggcagagattgcagtgaactgagatcacaccactgtactacagcctgggcaaaaaagtgagactctgtctcaaaaaaaaaaaaaaaaaaaaagaataagataaagttgatgtttgggaaactgagcagaaaaagcaacaatcaagattctcaattcttaattcatgattcctgaatcgatgcacttgaaaaagagaaaaaaggatcagctttgggaatgtgttaaacactcacttctgaacacccatggtttatctagaaagtgaaaggacccatagaacttggtcaacccttgatcacgacagatattgaggagatatgcgaatgcttggaagattcacaataatcatgttgctcaggaacatgaaaataattataggtgacatttttaatcacttacataagatgtagatggctttatgtgatttactatataatatattccttataacaaaatatgccatcatcatttttagatgaaaaagctaagataaattaaataatttctgcaagtttgtcttctgctcactaagtagaagacctcagactcaagcccagtctgatttcagatcccacgctcattaataagaatccttccttgtctggctactgttgacctctaattaggtgctcacctacattaacctggaggaacaaagctggaaaggggcacaagaatcctaggcaagagtagggaagggacggtgcaaccagacaaggcaggcatatttgaaggtggtttaggaatttacatcacgaatcccaaacatccatggagacctccttttaacacatgacttggcccagaggtaggcagtaaagagcaagttcagataaggctttttccctgcttataaaaaacatctgcaagttaaaagttgaaaagttatttatttcagctattcactcacttcagccccaatcagcacatgcctcagaatatctggagactgtgctaatacactcttgacatttggactaagacagagactgcaattcaatgttaacaacctggggtacctaaatggccattccacattgatcacttatttcaggcatttctccaaatagaaaaggttgattttatcagacattcactcttcttaatgtggatcagtagttctgtctcataccagccgtagccgcctggtgcctgacttgcccctctcacaggctggtggggttgctgacagcgtatcactgattttccacaaccagctccagagacacttgcccacacatcttctaggaaccattgcagatgtggctctatgacctccccataaactgaactcctaaatgctgaggcttccagattccctccaccaccccctgaaccagaattaaatattaaagaagtaaaatacattgtattttttaaagcaacctttgcgttgtcctttgcaaatattaaaagcaatgccactggcacaggaactaatccaagtccctggggccacttttcaaagaaagaaaagagtaatagtaagtaaacctctaaatgaaataaaggaagaaactccagctaaaattgctgaataataaaataaagacatgtaaatcatcctcgggggataattttctcctcgatcctggctgattttgcagatgaaaggaacacagcgccagaagttcagcgaccaggctcttcatcccactctgcccattcattggctttgtagcctcacttcaggcaagtcactcaatctctttggagctcagtttatgcttctgctgtagagaaatgataacaccaacagaagtcacagaggcggacctggaagcaatgagaaagctaactattttctgcctttctctctgccctcatcacataaattcaaataagccccgtgctccagttccaataaaggagtctcctcctcccgggaaagctggtttctccatctgcgcttgtgaacccacctcccgttcctgtgggggcatctggcctgagcttcggtctatatctatgaagtgggattaaaaataatgcctgcctcacagcgatgttgtgaggataaatgagctgaatcaggtaaagcacttaagacagtggttggtacatgcaaagtacacaataaatattagctcttcttatgtgtggctcttatttatccacatataagaaattttcaagtgtctttcatctgaaatacctgaatatctaaacatagttcagtcatgcaccacatcacaacattacagcgaatggaccacatatacaacggtgtttctgcaagattataacagagctggaaaattcctcctgcctaatgacatcttgatgatcctaacccgtgtgtgtgtttgtatcttagtttgtaacaagaatgtttcaaaagttaaaaaaaattaacagttagttaaaaatagaaaaaagtcttacaaaataagaattataaaatattttgtatagtggggcaatgtgtctgtgttttaagctcagtgccgttacaaaagaatcaaaaagtgaaataaaattaaaaactgtgtaaagtaaacatgttatagtaagctgcagttaatttatgattgaagaataattttttaaaataagtgtagggtaggctaagtgtacagtgtttataaggcctacagcagtgtagagtgatgtcctaggccttcacattcactctcccatcactcactgagtcaccgagagcaacttctagccctataagctccattcatggtaaatgcccaatacaagtgtaccattttttattttatgctctattgttactataccttttccatgtttagctatgttaaaatacacaaatgccattgtgttacaattgactatagtattcagtccagcaacatggtgtataggtttgtagcctaggagcaataagctgtgccataaagcctaggtctgtagtaggctatactgtctagatgcgtgtaaggacacactgatgttcaattacaaaatcacctaatgtcacacttcttagaacagatctccgttgttaagtgaggcatgactgtatattaagttatattatatataacttaaccattatatatgttattaaaatatagttaataatagatatatataaataaatttatataatataaatataatttatatattacatatgaatctgtatttctatatagattatatattatataatttaagcattatatatgttattaaaatatagttaatcataataatatatgtactgcatatgaattatatatttatatattataaatatatgtatacattatacataaatctatattatatatagattatgtatatagttctctcttaacctcttctgacttgtatcctcctctagatactacctcatttctcaactttcctatacaaccaaacttcttgaccaagtgatcaacatttacaatctttatttttctttcatttttgaaggaaaaaataaaagtatcataaactccatgtatgtatcacacattccatcatcaactccatacctcaccaactttctgttctctacattattttgaggcaaattattgacatattatttttccataaatatcagtaagtgtcattgagaaatttttttctcctctattttttgaatttccactcactcttgaacatgtagacacacatctattctagacaccaattagatagatagagcagtgatcatctgggcaatactgaatgccctcccttaacactccatattctgcctcattttccccatttatgaaaaggtttttttgttttgctttgtttttgttttcaggtaagtttgctaatgatttcccgactgtcaaatccaatgaacattttttagtcctatatcgtatagtgttacttatatggcaaagtaaagcactttcctataattttattgtctcctcccaccccactctgaacacttgcagaacgcattaccatgagtggactctgatggttgatataaataacagaagctttagaacttacacacaattctcctggcccagcactagttccactccatgactttcccattcaaaacagcataggagcctatcatgctgacagctttggtagctggtactcgggttgctgttgtccttgtttttatttgtttttgagtaattaatacatttatattatacacagttagaaatgtgcataatcatatacagttaaagtttcctgacatcttgtcccttagaaaaccaagtcccctccctcggaccaaccacttttcaggctgctgtatgtccttcagagctgctctacacatatataagcatataaagacctcctccctcctttttaatacacacctattagcatacaaatgcactgttctgcaccttgcttttccacttagcaataaatcttactgatctcttcagatcagtgcatgaaacacttcattccttttgaggatgcacagtattaaattgtgtgggtgtatcataatctcttcagccaatcttccactaatagacatttagactgtgactaatcactgccattaaaaacaatgttgcagtaaataactttgcatacctgacattttgcaaatgtttgaatacatgtataagaaatttctagaagtgttattgctgaattaaaacatatgaaaacttgtcattttttgagagatagtgccatattgtccaacagagaatttgcaccgatgtacactccaatcagtgaaaagagtggcattttcctaatactttcatgtaaatactgcttattaatttttctgacctactcaagtccaattaataaaaaacaatatcttggactaattatttagcattatctatcagccttgctttatctagatttttaaaattttaactgttattgttcattgttgccatttttctagatattatgcatatttttggtattcattatttatactttaacctggtggttgttttaacatattgtggtagttttgtttttgttgttatttaatttccaggtagtagaataaatggattttctggcttttatattgattttagttttaccccaccgtgaccagataatgttgtctgcattatttccatgtttgagaacatattgatgctttcctagtgattatttttttgagaattttcaatggatcatctgaaaaatgtttaatctcacctattagtctacggagggtaactatatatctattacatctcatttttaaaccatattgcttaaatcttttgtatatgttttttattcatttaatctttcatgaaatggaaaaggagaattgaaatctacgattactttatttctgtgtatttctccagatactgcttttttttttctttatacaagttatcattgcaggaattaggcctacacaaaagtgcaagaggtggggaagtgaaggtctagaagtagactaaggattcgagaaggtgtcctcactaaccacttgtgataaaaaattaaataaatatgtgggctttgtctctagttcctgacatacagctcctaaagtccttagaatctgcagagttctgtgcctttggtgtgccaacaagttactggtggctggagcaccctggatagatgcaggatggaggctgggcaccagcaagtcctaggcatggttggaattatagcactttaagcccgacctcccaacctctgggcagaggaaagagggtagagattgagttaaccattaatggccaatgaactgatcaaggatgcctatgaaattaaacctccattaaagcctgtaaaggggtttggaaagcatctgtgtcagtgagcgctttggggtgctgagaggtggcatatcccaaaaagccatgaagactctaccccttcacccattcttttccgaatgcagctcctccatttggatgttcctcagctatgtccttgaacataaatcagttacattaagtaaagtgcttacttgagttctgtgagccattctggcaaattatagaaactgaggaggggtttgtggaaacccccatatatatagctggtcagtcagaattgctagtgacaacctgaggcttggggctggcacttgaagctggagccatcgtatgggactgagtccttaacctgtgggatctgacactgactccaggtagatactgtcagaattgagttgaattgttcaacaaccattggtgcctagagacttgaaaattgattggtgtgagggaaaaaaaacccagacatttggtgtcagaagcgttgtgaataaaacagttcagatcagtgctcctgaagcaccagtgtggtggacaagtgggagctttcaggcatgtctgagaagccagcacatccaaccacgtaggcaggactgtgaaatgagagctcagggagaaagagagctggtgctgttgtgcagtgattacctttgtgggtctgaaactaacctctgatgatgggcttgggaccactatgctctcagggctggcagtgaggaagaaaagctggacctggaattgagaacaatgagggctattggaaaccactgcgtctatctttgtccctgaccatgaagaccttccagaggcatccagaccacattttgaatcttcttcaagtgaactttttgtctcccagaaccatataggaaagggaaatctggaaaatgaattttctagcttaacaaggttgactcagtacaacacaactcacctttgctcattatgatattccaaactttctgaatcacttgttatagatgtgtctcctacatacagtatagagtttagatttgattttgtctaatcttggattttttaaattttaataggtgagttcagttatattgattagattgtgtagtagaaagttatgcttttagttaatcaaattttttgttacagtatttcctctggtgactgtatcaaaataattcaagtagactgtatgttcttggctttgtgctagcaatgtgtgtgaacccaaaatatctgagacaggtctttaccaatttagaaagtttattttgtcaaggttaaggatgcacatgcatgacacagcctcaggaagccctgatgacctgtgcccaaggtgactgaggtacagcttgcttttatacattttaggaatatatgaggtatcaatcaatatatgtaagatgtgcattggttctgtctggtagctgggacaacttgtagtggttggggacttccaggtcatagctagataaaagacaaaaggttgcattattttgagtccttgatctacctttcactgaatacacaatttagttgagcatagtgaatctgcatttttacataaacagtggggcagaagaaacagtcagatatgcatttgtctcaggtgagcagagcgatggctgtctgtcctgcacctgtgaagattagctgctggtttacattgccagggtgaaattgcacaaaagtattttagggtaaaaatcttgaggcccacaaggaattttaaccttagagctctaacttcatataatatccttaatcctctctctctttaaacattatctgttgacttctggttatgagcaatgattaaattaatagctttcctctcacttgcaactgtcacctgatcttattttattatgttctctttctcagtgtttacctttgtaatattaaataggcttacccttctactacttcaaatgttattgcttagggaccatcaatagaagacgagcagcccggaagacacttcctcccacttctcacccctttgccctctcaggccatctctctgtctcgttaatatttgtaacagagtttgcacgtatgatactgttgctcccgtgctctgtgccatgtctcagaaaaggaaggtaaaatgcctacgttcctctctcatgtgcacattagaagtatatgggaagctttgaatgtgttcaaagttaatgatttccaaatttagtcacttagataatattattttctaacgtttatttgccacacagcaagataattttagccacccactggtttgtagaaacccttcactggagaaccacttgtccagtacagatataacagcaacttccttaagacatttcagaaaccagaaagtgatcaattattttttatctaacttgagtttataaggctcatgtgtgctccttacaggggatattcttagactgtcattcatgcccctatcctcatcatattcccacaattctagtaaaccacagcttattactgagacactatcacattgaaaccctaacataagagctttccagagataaattaagtaggagcatacatcctgggagcaagcaagtggatcccaaaaagcacagagatgtgaggtcttcaatcacgggcagcttcctgagccggcagccagtgaggtcacataaggccccttgctccaaagggtccctgattgaaaatctttgaaataattaattttgtatttaaatttgtgctttttaactgatgtcccaggggaaaaaggggcacacactgaggcctcaaacccttgcctcacaggtagattttaggctcccagcttctctgcctctggatgccccaaaccccactcagccctcacctcacacagtgatagctgccatcctgtactcgaggcgaggcccaggcacacacacaggtagagttggggatggttacacatccccatagcatcttcatgtggggcatgacagagctgtcccttgccaggctggaaataccaggacacatgaggtaggcgcatcagtagtggcaagcctcttgcccacccttggttcagataacaagcgtatcctggaacaaaagttgtggtccttcagggaatacccatccttcttggactgggaagctggtacctggaaaccagagaccgatttccctgcctggggacagggcatctgtcaggtagctcacagaagggataaacagacagctggtgagccacaggtgtggctggctacatcacagggctgacccccatgcaccttggtagccccttgcctgatagggtataatgttaaatagcaggtaaataacaccatgacaagtcaacagagataccaggaagaaagtaaaatatgtgcatatggaattttgcactattaacggcactttattctggtttttgaacaaaggatctgcatttttatcttacattgagctcctcaaataaagtggttagtcctagaagtaatttaagtacaagacaatcttaccaatggctctagctattagggcataacttcacaaaattacaacaagtgctcacaagtactattgtaggctattctaagtaggccacacatgtgttcagtcctacttagggattaaaggcatatcaaccacttttttggggtatttacttgcttcaggaggtccaatcatttgcagatttgcagaatacttctccaggttgtgattcttttgctgtgagctcagtggaagcctctgtaaacctgactgtgacatcttccctttaaatcatctgttgttatgtatggactgctccttttgtactgagcaccgggattcagatttgtgaatggggaagtatatacaaagataagcaaaacactgactgtagattccatattcaagcctatctggactcatataatcgatgaattcacatgcatatattttggctgtttggccctggaagggagggaagttaaaacaataaaaaaaggccggtttttcaagagcttagaatgaaattggcagcaaaacacatattcatattaaagagaaataaacaatcaaaattaataataattattatggctgtcagatgaacagtgtcttcaaagagttataggaaagataagactgtttattgactatttaccataggtgaagcagtgtgctagcattttatgtatgtgatttcttccttccacctctcctgagagagggctattggtatcctcattttatagacaataaaactgaggctcaagtagcttaggtagtttccgagggccacacaacctgttgtcatttaaaggcaggtctatgtgaccccagagtattctactgtaaaatgtaccttccaaggataactgtctcatctctatttattcagtacatttgccattcaaaggactttcacatctattacctcatttgatctgcacaaaggcccttgatagaaagctcaccaccagaacggggagctgaggcacagagcaggtgaagagcccaagttcattatcgattcacaagtgaggctcctctgatctcccatgatctctacttgtctggtaaatgaatggactgaaaaatgagtgtataatcaaagtgcgatttgtccagggtggtattgtatgaataatttatgtagcataaatactgctggatggagcacttaactaaacccttgatcagatgcctgttattatctggctggaagacaatcaaaaaatgaaatgaaatttgggcaaattccatacacacttgggaaaggccacagagagcaaaggaagaacacaaaaagagaggaggaactcttgagagtttagagtgcatttggattcccaagactgctggaagtccatgatgaaaacgtgctaaagtgtagctgcatatctaggggagaaattacatgtagccactgtgattgcaattaaactggaggctcctttctggctatgatacggtgggtgggttgtttcatacatttgtagcttggcatgactgattctgacattgctaatgatcttaatatcactcgtacactgatgcatatgagcctgtatcagtgtgtattttaaaattcatggaatataaaattattgatctctcctcaaaatccaaatcaccataccacaggcttcatcactgatgtcagtaactaaaaacagctctcatgaagaagccacagtacaactgaaacaaaaccagaagggtggtcacaaaagggaatatcaaactttcaaaactcgaaggcccaaggcaaatgatttattgggagttggcataaaaatttctatgacatccccttgtcttctttccggtccttcttcacgttaatcatacagtgggcctttattccaaataataacttttattcctgtccttacaatttctccaaactcaaagctttgtgtcactacactgtatctattcaggtttttttaagaaatcaattcataattcagcatgcacactgctacggtactggtccagtctttctcacttctgtcctggaagacattatctgatgggcaagaacactgaatgacttgtccctagctagccatgggagtaccccatctatgcaagtttgctggaatcttgtgctgctcagaatataatactggagtttcatgtgttctcccaagcaaatttgaaactccctgaaggcaaacatagagatttctgctccattcaggcttgtatagaaatctggctggctttttaagtattcacagggattaccttcctgactattaattttagcttgtccttccttggcatcactttatttagtttccaaagacattgatttcccacttttgctgtgaatacttccctcaggttccccctgagttgactatttggacaagaatgtctagaactctgtctcacacctaaaatatggctctagctctgattggaagcatcatattttcatataagagatgttctggcctcctgccttgcttgaaaggtccatgcttgctgagccaacttgtcacactcctcttagataggatggctgttagtttctgttctgtttctcttataggcttctcacacagttagacatagacttccttgtatgtatcaactgagctctcatgttgagtttagtgttttattttttaatctttataaaattttgtgctcctaaagataaactcatgaaacaaaaatatttagcatgatgatttgttgcaaagtgattgcttgtgtaggcaccaatcatgttgagaatgaaaacatcacaagcattcaaaagtccccattatcacctccctcctcccaaaaaaaaccccatttgtacttcttgtttttctttatagtatttattacctctgcagcaagcatccttaaacactccgtatttttcaactctataaacagaatgtatcattttgtgtttcatttcttgtgtataatattatgtccccttaaggttctttcaagttgtttgcagcaatacagatatttcattattttcattagcaatcaggaaaatccacacaaaaccaaaataagatttcatacacaatagaaagaatacctaaggttaaaatgaaattttaaatggacaatttcaagagttagcagagagctgatacactgcctgtgaatgtaagtatatccagataatctggagaacaatttgttattatctactaaaatttaaatgtgtatacccacatcccgtggctcaacaattccacttctacatatgtatccctctgaatcacatgcacatcatcctaacagcatgattcatagtagctagaagctggaaacactccaaatgaatgtcagaagtaaaaggataaattatttcataatcttacaattaattctgatgtgggataattcctttaaagttttttgtacacctttctttataggtgttatatgtctcactcaaaaagaaaacgttaaaaaattctttattgtacaaatttaaatagaagtactctatacctctatgctgggtaaatgaaatactaggtctgttcaagtctttcgcccacttttttctatttgaatgtctatattgtatatatctattcaactgatacatatatatgtgtgtgtgtgtgtgtgtgtgtgtgtgtgtgtattatttgtagtaattttttaatatcctggattggagccctagttctctcttgtgttataaatatgtcatctcatcttactgtgtgtttgttcattttcttaattaaatgaaaagataagttcttaattttactaatctaattcagcaatgtttttccttatagcctcttgcatcttgttttaaaaatgtataatatattctatcatctagaagccttattgttttacctttcacatccgtatttataatccttttgaaattatttttgtggattatgtggagtaaggtcacactttattttttccaattgtccacatcattgaaaagatcattttttcactgctctacagcatcacctttgctatatatcaagtgtctctctctctatatatatatatatgtctattactaagtttccaattatatccccctgatctatttgcctaaccttgtgccaatatcgcatgtcctaattactgtagttataatgatttgtggtagatacaagggaaaaaagtccctcacctcattcaagagcatcattagctatacttcttatttttaattttttatacaactcttagaataagcttgccaagcttctaaacaaaatgtattgcgatatcaattggcattgcattgaatcagtagatcaggattagttcaggaataactcacattgttacaacattaagtcatgaatcaatgaaactggtccatctctctcttcatttatttagttcttcttgtatatttcactcaatgatgttttaaaattttctaaatacaaggctgtgcttctctagttacatttattcttagatattaatatttttatgatacattataaattgtatcttatttaaaaataggatcttctaattgtttattactggtatacggaagtaaatttattttactaaattgaccttgattcatcagccttgctaacctcatgaatcctaataatttatttatgaattttatcacattttttgtgtatataatcaaaccatccatgattaatggcatttatatattttcctttctggtcctaatatttaaatcattatcttgccttattacattgaaaaggaccttcagtacaatgctcagtagaagtaagaattatagacaagcttcttcattcataatcttagtaaaaatatttcaaaatttcatcaataaatacgatatctgattgaatatgtttgtagataacactttactaacttaaataatttcatttaatatttgcaatataccaaacatatggatatatatattatatgtacatatatttataatattgaaggtggatttttcaaatgctttttctgcatctaagattttatttttatgtcattaatataatgaattacactggttaatttttaaatcttaaacaaacctcaccttttaaaaataaatccaaattaattactgtatttagctctatatatctagagatctaaatatctgtagatactataatgatgttatgataatagcacattattatgattagcatattattatgtcatgatatataaaatcaaggattctacatatcttttttacatattactagaatcatttgactattatattttattttttaaggatgacatatatagaaatgtgcaaaaatcatagatgtacaattcaaataatcatcataaaatgaacaccctttcataactaagttggctaacactttgctacaggttttattagatcatagcaatctcataaaccatggacacattaagagtttttttaatttactttttattaatcaccaggcttaggaatttcggactgaaactcagggtattggaaataaatatttggggcataaagattattgacattctaaccaagtaagggctagccaggccctcagtttttggaaaacattgaaaagagtaatacgttttgaaaacaaaatcgagtgggctgctggcagagctataggcaaaggccttaaggtaggaaaagatcaaggattctgaagtcagatagacctgggtgtaacacgatgaaactaggatttctcttctgtaaaaccaagaaatgattgaattattgctttccgtataatagtcttttttttttttttttttgagacgatgtcttactctgtctcccaggttgacgtgaggtggtacgatcaaggcttgcttcagccttgatgcctcagcctcctgagtagctgggactacaggcagatgccaccacgcctggctaattgtgtgtgtgtgtgtgtgtgtgtgtgtgtgtgtgtagagatgaggtttcacatttgtgcaggctggtctcaaacttctggcctcaagctattcttctgcctcagtctctcaaggtgctgggattacaggcatcagccaccatgcttattttaagagtcctgagaccaaactgtgctggttggtaaagctcaatgcttggcactcagtcaacgctcagtcaatgttaatttctttctttctacatcttccttcagttaacacaaacttacaacaatgaagaaataaacattaaatgctctacagggccagtttttgttttcttttgttctttaggtataaacaaggaactaataagaggaaaaacatagcagcacttacagcagaaggaaaatccagactggatagtagctgaggttgtggtccctccctcccacttagtacagagataaagtgggtaccaggtgttcaaactataaatgctgagttaggagggatgtatacaagggtgtgaatcctgctatcacagtccccatagcatgagcacatgacctattactttctgtaggaagtgaagaagggtatcgggtaaaactctcttctgtgcaattattcacacaaaggaatcaaagagaagggaagagatggcagtagcagggctagcagctggacatccatagttttatttcactgtatccatgtacttagtcccctgaggtgagcttcgttgtttcctttccctttggtgactcaacacagactccccacctgtgcatgaagcactgcacatacattgagctgggccatggtgattgggcttttcctagaagataaactcttccatttttacataaatttaaatgtgtagcacagatctcctagaaatgtgggtcatgtttttattgaaaattttgtatttgtctattagtaatttccatacaccagaacttctgttaagattgcattaaaggagtggacatccttcatgaggaagatcctctgtgacattcctcctacatcatcttttggaggccacctttcagagtggcatgcatttcactaactgggtccttcatcccaatacagcttactgccagtgagctagaatccaggctgaaataaagcaagccaggacttttaagaaaatgaaacgtgattacaattttaagcacagatatctgagtgggtccttggcatgttttgccattatttccatagctttgcccttgaaatgtgagacagcactgaaacactctcctatcctcctctcctaacagagtagcacacactgatattgtcagcattattctcaaagtgttacttcagcttaagtttcccttattttcatttgattttctggttttgctttcagaaaatataaaccgagccaagaatttgcatcttcctagggcagaaacctgaggtctattctggaggctttatctgaatttcacctctcctcacatttcctaatcccacttttccatttgatattattctatcactgtctgacatattatatatcttacttgattgacttgtctcttacttgtctcacttagcacaatacaaactctgtggaggcagagactttattatgagtccttaatacctagagcagtacaaggcatatagcatatgctccatacatttgtgtagagataattcattatctcaatttataacaagaagcactgcatcctaaattatccaagttgatttggggtaaaaagttaggttgggaaacgaaggaaaagaatatttaaacaatctataatgaaatatattaatttaatgagtacttaacactgtattttctaatcaaatagtactcagtaaaaaaagccttgttcagcataagtgaatttctttccatagcaccgacttcttaaaaaaccagtacttacctactctcctgttctgcactcaagcacgaaattgattaaatcacttaattaaataccaatttaaattaccaattctgaggctccacttccagaatttgttaaaatgtaacatctctgtgcctcactctcagagtttctgatttagtcagaaattaagtgggaggattgcttgagcccaggagctcaagaccagcctgggtaacatggcaaaatccggtctctacaaaaaaatacaaaacattagctaggtatggtggcatgaacctgtagtcccagctacatggaactatatttagtcagaaacacagaagcatacatttaaaaaaattttcagggaattcttacatgcagtaaagcttgcaaaccattggtctaggtatttttttttaaatgacactattcttttaaaatcatttttctttcagtccttctgaaataaggtttgttcatgatcatgcaacagatactttagaatatatgtatatatctttttatatatttgtgtttaaaatacatacacacacacacccatgttatacacacacatatacaaagcctataaagccaaatgtatatccttaaatgttttgataactgaaggacctgaaaagccacagcacccaccttggattgtcatttgtgcaaactataagtcttgcattcaacttcaaacagtcgacaagtcattctcagacctgtccctttcagaggacatctctgtcactgggcagattgaagggatagtaaagaggattcaaaagcactgagccttgttttccagtaagaaactgacatgacagtaagctagttcactgtgtacaccatcatgacccaatctgcgtgtgggaattctgagctcttgagagaacatgaagagtgttttgggaggaaataagggtagtggaaggtcaaggagaaatagttctttgatagcagctcacacttcttaatgaaagctgcctgctacaggacttgtggagagctgctatgtgacagagagagacacgtaagggagaggaggaggaccaacatttgcgaaggccctctgtgggctgggaattaacatgcgtatctcatttagtcttcgtaataacccacatgctaaaaaaagtccatttgtattttagacagttcagttttaccttcagtttcctgtaccacataatttgtccagaatcatagatctagtaaatgggacccaggtctatctggctccaaatactctttcatgtatacaatgctgctaggccctgggaggaggcagagtgtcagaattactcccatcttactagtggatatggtgaattcacactggctttctttctgttggtggatcagaccaagctctttagggccgttgcacttagtgttctctttgcctggaacactctcacaagcgagtctttgtgaggctgacttttcctgccatttctgtgtcagttctaatgaattctatcccgagtttcctgactacctagaaagaaggaacttccccactcactctcatcgcgtcactgcttcattgtcctcttggcacttatcagctgaaatttctgtgcattgtttatgcctttgatcactcatttattgttctatttttttaattagaatgaacatttctctttttttctctttttagaatgaacatttcttaagagcaggaagcttttttttttttttaatgcctgttgtatacttgatccttagagcaattcatggtaattactaggcacttagtatgtactggatattttaatagaatgggtaaatcttgttctcaccagtaaaaacaaaacactttcaatttttaaaaattttgtctatagcactgtgggactgaccgatagtaatttttgagcaaaacgagctcaccaaattccatatgggtgatgtcatgttatgtacaaaaataatttgagatagaataggggccgggcatagtggctcatgcctgagatcccaccactttgagagacctaggagggatgatcatttgaagccaggagttagagaccagcctgggcaacacagcaaaatcccaccccttaaagacaagatataagatagactatgatataacattttatttaataaagtctaaacctcaaagtgatagtcaaaagctgcagtgaacagaaaggaaaggaagaaaccactgcaggctctttacatcagggaatagtgtattcatttattaatattaatttagtgttggacactgtaaagcagtggttctcaaacttggaaccaccttgaggacctaaaaagtgctcttatgactgggttccacctcagagtatctgatttaattgttctgtggagtgacctgggctttgggatatttaaagtctcccaagatcactctactgtgcagacaggtttgaggaccactgttctggggatagagcaccagccattgtggttgtcagagtctgatgcaagtgacagattcagcaattacggtatagggctggaagttatgtcttgtgataaccatgactgtaggttactatggaagcacaaagtagatgctccccaaccgaggtcctcccatcacctcccagagcctaggctgagctgcaaaggatagagagacaaaaaaggaaggccattgagggcagaaatagagagaattcaattggcagggagcaaaggtgagccagagagaacttttgcatctttggtgcatgaagtagcaagtaaaaggaagaaaaaagccaggtctggacaagtactctttgactcaggacataaactctgtcttaagagatgaatagaacatgaataggctcagagaaaaggaagttaatcttggagaaaacaagagttataacaggtttagaaactatctggtgtaatcagctaattttatagatgtcttaactagggtgcagaacagttattcaacctgtcccaaccaaccaaccaaaccacgtaaggacagaacctcgactgcaatgtaggcttggcgatttacaggcaagttttcaagcactgcagtgcagtcataggggaaaggcatgaatggaagcaaaaagagtgtagtgtgcttgaaagagtcacaatactggtcttacaagaaagtaaaatagatatcaactaaatgaagacatgtcatttttctcgttatatgacctcaatgaagtgcctgggtatgcaatcacccatacctgagtcttggttcaaaagatgctcttctttttaagttgaggaaggcatgtgaggggtctctgttggatctatttttttgatgttgtttgaggataaattttggtgtaagaaaggtgctggtgttaacaatagtgccataataactgttcatctgtataacagatttggatcactcaggaggttcagtgtgttccctgccttggccatctccatcttactgacagcatttctgtatcttaaaagcatggaagcttttggtcttattgccatacacacacacacacacacacacacacaaacacacatgcacacacgcatacagatgcatacaatttgtggcctttgctttgaatgaaataagtgaacacccttactacctcctctaagtgtcttaacttcaatttattaggtacagactgaccctttaaatcacacttcatcagtgcgaaccctgaccaaaaacacaaggcttcctctccagctgctctgtggcacacacgtgtgcattttccttcctgcttagcatgcttgtgttcctgaaatattttggaggctttctcctttttctgtattttggtttcaccgacatcagcacacccaaggcagtggcgctgcaggagagactgctgtgcatgattggtgtgtctgcacagtcaacacaattattgcctatgtctgacttccaggacttttatcatcattggggagagattcacaagtaatagcaaatgtcgctgtggtcaaatggtaaattaggctttaagaggctacaaatgggaaaattatgaggtattttaagacacgagacgtacctgagggaactccttgccccatcccccaatcattcctaaactatcccatgcacccagtttttacaaccctcatcaagacctgaagtttccctaccactgcagcccacattgatctttcccttatatgaacatcagctgagttttatagtgtgtatcaaacaatttagcacttaacgctaattaaatgaggttaaataaaatcacttctgcagaagtgcctgctgtgaactgtacaagacagatgcatggaactattaccaccattaattagattaattggcttttgtatgttcatttttcctcctcagctctttagcaagcattctactggaggtttcataccagctaattcatgatggggagaaaggagatgctaaatagctgtggatttattaaagatgggattacgtggtgggccagattcatggctcgttatgcacagtggtcttatttcttcctgccaccattttctccttgaaaatttcccctcatctttgcaaagggaacaatgccagaaccctatccagctatatttagacagccagaaatgaaataactgtaacatgattgataaccttaagtccagggaaatgatattactaattaaatcgtgaaacattaggcaggctgtcaggcacagatatatttaaagtcataacagcccttgcttatttttaaagtgtttgcatattgaatgattctggtaaaattgtttctatttatcagaccaagtataaagtgctcatctccatggtatctgcaagcatagcagtcaatctaagataaatccaggcccaagagagcaatttctcctttatctcacattctctccttctctgtaacccttttatgaggttcactaaaatgagtttcattcaactttggaattagcacattccacactttacaatttctagaagcacaagcatgtgatgagctgagatagaaggaaaaggcacaagtcacagagcttcgatttactggatgcttattgtgtgccagatcccttagatctttgagttgctaatcttcctgtcccaattttacagatgcaaaaccaaaccacagaggtggtaaaagacacacacacacacacacacacacacacacacacccacaccttttcccagctaacagggagcagattgcttttggaactgagggctctttgacacccatgtcagtgccccttcaaggtctagtgataagaaaaaaaatatatgtatatatatatatatctcacattaagaagcagatgagtttttttcagtccaagatggccaaataggaacagctgcagtctacagctcccagcgtgagtgatgcagaagacgggtgatttctgcatttccaactgaggtaccgggttcatctcactggggcttgtcggacactgggtgcagcccatggagtagggtgaggcatcacctcacccaggaagtgcaaggggtcggggaattccctttcataaccaagggaaggcatgacagacagtacctggaaaatcaggacactcccaccctaatactgcacatttccaaaggtcttagcaaatggcacaccaggagattatatcccatgcctggctcggagggtcccacgcccacggagcctcactcattgctagcacagcagtctgagatcgaactgcaaaaaggtggcagcgaggctgggggaggggcgtccaccattgctgaggcttgagtaggtaaacaaagcagctggaaagcttgaactgggtggagtccaccgcagctcaaggaggcctgcctgcctctgtagactccacctctggggacagggcatagttgaacaaaaggcagcagaaacttcagcagacttaaacgtccctgtctgacagctttgaagagagtagtggttctcccaacatggagtttgagatatgagaacggacagaatgcctcctcaagtgggtccctgacccccgagtagcctaactgggagacacctcccagtaggggccgactgacacctcatatggccaggtgcccctctgagacgaagcttccagaaggacgatctgacagcaacatttgccattctgcaatatttgcggttctgcagcctccgctagtgatacccaggcaaatagtgtctggagtggacctccagcaaactccaacagacctgcagctgagggttctgactgttagaaggaaaactaacaaacagaaaggacatccacaccaaaatcccatctgtgtgtcaccatcatcaaagaccaaaggtagttaaaaccacaaagatggagagaaaccagagaagaaaagctgaaaatactaaaaatcagagcacctctcctcctccaaagtaatgcaactcttctccagcaacggaacaaagctggatggagaatgattttgacaagttgagagaaggaggcttcagacgattggtaataacaaacttctctgagctaaaggaaggtgttcgaacccactgcaaagaagctaaaatacttgaaaaaagattagatgaatggctaactaaaataaacagtgtagagaagaccttaaatgacctgatggagctgaaaatcatggcacgagaactatgtgacgcatgtgcaagcttcagtagatgatttgatcaagtggaagaaagggtatcagtgatggaagatcaaatgaatgaaatgaagtgaaaagagaagtttagagaaaaaaagagtaagaagaaatgaacaaagcctccaagaaatatgggactatgtgaaaagaccaaatctacgtctgattggtgtacctaaaagagacggggagaatggaaccaagttggaaaacactctgcagcatattatcctggagaacttccccaatctagcaaggcaggcctacgttcaaattcaggaaacagagagaatgccacagagatactcctcaagaagagcaactccaagacacataattgtcagattcaccaaagttgaaatgaaggaaaaaatcttaagggcagccagagagaaaggtcgggttacccacaaagggaagcccatcagactaacagcagatctctcagaagaaactctacaagccagaagagagtgggggccaatattcaacattcttaaagaaaagaattttcaacccagaatttcatatccagccaaactaagcttcacaagtggaggagaaataaaatcctttacagacaaacaaatgctgagagattatgtcaccaccaggcctgccctacaagagcttctgaaggaagcactaaacatagaaaggaacaaccagtatgagccactgcaaaaacatgccaaattgtaaagaccatcaatgctaggaagaaactgcatcaactaatgagcaaaacaaccagctaaatcaaaataacgggatcaaattcacacataacaatattaaccttacatgtaaatgggctaaatgcaccaattaaaagacacagactggcaaaatggataaagagtcaagacccatcagtgtgctgtattcaggagacccctctcacatgcagaggcacatgtaggctcaaaataaagggatggaggaagatctaccaagcaaatggagaacaaaaaaaagcaagggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagcccttagagacctacaaagagacttagactcccatgcaataacaatgggagacgttaacagcccactgtcaacattagacagatcaacgagacagaaagttaacaaggctatccaggaattgaactcagatctgcaccaagtggacctaatagacatctacagaactctccaccccaaatcaacagaatacacattcttctcagtaccacatcacacttattccaaaattgaccacatagttggaagtaaagcactcctcagtaaatgtaaaagaacagaaattataacaaactgtctctcagatcacagtgcaatgaaactagaactcaggattaagaaactcactcaaaaccgctcaactatatggaaactgaacaacattctcctgaatgactactgggtacataacaaaatgaaggcagaaacaaagatgttctttgaaacccgtgagaaaaaagacacaacataccagaatctctgggacacatttaaagcagtatgtagagggaaatttatagcactaaatgtccacaagggaaagcaggaaagatctaaaattgacaccctaacatcacaattaaaagaactgcagaagcaagagcaaacacattcaaaagctagcagaaggcaagaaataactaagatcagagcagaactgaaggagatagagacacaaaaaacccttcaaaaaaatcaatgaattcaggagctggttttttgaaaagatcaacaaaattgatagactgctagcaagactaataaagaagaaaagacagaagaatcaaatagacgcaataaaaaaatgataaaggggatatcaccactgatcccacagaagtacaaactaacgtcagagaagcacctctatgcaaataaactagaaaatctagaagaaatggataaattcctcgacacatacaccctcccaagactaaatcaggaagaagttgaatctctgaatagaccaataatgggctctgaaattgagccaataattaatagcttaccaaccaaaaaaaagtccaggacctgatggagtcacagccaaattctaccagaggtacaaagaggagctggtaccattccttctgaaactattccactcaatagaaaaagagggaatccttcttaactcattttatgaggccagcagcatcctgataccaaagcctggcagagacacaacaaaaaaagagaattttagtccaatatccctgatgaacatcaacgcaaaattccttaataaaatactggcaaaccgaatccagcagcacatcaaaaagcttatccaccatgatcaagttggcctcatccctgggatacaacgctggttcaacatacacaaatcaataaatgtaatccatcatataaacagaaccaaagacaaaaaccacatgattgtctcaatagatgcagaaaaggcctttgacaaaattcaacaatccttcatgctaaaaactctcaataaactaggtattgatgggacgtatctcaaaataataagagctatttatgacaaacccacagccaatatcatactgaatgggcaaaaactgggagcattccctttgaaaactggcacaagacagggatgccctctctcaccactcttattcaacatactgttggaagttctggccggagcaatctggaaggagaaagaaataaagggttttcaactaggaaaagaagcagtcaaattgtccctgtttgcagatgacatattgtatatttagaaatccctatcgtctcagcccaaaatctccttaagctgataagcaacttcagcaaagtctcaggatacaaaatcaatgtgcaaaaatcacaagcatttctatacaccaataacagacaaacagagagccatatcatgagtgaactcacattcacaattgcttcaaagagaataaaatacctaggaatccaacttacaagggatgtgaaggaccttttcaaggagaactacagaccactcctcaacaaagtaaaagaggacacaaacaaatggaagaacattccatgctcatggataggaagaatcaatatcatgaaaatggccatactgcccaaggtaatttatagatttaatgccatccccatcaagctactaatgaatttcttcacagaattggaaaaaactactttaaagttcatatggaaccaaaaaagagcctacattgccaagaaaatcctaagccaaaagaacaaagctggaggcatcacgctacctgacttcaagctatagtacaaggctacagtaaccaaaacagcatggtactggtaccaaaacagagatatagaccaatggaacacaacagagccctcagaaataataccacacacctacaaccatttgacctttgacaaatctgtcaaaactaagaaatggggaaaagattccctatttaataaatgttgctgggaaaactggctagccatatgtagaaagctgaaactggatcccttccttacaccttatacaaaaattaattcaagatggagtaaagacttaaatgtcagacctaaaaccataaaaaccctagaagaaaacctaggcaataccattcaggacataggcttgggcaaggtcttcatgactaaaacaccaaaagcaatggcagcaaaagccaaaattgacaaatgggatctaattaaactaaagagcttctgcacagcaaaagaaactaccatcagagtgaacaggcaacctacagaatgggagaaaatttttacaatctacccatctgacaaaggactagtatcaagaatctacaaagaacttcaacaaatttacaagaaaaaaatcaaacaatcccatcaaaaagtgggcaaaggatatgaacagacactaccccaaagaagacatttatgcagccaacagacacacgaaaaaatgctcatcatcactggccgtcagagaaatgcaaatcaaaaccacaatgagataccatctcataccagttagaatggccatcattaaaaagtcaggaaagaacaatgctggagaggatatggagaaataggaacacttttacactgttggtgggactgtaaactagttaaaccattgtggaagacagtgtggcgattcctcaaggatctagaactagaaataccatttgacccagccatcccattactgggtatatacccaaagaatgataaatcatgctactataaagacacatgcacacgtatgtttattgcggcactattcacaatagaaaagacttggaaccaacccaaatgtccatcaatgatatactggattaagaaaatgtgtcacgtatacaccatggaatactatgcagccataaaaaagggtgagttcatgtcctttgtagggacatggatgaagctggaaaccatcattctgagcaaactatcgcaagggcagaaaaccaaacactgcatattctcactcataggtgggaattgaacaatgagaatacttgaacacagggtggggaacatcacacactggagcctgtcatggggtatggggaggggagagggatagcactaggagataaacctaatgtaaatgacgagttgatgggtacagcacaccaatatggcacatgtatacatatgtaacaaacctgcacattgtgcacatgtaccctagaacttaaagtataataaaaataaataaataaataaaaaatacccatcagaacagaaaaaaaaagaaagaaagaaatggaagcaatgtacaacaaaatatttgcgtttaatacaactagatggtggttgcatcatacatttgtaccttgtgatgtatttaattcataataaaaagagataaagttataagcatattacttagaaaaaaaagtagatgaaggtgtaattcttctccagaggtagtcacacttgtgagtgaagttcttttaaagacagttctctaaagccagtgggatgaagagaactctatgggcttcgaggttaagcatatctttgccccacagccaggctgggctaagaactgtgtggccaagatcacataacttctctttcccaggcatcctcatccccttctgtaacatgcagcaatgatacccactttgctagtatttaagaagattaagtgggaataatttaaaaaaaaactacaagaagacaaagggcaaggaagaggggtgagtgtaggacttcctgacatttccagaattgcattcatgcaggggttttcttattctctgttaaagatggtattaaatatttcctagtgcacaaattttggcaaacataataggcacatcttgccccaacacaaggtattagattgagcacaataaaattgtgaggaaaggctggaaaatcatgttaaatagtattaagaaagccttaattgaggctccaaaatgattgctttaaaatctctttatcttggtttgttattttcctgacggatgttggagggaagggtgccttcagctgacctgtgttgcattctaaaaggctttctgttaggattgcaaatgagtaaacagatactgtccctaatcctgaaagcactgaagacatcatggtaaattacatgcacagaaggaaagaaggatcttttggcattaaatcccggtctgggatctcatcttcattctatatggattgtcaatttgccaaattcaaagcctcaagctattgtaattagactttgaaaatctctctctgatttccttttcaccattgacaaggatttgctactgaaaattacaaattgcaaatatattgtcagggcctgcaactggtcatatttcatttcactcttaagttccaagaaattacctttgttttagtgtttaatttagttggcttcaaagtactaactctgatatgagtgaacaggagaaggaatgagaaggaatcacagactcctatatcttggtggtcaggatccttcccaaacacagtgccctgttgccaaatctctgggcccaccgactcaggctcaattcccactgtgcttgttcagtcttttgcctgtatacctgccccctcctccatccaagctaaatcttgcaggtggaatgagtgccctttagcctattcatgggctgaccatacaacttttgagagtggaaaaaagaaaatgatcattcctgaaaaagtttcaaaaaatgaggcttggctgggccagacaggttgtctggtcaccccatctatgcaaagctatcttctttataggtgcagtccaggggtcctccatggaagtttcactggtggcgacagcatcctattagctcttccaacactaactgtgagccccaaactcatttttatatttaattatttcaaggcttatataattttttatcatactttgaatatatgccatactaggccaccaaccctaatcctaaccctaaactgtcatagagaatcttctcctttagtgctcggtaatgtactgtggtcagagcagacattcagacattgaatgaatatatacagaatatgcattcattaaaattatttgtatgcttttcctctcttttataattaagaaagaaagaaggtgatactgtaataatagtaccagccccagaagtataaagactctgagaagaatattcacataaatattatagtaatagccatttgtggagtttgatttttctgagaaatttaaacattagggcaatctagttagccagttttcattaatgtgaatagctgtgttttagttgatgtatccttcacctaagacttgggttattgtactgaccctgatgaaatagctatgcaatcttaagtgcattatttaaagctgatggagccccacttttctgatttataaattttagtgaagattatctctgccttagagccatactgtagtaatgcatttgaaaccatgccctcgttaagatcacacattctatatgcaaaaggcaccttgttgtttatcttgtgaagaaatgccatgagatgcttcccccaggatcattcagtcctgccaacaatcttatatcgtaagtattactaactgcatttgcagatgaggaaatggagaagggttaagtaaattgaccacattagtgactgccagatgtgggattcaatctcaagtttatctgactctccagtcaggaattggattgtatcattgtttcagcaaattcaatgatgtgctgataggtgactgatcgggggtaatagattaggaattaatctcaggattcatttagttctggcggctccatgcagattcaacccaaatgtgtttgcgtagtgcagctgcaagacattgatagtatttctccattgaggagagtggatggtttctatacaagagctaaataaaagattttataggaaaaaaagccccacaggcatgttataagcattcttctatttgtgtattttttcatcccactatggaagctttagaaagaaataggccccttctcttatgaacagctctttttagttgagtggggataaggacaatgtttcattttgctgtgtgtcttggcattgtgcctcaggcatgagcgtgcaatgggtgtgtgtgaagagtggatgaaaaccaagggcttcgtcctctcctggaaaaaccatcaaagagacctaaggagacatgtattaataataatctacagagacggtcctttgaatatgctcacactctcctgagataaaggatttcacaggcaggtcctgttctgctttggcaggaagaaaggagattattcaaaggccctgtaccgacagtgccattgggtttcataagggcccattttcagactacacttgagtggaaaggtctggagatctgagcagaacctatcgcttctccttgacagtttgctgagtataagaatacacaaggttcctcatagcgctcactggtgaatggtcattctcaccaaatccttttgttggcttcataaagtgcagagttaatggtctgtattattgtagtttgatatttaagtgagctgaactgtgctgaactattagagttaagattttcttgcacagataaatatttcctataaaatatggtattatggtggtttccattaatctggttgtattatgcttccaaatgagctatctgattttatcgttagaataattttgtgagacaacgaggatcaacttcatcccattttacagatcagcaatttagttaacaagtggtcattattgttcctgaggctatccaaatattcaagctatataagcatccaataattgtgatataatattactaacactaatataacaatattatcaatagctaatatttcatgaggactcactatgtgttaagcactcagctaagaatcatttcaattttctcacctgccaattggagatataattactgttctgtccactgcagggggtgtgtacagattagatgcagtaatgtgtgtttgagtaccttggcatgttcaatactgttcaatctatgtgtccatttctcagcttaccaactgtactaatgaattcttctctctagctcactgaactgcctactcctcgcacctctgtctaagctgcttttgtcatgcagctctattcacatttctctctttaattccttaaaagcaatactaataaccacaataataataggaataataattacagtgcatgtcttccattgtagaagcctgcctggtttacaaagatggcatgtaattgatcagcaaaatatccctgagaagaaaataggctagttatcataatgctcatttttcatttgaaaatgcaaaaaaggtagttgagattcagaaagactgacaattctaactcaacctggtgacaaagtgaaattcacactcagatatttccattccgctccatagctccttctgttttaagtgagtgtccctctcccttccaaggccctttggtccttaaaaaaaacaaaacaaaaaaaaaggtctatgagagtccctatagcttcttcaaagcttcttatatcaacaccttttgcaaagtgacttgccttccttggatgatctaagcttccgtacagtctgaaggagttctatggtgatcatctctagttctatttctctttaaagggcctggtcacacagttggggcaagggcatgtgtcattctttctataggaaatgctttccctctgcttatctggctggagttgtagaagattccacccacatgtctcctctcctgtgaagcctttgccaacacctctccacagagcactgctctctttgtgtctcttctgtatccagcactgactttctgtggagcaccagtagtgctttttttccctctgcagttggaacagatctgtgattatgtcagggatcagctatcagacccctgacatggtgacagatctgttctaactgcagactgtgtgactcctgacagctgagaccacaccttggtcatatttgtgtgtccatgtcctagcacagcaaatggcaaacaaaaaccccatagtgtatattttattgttttctacagtaaatttttgaatgaatgaataactttaacaaaacaacacctgcatctgttaaagggcagtgtgtctaccacttctgtgaagcagctgtggtctgatggaagttgaagtggctaaagtagcctcctctttttctgtgagtccttaattgctgttctttcctgcaacattatcagtgtaatgtgctaactcatcctacgtgtcacccaagcacattttgtagatgtgtgtgggacccaattctggtgtcactcatttgtaaaggccaaagttgaggtgttgtcaatgtctaaactccgtttgtcagtgagcttctcaggggttcgttccactggaccattagttgcctaatcctaccctcattttcttcctggagtaaaagaaaagaaaattacaagaacgatgaaactgtgtatattaaagggaaatagggctgacacaattgagaaatactcctccacactagttagcccttgaaaaagaaaaaaaaaaaatggtaaagccaaggcaagccatttatattaacacacctgggttccagacagaaactatggagtctattaattaaaattagtttggaaacaacattctattataagataatcttttcttcagaaagcttgctattagtaaattaacctcagccagtgttctggcacaatgaatgctctatctcataaaatccatattgtctgcttctagtcaataaaacacacaatctaataaaacccaattgtgcatggtcctggggcccagaaatcatgcagataattgaaatgaaagacacacaaatataaataattggctgcagtcaatagtcctaatgatctttcccacctagttttttacatgtacttggattccccatcttcgcagccaccatttcccaatattcttctgacctgtccattccccaagactctatcctcccagaagaaaggttacattgtagaatgattgctgaggtttatacttgaataaactaggcttcaaattgtgattttacctcttcctggctgtgtgacctgaattatattgccaggattttggtttctttatttgtgtaactgtataaaaatatctactatacagattgttgggagaattacattgaaatgaaagggataaggtatgcccatgtggctagcagagttccatattcattcccatttctttcctttacaagcagtgaggctcttaatagaatggcaagaagaacaagaagtaagaaagcctggagaacaagaagtaagaaagcctgaaagactcaaacactgtataatttttctctgaataagctaatgaacggccaaggttttcaccttttatgaagcgttatcatttgcaatatttctgagaactcatatctgctggagaacaggatatttccccagccagctcccactgagggccaggcgtgtttccagaaagcaacatgacattgcaatcagttttccaccaaagccagacacaggcaagcaaagggaccttgggctggcccgtacttctttggacctcagtcattccacctctataaggaagatgtaagcttgttttctttatttcctctgcgtttctgttatacatgtctgccctggattagtaagaatgggcttcaagaaagactaggaaaaaaaaattagaaaaggaacaggcaactcaagtgctcataagaagaacttacattaatcaaacaagtgtctgtatccctctgacactgcaaatactctgcctccccttgtggagtctataagcttgtctcatcctctagctatttccactcctattcctttctccacagaaactatacaccagtgtctacacatccctgtcaaatatttctcaccaccaaaaatctaggtgtgaagatccaggcttcgtttgttcatttggggttttgtgttttgtgtgtgtgtatttacacaaactgtgatacttgccagtgtcttttaattcatggtgctgccatataaactgcgtttattcctttctgtcctccaagctaggacaatcacaatctccttcacgaagacttattgatggcctgcttttttcatcatgccattatctgaactcctgtacaatggagtcttgtggtggcgttgaaccttaaatctaggtgaactgtctaacagcagatgaggaatgttgaagttgtgccatgcagctaatctacggcatgtggttttcatacttaaaggctgtgatgtccaatttccaattaaatagagacacctattttttccctgagaatgtaatcttgtcttgtaatcacctgaccctctcaaggatatagtctatgtcttttccaatgtataaatccccagagctgtaagtgaatcagagaaagcttgagaaatggcttcatgctttcatattttgagctttctcactgctgcagccatagggtaacaaatatgagaagaataactaacaatagaggggagaagtgaaacagctacagaacttacagactttcaagggggttatgctccaattggcccatcgtaagttaaaaaaatcatagattgaaacacactttgtatactttacctactcaacatcaaagcttaacctagtccaccttaaatgggatcagtttgacacttattatacattagcctacagttgggcaaaatcatctagcacaaagcctattttataataaaatattgagcatctcatgtaatttacagaatacagtactgagagtgaaaaacagaatgtttgttcaggtacttgacgtacagtttctactgaatgtgtttcaccttagagttactgtgaaagtcaaaaatcataaatagaaccatcataagtcagggactgtctgtagagttaacaagactagggaacgtgtaagcaaaatcaagtttatactgaaactggatggctgaaagcaatgcacctcttttctgcacattgcttagactgtcacctcctcttggaagtggcccttcatcagaaaagctctggtgagtgaaagcaacatgctcccccttcacaatgctcttttgtcattgtatatgcagtcttgtctttttgggatgtcctgtcacaattcctttggagttttagacagaacaacctctaagaagtgtgacctctctaacctaggctggaggagaaattcctcccctgagttctcctgcctcacactctttccttcagcatgacttatattgtgctgagttctgtgctcatgcctgtcttctcctccagcctatgagctcctcaagggctagatgaccctttctatcaccacctcgtactgcctagaacatggtctgactggctactggcctgctgtccgtgtgttaacatagggtgtgtgagggagtcaatttgtgaatgaatgaatgaatatatgaaaaaaaaataaagctgcctttgacacttttataatgtctcttttcctctgtagtttttttttcaaatttgttctccatgttaatccaaactttatttgcatataaatgaaaaaggaggaaatacaaggaaaaaaatcctcaattttgtctggatccacataggacttggtgtagagaaaacttcagtgaagtcttttgactttgaattctaaaataaactatgagcccatttacccagatttaatagcttaaaaccactgcagcatagagaagttcaattttagagattttttttcagtcacaaatacacatgtatttaacacacaaaaaaaattctactttgggcgctttaggggaataaaaattgaaattaaaaccagtctaatactaaggggcttacattctggtgaggagtatgtgacacatagatatatcaatgctgttgcgaggtgcagaaactgtgtcaggaatctggagagaaaatggtggacttgtacttgccattgaagagataccaagatgtgaacatgtggagaagtcggtggtcgctgtggagagatagtagcatgcagagggccatgagcctagagactaacattgtttggctgaagtcaacagcatcagaggaggttccaggttctaaattcagaagaaaagccaaggagatgccctgcacatgccttcattacccactatgattcatattcaggagcaactcaattttgtgggatttcgtagatttcagcagggagcataatcttaccaaaattagatttcctcaatgaaaaaatggagaactgaaaaatgttacctcaaagagaaagttagagatgatcctttaccgatgaggaagtgtgggcaaaagcctggcagttgaggccgacctcctctccctcctctctgtcagcatctcactagtgtatgtgatgagactcaggtgaggccccagcactgatgagacactaagtgtacatgagctctctgtttcttgtcacatggcctcccctatacagcaacaacaagcaaatgagaaaagagggcaggcataagccaaagtccacctgctcttaaacacattcgtaccatgatttcctaaggaactgttatcaatatcctgttttcattcagggactttgacaatactgtctgagggagccttgtactcttaatggagcagcatgcagagaagttagatttcatgcctcattacaaatattaagagatggactttcagtgatatgtatgtatgccttttcatgaagaccttaaagtttgtttgtttatttttttcacctgagagtttctctacacttcattactctataactgtaccaccatacattgggcttcaactgttctagcatggccagagcatctggagctggagagaagctgtattctgcatgcaaagccaaattggagaattggtccccgagtttgagagaaaatctatttaatttgattattgacagaaaaataaatggctctattatttgtctagaatctccgaaatacggcatgtaagaacctacatgatctgaattccaggagttccagctgatccttcccctacaaacacacacacacaccacatatcatatatatatatcagccctctagatttacttataattctagaagaagccatgtcctgcccatcagtagcagcctttgcataataaacgtttcctctctagaacactcttggcctaactattattagcccttcagtactctactagggtgctatatattgagtcctgagtctacaggaggttcccttccaccacatccctgcagctgttcaatcttcttttcatcctggaaatgaacctgtgggaattatccattgttttattttgttggagtttttttttcccccataagactatgagccactcgaaaacaaaggtcaagctttctaatctttgatcaataaatctaaatatattcctaacaaaataaatggtgtaaaatgaagtatttaatataaaatcctcttatttctaccccaacacacacacacacacacacacacacacacaatgctgtttcaagagacaaaaaagctctcaagatgttatctgatcaccttcataccattgaataaagaattgttcccatttgaaaaatactaaagacaagagaagttcaatgacgctccctaaagcaagtccggccccttgaaaagcaggagagtagttcgcaccatgatctgccctctcttggtgtagacttctcccagttccccttcacctggtagtttacttcagaggaggaacaagagagtctcgggaaagaggactctcagaagcaggatacttgccacgtgaggcaggtgcctgtttctcctgtgcagtggtctccagagaccggcgaaggagactctgatctgtaattatatccttccttcggtctctcattagtgcacactgttgctgaatacagataagcctgtatttgagaattctgtgcccgatcattgttattaattatagggaagatttgatattttaaaatatatttgaggaaggagccaagatggccgaataggaacagctccggtctacagctcccagcgtgagcgacgcagaagacgggtgatttctgcatttccatctgaggtaccgggttcatcgcactagggagtgccagacagtgggcgcaggccagtgtgtgcgcgcaccgtgcacgagccgaagcagggcgaggcattgcctcactcgggaagcgcaaggggtcagggagttccctttccgagtcaaagaaaggggtgacagacgcacctggaaaatcgggtcactcccacccgaatattgcgcttttcagaccggcttaaaaaacggcgcaccacgagactatatcccacacctggctcagagggtcctacacccacggaatctcgctgattgctagcacagcagtctgagatcaaactgcaaggcggcaacgaggctgggggaggggcgcccgccattgcccaggcttgcttaggtaaacaaagcagccgggaagctccaactgggtggagcccaccacagctcaaggaggcctgcctgcctctgtaggctccacctctgggggcagggcacagtcaaacaaaaaaacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacctatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaacccaaggctcgagaactatgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaatagactttaaaccaacaaagatcaaaagagacaaagaaggccattacataatggtaaagggatcaattcaacaagaggcgctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatagttggaagtaaagctctcctcagcaaatctaaagaacagaaattataacaaactatctctcagaccacagtgcaatcaaactagaactcaggattaagaatctcactcaaagccgctcaactacatggaaactgaacaacctgctcctgaatgactactggatacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaaatcaataaatccaggagctggttttttgaaaggatcaacaaaattgatagaccgctagcaagactaataaagcaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccatcatataaacagagccaaagacaaaaaccacatgattatctcaatagatgcagaaaaagcctttgacaaaattcaacaacccttcatgctacaaactctcaataaattaggtattgatgggacgtatttcaaaataataagagctatctatgacaaacccacagccaatatcatactgaatgggcaaaaactggaagcattccctttgaaaactggcacaagacagggatgtcctctctcactgctcctattcaacatagtgttggaagttctggccagggcaatcaggcaggagaaggaaataaagggtattcaattaggaaaagaggaagtcaaattgtccctgtttgcagatgacatgattgtttatctagaaaaccccatcatctcagcccaaaatctccttaagctgataagcaacttcagcaaagtctcaggatacaaaatcaatgtacaaaaatcacaaacattcttatacaacaacaacagacaaacagagagccaaatcatgagtgaactcccattcacaattgctttaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacacgttatacaaaaatcaattcaagatggattaaagatttaaatgttagacctaaaaccataaaaaccctagaagaaaacctaggcattaccattcaggacataggcgtgggcaaggacttcatgtccaaaacaccaaaagcaatggcagcaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccattccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatcacacgttagtgggtgcagtgcaccagcatggcacatgtatacatatgtaactaacctgcacaatgtgcacatgtaccctaaaacttaaagtataataaaaaaaaaaaaaacattaaaaaaaaaaaaaaaagaagaaaaaaaaaaaaaataaaatatatttaatgggatttggagctttgaagttcatgggaaggattgaaatgtgatacatgttgatagtgactgtaaatgatacacagctaatgaaaatttccattgctggggtgttgaattaatagcacttggcatttgtacagcaatttttattttaaaaagcattttgtgagcaatattttgtcttattctcagaagagcccacttaaagcagataggacaaaggtcaccatacctgctaacaaagagaaagggagatggaggcacagagaggagcaggcaggtgtttgaggccaggagctggcggcagtcgtcctgacactgggcaggtgtctttaccaccggaagctgccacctcagctcagacccgagctgttaaatgcctagatgcctaactgtgccaaaagccactcatgctgctaaacttagttcccaaaacaaaacatacacaaacacaaaaccctcccttcccaaatttcctgagaggggtaggacacaggaatatgagaaaattttcaaatcatattaaatttctttcagtgctaagaaccttgacactctggacctttcacctgtgattttcacttctgggaatctatcctaaataaagagagagaaatgttcacagattttttttttttgaataaggatgctcatctcagaattatgaaagtaaacatttgaaaatgaaccagttcttcaacatcagaatacttaaataatttatattatatgtggggatcttatgaagctgttaaaatttctacttccaaagaatatttaacaaggtaggaaattcctgtgacttaaccttaagtaaataaagagtagataagaaattaaagttatgtcaaattattaatagtagttatgtttattatttttattctatctctttgttgttttagtttaaaagtttcacaataaacattatttgagtaacagaaaggaagacattttaagttttatttgtaaaagtgatattctaaattaatgtattatctcattaaatgtggtttcctcagcttctcttatggccagacactcttcttaggagccaaatatgccagtctcttcccttggggagctcacatttgagtgtggatgttggctggggttggggggagacaaaacagaaaataaacaataaacatacaaagtacatgacatagcatttataacaagtactctatgatgctttctcgaagtaatccaaagatgatacaaaaaggggaaaaatgtgcaggatacagagcttggagaaagacggagagttgccatttgaaggagatgatgaaagttgggcttttgaggagtgtagcatttgaataaagtcttgaaggagatgagagcctcagccagaacataacttcttctttaatactttgggcaaggtttgttttcagttttttttcaaaattcagagaagtaattcaatgcatgtactatatatcagctaacacactatatattagctaacacacagtgggatttgagacagtgcccttaagcaaacacattaatatttctgcagggaaacatgaatattcatacaaagcggaataaagagagtattagcccacctgagttctggctagggttctccaccaaatgaattttgggaaaaacatatttgattacacatctttatggatttcaggaagagagataaagagttgtaaaattgtaagacacacagaggttgagtgaagtgatgcaatcagaaataacatttcatatttattgctgttagcatttacacattttgctccagatgtccttctgacagcgctacagctctggagtgggtttgaaacagctccattgaggggatggaacggctctaactagctctgttgggagcctcctgtcaccaagaggcaagtggcctgggcggcttctctcagagggaactcctgcagggcatagaggcttgggctcgggcacccttcagtgttcctcttctccaagataatgcacgtccttaaattcatcaatgcatctaggtggatatcttcaacagtgacttttccaaagggagagtagtgaggcagaaatgtttctgagatgccgaataaagccggccgttagcctttgcgaacacgatgctgattcatgtgggaggtttaataaatctgtgcagaaggaatgtttggttgatggccacgctggctgcgggcactttcactcacactgcccatgccttgcctcacaccaaggtttcacaggataactgtctcaggttgtcaaggcttataagctactttattatatttttatttagtttttaactaaattactttggtgaacataatttctaaaatttacaggacatctcatgattgaaaatattctcactaccgcgtgaacccaggaggcagagcttgcagtgagccaagattgcgccactgcattccagcctgggcaacagagcgagaccccctctaaaaaaaaaaagaaagaaaaaaaagaaaatattctcatttagttttggtttccacattccaaaaactaattgagaaaacattttactatggaaatgcagattgtcatgagccagggactagtggtggttttgtttcctgccgtatcgtcatgtttctaaactctgcctataacaaagcaggcataatgcatctatggagagagaggtatatatatatataatatatacatattatatatatacatattatatataatatgtatatatataatatatgttagggcctattcagtacattcaagtaattcagtacattcaaggaaactattgataatgctcatttatctcatatatatatatccactaatgcatattatatgagatatatatatgcactattgcatatatatcaaactattgataatgctcttttatctcatatatatgcacatattgtatatatatttgcgtgtgcacatatgtgtgtatacatatatgtgtgtatacatgtgtgtatataaacacacaaatatacacacagacactatgcatctatagagagagaggtgtatatatatacacacacacatatatgtatgtatatatacacatgtatacacacatatatgtatgtatatatacacatatataggcacacacactcaaatatatatacatgtatgtgcatatataagatgagtgaatgagcattatcaatagttttccttgaatgtactgaattcctacaaaatgatcagcagctgttctttttcagttgtattccaggttaatcacatatgttacctgtttccttgcaatgcttcaaggctgtgggtgtttcgttaagttcttcttcacttccaaccatccagatctgctccagttagtctgttcatagccctcactctactctcattatccttccagtcattacattttgggtccctatatcttatatttaattttgataaatgagtaaagagaggaagtggcctgttcagacattaaatcttggtgcatattattacaaaaaaaggatcactagatcaagaggaaggaacatgcatttgctagcataccatgtgttccaagatggcgtcaattgcaaaaaaaaaaaaaaaaaaaaaaactcaggaaaactcaacttcattctgagatcagttgaaatgggggctaatatcacaaacacactggctttacagttgcattatctgtattcagagctctctgagatgtgcaaccagggcaaataacacaattttctgcattacttctctttagctaagaaattttcttcaaacagaagggaaaagaaaaagacagactaaactcttttgtaaaggctatcaccaggtctgagagcagtagtggagtgagcagcgccaatccgagtgagaatagcaacagtcaggctgctgctgcttcttcctctcctatggccctgactataaaaataaaactcctcccatttttacagggccagcaaacactgaacagctcgcagctggccgggccaactgtgtgtcttctgttgccgccaaaacaatccccttggcatccgtgaacagtgcagaagcaggttcttcaccctctcagaccattcctgatggagatgaggagattctggcttttcaccttctggccaacactgctgctttttgttaacatctatcctggtggttagaacctagatctctgtctcttgtaccctctctgctttactcaaaaaaatctggaacaatggtgaagtgggaaagcccttaattctgtactctttaaaaactactgtggaaagtaaagggatgaaatcctaatcagaatttttttttctacaagagcgtgtggatttatttccgattaaaaaaggaacagcaccagaaagtattcatttgctgttatatcaaaacatttagatttgtttgccctactatatttaaattagtgtgttaagtaactgagaattgaaatgcagcaacatatagttccaaacatgcccaaggtgtatatcccagcctctgtttatcgattttgtgcattcattgactaacttacctcatggaggttgtagttacaaccccaaatctaggctggtaacttataaactggctatagatatggattatgggaacagataatttagagatattggataatggattcttagtcagtttcagctgctataacaaaaataccatagacttgtgtggcttaaaaaacagacattaacttctcacaattctggaggctggaagtccatgatgagggtaccagcagattcaatgtctagtgaggacccatttcctggtttgcagatgactgtcttctccttgtaccctcacatggtggggagagagaaagaaagagaaaaagaaaaagaaagagaaagagagaaaaagagaacaagctgtctcttgtctcttcttatcaggatactaatttcttcatgagaggtctaccctggtgacctaatcacctcctaaaggtcccatctttacataccatcacattgggaattaaggcttcaatatgtgcatttgtggggggcacaaacatttagtccgtagtatggatattagagattgttactcagccccctgtcccttctgaagagtagcgtgtgcttttggcatatccaagtaaatgcagtcattttttaaaatgcctatttaacacctactacatatctatgggtcaagctcagtgctagagatacatatgtgaataacagggacacggtatgctggaagtgtctgctaggggtagcaggaagttctaagcagaagacctaacacggtctaggatttgacttcccaacttagaccccagagtggggcagagaaaggaggtgcacgtgtccaatgagtacaagggagaaacagtccatgatatggggtgaattgggccggagctcccagtgggaaccttgtggccagtgtcagcaatttaggctgaatcctaagaacaatgccaagccctgagaggtttctaaacagaggagagagatgaacgcattggtcccctcttttccgctaggttcattttgcactgccagatctccacagtgactctcccttctctacgcttcctcatgagcttgctttcaggacttggtaagtgctgctgactttgtcaagagcacttggaagtcggatgaaccaggtttaaaaatcagctctgccacttaccagttgtgtgattttagacattgtgttaccgagatgttcttcctcatttgtacctcctagtgggttactaattaaatctctgtttcagcacttaaaaaatgttcttctctgttgtctttgtcatatgaatttcaattaaatgtcttaactcactggcctaaggcccttaagaatatgtatgtaccacgtctgacagataacgcaggacctagctctatggagttgtctcgtgtaaagataattcacccctgtctccctagcctagataatccctgtttatccttcttcccaggtgaacaaggatctcagacccaggaatcaataacaactactattagtttagcccggacatacactgcatgtgattataccaaatgtacatgtgtcctcaggcatataaccaagaactaattatctcgtgactgccaggcactgttacttaaggaaattacaacttcttaaggggtggctgagaggataagtgagaataggaaaataagtttataggacacccactgaaatacattaacacgcacttgccatatggtgactcattaaattaaacttgactgaaactatgggaagtggatggtggcaaatgcatttttttagaaaagaaagtgcagtctgagagaggtaaagcaacttgctgactgcgctctacctcaggtaagccagcgcacatacaggagaagggtaaaacagggcttgtctgactttcctgtctaagtaccttacctgaggattcccccaagaagtgaagcaacacaaaaactgatatgatttaactattattgactaaatgcatactatatgctaggcaccattctaagtgcattatatccacgtcccattgaatttcttatatggtagattgtactatcatccggattttgcaaatgagaaaactgagattcaagcaggttatgcaagtagcccaaagcctgtgaacaaatacgtggcagagctggagtcgcagatctcccttttgctcattcctttgttcttaagtattcctcttacgcaccagaatggaatcattatatatgctgtatgaaattaaaattgatatatttttcagggttgagatcagttaataaggactggaggaggttttgtggagggagagagcatgtggagggacatgggctgagagctggagagaattcagaaggtagagaggaatgaggagggcattccaagcaaggcgatgtcacagccagtgtgttggagaggaacatgacagattggagggaccacggacagaacagacaagcaagcatctaaatttcaattctgaaggaaatagccagtgattctgtcttattatagcatatacttctccgcttggcaatcataattctcctctagtttcctattaaaagaaagttgtaactgggagacaggcaaatgaaaatcatcctcattcatcaatgttggtttctatagaaactactggtgcggctccatacagaatcctggaatcaaggtcagctagaccatccctagggttagttctgctttgaatattccaggagtgattaaccaacctaaaactacccttaggccaaggctgaaatttgaggtcaggattgctaaagtagatttataaaaacttaacccttcatagcataatgacatgatttaaataattcacatcactcactgattttctgaagataggagaaaggatagtgaaattcattaaaaagatggaaacaaactgaaaattaggaaaagaattagaaagcaaacatgaagtggggcacacacagtaaatgatgcttaataaatatttaaaataatagtctccaatagcaagaggtctagagtgtggcccctggcatccaaccttgctgggttcagatgctgactaggctgccggagaagtgaatacagtaggtcaatgtcttagtcagctcaggctgctatgaaaaatactagaggctgggtggcttcagcagcagatatttatgtctcatagttctggaggatggatgtccaatatcaagatactggcagattctgtgtctggtgaggagggcctgcttctcggttcatagacagtcatcacctctctatacctttacatgaagatgaggcaagaaagccccccgggacttttttttttttttttttttttttgagacagagtcttgatctgtcacccaggctggagtacagtggtgtgatctcagctcactgcaacctcctcctcccaggttcacgctattctcctgcctcagcttcccaagtagctgagattacaggcgtatgccaccacaccccgctaatttttgtattttttagtagagacggagtttcactatatgttggccaggctagtctagaactcctgacctcagttgatccacccgcctcggcctccaaaagtgctgggattagaggtgtgagccactaagccgggccctggggctttttttcttttttttaataggacattaatcctatttctgagaaatctgcccgcatgacctaatcacatcccaaaggcttcatctccatatgccatcccagcggagattggctttcaacatatgaattttagggggcacaaacattcagttcataacaagtagatacatcagttatttaacctccaatgtcctcttctgaatagctagaatacaatcctccttagttacacgttctgttcttgtgggctttccttgtgaagtgggcccttttgagccagaaggagcctggttattctatgtctgagccagaatgagcctggttattctatgtctgctgagtttgtattcccctagagcagaccctaagacaggaattcaagtgcaaggggtttgattgggagataaacggaacagtagtaggtgccagagacaagaaaggaagaaagggcatggcaaaatgggtgctatgagctgatgggggtgaggagaggtggaatgagagccaattcactgggaaatgcgaagggccagtgtacaacacctcacaattacacctcccctcccccgaggtgcagaagttcacattgttcttgggtagagggatgcagccaaggagcaaaaattatcctgcactctgtcctgccacatgatggacaaagagacctccactggaaagagaaacttttccaatgaagaaaggtcagtgctgccttgagaagtccagtgtgctgaagtgccagaatggacaccattttctacccagctcagagcagatcaggcctccagtgtttgctccataaatacccatcaaataatgaccaatgggatgaatgcagcctcaagggatgaatgcagcctcaagcccaggggttcttctcctgggtttttcactataatcagatgaggaattttaaattgcctgatatctaggctccagtgcagaccagttaagtcagattatctgctgtggggtccaagcatcagaatttttaaaagctcaccaaatgattccactatgcagccaggactgaaaattcttgttcaactaacacatgaatcttttctacaaagtccttgacagatggccatgcaagcctctttttgaaactcttcatggggagggactctgctattctcagaagcaaaccattcccgtttttttttttttttttttttttgatggcactaattgttccaattttttttccttactgtgagccaaaacctgcttctgtaccttccatcagtcattcaagctctgcagtttggaaaaatgcaaaatgagtctattccattttgtacatgactgctctttagatattcaaagcctgcaataatgccctaacttgaccttcatttttatgctctaaacgttttcagttccttcagctactgctcttcaacctcctgtaatcattttcatttgccaataccacttttctcctgtggaattctcaactgaatccgtggtctgtgtctgcagttggaaatatacagggcagcaaatgttaaatgaatagcgtgtgtgtgtgtgtgcgcgcgtgtgtggtgtgtgtaaagtgtttaaagtgttatgagtgatcggctgacttaaagtaaacctgctttactaggaaaaaataggatttactaggaaaaaaataagatttcactctttctgttccatctcccaaaatttgttttcttaaacagcatttttctctcttggctaatttgtttgaacacctcagctcttgttttgcttttcagggaaatgtagatatatatttaacatgcataacttgtagaggagagggcgtagaaaaggtttatatttgaggttttttcacccatccgttttttaggagtgctgagccatggaattcatggcctgaaaaacaaaacaaaataaaaatcaataaatttgaaagaaagggagtactgcatctgtgatacttcagggaaagcaattcttaccttaatgaccaagtctattgcaaattctgggggcaagcagttgagcctcttctggacaagtgggatagagcaagcctttgctccactggagataatgtgcgtggccagccaccctcacctcgtataaaacagaagcccagttggccttgcaaagtgcatctaaaaaagggttcagggtgagggtagatttgtgccaattaatgtatcatgttgcagaaaacacagacaaatagagttgacaggtaatcttgatttcgtaaaagggttaaggctttgagaagctcatggtcgactctgaaagaatcttaaagagacagtttggaattccagcaagaccagtgtggagcagcaggagggagagtagagatgacctagggacaagaggaaagacttgaatcgcagggcagtcaatgttcctccagctccactgctgattatcacgctgatctgtggggagtaaaattccctttcaaagccttggcttatggatttgtgaaatgaagatgaatgatcatcatgatgtcaatgttcaaccacagaattgctgtaggaatagcatgagtgaattcctgtgccaggcctggatggcagaccctcaaaaatgtgaacattttgcctatttatttttgttttttttgatacagagtctctctctgttgcccaggctggattgcaatgctgtggtcttggctccctgcaacctccgctttccaggttcacgcgattctcctgtctcagcctcccaagtagctgggactacaaacatgcgccaccatacctggctaattttgtatttttagtagagacggggtttctccatgttggccaggctggtcacctcaccttaggtgatccacccacctcggcctcccaaagtgctgggattacaggcgtgagccaccgtgcccagcccattttgcctaatttttgagagttcacagagctggtagttcgggatcaaacttcagctccaccaatcaccaagtagcatgatctagtgaagtcactgattacctctgtgcctcagtttcctctgtaaaataaggaccataacattacctatcttgtagagttattattaagaccaaatcacctgatagttatggaaagcagatggagcagagcctgatacatagtttgttgcaaaaagagctagctagtaataaaggattctcccctaactgtgttccactagttctaaaacctttggggctctgtttattcaagtgtaaaatgaagaacgtggttaaagtctttgaggattcttaaccttattcttggtatcgcaggatttgcaggttgcaccgtgagtctggtcacatgtctgtctccctcacagccaccctcttcccctgggtagagagaccatgagtttttattttccagtgcctcgttggaaaacaaagactcagcatttgataaatgtttttgaagaaataaatggagtaattcatataaaaattcagtaacacctgttcttttggcattggtgtttggcttctctagtgctctatggagaagaagctgtgttaggctcttggagacaagaaactgaaaggcaaactttgacttttcggtttcctagttttcccaccttatgtttctttttcagtattccatctttatggttcctttactgaaatttcctcacttactttctatcttgtttttctgtagttaaaatttgaatataataattctttttagaagaaagaaggggtccatacaaaaagaaagaaaggaaattccacttctattaaatagtttggagtaagttatgtaacttctttgtgcttaatcattcataatctaaagggcatctataggaggtgcaattagtgaccattcaaaattcctttctgtcttccttcctgccaaaaccacaattttcttcaagaatttcccttcttccacccaactgtgtgctcatgaggagatcccaacctaaccttaacaccaaagtctaggacaatcatggaagtctaatatctctgccaagaactgcctctgacaagtttatatgacaaaattctagcaaagcgaaggatgttcttgccctaaaaggaggtgcttaagaataaacagctcattttattctattggacagccataactctgttcattttgcagctttgaaatgaagatgacatgctgcaaatggtcaagtggaaatatagagagaatgaagggtcttgttaacattggtgggtcactgaattaaacaatcctggagccactgaacctttccttgtttcctgagatgatgaattttcttttctggttaagccagtcaatttggccttttctattactgacaacccaaaaccctcccttggaaaacattatccatagcctagaatgattgaaggagttgatgagataatgtacaatgcctagtacaaccatccctctgtatccatgaaggattggttccaggaccacccacagataccaaaatctgtggatgctcaaattccttatataaaatggcatagtattttcatataacctacgcacatcttccccttttctttaaatcctatctgagtgacttatagtacctaatacttgcgtatgtcacttcagttgcttaaattcaacgtaatactaccatgtgtggccaattcacgttttgccttctggaaatttgtggattttttccccaaatattttcaatttgcaattggttgaatccacggatatagaacccatgaatgtggagggctgactctatttactttttgtgccagacaggttagcatgtccaacaaatgttgatacatttatgatagctttcttttcttgctatgagaggatattttatttgtttctgggttacctaatagttatgttcttgtcctcaaaatagattgttgcctttctaggcatcagattggtgcacttcctcttaccaagacatctcactagggtgaacatttggcatatctttccattaaacctcaagagcgcctggcaggtatgggacaggtgtgctaaaggtacaaggctggtggccagtggagtgcttcacaatagacagaaggaataataagatgccctcgacacccacaggaatcttacagttcaacttctagtctgtcttctttgattaagaatttcttaatggtcatttcaaaccctagggagagaggttatgtgaggtggctttgagagacatttatacttcaggggtttcaacatgcatagtcccttaacagaacaattgcctttattgttgacattgcatatatgacattgtgtgtctcttgggatataaaactcacttaatgtaaaaacatctaacatagttgttttggttgtttctttttattcagatttttttaaaaggtttaggtgatatctcagtttgtgagttgaagctttggaagtattcttgttcttaaaccggaatctgcaaactttttctgtaaagggctagatagtaaatatttctggctttgcaagccatatggtgtctgtcacaactgctcaactctgttgtaatatcaggaaagccatagacaatatgtaaatgaatgagagtgtggctgtgttccaataaaattttatttacaaaaataggtggcaggccagatttggcctgtgggtcatagcttgccagttcttgtttttaatcagtgaaaagatcaatttgaacactttgtcccagttgtcactaaccaactgtgtgaccatgttaagttatttaaccttactaggtcttagtttccttaatctggaaaacaaaagcactggacaaagtgacccctaggtttgcctctacagctaatatgtgaaattctgtgatttcagcatgactcttcaagggtatagctaaaaactaagtaaagatgaataagaaccttgtggtcttgttttgaatacactcaattctgaagtcactatggagtatcaacaaacagcatgtccagctgtattaaaaaatcaaaaattctatgaaattcataagaaaaattgttcatccaagttttaaaggactcgagggataaatgcatttgaagaaggagaataactaggagtactactacttattaagagtcttccaaagactaagcaatattcctgttttttacagatattgtttatccttacacatagcctatgacatagtgtattgtctgtgtacaccagaggaacagactctctcttattatacatgcaggagagaaattataagaaatcgattcacatgattatggaagtcccagtatctgcagtcactaagctggagactcaggagagcagatggtataattctagtctgagtctaaaggtatgagaaccaggaacaatgatagttaaagtttcagtcagatgtcaagtctgaaggtaggagaagaccaaggtcaggcaaagaaagagaatattatttcactcttttataagagtctgttctatttaggccttcagtggattgaataagacattcttgggctaatagagaataagactaatattcccatcatggaaataaagaaatacaaatctacagtggtggaaagaaatgggataacattaaggtgatcagatcaacagtcggagtccctccttctccccaacaataagctctttagtggtagaggcagaaattttaatcctcttctctccagtgttttctgtctttgccttttttttttttaaagttaagagcaatagaccatggcccataagcaataaactatacaaactgagcctgtaggtatacagaatagtggcataattaaataaaacttacaacagagttaatgtgacacacacctaatgatatacataatgcagttttgaagcacggtaattaggtataaaatggtaagctgttgacataaatggctgcaattagtattgcttctgcacaagcaaaccctgtgttaaattttacatttgtcacttggttggttctttgggatttataaataatcatcattgttgacagattttgtaactgaagagtgcaaaactatggaaattcatggccaaagagccatatttatttatttcattttatttgtttccttatattgtttgtttgtactatatcctgccagtttcacaaaggctttggggtcatctgcataaaccatctataatgcaattaaaaaatgcatatacaatgataaacaaaacagcaagatcagaggaaatatcaacgagaaaaggaagtatagataataaaggaggctaacagttaactttgcttcttgtagcaatggctagatgttgataacatctgtgaactgagtgcctaatacatcaatttatttcttattattttaacaaccccgaaaagtagatgtttcatttatattttatagatagggtgagatagatgaaagtatgttgactatgttcattcagccagcaaatgagtggagctgagacgaaaacttggtcttcatgactccaatgtcatagtgcactctactggatataaggagacttggagtgaggtgaggtgagggagatgatggggtttggatttggagaaaataaactttggcttcctagcacctaggaaacagagagaagagaagttggtagccttgcatggcccatgcaaacccaagcactaacaggaaccacatgacagctcctagaggctattagcagtcagcaagcacccagcatttatttaatgatttattgataggaggagatgtttcaaaatgtattaagtatgtgtttgtcaatacactgatatattacttactcatttgagtgtggacccactccttgctgtaaagagtcatctgtattttaaagaaaatgattttgaaagatgataatctctgtgctcattgcaaatgcagatcaaaaaaaagaaaaggacaaaaacaaatgatctctgccctagattaagagaggctaatggtttaatgttctaccacagaccctgaaaattaaaatatgagcatcattaaacagatcttgatgattaaaatttagaaagcttttcagaattcatctgtgaattcaatagaagattatggatgattggaaaatattttataggttcaatgatatttgagacatatttaatcatatcaagacttcaagagttgagaaaacaaagcaaacacaggaaaataataaaaggaaaaaagggtagcagatgcacaccatatgtgtggacatgattgtggcaaagctcattcaacttgaatcctgtgccactcactacctgaaagccttgggcaagctatttactcatctcttatgcatatttctctctgtaaaaatgccacaaggtaaagaataaataatgtagtgcgctttaagttcatgctgccaagcctggcacataataagtactcaataaatgttgggttttttttgttagtaattattgaatgaagtataggacactggagttagaccattattgcatatttaatttatgacagagattgtattgattatttataggtattacttcatttaaacttggtaaaaaaattatgaggcagatcttattatctttacagacagtaaatcaagacaaaaagaggttcagttactcatgtgatgccacaccaagtaaaggtggcagagctggactttacacccacacaaagtccaatgtagctggcttgccacctggttagttttttctcaagtcatccacagtatgcagataaaacccttatcattgatttgggaaagatgacttgggggttaaaataaaggaaacatgattccttctctttatttctgtcctacccccacatgtagtgtgaaatgaagagtgaaaagtagaaatcaagataagggtaagattaaaattttttaaactaggattttatctaaaattaagagaaaaacactaatttttgtctttttgaaaagtaagcttggaattatttagtttctatatgcctatgtgaatcaataactataataatcataataatggcaagcacatcatagaatgtatttcaaggcatgttttttatgcatgccaccatgatttctgctcctctctgcacctcctcatatccctaaacatcattaaccaagtagaaattccaaagacagacagagtcctttgaaagaaattttctctaaagtaaaagtcatcccttgaagttgacaaaaaaggggacctcaagtttctagtgacagtgtacttccaaaatattatgtaactggtacattcttgaaccctttctcctacgaccattaaagacttagaatcatggattcttaaatttgggaaccaactacagggcatatttaatctcatccatcctttcatttcgcaatggtggaaactgaagcctagaaatgagatcatgaggaactggaagtatcagatcaaagcaaatatatcccacccatcagtgtttgatatttgggccacaccacactgaccctccaccccaccaacattgcaatgaggaaggtgacatgctgcctccagccctggagaatagggctatagaaatacctaattcatttatatcaaattgtcatcataggagacccttagaaggaaagcctgtatctacctactgacagagagttttcatttactgcaaatgtcaagatgggattagcatgctttgaggagtcaggcatgggggtgtgaatctgatctacatgaagatgcttcaggacagaaatgctagctctcagggctcctcattttacatgaaattgaacaacaaaaaatgctaactaccttcctcccctaaaggtcaatacaagcaacactggctttgcttgaagtttccattttgaaagcaatgtggtttcctcccttaaatctgcactacaaaaaagttactaccttttgtgacagcccttaagattatatgcctcccccattctcaccttaataactctcctctttcatttcatttctttcaagttaaggaaaggagaaataaaataacatttactcttcttccatgaagaacaaatcttctctttcttttaacttcaattattgcttctgcatgcctctaagaaaaaaaaaagaattaaaacctctcttaacaacattcacaacttgatcattttcattctttgttccaaggtctatgactctgttcttcacttcacttacttagctggagtctatccaaaacattcattttcttacatctgtgtttatccctagtatttgttcttagtggatttcaaaacatgactgttctccttgtgtttctggctctgaaaacactaaaatgcatgccaaatgttagagaatgtacatgcacttttgaagtctttcagccattcattcaaagaggtgtgttcagtgcagacttagacactgttctaagcaacgctgccatgaacacgcaatactcctgccttcatggaacttacagtaagggatgcaggcagtaagaataataaatctgaataatttacagcaagtacatggagcggtgcagtgactggctatctcctcaaggcatgtgccattgattaagacacaacccccaaaactccccattgctttcacacccagcctgctcattcatagatagattataatataatttcagatagctgtaagtgacaaagagagaaataaacccagctaagtgcagagactctgttttatatgtatatatacttttctttcctcctgaaataatatctctttgaggaagtgacatttgaacagacacctaaataaggtgaaaaagtaaggttttggagaagaaaattctaagtggaggggaagtccatgacactaaaacacctttgatttattggacaatctgctagaacactaaagtgattggaaatacggaagagaaaggcagaaagggagaagagagaggccaaggacagattacacagggccacgtaaatcacataaggaaatgtggatttcattctaagcataatcataagacactggaggcttttgggtaggggtttaaatgaggccgtttcaatattcacctcacctaggtaactctgtagagggtagatctcagctggggaaggaaaaatcaggttttgtcttaagctactggatgggtggctggcaggactgggtagcatgtttgtgcagggaaatggggaacctgcagactttatgacacattgtggtggagcaggtagaacacaagccctggagccagccagagaagggcttgatcctcaggttgtaatctatctgggctgacttaatgtctgtgtacatgtggataaagagcttgatctcaactgtgaagtgtggacactgttgcctaccctgcagtggtgttaggagttatcaggtgatgatataaacagagtttctaacagggcagctaatgtgttcatagtcaaagccacagtcttttgagtcagaccaggatttgaatcccagcttaattagtcactttgcttggtagaggagtttgtgcagtaggtaaatctcagaggtcctttctcctcttctgcagaatttgtagaatgatatccatttcacacgattgttttgagaattaaaaccatgtgtggaagcacctaagacacaatggatgcaatttagtagctgccgcaaggttttgaactggttcccttaacctctctttgccacggtttctccttctgtgaaatggaaacgtctgatatgtttgtgaagatcaaataagaaaacatatgtgtagtgtttaccagaatgcctggcacgcactttatgttaaaaacaatgtagggtgatgtcatgaacatcaccagcaggacctttctctcacctcccctgctccaagcacatgaaacacatttcacatcaaagaccaagtttctgaatggcttgaggtgctcaggctgaagaatgcctgcaatcctctatctctgcttttaagtcaccaaacatggaggggtagcatattctagggtaaaagacattagacagaatctggagggatctgtccctgcctctacgattaaaaatcagaaattttccacataaaacccccagattgctgacttggctttggtagaaatctgaatgttttacaacaagtacatggagcggcgcagtgaccggctctctccacaaggcatgtgccattcatttagacacaacccccaaaactcctcattgctttcacacccagcccgctcattcatccttgttgcttaatgagtatgcagaggattgtgagtgtgaaatcgtggctgactctaagacagaatatcatctagacctggagactctccagacttccagatcccagaattcatgttttctggtagaaacatgaatactaataatgcagacaaaattcttgaaacagccaaatgttgggtctgtgatttgcctgctctggttcattagccatcgttcctatggcttcacatctgggagtctgtaaacaggccatgggctgaatgacacggactgttgttttgtttaaaacgaatggctgtaatcctgattaaagcatcatgtgggagattttataataataattatctgtagttcccattagagccagcaggaatctgaatcacatttaataatctaaagcttggaagtagtgacacttaagtacattgagatttaagtatagggattccaagaatgaggaagtgggtattgctgctctctagccttgattaagtctctaactgtcagatcagcttagactagttgatactaaaaccttctctggtagatcattcagctacttattgtcaattttctgttataccttgttctcttattgacttccacttttacttattcttaatggtggtggcagctctattattgtgccaataattcaagctaattaacagaaaccaccaaaagaaagatctctactatttccagttccttaggtttccttccatgcagtgatggccaccagagggaacaaatcagacaattaggctttatgattagaacatttatatgaacaaagactaacatgtcattggcagagattaggagtctgcagaatccaagaagtccccaagctacagactcaatcctttctctttgtcctttgataaaacttcctcaaatccatctccaagccttcccccaagatggagcccacaggattatatctaaggcctctgcccacagagtgaatgccaatgcaccccttccctttttttcttctttaatgaccttaactcttgtatatatgaatataaaacactcttcattcttctcatttttgtatatattttttgtcctgtcgtcttctctaacttctccaacttaacaaattctcttctgtaaactatgtctcagatatctctctctttcaaacaaaagactaataatccatactcagggacactttaactgttggtatttcttcccacctgaagactttacttttaagtgatgttctcatgtttgggaaaaccacacataattcattaaaacatgttgcttctgctcctcaacacaagttttaggggtgatctctatttaatgtattttcacatgtgactgtagccttaaaaccataagagattaataataaagtttcttttacactccagggtcagtttttacttggcaatattaactccacttatcaccaggagttgtcaagtaaaacaaaacaattttgtaaaagggttctcacttttctcaacactgcataaaaattcttgaaaaaaacacttttctcactgtgttttttgttttttaaagcaaaaaagcaaggtagcaggtttaatggggaaaaactgatttcactaccgtgtactctccctagtattctgaaaataattgtggggcaatggagaacagattgtctcttcacatctcttgttaggcagggaacctgtctagacagcaatcttaaggacagctgagctgcttcctgcagggtcatagctactctgcagtgtgagagggccagcccagtatgctttcaagagcccaggaaaggtcacatatacaaagaactaccttccccttcctgtgctgattcttcatgcctgaaatctgttgaagaaagacaagtaggatcccaagtggtgcaaggctgaggcaggaagccaaaccaaaataaagaaagggagggagtaccagaggagacagaaggaaatgtagggaggaagagaagaaagagagccaggaaggaggcacgtttttattccaatgcttttcagatttttctggatgtatgacccaggataagtcagttccttactataaaagaggaagaagggcacaagcctcatgaaactgttgtgaggattaaacaaggtcttgctataggaaacacatcaatgtattagttaacgtgataaatggtttccttcccctctcatgattacatttttcaactgtaaattattaattctatcagggaacagaaaactggcgctctgtgtttataagtccacactatagcatagatgggtatctctgatcatttcctaacaaattatcttaggaaggtgagcaagcaaggtaaagagtctgcccggacgttggactgttagagagcagaaggtaaagctttatcgtgctaatgcatatttttcaactttcagtattttcttagcatgggttttattagtttggcagtgatagtggcaagcataagctcaatgtcccttcacccaaatgactccatttgtcggacaaaaagttcttcatcttgtaaacattcagatggatgttaagaaagagttggagcaaacctgctccgatgtggttggaggaagaaaaaggtacgttacaaaatatccccttaatactttcaaatatctgcaagaatctcatttggggattagacctggcctcaacagaaagaagaacaaaacaggaaagcaaatggaattgtttagcaccatttatattttaagacattaacatatgtcatccgtgatctcagatcttctgtataaaaatatagagtaaaaaaaataaaattaccaatggctattaatgttattacatcattactatttattgaaatttttttctcaccaaaacaaagctaagcatttatatattaatacatactgtcaattgaggatttgacctatctgcgtggaactttggagttgatgtaaactttaaaaaaattcactccatctgaccatccctacctctgacatagcacacctgacagccatcatactccttagatggaatccaaagattctacctcttccttgaatcacgatgcccacttagaatcagtaggctagctatttctattcggagcactgcctccatgttttgtttcttgatgctgcttcttttttttttgttcaattcacaaacctgtcttctttcccactggactggatcttatccttcacagccctcatgcatacttagagaatagcatggggcaaaactgaagagaaccagagggctgctttttcttttcatatctcttgtggtggcattggggttcttattggcctgggttagggactggctcggggatgttggacatgaaggctttgatgatgctctgcgcagctatccactcactcaaaggacaaatggacaaaagcagaatctgattcatccattaaaaaaattgattttgaggatgatgaagaaacacaataaagaaaaaaggaaaaacggttccttctgaaagaaaactttagtatgggcaaagttcctgtaaaggctcttgagttatgaatagaaaccgcaaagacttgacatttattgtgaactttcaaggaatgctggacaaaatgtgattcatttttagaaaagtaataaatcgtaatgcaatggtgcacttccagcaaaacccactggaaaactccatttctaagattgaagaaccctatcctgttggatttataatgcttcaaaaatgaaaatatgatgcccaattattaattattattgtttgtttgtttaaggtacagaacaaagtgagggcatatttaaggctcttagactcagacttagcatgtgacttccctaacatgaagggagcagtgtgaaggcagtagcccctggttctaagagccagcatcatctgcatagagcaaaggtccaacaattgatcttatccttcagagccttactcttccacatgcataatgcgagggtagccttccaccaccccacatagatgtgtcttgtccttctcttcatgtgggaaaagaaaatgggtaaagaccaggagtagcctcagtatagactgcacctacagctaaaaccaaacagactcaactgtatatttagggaaatgggctatatattcatctccaggagagagaagaggcagcatgacttagaaaagcagggtaatcatctacaacaggaccactaaaggatgacacaggatctgaggacaagaactgaaagaataaagagaggcaggcagcatatggtgatagttatgaagaaatccactttcagacattatgtcttaaatatatatatatatgtttttgtttttgtttttcctgaaagggcattgggttgacttctgcttcagtcactgacataacctttgcttttctttctgagagttaccttgggagcagcccaatatggatttgacttgttcatttggcatgatttagtacctgagttagcttttcagaaatcttgccagtattagcattgtgtgcagatgcttctcagatgagtggcgtcttgggacatcagcagagatggtgctattaaatcacacagccagtgtcctctgccattctatgaaaggcaggcaagagtgccgcagcttcccgatgcctccagataaactacagggccttttaaggagtgccctgggtaagctaccacggtggtgaggtgcatttgggtaagtgtgatagagacagccaaggtggcggccatgggccacggtgagctgtgtcagcctttcccattgcatatggctgcctggctgcctctatggtgaaaggtaactgtgggtagtagaaaaatgattggtgaaaagagaacaggaataggaaaagggcagaaaatgcccaccgagacaggtaattggggaagaacaaatagacagagggagtggaaagaccgtgttcacagaccccatggcacatcccttctagctgtgtgaccttgcaccagttaccctggcttccatatctcttacgtaggaaacccaacaggctcttgtggctgtgttctgatccattagccatttgagaagcccctaacttcctttcccatcttctctaccctgccatgtaggttgattttattttttattcatttctaagttgctgagaactatagtaacaaccccatatggctgtcactcagatagaaagaaggttattgctttttcaaaacaggatagagttacagcagcgatataaaatgttggctttcatcgagtaatttcagatgtcctgttggctctcctgtcctctgcaaatgctctttctctgttcactggccggaagctgcttcgtgtccttcagcaaggtcagagaaaggagctgaagtatattttctgctagatattgaacacacaaattatggtaccccatttggccagccacaaaatgcccttgcctcgtttttgatcactggggtgccagcacaacagtatcaccacaaaccctcagcacgttgctaatttgagctgttctcttgatatgatggcagctcctggatgggcaccaagagtcataagaaggcagaggaatggtcagattggctatgtgagcagccatcaccagagtccttggggtcatcctgcgagctgaagtccttggcggccacattttgcaaattatttctgtctttaactcagactcttggctttctcctatctctggtgttgggaattgactatttcctcagagtcaaggtctatctactagagcaaagggcaaggtgtcctagccattctgggcattcagtaaaggccaagcttttttttgtacacagagtaaatacagacacacagctctctgaggaaaatggtccagaaaggatttctgtcagccaaatttggttatgttttaggttctttatcagcaaataggaatactatgactcccttcctcacttagatgtaagccagtctctttcggccagcttattagctcagaggctatcttcatttgtccttgtgtactcaaaggctggccataggacctactcatgaatgacaccaaaatgctgaatgatttaggaattaaggctttaacatttctatttacttttctctgtcagtatttaatgaaatgcagttttcatttcttttagactttcatagtttccatatccctcatgcctatatttaaaataaattatgtagagaaaggctgcatttttccttttgaaatagcagtgaaatttgtaggaattcttgagagtaccaagaaatatatccacatgaagatggatgtgataattaacttggtataagtcattgttaaataactactaaaatattttttatttttttaaataactactaaaatatatttgtctgattataaaagtgagacgtgctcagtttagaaatttctaaattccaaaaacttagaaaatatgaaacacttgtaattaaatcagtgagtaatattgacttttaatatttttgatatcatggtccttttctctttttctttctttcttttgagacatggcctcactctatcacccaggctagaatgcattggccgagtctgggctcactgccacctctgaccccggggatcaagggatccttctgcctcagccttcccagtagctgggtctgcaggcatgcaccatcatgcccagcatttttttagtatttttagtacagacaggatctcgccatgttgctcaagctgatctcgaacttctgagctctagcaatctgtccttcttgacctcccaaagtgccgggattacaggtgtgagccatggcacccggcagtatcatggtctttactttggtatgtttgtaaatgcttgctctctctctggctctctctctctctctgtgtgtgtgtgtgtgtgtgtgtacatgtgtatgtgtgtgtgcataaattgtttgcacagtaatatatacagggcacctcacttttttgcactctgctttatttcactttgaagatattatactttttaaaaattgaatgtttttggaaaccctgaaatgagcaatctattggcaccacctttccaatagcatgtgcttatttcttgttttcattacatattggtaattctcacacatttttcacacagttattattataactgttatggtgacctgtgaccagtgatctttaatgttagttatccttttccttgtttcagggcaccaaaagtgcacctctataagacagcaaacataagtgataagtgttgtgtgttatgactactccactgatgggccattcccctatctcactccctctccttgggcctccttattgcctgacacacaacaataaatattgaaaatagaacaactaataaccatgcaatagcctctcagtactcaagtgaaaggaagatttgcacctctctcactttaagtcaaagctagaaatgttcaagcttagcaagggagacaagacaaaagccaagacaagctgaggcctaggcctcttgtaccagttagctaagttctgagtgtgaagaaaaagttcctgaaggaaattaaaagtgctacctcagtgagcccacaaatgataagaatgcaaaacagcctcgaaaatgttagtagtctggacagatgatcaaaccaaccacagcattttcttaagcagtagccccatctagagaaaagccttaactcctttccattctgtaatggctgaaagaggagagaaagcttcagaagaaatatctgaaactagcacagctctgcttatgaggtttaaggaaagaaactgtctccataacatacaagtgcaaagtaaagcagtaagtgctaatgtagaatttgcagggaattatccagaagatctagatgacatcactgatgaaggtggctacactaaacagattttcaatgtagacaaaacagcctttcttttggaagagaatgtgatctaggactttcatagctagagaggagaagtcaatgcctattttcaaagcttcacagaacaggctctttctaggggttcatgcctctggtgtcttaacattgaaaccaatgctcatttaccattctgaaaattctagggcccttaagaagtatgctgatataatctacttgtgcctcataaatggaacaacaaaacctgaatggcagcacatctatctatagcatgatttcctgaatatgttgagcccactgttgagatttactgctcaggaaaaaaaaaaaaaaagattcatttcaaaatattactgctcattgacaatgcacctggttacccaagatctctgataaaaatgttcaaggaagttagtgtgttttcatgtctgctaacacaacatccattctgcagcccatggatcaagtagtaattttgactttcaagtcttattatttaaaaaatacgtgttgtaaggctatagctgccagttagtggttcttctgatggatctgggtagagtaaattgaaaactttctggagaggattcactattctagatgccactaataacatctgtgattcaaaaaggaggtaaaaatatcaacattaacaggagtttagaagaagttgattccaaccctgatggatgaatttgagagattcagcagagaaagtaactatagatgtggtggaaagagctagagaaatagaactaaaagtggaacctgaagatgtgactgaattgctgcaatttcatgatagactctaaagtgtgagacgttgctacttatggatgagcaaaaaaagtgattgcttgagatggcatccactcctggtgaagaggctgtgaacattgttgaaatgacagcaaagaatttagaatatgaatttgagaggatttactcaaattttgaaaaacgttctactttggataaaaggctatcaaagagcatcacatgctacagaaatatctttcatgaaaggaagagtcaatccatgtggcaaacttcattgttgtcctattttaagaaattgccacagccatcctaatcttcaacaaccaacaccctgatcagtcagcagccaacaacactgaggcaagaccctccaccagcaaaaacgttatgacttgctgaaggctcaggtgatcattagcattttttaacaataaaatatgtttaattaaagtaagtacattttttttagacataatgttatgcacacttaataaactatagtgcaaacaacttttatatgcactaggaaaccaaaaaatgtgtatgattatctttattgcaatatttgctttacttaaatggtctggaacaagacttgcaatatttctaagttatgtctgtatgggcatgtatacatcacacaagtgggatctacacatacatatgtatgtatagaagcttacatatatataatttagcaccctacttttgttcaacattaatttacattatgatctttcccttgtcattaaatgctccacaaaagtttgattgaattaattaatttatttttaatggcttttatactcttttattccttataatttttttgccaaataatatccgtatattctcctgtgatcttttttataatttcaacttttattttagattcatggggtacacgtacaagtttgttacatgggtatattgcacgatacttaggtttggggtacatatggttccatcacccgggtagtgagcatagtacccaataggtagtttttcagcccttgcccccacccaagtagtccccattctctattgttctcatctttatggacaccacacccaatgtttagcccccacttataagtgagaatacgcagtatttggttttctgttcccatgttaatttgcttaagatgatggcttccagctacatccatgttgctgcagaggacatggctttattcatttttatggctgcaaaatattccattgtgtatatgtaccacatttgtaacacattttctttatgcagtccacaactgatgggcacctaggttgatttcatgtctttgctattgtgaacagtgctacaatgaatatactagtgcctgtgtctttttggcagagcaatttgttctcatttgggtctatatgtggtaataggattactgggtcatgtgtgaattttcactcttataaattaaaatgtggaaacgaacacactagtttggtagtccttgtggctgaaaatactgagtccacaggagagctccaaagtttgctatgttctttgcttccccatttccaggatctttctcctcctttctaatgtcttccttgttctccatgtccctggtctaaagaagtgatggcacatgctgtgcgtgctccctagacttcagttcccttaaaacatggcaaatgaccattaagtaagaggagacaataccactatttcacatctcattctgggggaacatgaattaatttctatggatgaaataaagagaaggaaagccatttactgaacttgatgatgaaagattgtcaaagtaggaaactcagagctctgaagcagtcctccttctaagggtcttgtcacctttacatcaggaagcactcaattggatagtataggggccaagggaaaatttccccattgcctctgaaaggtagctgaaaatcactgtcagaaggcagattaataggaagaaaggcatacaaatttacttgattatagttttacatgacacaggagccttcagagtgaagagctgaaaatacaagagaaactccacttttgtgcttaggttcagtgaagtttggacagttctccaaactttgattggacaaatagagtatgatctaatgtttacagactgagagggaaaaacagacaagcattgtctgtctagcttcttctctgactctgagcagcattccttctttctgggcatggggcagaactttctctggaagggggatcttatgacctaaaatcagacaaagtagatcagataatgtctttgttattgctggttttttttttttttttttttacatggcgtttctctcttgttgcccagggcggagtgcaatggcatgatcttggcccactgcaacttctgcctcctgggttcaagcaattatcttgcctcagcctcccaaacagctggaacgacaggccatgcatcaccatgcctggctaatttttttttatttctagtagagatgaggtttcaccattttggccaggctactctcaaactcctgacctcaggtgatccgctcgccttggcctcccagattgatgggactataggtgtgaatcaccacaactggctcagataatgtctttatggccagtttttacacagaaaggcgggaggaaagttagagtaatatttttaggttttatggttggctttgggaaaaaggggttttagcttctgtggctagccccaggggagaatgaggggccagagacaggagggtcggagaaggtcagagaaaatcttttgtttctgagaccttcattttgggatatcatttttctgagctccaacaacgggcagacagctatttatttacttccaaaacaacttctgggttctctatcagaaagtgtgatgagaaaacagaagctattaggtagaacaggtctggactcaaatcctgactcttgtatctgaaacgttatatatctagatatgccatttcttccctttccatgtgtcctaatctgtcctaatctaaaaagtggcaaaaatcccctatttatgttggtggcttggagaaacagatacatgaatgtatgagcaatgctgggcatgttttagatatttttaatcaatgctcattctgtgtgtgcgcacgcacacaaagcacacacaaacacacttctcgcagaacctcatagcaaggagatatttggggtaaatgctgtaatgtacctacagagatagttttaacagctcttcctgctttctatatcaggtttttgtttgtttggttggttattttttgtttgttttgtttatggtttacttttttttttttttgaaacagagtttcgctctgttgcctaggctggagtgcagtggcatggtctcgtctcactgcaacctctgcctcctgggttcaagcaattctcctgcctcagtctctcaagtagctgggattacaggcacccacaaccacgcctagctaatttttgtatttttagtagagacagagttttactatgttggccaggctggtctcgaactcctgaccttacgtgatccacccgcctcggcctcccaaagtgctgggattacagacctgagccaccatgcccagccaatggtttacttttttattgtttgtgttcttcagcatcccttcttgtcaactcctgggttattgcacatactaagcaactatcttttctcagtgatgtatttctttcagttgaactcactgtacgtgtagaaattaacaccctcatttacccaggcatccgctaggctataaaatcaattcctttattattccttgctgtctaattcctctatcttttgaatagaagtgttgctttccactagaccttatccaagttcttaatattatcattcagtttctaggactacaagctaggctgagcactctaattatagtctaaccaacctgatcaaaatttgggaattaattggtagttcctacatgctgagatctcccatagtaatttcaatgtttttgtttaatgttttatttaatgctttgtttaatgctttagtctgcttttggaaaccactatttagcttgtgttccattaagactaccgagtcaactttgatctcagttcctcagaggtagtgctcattctccaccttggaactgaagtgtttttgttgtgatggtgatggtggcagttgaatttttggttttggactttttttaaagaacttctaagttcaccttttaagattttcacatttatcctgcttgaactctagatagtgtgctcattatcacagacttcatatagcctgtaaatagatagcaacagcaatagtttgaatatgaatacaatacttgtgaaaagctctctgatttttatttgttatttatttatttatttatttatttatttatttatttatttatttattttgtgtgtgtgtgagagacagagtcttgctctgtcacccaggctggagtgcattgcatttttagagctctttcaagaaaggctgtattgatattagtgtttcacccactcactcccattccataccccacccagcccgtgaccctggctttgcattctcatgtacctgcactcattctctaacttcagctgcttattattattattttttttaattttgatatggagtcttgctctgtggcccaggctggagtacagcagtagcgtgatctcagctccctgcaacttctgcctcccaggttcaagcaattctcctgccttagcctcctgagtagctgggattacaggcatgtgccaccatgcccggctaatttttgtattttttgtagagacgaggttttgccatgttggccaggctggtctcgaactcctgaccttaggtgatctgcccgccttgacctcttaaagtgctgggattacaggcgtgaagcatcatgcccggcctaacttcagttattggtactgaacacatcaattttgcttaggaaaaggtatgaaggctttctttgattttattctccttccttttttaaaaaatcacaaaacaacaaagttagagctttttcttagagtgattacattattgtatgatgctgcattctaccaaaccagagcaatcatcattcaagatgaaaatgcttcctttaattatatgaaatgtcagtctgcaagttgcacggcatggaaggggttgggttattccaaatcaccaaaagacaaatgtatttacaacttctattaaaatcctaaccctgtagctttaacaaaattaacaggatttcgatgcattcctggtaagtttgacttataaatttcaattcttggcccccatgccaaagcttgatgctgctcatctgcttctttctgctccccgaagatagagctatttcaggagacacgttttgtatttccatcaaaaccagggagagcttcattaaaaaataaacccatgattcttttccattttttttttctacctaggtaatttgggtaattccacagtgaatgaaagagatgaaaagatgtgatttaagacacattaaggatgtaaatatatacaaaaatttggcttcttgtctcttctccaacaattaatttcatgaaagtgttttctggtggcttacaaacaatgcatgaacatgcacaatggtctttgacaggatgtcaaagagcctgcatggctgagatgacttccatcacagaaaatcaatttcctgtaaatagtgaagaagcaaagattttaggccaacatcagatatgattctcgagaatctatttcctgcttgttttctggaagcgcttggtggaaatttgaaatagatattttgccccatcaattaatttcttattttttcatcatcatcagaaatatcaaagttaatattttatcaatattttagaccccattttgttccaacagtacattcaatacagttaaaaaataaatattgagtgtttcctgtttgcaatctgaatatacatataaatgctagtgagaaatgaagaaaataaagattcagtaaccaaagcctaaatctacataaattgaaaataaaatgataagtttagaaatatttagataaggttaaaattgcatataaattcaagatgagttttattatgactcattataactaattccaacagttgatagaaatcatttaaagaattgtaatactgtttggtaatatgttatgtggaaacatagttaggaaatctttccacttcctcagtctggatttcaggaaatgaaagcccccccaatctccccccaaataattcaagctctgctgtgtaagttataggaaataccctcccctgccagctcatttcctcttattgttcaccttgaatggggccctcagctaccttttcatgcctccctctccctacagatgtatcaagcctggtaaaagccaagggcttccacaggaaaagagctaggtcagagatacccaaggccaccatgaagtccccttctgtaagagaatgtgaaggggagtttgagaaaagccagaatttaaaaaaaaaaaattctagccagtcaactcatttagaccaatacattaacaagaaaaggaaccaagtttcttctgtgttcacattttcgatgtaattttgtatttaattccatctaaatattaattttatagttatattgcatattttataaaatgttagatatttatttgaataactatagtaattaggatagtactttgccttgaagactcaataaataattgtagaattaattaaagtatgtaagaatttttgtgttcgtaagagtgattttatgtttctgcatcaaaattatattgagtaggagtttcttttttgtatataatcaagctgtagcaacatagtatattaagcatcataaagatattctaggaatataaattacctatgtgcaaataaccctatattcaggttttccttttttttttacatttttaaaattatttctttctttctagctagctgcctatctcctggtatatttttattctatatctaatgaaactagttgatctagctaacaggttaagtggataaagtgtcccattgaattacatgaaaattgttctgcactaactgagaaaggcttacttccagccctggctctgatcttcactgtatgtatgtacttgagcaagtcatttcgttttatgtgtgctatttcttccttaactaacaaatagaaatcatgtatctcctgcctgcatcactggctaaggtgaagatcaactaagattataaatgcgctctgagatgtagaaaatgctatatatttataagatggtatcatttgtacaatgatgatgatggtattaattatgtgacagactaatctttaatatacacagcaggattttctcttttaccctttcaatcctgatttaattgatagctatttctggatctaagatatgttgagattcaaagctggcactgggacagagggaatgtcatgattccaaaatgtattagacataaagtcatccaaacagctataatatgtagagttttgttttgactcatacaagtttaattatctgtaatttaagaaaagtggctttaatactaactacttacaaatataatttcttctcacaataatcagaattgggagcgcacttttagccattacattaatctagttttcctttgtgacagaaaactatatatgtgtccgttccttatttatccttcatatgaatattgtttatcagcactggaaatctcaccctcacatcctcttcaaatgaaatatgaaaaaatgattagtctacacacaggcactcctccttaaatataatgctaggtgaatttacaaacagttatctcaatgaattatcaaaatatttctaacaagggattgattgtcccaattttacggatgacaaaactgagactcaggaagcggaagtaacttgccaaagctcacacagtatgtctagaatactaaaaccttgtatcgatcaagacgagcatgttgacctatgcacaaggaagctttgaaatctagttcatcattgacaaatccggtgaaaattaatcttttagtctcatccttcctcttcctaatcttcttatgagactgtatgtttctatttaagtatttttcagctacttaactgtgtccactaaaattctccaatgtttttacaagttccaagcatttgtcatataacatttcactcatatttttgcatttaggtcgttctttgtctccaaggtattaggttttcttgccattcatcttctgcctgtgtctttagtacccatgaagctaccttggctctgctgtttctctccttttaatcagaagatttgttccattttgttccataccagccaagttatttcactattacatttctgaatctttcatgcttacagtttgccttccttaccaaggagcctctgcttatgacagcatttttcttcttcattctcacaagtagcaagtaaatagcaaataaatccttcaacatggaagaccctccaccttttgcttatttatttttgtaatttgtaccaaccctttatatttggtgaagatatcacttttatcaggaagactactaggtacattggtatgatttagattcttctctatggacattaattgctatattcctaccacttggctatagtgactggcatttaataaacattccattagtggtagaatacgggagcaatttaatggatgaatgaaatgtgtgtctaaaaatgaggttgcttaaaaaattctgtttctctgattcatgttatagtgttagctccagaagggaatgttctctactaattattttatggtaatcttaaaaacctttaatggttttccatcttaactatttttgataaatagtaaaaatgtctagtttcttttgaaatacattcaagtcttgtgaaaagttgagaatgagatgtatattcaatgtgtcacaatccagtggaattgaacttatgttattgtgcttgtattatattgcacaaggttgaatagcttcctttcaaaaactgtcagacctggcattaatcaatccaatcgaacagtaaactacagtctgtcctttcttatttggcaaacagataaagcacagttaatatatttcattgcaaccctcaggtgttctgtttctaatgtttactttagaaaaggttataatgaagttgacttactttattcatacattcattcaaaacccatttttcagtgtaatgtgccaggaatctctcaaaggctgggagtagagagaagaaagataacgtccacccactcaaggttttcacaatcaagatggggaggaagataagtaggtaattacattcagttggtgcaaaaataatcgcgatttttgccacaaaagtaatagcgaaaaccgcgattacttttgcacgaacctaatagattatgtgattaagtctcagcagataaatgcccagaattttatgacaaaaagtagaagggaaaaccactcaggccaagacatttagaggattccagagggagttctacatttgctaagttgcaactagttgctggtagagtattggggagttcgagggaggtcgaggagtttttgagtgggagagaacagcatgtgccaagacatatacacaagatgggcagaggaagtgtctacaagactgaaagcttattggctgaattatattataggaacattggattcgtatatctgaaagaatggaaggagacaaagctggaaatacaagtgagaattacttcaaaagggaccatatatgcccctccccagctttggggtgggcggagctttgcatggagaagcaatgtgattatattagcatggtgaagcagcacgctggtgtatggttgtcagataaaatatagttacatttcagataaagaatgaatcttttctttcagtatcaacatgtcgcaaatcttgcatgggacatatttacacaaaaaagttattcattgtcaaattgaaattaatctttcactgaacatcctgtatttctctgtgttaaatctgacaaccttactctgatagcagtgtggagaatgaattggagaagaaaggacaaggcagaaaggccgattcaagggacaacctattaaaatctgcattcaccctttgagtcacaatggcattgctatttattacattgtgctaaagtgcaggatgtggacaactttgttaccatggctgagacccagagaggcacagcctgaagagaaagacaatggatattctggaacaaataggagattttagtgctccaggttttacaggagcactggacctaagatggaaccatactttaaactgggaagaagatggcatgtgtgcacatttcctctgaagactgtggggtaaaatcgatactgttgtaataaaacataggaaacaaagacccactgcatttatcctgggtctcaaggagaagtattcaaacatgccccatattcgtgtttgtataatgatttgaacttttcaatttcttcccatactcagtatcttctatctacatcacaatggctttgcagtcaggaaacagttatcattaacccaattgacagataaggatatctgcacatatacacatattctgccttagtttccttattaaaattccttttgcatgtcaaatccaagctgaaactccacattttctaccaaaatgttcagcccacagtttcttctccctgccacttactatgtcagcattactgagccctgcacaaggttcctctctgagaccttgtttggttttggcttgtgaactcatattgccacccactggactgtaagctgccaaaaggcaaggacaaattttagcattttccaggacacttctgtagtatcttagtattaggcgtataaaagactcctaataaatgtttgattatcagactagcagtggaagagccagaaataaattaaaaatctagtatctcaatatgcagccttctgctcttttgggttaccttcatactttttaaaaattttcatcccctgtcaaaccatacagaggtgtgatttcaaggagaatgaagacaacactggaggcccagagttattcagaggatgctttattcatctcccaaactcggtgcaggaatgagcaccagccacactaaagaagagcgtctgtttaaactgcaccatcaggatagggtctaccaatgagatggagttaaggaagctgacagctgactgcaccatccttggctcctcttttatgaaccctcagggtgtgagttcagtcttccccaaccattgctcagcttctttgcttcccagggagggggattgtgagcaggtccctctgcatatcagagttgaatccactaactggttataatccgctcctaactaatgagcagttgctttatgttaatggatatattcaaatatttgtttacttgttagcataggacatacgtgtatactcctataaataagataattgcaaagtacgtttactatgtattgtatagagcagctattctcatggtaaccatgccaacaagtatatcagaacccccggaggatttgctaaaacacagcttgctgggccttagggtcctgagtgggcatgagaatttgaaattttaacaaggtccccaggtgatgctgattgtgtttatccagaaccacacattgagatccatcgatgtagaaaatacagtttcatatttgtctgtgtacgtgctgtgcacacactggcttacatatgaagacatctattctatagttgtgtgttatgtttagacaaaaattactgtaaatatgcttatctgcatagctactcatacatatataaaaatatacaaataaaatgtttactcacaaaagttgtttgtatatgactttaagtctaaataaatgcttatgaaaggttataagcctatataatgttatgtatacaaacacatatgcatgtttgtacatagaaatatagttatatttctaggtgatacttgtgtatgtacatgtgtatagtatcaacgtatctttcccttttacaacaaaggccttattaagtataacatcaaatttaatattttagttaaactcatcatcaaaagcagtgtttaagtgttccaacctgagggcggagatgtctccatgctggccctgttaagctttattagaaggatgatcttttcaatttccctagagcctcttacatatttgctatatttcacatatggaagtgccaaattaaataagcttcatggtctttcagaaccaccagggccctcctataaagtcaaatttcaatcatttcacttctttgccttcctcccaaagagatagtacaattcttctggcatttaactgactaaattaacaaaaatgcagtgcaaactcagtgtgttgagtgctcctgggtcttacatccttcttgtgctaaaagggtctgctttgttcaaaggcaaactttgtctttggaagaggaggaaatgcgagacatgagtttggggcctgacacttaggagggctaaggtagaaacaaaagaaatgaaagcatcagattgaccacatctcctgtgacatacagtacaataacagcttctttcttccctactccacagttcttcaaatgcaatagaagagaaaaaaagagcaacctggaaggaaaaaaagaaaaggtagcaaaaagagatggatatgcattactagtcacttcatttccaagacatgattatgctttggttatatctcatgacatcacattgcaataaatattacccatcatgcataactggtggctgaggtccagaatctttgggtaaactatttaagaactctcaactaaaagtggaagagctagaatttgagctaagatctgcctgatttcagtggttagatccagaagcataaatcagtgctttcctaaaatggtctgcaaggaagagttaaataataaataaaaatccctgggaattcatttaaatatacatgttgcaatggggacaagagaagcaggagaggaccttgtgggcttgaattttgaacgagtaaaataattttgggatatgaaagaggggagacttacatggtgagctgtcaacatcagcatttctcaaaaacaaggtggtgagttgcccaaataggaacttcactggtataaagtctgaggttcatatacttttacatccacagcttttagcaggatgtttgacctgtggtaagttcacagcaaactctcattaaattagttgcctttttagagctgattctgcttcaagttcaacttcccttcctggtcctctgatgactaaaacaattttaccaggggataagatttcatttcaaatccgagataaggttaaatgcaaataatgcagaaaaagaggaaacatattgactcagcacctgggggtataaatgatcaatggtagatcatcttctgatattatggtttattggagagatggagaaggtcactgaagatctgatcagggagtagggatgagcacaaaaatgagagaatctggtggtatcagacaaagtgtgcttatttcactagtttcctggcatctggtcttctgagcagaactgcaacagaggaaaggcaagaaatggctttgggagctgggagaccctgtgcacaaaagccttcctggcagcctttctttccagggtcattgtgcttagactttgttttacatgagaagaagaggtatcaacgattcaccatagaaaacaaaagatcctgaaggtaggaaaaacagtagtaacaaggtttatgaatcagctaaacttgtgtttccccaaatatatttgtttacgatgatcctttaagaagtttggaaatcaagtcctttaacaaaaccaaacgtgattcttaagattatataagttaacagaaacatctatttataaaagaaggaacaaaaagaaagaaggggccgggcgcagtggctcatgcctgtaatcccaggactttgggaggccaaggtgggcggatcatgaggtcaggagatggagaccatcctggtgaacatggagaaaccccgtctctactaaaaatacaaaaaattagccgggcgtggtggcgggcgcctgtagtcccagctacttgggaggctgaggcaggagaatggcgtgaacccaggaggcagagcttgcagtgagccgagatcacgccactgcactccagcctgggtgacagcgagactctgtctcaaaaaaaaaaaaaaaaaaaaaagacaggaacagtgacaaagtgagagagagaaagagagagagacaatgggacagaaagaattagagacggagggttatctcagcaccaggtagaattcagcagtggcatctgacattgtcatgcttcagacattctgccatcatgaaaaattggattaatcataacctaaagggtttcacatctgggtttcttaaacctggcctaaatgagtgaatccaagaccgcatataatgggatttcagtattttgaagattaagtttttcatgaattcttcaaagtttcctcctgccaaacagactgaaataaatcaaaatatttaggaaacacatattctaatcatgagtggcctctagataattaagaattgttatttttaattttagttatttttcaggagagaaatatttgtcaagcaattgtgtcaggcatttttttaggtgttggagatacagcagtaaacaaaacaattaatttctgatcttgtggagcttattttctaacaaagggagataaacaaagtaaatcagtaaaatatgtaatattctgaatacttaatattattgaaagccctcataaagtccatttctaagccttgctagccagaatgactcccggggtcaatgcagaccctgtgaggtttggaggtgtggaggccctgcagcttggcttggtcctcacacacctaccatgcattttattcatcttttgaccctggagaggttccagactactctgagcctcagttgccgcaactttgaattgtgattctgacattaactctgaaagtttttgagcattttataggagataataggtgtgaaagagtgtgaatgtaactcttgatcaagacagccatgcataatcttcattaacataattttaccaatgtcactaactcaaattaaccaaggagaaaaatcccttttatttatggggattttgttttgttttgtttaatagactggacagaggtctacaccttaagaattggcaagacttttgttggcatctattactatagattccacaccttgcagggcttccaggttggtattctaaatataaagtaacaatgggttcatctaaagggcataggggatgaaggtataggagactaagctgctcttagcacatcaacccctcggaaagatggtactgcggagcagagcaggtgccttcatatgcctggccttttctctgcctcccaagtgggctttgaacaagtcttttaacttcactgagtatgtttgcttctgtaaaattggaaacaattaccaactttcctatttgcagagcttgagaattgagttttctctccaaagagaaaagaagatacaaaaccttcatgcttgaattaaaaattacaaccttcatatgttttgctagaccactttttctaagtactcttaagggtgagcttcatctctttttattccataatgtgtatgttattcaaaagatttattgctttggtggtctgaatagggatataagagccactattaggctaacaattggtagcaatgatgtttttgagcaaacttcaagggtagttagagaagtctaacagagtgtgctttatgagctaaacacaataatggatcgtagccaatgctaaaggttccattagggaggaggaggagatgagtgcgtgagtttccacttacacactttttccctgtgtgagttgaggactcaactggcagattttaccacactgatcctgtaggatgcttattagaccaagtctcccaacccaaaaatcagagctaccccagctttacaaacaaccacttcctggtatttcaattaattaaaaatttatgtagaaaaagaaaaccgaaagctcaattaaactactatgatcctagaaaaaagataggaaaatggaaatttctctcatgctatccaattttctgaagctgctgcttctttcttaaaacaggaataagggtgttataagagatgtctatgtcattgataagatcatagatctattaaataatacagttattaaaaacaatatacaagtattacacacatgtatatgcacatatgttgtgtatacatatacctacgtatgtaaattccatgtctgtgggtagtttgttctaagtattttctcaacttttgtttatataaactactgactatgtgttatttaccccggcatgagtttttatcttctcattctctgggaggataccactccatgtgtctattgtttatcttgcaaaagtagatccttctcatctactgaatgataacagtagaagcctggctttttttgagacatattttattggaacaaaagctgtaaatatatacctatgttttcatggattgtgttttatttttattggtgtctttaaggaatttgcatgttcaaatgcaaacaccaataggtatctttgttttctgactaagatctgaaaatgaaattgagtgcacattttatttacccatctcatcaggccaacaaatccatatgacacagatctggttgttcataaactttttggtgtgggatgtttggagaagatctcaaaggatggggattctctgaaccgcttagttgtgtatttcagggtgtactaaccccttttagttttgaacttccacttgcccactatgcttctttaagaggttttgcttgtttggtatttttgccaaacagactttcataaaatatttcttgcaatgaaagccttccattccttgaaattcttgaaaaacttccaaattatatattatatatatatcatatgtatagtcaagttggagaaagagacaagtcagttgccaaatatggcagtgtgcttaggttagatgacagaggcaatcattcgatattaggagagtacagtggaagaacacctaaaacagactggcctggctgggcccagtggctcatgcctgtaatcccagtactttgggaggcccaggcaggtggatcacctgaggtcaggagttgagaccagcctgaccaacatggtgaaacctcatctctactagaaatacaaaaattagctgggcatggtggctcacgcctgtaatcccagctgctcgggaggctgaggcaggagaatctctttaaccctggaggcagagatcgtgccactgcactccagcctgggcaacagagcgagactccatctctgaaaaaaaaaaaagcaaagaaaaagtaaaaagaaaaatacaaaactctccctagcaggctttaaggagctgcagtctcgtgtctccttagtttgagacattcctggaatcctacagaggacctggtgatggggagcctgtgttctttcattcccatgaaaattaactctattgcttaagtgtggagcaggatgctttgtgtcaaacttgcagatccacatgctccatttttcccctgctctggccctgggatcctagactttctcagttgtttttctttctctctggtgtctgtggggctccgtccatgggatgcacaagggcagacaagggcttgggaagagtgggtcagaatgttcgttgtacattccattcttgctctctgctaccacagttggcctcttctccctggagaatgctgtagctcctgcctgtcctgaccttcacaccagctgccccctgcagccctggcacttctttgcccgatcaagtactgcccactgtggctgtctagggtgattcactgtcctgtgggggtttctttccatgctccccatgccctgaggacagtatcttaactctattccccccaaaccatgcgtctgatggtgccagtggcttcctgctgatatccacaactgacattcacatctaataggcatatcagaatcagagtgtcaaaactgaactccacacactctccacctctcagcttctgcatcctctcagctgtggcacctctaaccaaccagttgtctcgctgaaaatctcagatccttctctgacttccctccttctcctgggctactgtcctcaaatcttcgtaaaatgtcatggccacgaggagtcctaccatgaccaccctattgaatattaaacctcatctcttgcttccccaaaaactccttcttctcctggtcttgctgtatttttttctttgtttcttagcatttatcatttacaataggactgccatcaaaattggatggtttaaagctacagaaatgtatctcatttctgaatgctagaatttcaaaatgaaggagtttctacttcctctgaagcctctgagagaggacccttccttatctcttccatttcttggtagcttcaggtcttctctggcttgtggaagccaatccaatttctggctctgttttcgtgtgtttgtgtgtctctgggtcatcacataacattcttcctgtgtgtctgcctctatgtgtccaaatttctctcttcttataaggacaccagtcatactggataaaggcccaccttccttaatggccttagcttagcttaattaaatctgcaaagaccctattttcaaacaaggtcacatttacaggtacttgaagttaggacttcagacttcaatgcctctttttatttaatttgttgagcgggacataattcaacccataacctatagttgacttatttattatgtccactgtttattgtctatctccactagctaagaattagtatttttcagggcagagatctttgtatcttttgttcattgatatatcccaagcatccagggctatgtgggaaaacagtggttgctcaatagatgtctgttaaattgagggaaagtctgaacagcaagctgttttaagattaacgtaaaatggaattttactcagcatggggaagaaatatccctgaagctctaggttggcattcctgattgtgaaaagcaaacaccttgttatgatataaacagataccaaaccactaacgtttcacttggaaaacaatacctcactggacaaggagggagcgaaatttcaccctagtatttcttttctttattctacaattagtttatgaaatgtgaagcatttatttttaagctaactcctgttaaatcttctgaattccagacctgaggtttgactctttagcagatggtagatatgtaccttggagagaaagagagggtggagagggaggagacagagacaggaagtacaagaggggctgccaaacctcagccctggacagacttcagcaaacaaacagaagtgagacccagcaggaccgggtgtgagctggttttattgctgtccaccagctccaggtcataagtgacctaatcaaccttagcttgcatctttcttgcgatagctttgtgcctgttcgctgcacacagctctgattctcactcatcctaggccttggcgggcatatccagagccctttatgggatccaggacacagctgctgcaatatcccttcattccaaatcacctctcaacccctcccccatttattttctctgcgctactgaacatttccaacacttggtataccagcatcctcctcatcccctccccaaatgacttggctatatctcatatccagaaaggccagctatggaggaccacaggtgggagcaaccacccaccatagctattaacaaaactcaaattgcacatagcacaggtataaattaggtcatatatatatatatatatatatatatatatatatatatatatataaatataaataggtgtgctgtatgttcaggtaatgcaatgaggcctgttttctcttttctagaacatgtggtaaactgacaaacatgcatttactggtcatctgtgtgcttcctttagaggccagaaaattattctaaatatttgaaaatggtttacttccaatcaaactagttactaatctgtattatttggaaaaactgaatccacaaaaaaattttgcttagaataattttcttaccttaggttgccacattataacaatgaaataataataatgtaattataatcatataacataatattttatatataaccttatatattataggtaacattacacataatgtagtaacaatatataatacaactatgtgtaatatagaaatacaataccaatagcttcactaatcacacatttatcttctaaaaaaacgtttcttttgaatattggacacaatggtaaaaactaatagatggaaaagggaaaactagaagttatttgcagtgtcccaattcagtaagtaattgctgttatactatataagggatcctgcaaaccaaaaatcataactaaatggaaaactacaccaatagaaaactggccaaatagatcacaagtgctttcagaattaaataaaaaaaaaactcaaaaagcataaaaaacatctaaagagaacctcaatcgtattaaaagtcaagaatgcacgtttgagcaaggatgagaattcactgaacatttattactctggcaaaagcaagaagctgggcaccactgggagtggtatggccgggtgtggccaagctggagagccaggtggcagggagagcagacgtgaccccacagttcctgcagagagcgtgcatcctggagaaattctcacacaggatcctagaggaacactactgagaatactcacttttgtgcttttagaggtgttgagaaatgcagtgaacccccttgcgcagggggctgccaacttcatctataaaaggtctaagagccgtgagccagaggctctcttgcaatactcaacactgtcccacagcaccgacagaagccccatagacatgatgcaaatgagtggacatggctgtgatctaacaaggtgtcatttacaaaatcaggcagtaggctgggtttggcccctactgtagtttgtagtttgtccattcctgtatatcccaattcctttcacacatattaaatacacacacacacacataattcaaaaagctagcaagattaaacataaaatacacataatcatataagaatgatggcttgtggaggatgcagaggggaatggagtgatcaaacagagactaagcaatggtgtggtggggagtgatgaaaatgaacctagaaataaggattgtcctaactcaagattctgtacccagggccaatttcattttttctaagcaaaggcacacaagctatggtttcggatgaggagctataatttgctcctagttttttaagaactgagattctgtgcagagtgctgccaaattgcccacagtgagttagtatgaagcgcgggcctctgatttgatttgatgatgtacctaattgtggctgggaatcacagtactttttggactcattttgagtgccccttttttgtaaaataaatgataccaggtaaaaaatagcagttttttttttcttgatcaggatgtaatgatttaaaaaatgcccaagggaagaagacaattgtcaagctacatgcacaatggcttaaattgttcaagatattacctctgatgaagaagaaatggagctgtcacgcaatgaaagtctgtccctaggtgagaagggctaagggataagcatactacagtggttaaaagcaagggactggagtggattttcaatccacatcctggatcttcacttcacagctacatgatggactctggcagcatccgttatctcatgttacagtaagcatgatatttacctggaagaaatattttgagggttaaatgcccaatttcaaaaataagacgtgtacacagcgattacatgagatactcaggaataacatggtatagtttgtacgattagcaattcctaattattgttgctttccatatttccatgcaaagatagtacactcattatcccatactccttaacagagagatgtctgttgctacaaaagtataacgtatcatatggaatgctaccatgtgttgtcttgaaccccaaggcatctagaaagcatcccacttcccactgtaaacagtcacaaagcattttaaaataggttcatttttaaaagagccatttttagtgaatttgttaattagcaaattagtaaaataccaaagaaacacaccatgatagtcaaagcttacacagggtcacacaggatccctgtctcaaaagtcccgtaacagtctctcatctgcactgtccccaagccctggggaccatgttggcattacatagatgctgcttagcccatttccttgtcttctgcctgcaaggcatgcagtgagcacacaccttctgcaaaacctctaagtgaaacagtaggtggtctggataaatatagtagcatgcatctcgtgtctcaggttcctaaggttcctacatcatacctcaatctttcatatactttccttcacatgttacatgttttatttcttcattctactatcctgtttcagaaaattgcaggaatatataaatatgtataaattatgtataaggtacgaataatcacaaatacatatctatatgcctatgatctcaatttagggaaaataactgccagtatgtgggaatcattccatggatccctccttcctccacctttgcagatcgcatatcctgttgaattttgtgttattaatcctttgattttcttaagaaagttttaccatctacacttctatatttagttttgtgtgattttaaacttcatataaataaattgagttgacttttcaggcaatattattttcttgagttctgttgatactattgcatatagctatagtttattttaagtgctgaatgattttcctttggaataacatacaacagcttatttattttattggatatttgtgttgctttcagttttctgctctaacaagcagatccatcatgaatactttcacacatatcctagcacacatggggaggacacttgtttagagtatttacctagcaatgggatttcttggacatgaggtgtgtatatctttaactttattgaaattatcaaatcattgtccaaatatttgtaccaattcatattttacaaacaatacggcccggcgcagtggctcacgcatgtaatcccagcactttgggagcctgaggcgggcggatcacaaggtcaggagatcgagaccatcctggctaacgtggtgaaaccccgtctctactaaaaatacaaaaaattagccaggagtggtggcgggtgcctgtagtcccagctactcaggaggctgaggcaggagaatggcgtgaacccgggaagcggagcttgcagtgagctgagatcgcgccactgcactccagcctgggtgacagagactctgtctcaaaaaaaaaataataaaaataaaaataataataataataaaacaatacgtaggtattccatttgtattgactctcatcaaaacttcatattgaaagaaaccttggttattgtcaatatggggggtgtgaaatggcatttcatttccactttaatttttatctgtctaagtactaatcaggctttttaaagattgtgagccatttgagtttcttttttttaagtttgtcttcagatattttgaatatttttctactgggccatctgccttctttcaaatcgatttgtagaaattatttatatattctagatgctaatattttgtcagttatatggttgccaaaattatctttcaatctgtggcctagatttttactcccttcttatgtatatacatgtacctatatattacaatatacagaagcgcttagtttttttttcttttccgactttgattttagaatcaagcggtacatgtgcagctttttcatgagtatactgcgtgatgctgaggtttagggcatgattcagcctatcatcctggaagtgagcaaagtacccaataggtagtttttcaacacttaccctcctccctctctccccactctaggagttcccagcgtctattgttcccatctttttgtccacgtgtacccagaagttgttaatttttacataggggaattagtccattattttctgacattttaaattctctgtattttgcttaagaaatagttttttagcttaaagtcataaagacattgtcttacatattttttaggttttttttttcagttttcccttttacaattaaacctttagtctatctggcatgtattattttgtgtctggatgagaagtatgccagatttcttgccacatgatttcttttttttttttttccattaactgtaaattctattcctttcttactggaaaaaaccttgcaggaccaagtctatcataaaccaaattgccatatatcctggggctgtgtctggtagtcttattttgttttatagtggtaatattctatcccatgccaatattcacacggcaattactacagatttctataattccttatatgtaccaaggtatttcttctcattattttcttctttttcaggaatatcttgcatattcttgggtctttcctcttctaaataaactttactattagcttgtcattgttaaagggaagcaaagctggaaggagaaaatgaaaggacagaggaaaaggaattctgagatggggtgtggattgaatttcaatgaattcatagatctatttagggaacatcacaattgcaaactttatggtattgagtctttctaggaaaaaaattatttctatttatttagatcttctaaaaggtctttccagagtattttataattttttcatgtattttgttacatttattccaaggttctttttttttttttttttttgagacggagtttcactcttgttgcccaggctggagtgcaataacatgatctcagctcactgcaacttccgcttcccaggttcaagcgattctcctgcctcagcctcccgagtagctgggattacaggcatgtgccaccacacccagctaattttttatttgtagtagagacggggtttctccatgttggtcaggctggtcttgaactcctgacctcaggtgatgcacctgcctcatccttccaacgagctgggattacaggcatgagccacctcgcctggctggtattctaaagttcttaaagctaccatgaatttccctttttaaaatcaccttttcaattatttatagctggtgtatctaaacacaattaatttttgtacattgattttatgcatagtaacttgataaacacttttcttcattctcataatctctatgtagattgtttagggttttctaaatatacaatcatcacccatgaataatgagagttacacttcctgctttccaatcaacagaaattttctttctttttcttgaatactttgctggctcggacctcatttgcaatgtcaagtgaataatgttcatggtgggcatatctgtctttttcgtgattctaaaacaatctttgcagcatttcatcaataaggggaatgtttgctctagattggcatagacacccttccaatcctaatttgctaaaagtctttgtcaagaacagatgttaagatatttttgttggatactgactttacatctattgaactaatcatattagttatctccttttagctttcaatttggtaaataatattaaatagttttctaatccgaagccatgttttttcatattgaatattgctgaattctctttagaatttactctaaattactgaggtctcttattcatatatatttctttttgagacaccactcattgttatggttttctcaaaacatttcccttttatcttggttttcaaatttattgacataatcttgtttagactaacctcaataacttaaattcctcttcatcttaagtcacaccctattttacttcttctaatatgcttttattttgaattgtggtaaaaaaaaacacttaacatgagatttactcttttaacaaatttttaaatgcacaatacagtattcactaaagtcacaatgttatataaacagatctctaaaacttactcatattgtttcactgaaaaactttatatctgttaaatgataactcctaattctcaatctgtaacctgatttcgaagctgcaggcacttatgtcctgccacgtatttcttactccctacctgtatcctgaaatcccagtccagaggcacaaattgtccacactctggatgcttctccggttgctcatctaatacccaaatactgactgaaacctgggtttcctgcagttttccatcccctcttatagagcccccttgtttgtcttctgtagcagagccatcttcaggccaaatcacctctaagacccatatgtcctctggaggcagcccaagtgatgtcaatatttctctggggatctgtttcaccctaaggaaaaggaggcatcctgctacgtttcattttctctttttgctgggccacccatcacaagtgctaagagttgaagagcagggcttgtaaataagaatttaattactcctcatttctacaattcactcaaacatctggtaccaggcgtggagccctgaagcactgctcgacctgcaggtcacctaataggaactgagaaggacttctctctcagcctggaccactctcaggtacatgcactacttttaaacctagccaaaaagggagagaataaaattgagatgtaacaatgtttaatgattatggaaattgtatcaatcactcagtgagtcagaagacatttgatcttcattgacattcgaaaaagaaggagaagcagcagttacagaatctttacaataagccatatccgttatgtatgatcacatttaatcctcctcaacacaatcatgctaagaaagggtaattctgtcatcttatgtcaaagaaaacaaagcttaggaaaggtaaatagagtattcaagggtatacatctaaaaccctgcttcttttaacacttaacctctccccatggggctcaccattctggtgtacagagtaatgtataaactatcttgtgagaatcacagtatagttggagagacagtaactatcatgttaagcagtaagtgacaggtgcccctgttgtctggttctgaatttggaggagatgcaatcagggagctcaggaatgattaaagaaggaaagcagtatttgaaattgattcagaagatgaggattttgcatatataaatttgttctcaaaagtctatgatacaagcttagagcagcaatatttcaatacattttccacattccatagtaatggttcatcttagtatcaacattggcaaaagttatggactctgttcattagcctcaccattaatattgttttgcttttgctttgtcctcggcccctaagacagtgtttgcgtaatcaaaatctgagtcatatacatattatatgtatattttatacatatacttcataaatcatgtttcaagattattgttacaatgtaaatcagtctgatgctaatttaaatatcaggatatttatgctgtgccctaagttctggaaagcaaacatgaaaaatattagtataagcattttaaactatgtctaaaatcaaggtgaaagaatgtactctatcattttgttatggcccctatagttctgaagtaagtttctcccaatttcctattctcaatattattacttcagtgatcatttaaaatttctgttagaactacaaggaaaatgaattgtgggagtgtcatagcagccccaataaatgtgattcagtggccattctgagaaattttgaaggaaaactttggtttttaaaatgttaactttatcttgggatgtctttagtagtgtaatgttaatgaataaatccatcctgcaggtttgtgagtggtaaacaaccagtcaggttaggttggagagcaggacggggccaacttcaggagtgaagtctgcatacgagcattgtggtagtccgtttttatactgctatgaagaaatacctgcgactgcataatttataaagaaaaagaggtttaatggactcacagttacacatggctgggaagccatcacgatcatggcaaaatgcaaaagaggagtaaagacatgtcttacatggcctcaggcaagagagtgtttgcaggggaacagccctttattagaccattagattttgtgagacttattcactagcacaagaagagcatggaaaaaattcacccccatgattcaattacctcccactgggtccctcctataacacatgggaattatgggagctacaattcaagacgaaatttgagtgaggacacagccagaccacatcattccacccctggccccttccaaatctcatatcctcgcattttaaagccaatcataccttcccaacagtcgcccaaagtcttaactaatttcagcatgatctcaaaagtccacagtccaaagtctcatctgagacaaggcaagtcccttttgcctataaaatcagaagcaacttagttacttcctagatacaaggggaggacaggcattgtgtaaatacacccattgcaaatggaagacattggccaaaacgaaggggttacaggccccatgcaagtccaaaatccagcaggggaatcaaatcgtaaaacttcaaaatgatctcctttgactccatgtctcacatccaggtcatgccagtgaaagaggctgattcccttggtctttggcagctccaccccttgtgactttacagggtacagcaccccctcctggctgctttcatgggctggcattgagtgtttgtgacttttctgggctcatggtgcaagctgttggaggatctaccattctgaggtctggaggaaggtagccctttcctcacagatccactaggaagtgccccagtgggcactctgtgtgggagctccaaccccacattttccttcctcacttccctagcagaagttctccatgagggttctgcccctgcagcacacctctgcctggatatccaggcatttccatacatcctctgaaatctaggcagaggttcccaaacctcaaatcttgacctctgtgcacccacaggtacaacaccagatgtgagctgccaagacttggtgactgcaccctctgaagcaacgatatgagctttacgttggccctttttagccatggttgggatgcggagcaccaagtcctgagactgcacaaagcagcaaggccctgggcccagaccacaaaactattttttccttccaggcctccaggcctgtgatggaatgggctaccatgaagacctctgacatgccctgaagacattttccccattgtcttggccagtaacatttggcgccttgttacttatgcaaatttctgcagctggcttgaatttctcatcaaaaaatgtttttttgttttctatcgcattgtcaggcaggaaattttctgagcttttatgctctgcttccctcttaaacatgggttccaattccaaatcatatctttggaaatgaataaaatggaatgtttttaagagcaccctagtcatgtcttgaaggctttgctgcttagaaatttatcccaccagatgccctaaatcatctctctcaaactcagagttccacagatatctaggacaggggcaaaatgctaccagtctcttcgataagcataacaagattcaccttttctccagtttccaacaagttcctcatcttcatctgagaccacctcagcctggactttaatgtccatatcaccatcagcattttggtcaaagccattcaatgcatctctaggaagttccaaactttcccacattttcctatcttcttctgagccctccgaactgttccaacctctgccagttacccagttccacagttgctttcacatcattctggggtatctttatagcagagcccactacccagtaccaatttactgttttagtccattttcatactgctatgaagaaatactccagactgtgtaatttataaagaaaaagaggtttaatgcactcatagttacatatggctggaaaggcctcacaatcatggtaggaggcaaaggaggagcaaaggtacatcttacatggtggaaggcaagagagcatgtgcaggggaattgccctttataaaaccatcaaatctcatgagacttattcactatcatgagagcagcacaggaaaatcccacccccaccattcaaatacctcccacaggttcctgattatggggagctacaaatcaagatgagctatggggacacagccaaaccatatcaagcatctactgaggcaagaagacaggtagaatctgaaggtctatagccccattttctaggatattcattgaaagccaaagtaaactgctactgaggccaggaagttcactaaaatgtaagggcctagtgatatgtccagactaggaaagaaaattttaattttcaagaaagtcaaagccattagttgtagccctagaactagtgacagtagagtacacccaatcctaagttggaaactggtacggtgtgaccgtgtccccacccaaatatcattttgaattgtagtttccataatacccatgtgtcatggaagacacccagcaggaagtgattgggtcatgggggcggtttcccccatgctgttctcatgacaatgagtgagttctcatgagatctgatggttttataaacatctggcatttcccctgcttgcacttttctctcctgccaccaagtgaagaaggacatgtttgcttcctcttctatcataattgtcagtttcctgaggcctccccagcaatgtggaactgtgtcaattaaagttgttttcttttcttttcttttttttttttttggaaatggagtctcaccctgtctcccaggctggactgcaatggtgccgtctcagctcactgcaacctccgcctcctgggttcaagcgattctcctgcctcagcctcccaagtagctgggactacaggtgtgcaccaccatgcccagctaatttttgtatttttagtagagatggggtttcaccatgttggccagcttgtcttgtgatccgcccacctccacctcccaaaatgctgggattataggcgtaagccaccatacccggccaaaccttttttctttataaatgatccagtctccagtatttcttcagagtagcatgagaatggactaatacagagagaattctcttttttcctctgtgtgttttgctgcctcctttttttctcagcctgcgtgttttggtgtctctggtagatcctgaagatgtagtcatatgtacatgataattttttaacttcttatctaagatctccaaaaagggctcaaatgaagtttccatttggaagttctaaaagtgggcctttagtccctactcggtgatttaaagtttcgtttgagtatattctgatacacatcttgctttgcagagtatatgtagaaatcacttgtatttgtcctaaacattctgaaattgatcccaagattgagaacagatgaatagaatggatcaaccaagtgttctgggcccattctgctggatagtaactaagtgattaatgccaatgggccttgggcagagctagtgccaatcccagcactgtgaccttgagcaagttacttaaatgcactgaggctcagtttctttataaaaccaggtcaataacacctaaccctatgagttaatttatgtgaattgcctgtcccagtggcctattgtctggactcaataattggtatatggtattataatgatggtgatgacagcaacagtgcagatatggcttaccttgcaggacattttgtgatgcaaagggaaacccttgtcaacataatgcgtgtatgaataaccccttattttcctaacctaccatctcctttccctcaaccacagtgttggggcatgtttgccaagctctctttgtgtgctatcacaagggttaggttgattctggaggtctgagtgggccagtgggggcagttgcatgaagtagtaagatgagggatagctagagaagagagaccaccagtgctccaggctcttgatgatctacatgtggttcatgggccagcggcatcagaggcacctaggagcttgaacctaaattataatctacatttttgtaaaggtaattcatgctcacaataaagtttgagaagctctgtcccagggagtaccctagaaaatcaaaagctgtttcctgggtgagtaataggggacagaagcctgatacatgcaggaattacagggagatgaccaaggtaggaattccatcagggtccagttgttttgaaggcacaggttgcaggcagaaaaaaagcactatacagcccaaatattaatagatatgaaacataagcaaacaattgatttttttaacttttcacatatattctgttcaactctgtatggcaaatatgatgtttagtatcaaatggtagccattcacattttcttagtatgctgaatttattcccaagttaaaattccatttaaagaaacgagaatcccttcctaacacatgttacagactttaaagaactagactctgtgacccagttcatcaaaatgcacttgaaaaattctgtctggagctctcagaccaatgctacacattaaagattttattttcttcctcctgtcttttccaaggcttgactcctaaccacttgagatggagctaaagctgacagagaaagtgaaaatcctctgccttcttgcctggaggaaatgcttggcaggagatttccaagctgtgctgtcatcaaagctaaacttaaccttgttcaggaaaagaaccctcaactttcaaaccaactccttgtcagaccattcaatttgcaaagtacaatgttggggggatagaaaaggaaggaaaaatagcaatgaatgcactgatgtttgagattgagacttgaaatgatgactactcatgttttgcaatgacattaaagttaaatgtcttggttcacgggcacttaccactcccttcatcaccattaatctttgctcacagttttgaaatacaccactttgtgtcttcagcaatgaaacgaaattttcccagggttgtaattgctttccggtatgtcttttctcatgttatttgattgctaaaggttttcttcaaaatgggagatatttagtgaacacaatacaatgtattttcctgctatttttaatctgttcatgcataatttgaagggtttggtgagggaaaaatggaaattgaactcatctgaccgtgacagatttgcaaactctaaatacaacttaaactttatcgatgcttttaaattacagcactgaatacctggacatgtccatataacatttatagcattttatgtcttcatagctacagccaacatttgcttaagaatcacaattgtaattcaggatgagcaagaagagcattttacaaggaaaagtagagcatgctgaagtattttgcctggaacaagcttttatttttagcctgtccccaaaaaatcattatctagaggcctgaaatgtctcaaaaaatcattatatttgaatacctggtaggtcatttcatagagtcctgaagaatcctatttaatatcacgtgggtttgttatctggaccacagagcaattgaaggaatgattgtctattgggacctactcttttcctctgacttctgacatgcaaactttctccagtgtacagttttaacaaatggcacaccacactttggtccagcatgttatatccaggattcttattgagttattatgaaaggtggtatttccaaaattcatataaggaactctcaataatttatacttacctccatgtaatacattcaggtcttctttccaatgccttagcttggatacattttgtgagagtaatagcatgtgaaagaatgtcaaaaaccagaggcctgggcttgagatttagccctgagctctgcccatgcccttcccttccagtgagaaaatatctttctagaagagaataaatatagaaagcagagacatccatcatggatcaaagagactagatggtgactggggacaaaccatgccagtttattgtccattcctgacaaataaatagctctcatccccaaaatacaaaaatccagaccaagaggcctagtgataaaatcgggagggagtggtagctactgaaaactaaaaacattctcgtgttacaacaataggatttcaatttattcatgttctaaatatcatttccttactcaaaaatctttacagaggttcacaggatagttataattgcaaagctgtagctatcattaattaagcattttctttgtaccaaccacttttgtctttgttggtggttcatgacaaccctcatttgtcatgacctccccgtgggaaacaggcatcatcatcttcattttccatggaggaatactatatcacagagaaagaaatggatggccccaatttaccaaatcagtcagcagaacaactggatgcacaaggtactgagacccaccgctgtgatgtttccattctatctcacacattcacttctgccatagcttgctcactcatcagacttcaaggccctacacaaccaggctctcctccaaattactagatatatccccaacttgttcggagttttgacttctttacttgcaaaatgagagggtgttggaggctggaacaagtaagtcagagagaagatgcgttgcctacccagttaatactcttatgaccttcatacctgtgcctcctcatctgtcaaatggtcaccatcttggctgtccttcctggctgagatgatttttgcaaagctcaaataaagaaagcatttagaaatcacactcataggacaaatggtaatgacaaatctcatcgatattctctttaagtgctcacaatcttgaacgcacttccctgtgtgacttggaaacataagtcactttactgttgcccacacattttccattttagagacctgtccagtttctattccgatttcttagtcttcatttaagactgtcctccccttatctaaacctctacctaaccaacaagcaattgagcaattctctgtggtcatcactgtgaaatgcagtgaaagtaggaaagtgagtaagatggggcctcaaagagctcaaggacctgtgtgctacaacatcttcaaaataaacacctgtcaccgagctggtcctcctagtggaggtggagtattatacacaaaagaccccataaaggagaaaaggaatttcttgcctggagagatcaaggaaggctatggagtatttacatcccgtgcagtaagtgcattgttgatgagtgagcaagtggaaggtgatgtgcgggcattcaagacagagtcaaatataaacacagccaataaattggcaaatccaagcacagattgagaaataagcggtgccagaagattaaataatccagagtttgatcatgaagggatatatagaagcaaggaactaaaattttattctgaaggcatgggagactagtgaactcaggtcagtcatctttcttatttcctgaatatggaattcattgctcacctgtctttgggtaattaaaaaccatcaccttatgacatattatgacttgccatctgaatataaatatatggtttttagtcttgtgacactttttattatatttatctaaaagaaagacgagaagctttaaatatgatttggaagtcatctaaatgtgggaccatttatcacctcttttctgcatgatataaagatatgttaattttagaaattgatttgtgagcttcccagttcttcaggataacaaaatagattgtcaatagacctagaaatattgaactaattatttattcttaccttcctttttgtgcaccaggtcatgatgattccaatatggtatgtctaaagttacataactctgtccattccaattgtcattgttttagttcaggctaccattattatatatatattcttttactattctaaatcccctgattgggtcttgttagcacagtctcttaccctcaattctctatccccatctccacccaagacatttttccatatagaaattgaagcaaactttctaaaatactaattgctgtgactctcttgcccaaaacagtatttccttgtttttatttcattttgtttttaaactattttgattcctactgcctgtataagtgcagaatttccttctttttaagtttataatcttcaaaacatgagcttgggaggccctattttaacatattcgcattttaaaaataaattatatatatgaacttgaatgaaattcaaacattttctccagccagctgtcccaacctgcctcatcccttgaaaagttatatgaggtccatgctttctgttccctttaagagtcaccaggttatgtatcagatagcatgatacatgatgcctgggacactgtacttaaaaaatatttgttgaatataagaaaaatgtgataaaacctaaaaagtatactatgtttggtcttggagcataagtaatgcataaacaacacagctcttggtacagaattatcctacatattctgaacagatgataaagaaagtgctaaaaaccgtgtggatggaaatatgtagtagatagtcctgggaatatcatttttcaaggacagtagttggaactggagatgatccacttagaaagcagtagcagatgaaggtaacttaaattcatctatttatctgcctatcatcgatttagatattttacatgaattgtcactttttgttctcacaacaagcctgtgtatagttatcatccccattacatgtagagaaaactgagattaattaacttcccaaaggacacataattagtaagttgcagagtcaggatctgaattcagactggtctggtctctttgcaaatatactacagtctccaacacacacacaaacacacacacacacacacacataagcaaccacattatgatcttgtaggaccactccttctgtctctgggctgccattattttctcatctacatacaccagtaaaggtcaatgtttgttcaaattatcagtacacgtttaacccatccacttctaaatgtttggcattgaccccattggttgtgctattagccagctggccagtactcaactcaagcctatctttctaatcaggcattttcctaagttccagtgagcagaatgagaatacagagatgttcgttttattttagaatcattatgcctagacccatgcaagatgaaaaaggtttatgaatgtgtatggattgattgagctacactttaagatcatggtttcctgagaaacgaggattttcagtgtaatttagaaacactcaatgcaggatcatgattagctgttggaagtttagccccattgtattcaaaaaagagtagatatctagtgagaaagacaacgttctagaagagaaactctcaattctgataactactcaatgaacagaaatactgtctttacaaattctttagttgcctcctttccctcattttaatattcaatgcataatcatctggacaatgacctttttaaaatataaagacatcatctctacttttaattttaaaaaagttctaccttccatattttttctttctcccaatcttatcattcagtaccatccaattcattcatttatgtagcttttcttcagaaccaataaattctgagcataatttggcactactttgtaatgatgtgtgtgtgtgtgctgtgagaagtgttaatagatggggaggagggaaaaggggtttatagaagcagagtgaaatttgtggaaacttttcaagtaggaaacattatattttttcaaagatttgtgttttttcttatgagtctcctataaaacccaccaaactattccagccaccactcttagcttctcctattccagaaacttctaatttttttggtttatgaattttacctgttacactcaataatataaaaggttgaatagctttctaattaagctatgacacattattcataaccttaaaagtttaatagctttaccgtatttgattttaaacactgtcagagtgatgcctttggaggcacagtcctcgacttctgataaagccgatcctaacaacaggtcacttactcctgaacttggtcttacgttttgattctttgaccaactttcagtaccaccaatgatttccttaacttaggcttggctgggacctaccatgtgtagataaatctttttttttttttttttttttttttttgagatggagtcttgctctgtcacccaggctagcgtgcaatggcgctatctctgctcactgaaagctccgcctgccggattcatgccattctcctgcctcagcctcccgagtagctgggactacaggcgcctggcaccacgcccggctaattttttgtatttttagtagagaccgggtttcaccgtgttagccaggatggtctcgatctcccaacctcgtgatccgcctgccttggcctcccaaagtgctgggattacaggcgggagccaccgggcctggcctatgtgtagataattctgctctttcatcctcatgatgccacccctggaagccaagctcaaggctggcataccttgtaagtatttttgaaggcaacatattaaaaatggggtttttaaaaagatggcttaatgggactagagctgggtactacttggctctctcagtgagaaaactaatggaaaagaccattgcaaaaatcataacataatatttggatagtcagaactagaatcaaatcgtgagaaagagaaaataaataagtggaaaactgagagatcatcccaagagaaaacaacaattcaacaggatagaacttgtgtctttcatcctttcactcaacaaagaagtattgactaatttatgtagtctgaaatactaaataccagggcaaaaaaagaaatctgtccagcctgaccctttatatttgcacatcattagctcattatatttgtcacatatgaggggctcagttgtaaacaacatagctcttggtacagaattaccaacatttgttgcattagattaagtcactggtaaattagatttagagcatgaaagtgaaaagaataaagcaaaacagtctgttgtaaaaaaatatttctaacctgagaatcaaaacataacaaaaaaaaatcagtggcaacatcaaaaataacaaaaacactgctttcctctcaggtgtaatctgagaagaaatcaatttagggaagggtatttcagagctgttgagtttgggctcattgtggggcatccgtgtacagatgctcttgaaattcaagaaggaaagagctatattcctacaaaattgtcaaatagagagaggtctgccgtcatattagagtttagaagcaggtttcaactcaggttttgtgcagagtcactttgaccttggttcaaagcccagtttagatattgcagagactctgaaatggacaaaaaatgtatagagtcctcatccatggaataaggtgatggtctccccgttgcagctgttgcagtgactgtgagcaactcagaaagctgcaccaggaggctcccaaggagtcaggcctgctgctgctaccttgttatgcttatggggtttaggatgatgtcctcccaccaagccacttacaagcaggaaattagtaactccaaataaaatatgtcctaaaatcgtacatagaattgctttaaaagcctggaaggaatcccagagccctcttgttagccctggacagcactaaccccctcttctgggtgttcccgcagtctgctctggccccatcaccagtcactattgcagtgcagggagtggtgctgtgtttatctccaccacgtttgatgaatttgcgataattacttttactctctgcaaagcctgacagaaattttgacacctagtatgtgctcaattaaattgtgttgatgaaacaaatgaacaataacccgtgccgttataaagttgaggaatctgaaatacagggaagtgaaaaagagagcacattactagtgcaggcagaaggctcaggactcctggatcccagaccaatggtcttttgcatgtaattgctcatgaacataaggagcttatttcaaaaaatgtatggattatctttcagtccaaagtaaatgattgctttcttgagctcagggtctatgtatttgactttattctgtcttctcacagcaagaagcacaaccatgagtatttagcagctgatcaaaaagcaagttctgcatcaatctggaaatgagtgtcaggatagagaagactcggccttcctttcacgactgattttagaaagctgtatttttggtctactaattatgaagtaatgtatcttttagggtttcatcgtgaagaatgggggcagggtcagattcaagagtaatattatagtatttatttttgttattttctaagtgaaattataggtaacaaggggaaaaataattgaagcaaaaggcatgagttgtcatgtctaagcaccgttgtaggcactccacaaaatgtatgttttatatcttttagacaaagtaggctattaagtgtgcaatgctaagaggaattttatctcacctctaaatacaagtgaatcttttaagctccaaatccccacatacagacaatttaccgtggtaatcaagacgatgcacacaattgaacttcagtaccatctgtaactctattggtattttaataataatgaataaaaatatatgttggcaacaaaaaatgttactcgaagtagaatcattttaaagagtcaatgataatttctcaatagctgtgtagatatcatatttacttggaattctctgttgtgcctttaccttgtaattaatatgaaagaagaccttcagtatttaactgtatacatatactgaagaacatattatcccctcttctttgaattggaaatatgaaacaaaatgcttgtccatgcaaatattaataaggaaatgaatgtttcttttatttttctcttcttaccttttttcttttgccttttttctgtttgtttgacttctgccccctgggtgggtagggtttatctaggggagagtattgaagatgaatagaagaaaggcaaaaaaaaaaaaaaaaaaaaagaagagaaattcaaattatcctgaaagttataaactactcttcatcaatgtttttctgttgtccaggaaataaaataatgtctttcacttcgcagaaaaaagatcatccattataacagttgttataaataatactactactaatggttacctgccttctgcaaaggtgccagaaaactggactagggccacctacaaacagtaaggaaacctgaattttgcttccagctggtcaaataattaactgaataatcttgggcagtcctgtcatctccctaagctccccccaaacccttatatataaagtgaaaggcttggaacctgtaatttctgaagttcctcctggttcagaaatcctcttaaatctgtgaatgtaaagcaaagttacgcaaacaggactgggagtatttaaacagctactggatggaaagagctaaggtgcttttggttatacccacagaagtagatttttatctggggggatgatgggagctagtgatggcctttacattataaagaaaaggagtacagatgacagcaaagttatttgttgaagaaaaatggggaatcaaaaatatatatgaaaaaggatttgcattttaaaaatagacttttattgcatcagagtttttttttaagtttaaaaaattcttttttttaaaattattattatactttaagtttcagggtacatgtgcacaacgtgcgggtttgttacatatgtatacatgtgccatgttggtgtgctgcacccattaactcgtcatttagcattaggtatatctcctaatgctattcctcccacctcctcccaccccacaacagtccccggtgtgtgatattccccttcctttgtccatgtgttctcattgttcaattcccacctatgagtgagaacatgcggtgtttggttttttgtccttgcgataatttgctgagaatgatagtttccagcttcatccatgtccctacaaaggacatgaactcatcattttttatggctgcatagtattccatggtgtatatgtgccacattttcttaatccagtctatcattgatggacatttgagttggttccaagtctttgttattgtgaatagtgcctcaataaacatacgtgtgcatgtgtctttatagcagcatgatttataatcctttgggtatatacccagtaatgggatggctgggtcaaatggtatttctagttctagatccctgaggaatcgccacaccaacttccacaatggttaaactagtttacggtcccaccaacagtgtaaaagtgttcctatcagagttttgctataactcttttggagaaaagacccatgaaaaagcttttaaagatctcattttgaaaatactaggccaatgcatctgtgaaatttggttcattcttggaaagtgattcctgggaaatcaatatagtctatcccaagttgtgtgtcccattggaagtgagtatgagagaagccttttagtctctcattatattttttttcttaaaattcaaatacctatcttcagaccccagtttcttcaccccttcttcttttctacattaaacactaatgaatattcacatacacttttggaggaacagagtgatggattcagcattgttcagacacactgttagaagtctgagatgcatgtggagcctgaaattgaaggagagcacaggtttgcttattgaaggctgcaggagcactgagggagataacatgttctttccttgctccccagccatgtgcttggggtagtactgacccagtctccacaatgctgcagacctgcagaggagagaatgaaggcgcaatgtcatctttatgcaggctcgtgtcttcacccattttattacccctccacttcaccttatcctgttcatctggccagttgtaaacctttaatgtgaatgagctatttatgataccaatttgtgggcaagttttgtggaagagaaaaaagatcccagaaataaaatcattaaaatatttgctctcaaatgtagcagatattactgggcaattcatatactgcttcctattctcattacgggctttatacttaaaaggggacattttcccatctattcttattccatctttaaaatgactctatggctggatatgatgaaaatgactattttgcagacagtgaaaataaaacttagtatacctgaatgtattagctggaatcatccaatcaagagaagaaacaaatctaggaaaaaggaatctccaagctctaaccctcaatatgctttccactaatgcagcctatcacaaatcacaaaacaaaacaaacaagtttattgttctcatttatgctagatcattcttcctttgctttaagaatctgatacatattttaaaaaatatagacatttgaatttagaatggttctatcatcaaacccttaacctgtttatgcttgaggttgcaattttttgaatttttgcaatcagaccttggcgacaaccttgagcagtaggatatagataactcccacatgcttagcgttccaataatggaacattaggcaaaaataggcttccattcccgtttactaggctaatttcataagagacttgctctctcttcaacgtaagcgaggttgccaaagtggttcatgtgagacagaagtgacagaggaaaagatttatctgcttttgggggcagggagtgatttcttccttttagatttgagatttttccattcttattacttttagggacaggagatcaaaagttcagatatgtttcccaaaaagccactgttcaaatgcatagggtctatgaggaaagggctgctgaaaaatcttccttggatctttccattagcataaatctatggattgactaatttccaaagtggaacaactgtccctggaaactgagatacaaggcagacatctttcagaggagaaaacggacagtagggaatggcagttattgccacaagttaatgggctctggaagcttagttctcctggaggtcagcacctcatgatggaggggattgcacaggtctggaagaacaaaacttatcacttgcctgagagtctggactgatagataccaattttactggttcgctgtaatcatagtgaaagtctcctaaatttcctcatcagtttatttatttgtttacatctctatatttctcaatggcctcggagctccttgaggtctagactttattttacccaaagctatcctgattgcctctctgagaatatgcacaaaatgagactttataaatattggttggactgaattaatttgaaatgattaggttacttctactattccatgatcattttaacaatttatatatgaatgcgaagattaccaaaaaagaaaaagaagagaaaaataaattccagagttgtttcttgagcaatgtatggttgagttgacttgaaacatatacaggggtacagtcaattctgctacaacacaatatatgcatttgtaaaaatggcttgctaattgtacaataaaaattttataagaaaagatttaggggagaagtagggttaggagtacaatactcaaaaatttcatcagtcacacataagactataaaaacctaataaaatagtagcagagttgtatacatgctcagtgtctaataaatacataactactatatacaatagctataatactttatgttaaaaagagctacaactttccagtggaagtgggtgtcagaaaagctgtgatttcttgttaagtagtggagagagtgttacctgaaataggaggatggttatatctacacatctggatggatgaggcttagaaggcttctgtgaatgtagataccgtattgatgcttaagacctatatatgtgtttgtgtgtgtgtggtttgtatttttctatggggctcactttttttccacattcatctgatgcttcttgatgacaaaacaggcatacgtacatgcaagatctgcattacgttgaatataatttaataagtgattattatatgtttttttctaatatataaataatgcaacaaatatgtgactttaaacaagtgctttgaggtatgtatgcaccttctgtcacctgtatcttctgccagaggtaaaatggtagtgatctgctttctgttcaccaaatgaccataactgccgagaaaccatatctgcgatttttatgttattcttcttcagtgaggatctggctcggttttgtatttgtcaaatacctcaaaatatttttcaacatttgtatttgggaaaaactcaaaatacactttgccagttgattttttaatacacttaatgaacaataatttaatccttgtgtttctaattaattttcctgcagttagttaaaatactgctaagaatttgctgaataaataagcttaatactatgtaaatgttctttaaaaaaaaaaataaatcaaaccaattcttcctgagagcctttactaccatgaagtttaccttcaaactaaacggcacattttaaatttgttttgagtgaggtatgtctagatttcatgaagtcattgttcaatgtcctatgaaattaaatgtgtacaagacaaaaaataggaaaagaatattggtaatagtatactgactaattggctggtagattgactgatcgatcctgcctcccattctttcctttcttatttcattagctcacgatcccattctttcaacaaacctttatcaaaggcttgttatgtaccagattctctgctagggtcccacaaaatgtgtgtcacccaatggaaaatacaaacagataagtgaattattacaaaaaatttagatgaccaattgtcttagaccattttgtattgctataacagaatgcctgagactgagcaatttataaggaacagaaatttattggtttacagttctaaaggctgggaagttgaatatcaaggttctggtatctggtgagagctctcttgttgcatcatcatatggcagaagacgagaatgagagagagaacccactcctgaaagcttttttattaaagctgtaaacctaagccagtgagggtggagccctcacagcctaatcatctctgaaaggccccaacacttaatattgttacaatgacattagatctcatcatgagtttgggaaatgacaaaaattccaaccatggcaacaatatactaagagtgaagagcagttcctttccatgagattggatggtcaggatatcagtgtcaacccggaggggtatatctaccttctcaagacaagcatctttgctcatggccccaccctgtcccacatttgggcctcatcaaagaatccttagaaagaatactttccacatttaggataggttggaaggatagctgttgaagtaaataccagattcagaatatacaagatctaggactattcactactgcttcacggaatagaaataagttctcagaataagtaaattgttttctgaagactttcacacaactgggaataagatattttaagttatcctactcctctagacacaattattacgggagctcttaggaactgaagatgggagagtagtcaaacaatgtttcccccttttaatcatctcgcttcttatagaataatcttgatggcaataatttgagggtttgctcaagtggcttattgaagaaatgtagctagttgggtttttgagtcagacaaatctaggtgacaattctggctgcgctattttctagcattgagaccttggacaatctgcttgacatttttgaacttaattttcctcatctgtgaaagaaagctggacctgtccttcaggggtgctgtgaggagtagatgcagtaacacatggaaaccgggagtacctgaccttgttcagagcaggtggttaataaatgatggtagttaatttctcaacttctcttcttatggaatgtttcttgctaatagaatctggtctctctccctctgtcctcctatcattatagacaactgtgatgatccactagcatccctgctctctccaatggctttttccagttcctcagacctcactggcactcacagcccagctcaactcaactggagagttggtaagtaggctgactgaaatcctaatgccaagcactaaataattacgtggtgggtaggtgaaggagagtgagcactctcagacactgaaatcatgtccaatggccgtcttcaggaaaatatttacgaggagaggagtgaaaatctaatgtaagcatacttccatagcataatagtcattcaaagtatgctgacttgtgttcacccaaatcacagtatccttttttgattatcacgagaggtctttgtgaaaattactttataaaaagcacttgctttatttttatatttccatagctaacataaatagatataaaacatgttttataataaaatatttataatgaatgtttattaaattttctttcaataagtttaattttacttgaaaattaatattgctgatttttaaaatacaaaaatactattaattgaaagtaagaaaatataaataatctgttattctaccagctagaaataactgtagttaagtatatggtgtttatctttaacatctgtgtgaagtaagagcacctccttaactaatctctcatatgaaatgttgttaacaaatatgatgttggatatctaggcagatacgttttagtcagatttggatgttgacttttctaatgcatagatacataggtagataaatactgcaaaagagatttgaattatttcaatttttaaggacttttaggtatctgatagtatcttaatatctactaaatattataaacttttcctaggtcaagaaaagcgtgtatgcaatttaaagagagctacgggtctattagagtttatattatttaattttgagtatattttccattgatatcttaagtaggttacattagcaggtttttgcaatattgaaccatctttgcattctggaataagttctaattggtcgttgtgttttttttttttttacacgctaactaatttaatttgttaacacttgaatttataattttaatctccattattagtgagattgatttatagtttttgcttgtatgtttgtttcctgtttgtcttgtacttcatttcaccagttttctattaaaatgggattcataatttaaaagttagcaagtgtcactggtttgttgagaaagctgtttaagaataatattctaaaaacaaaagaatggccaaagattcaacaggaaaatttcaattaaaattttgtactaatgtcctttgctgaatattctgtgccaaaaatttgattaagcattttagttttattatgatatttagtcctcacaaagttgttgcaaacattattaccttttaccttcaggtagggttcctgaggcatcagtttcccaagacagaaaaactagtctggggaaatgcttgcattcaaacctaggttatctgaattcaaagttcgtgtttatattcatcccgttaacaaatcgcttcactagtacagattgaaaaggggtgtagcagcaagaaaataaaaactaatcaatcaaccacagttcaaatgcgagctatgccacttaaaaactctctgactgtgcacaagtcacttacctctgccaacctcagttttttatctgtaaagtggcccaggaatgtctgccttgcaacattatgtgcagattaagatcagacttgcatatccaaaatatctttcttacagcagggtagagaactgaactggagcaggaagcccactttccatttcaggaagaaacacaggttggcagaatttaacacggtttccaacagagcttccagagaaaggagttgtctcgatcccacccaaattgtgcagcagcagaaagcaattactactgcctaatagctcctgagcagtttctgggggaagctgtgggtctgatcacaggccggctctctccctgacagacagatattgagtgaggacaagtgtctttgctccaacttattataatttttcggctcaccggggaatttgagtgcctgaatccaaggctagcataaatgtacagagaggttcacttttcttccgtttcccaacaagagtctaaatcagaaaggccaagcagaagacatagtgatacagttgggatgcactgacctagaactcatcctctagtgcatattccaagactcccaagggggacagcctctcctttactcaccgaggcccaaccacggccctcagtgggaattaaacactggctcagggagatacggtatcagtggttctcatcccagggctgtgcatttgaatcacctggagagctttgcaaggagcattgcctgagcccatttttcctatgttctgaattaattgtcttggatgggacccaagcaaggatattgataaagtgaagaaacaaaagcttccaggtcattctaaaatggaacaagagttgcaaattgctacattggaggaattcatgagtaaaaaatccttctattaataattattgagtcccagtatttgtcaggcattgttctagatccttgacacacagttggcacaaataggcacaaacagtattcataaagagctgacatggataataccattaccatacaattacaaactgtgatactgatcaacagctaacatttgtcattagtaataatatcaacataattattttgttaagtatgtccagatatgtatttctactataataaaccatgtatatgtgatatatatgtgtatataatatatagagtaaaatgtatatatatatacacacacatatgtagttgaatatatacagtcagagtctgtcatatacaaagaggtggatatatacaggtttggttatataaatatattcatacatagtaggatgaatatatatgtttatatagttggacatagtaacatatacatgcatatacagtcatgtacaaatatatacatatgtggtatacagatatattaagataaaacttgaaagtcattatattaatgctattaagaacagattttgtttcatgagtggaaaaatataacatttagaaagttaagaagaaaacttataatttttgtttatattggaagtatcagtataaaatactgatttatttgcttccttttaagaccaaacttatgtcctgtctatgcactgacatggcttagaagcaattataacactgtctcaatgaacactcctttttaatgtgtcttcctttaaaacttatcttttgttttacaaagaaaaaacatgcaatatatccaaaagagcaaattgtaccacatggtttgaaatctcagatgctctcgaatatacatgcagatgtaaaggagcatctctccggatggtgagattgtgtgcctaagaattacaccctccctcttcccctggttgtaagctgatgcctggcagcgcacaactaaaaattataacaccactatattgagaacttcccatgagccctcaatgttctgagcccttaaggtacaccaattctatactcacaactaccctttatgtagatgtcattgtgatctctgattcataggtgacacagagaggaaagcaatggccatgcccggctttcacccaagtgatctgaatctgtgtagtgctattggccaaagcaccacaacactatcctgcccagagagccagaataacttcagtgttttagacagggaaagctgtgtgtcatttttattagttcacttacttccctccctcttatgtgattgaagtataattgacaaataaaactgtatacatttacagtgtatgaaatgatgatttgataggtatgcattttgaaataattaccacaatcaaattagctaacacatccatcacctcatgtagttatccttttctttgttttgtagtgagaacacaagacctactctcagcaaaagtcaagcatacaatagagtattattaactatagtcaccatgctgtacaattatattcagagaatgtattcatattagaagtgcaagtttgtaccttgatcaacatctctccattttcttcacaccccagtccctcgcaaccactgttccactctctgcttctctgagttcaacatttttcagattcctcatataagtgagataatgcagtatttgtctttctgtgcctggatatttcacttagtacaatgcccactaggctcatctatgatgttgcaagtggcaggttttcttttttatggatgaataatattccattgtataaatgccacaattttttatccctttattgatcaagaaacacttaggtcgcttccgtatcttggctgctatgactaatgctgcaatgaacattggattgcagatatctctttcagatactgatttcatttccttcagatatatacaaagtagttgtattactggattttatggtagtttcttttttttttttagaaacctccataccgtttcttataactatgctaatttacattcccaacaacagtgtaaaagagttctgttttctccacctcctcaccaacacctatctccttctttataaagagccatcctaacgggtgtgaggtgacgtctcattgtggttttgatttctattttcctgatgattagcagtgttgagcatctttctgtgtgcctgttggccatttgtatgccttgtttggaaaaacgtcaatttagtcttttgctcatttttaaattgggttatttgtttttttgctactgagttgtacttgttctttaaatgtttgggtattaaccccttatgagatattcggcttgcaaatattttctccaatttgatagtttgccttttaatttttttaattctttttcttttttgtacagaaggtttttagtttgatatagtcccacttgctcatttttgtctttgttgtctgtgctttagatatcttagcccatttcagtttcttatacaagaatagctaaaactgggtaatttacaaagaaaagaaatttatttcttacagtgatagaagttgagaagtccaaggtcaaggggggcagatttggtcagggtcctcttgcttatggggactctgcagagtctcgagacagcccagggcatcacatagcaaggtgcctgagtgctctaacatggtagctcaggtccctctccttcatcttataaagccaccagtcccattcccatgacaacccatcaatccattaaaccattaatccattaattagtaaatggattaatctattcatgaggtcagaatactcatgagctaatcaatcatctgttacgggctgcacctctcaatactgccacattggggattaagtttccacatgagtttcacaggacaaacgttcaagttatagcagtgtcatatccaaaaaagtatcatttactttggaaagcaatgagcaatcactctgagtgtgctgggcatttctccactctgccttgttcaatacactgagccatattttataatattctgcctcaacacttcaacttccagcatgttctcctccctaacagatttgctaataaatgcagtcacaatggtctgctttatatagcctcattctattctctcttccaagagggtatggtgaacctgcctccttcagatctactactcaacaccaaatccctgccccttctaaatgtccaaacaccagattttacacacacactccctctctccctcacatacacactcacaaacacaaacatgtgttcggaaaaagagtaggtactaagatacacatgcattattttaattcccagggaatagtttaaaataagtaagtaataaatacttgtcaaagtataattttcaataagttaaaaacatagctctcatgcaaatataaactcataggtcttatacaaatataaactcagcacatcgtgtgtatgtgtgtgtgtgtgtgtgtgtgtgtgtgtgtgtgtgtgtattaaacttattaaggcaggaaccagtaaaatggtaaagctaattcaaagagtattttttgggaactgtgtattcagagacatttggtgagggtggggggaggcggaagaaaataatattggaataaaattgctaggtagatacaaaattagttaatgtatgtattagtcaagattctccagagaaacagaaccaacgggatatatatatacacatacacatacacacacacgcacacacaaatacatatatacacgcacacacacacatatacacatatatatgaaatcatttattatgaaaatgggctcacatgattatggaggccaagaagtcccaggatatgctgtctgtaagctggagaagagggaggctggtggtgtaattcagtctgagtccaaagatctgagaactgggggaaccagtggtgtgaccctccatctgaggcccaaggtctgagaaattaacgaaccactggtatcagtcccagagcccaaggacccaagaacctggaattctgatgtccaggaagaaaagaagatgaatattccagccccaggagagagagagaaaattcagctttcctctgcctttttgttctatctggtccctcaatggattggatggtgcctgctcacattggtgagggtgaatatttctactgattcaaatgccaatattttccataaacaccctcacagatataaccaaaaataacactttaccagctgcctggatatcccttaacccagtcaacttgacacctaatagaaaccatcacaatgtcttacagggttataaaacttgggggttataccttctctattggacacacatttataagttagcatgtgacaacttcacagtatctaagctctgatcacccaggaactagccaaaccaaatgacatgtgcatttttctggaaaattaaataattgttaaatggatttgcttcaaattgttccaggaggatactgaaagatcatactatattttcttatgatttcaaagctttagatagtgttttcttaacacatttattcattggttcatttattacagtaattagtgaatttcttctactctacaccattcagccttccaacactcttgtcaaggaacatcctggtatcccactgggtatcccactcaagatgaaatttaaattgtaaaacccatgaccttcagagcatcaaatccccctcaaaaggatagaatgtcctcaataatatccttgtacctcatcactgctgaactatttcacactgatgagctcccctgcaagtttttgggcatcactgaaaattgctgagtcccttgatgattatataaaaccttggcaaacattgaacataaaggactagggaacactttacccctacgtgtgctcagaactcaggtagactcatgtctgccctatacccaggaagaaagtgtgcgtaactgatcagtttgccatagcagaaaagaccaactcaaacattgaaataaagactaaaggaaaaatgtgctgggcaaatgttaacctatgagctcccccaaccctaggtaaaccaagtttaatgagttccatcaataacaaactaatttttctgagagaaaacacacacttggaaacagctgttgggctgtaggtattgctgtgcccatcaaggtctgggcaatccggcacacgaggaggggattaatagttaaagctcaactataatagtctccatgctgctatctcatcgatagaagggatttgccaaatagaatttttgttctctcacttccacaaacacttcagccttcatctcatcacacacaaaaaaaatgaaaagcaaggaagagaactaattacttttggaaaaaagaaaaaacaaacacaacaaaatacattaaattggaggtcagatcaccattaacttaggttgccaactcaatctatataattgtggcttaggacggatcagtctttgtcaaatatgatttgttttgtggcaagaaagcttttgatctcggcattagagtcagctgggcttcagagaaagacttactgtccgcaggaagtgcaggggttggtggtatatagcatgaagccacggagttgtgggttaggccttcttgaaaatgaaggggaaggatttaagttactttagatgattaaaaggaaaatagaaatagacatctttggccccatgagaggagaggtttgtatttttctattgcatgttttttttttccaaatagagtttggaaaccattatgtttatcatttgttccttgaaattttaatccgtcttcctcactcaatgtattttttgagatgcttgcctgtgtaagttgagattgtgtgtttctagcatgacagttttgttgccatggagaatttgatttcttatgtcaaggcattttcagctccctgggctcatggatggataaaaagatttaaaatccttacctcccgctttggcacagattccatgcacacttaccaccccccataccacttccttgggcagtacttgttacaaattgctaaggaccctaaaggtgttctgaagttggttttcatcttgatgtcatcaggccatccatgaggagatgagggttggaagcaagcaaaaatcagggttcatttgcacaattagcatttcagctgtctagggactttttccagattacaagggaaaatcctgggaacccaatttcataaacaacactacaacgtctgctctctggaggcaacatgagtcttctctctggatttattaagccccatagaatatatatctaatctactctgttttattttttatttatttcttttgtgtgtgtgtgtgtgtgtgtatatatatatatataaattattattttttttttcttgagacagagtctcactctgtcacccaggctggggtgctgtggcatgatctcggctcactgcaacctctgcctcccaggttcaagcaattctcctgtctcagcctcctgagtagctgggactacaggtgcatgccactgtgcccagctaattttcatatttttagtagagacagggtttcaccatattggtcagactggtgttgaactcctgaccttaggtgatccacctgccctggcctcccaaagtgctgatattacaggcgtgagccactgcgcccagcctctaatgtgttttaaaagacagtaagctatacagaaatgggtcagtggattaccccctctccctgtgaaccacccttctctcttttcagcacctttcctttcttgtgtcctgtcctagctgtcccaggcatggtaagcatccaaatctatgctttcctctgtttcatcacactctcccttcccagtcgaattgtgtatggtgggtagaagctgggacatccaccaggagcttgttacaaatgcagaatcttggcttctacccagaactcctggatcagaacccgtgcattaacagctggtgcttctgcaaattgaaatttgagatgcagcattctagaggatcactgaaccttttgttatttcagttctcacctctatgacttatttactgtggatcttaggggtaggagagagtagaaagaatcaaagttggctaagttattaaaaagaaggaattgtgttgaaaacttttgttcttcatttctgtcatcacttcagtactctggtactcatttttctcattttttaagatggagaaacagagtcagagaggttaagtcagtggcccaaaactacacagctaattttggtagggcttgaatttgaatctaggtctgtctacttcacattaatcaatatctttattgatgttgatgtaagatcttagtctgaataaagatgctcttgacataattagctttcaggtaattttggtattcccttagggttctcagtattttaactaaaataatagattttcagacatcaaggaagaaagagaaacctatatatcttgccttttgaatgcccctaaaatcatactgtgtggcctaatatgcctgagggaaaaactaaccttgacctggatatttaaacaatgccttaggcctcttcttttactaggacagctatagatcattgaaagatacaggacagaaaccttctgctatttaacaggagccttgggaccctgtctcaaattgagacaaattcaatgtgatagccctctattcaggctggctaattgcaaaaccacatgatgaggaggaggagaaggaaagggattatagaaaatttgttactggctactaatcaaaagatttgaacatcaccatttggcacaaaaaaaaagttccaagaaagaagcgaatttcatgtacttcatcctttacttttttttttcctgattgtaagtcacttcctttgaaaggccaggttgcgatgacttctaagcagcactccatgaaatgcagtaaaccatcactttgatgtttctaacactttgcaaagagacaagagcttctttaattcattagttcattgaatttaacttaaagcattgcaacaaaactgtaagaatagaattaagagcatgattattagtgacatatttgtctagtgattggcagtttataacagcaatttacaatgtcagtttacaatgttttcaatgtgtgtcacatttaggaggaaataagctatgttcagctggaacattgtgtggtagatgtttttccttcgtctaactgggaatagttagaaggagtctactggatatgttgttggatactggagtcttcttctcgagaagcctttcatttaaacattgtggacatgtccttaaaaacatgagtttaggtttactgaattctccatgagaagtgaaaatggcaacatataacaaacgccaaagaaacagaaaatgggagttaatataatcctttagttcatctttctccagattttcaatttgaagactccttctttcatggtgaccccctcctcatttctccttttgagtatctcactccttgcttatttcagttatattcatctacgcaattggttgatcatgtctggactttaattttctagccaatgaaaatgtttcattaaaaatccagatttgatcaaagaacttttatcatttgttttgctaaggactggcttctaatgaatcttttctacaaaaaatatccatggcaatcagaaagcgttctggggtatctttattggtgtgcttctgtgtgtaaataacagaaaatccagctcacactggttgaaaaatattaaattattcagattaggcacataaagattgaaaggtgttcatatttctatttccagaacagggtggttacaagatcctttaccctataatactttattaagctgaacattcattttgtgagactttttgtatctgtgggtttttttttttttcattacaaaaggattaaaggtaaaaattaattattaaaaacaaaaggaaattctcaaaaagggcaggctccagggctgccagatttaattcaacaataccatcctcagtggcagcattgtcctggaactgataagcctgcccaacatctcagccagctttacaacattctgggaatcaatgagaccatgacctcctgtggcttgttttttaagctatcagagtgtgagccctggaatagcagcataatgaacatctcctaggaacttgataaaaatgtagattatctagactcacaccaacctactaaattagaaattctggcagtagaaacctatgttttcccaagttccttaagtgattctgatgctcacaaaactttgggaagcacttcttagagcactgaaactcttcaaggatccaagacccagaatcaccctttcctatttcaccagcttccacaatttggtcatctgcccagtcctgaaacaatcacagtcaaggaggatggaattaccatcgctgaatttacattcattatctgatagagaataatcaaccatgtctataaatcttcattctatccctttctctctccctttctctccttctctctctcctctccttctctctttcctctttctctcctttctctctctctctttcacagtaatacaattcaatacactcatatttaatcattttgtgtccatagttgtgatgcctgtgagtttatatatatatatatatattattttatccatggtatggtagacactaaccatactatttttatagaagtagggaaatcacttatccaaagtcacaaggtagaaagtgaccttttaaactcaaaaacaccagaattcgaccaggcactgtcttttaaaagaaaattgctccaagaatccaagttaaatgtaatatgctcaactgtgcataaagtatatactgctcatgagaaaaaaaatgtaagtggtaatgtcatcaatatgagatctgcagtttcaaatcacttccaattccagttctcccttttccctttgataatcttgggagagtaatttttttccatatgcctaaaaacaggaacagtgttttaccttgctgctgaatcttctatatatatataaaatcaggtatacataatccactagaatccactaacaatctcttagtcctgagcagcagatgggcagagttagagtgtattgatttgccaagttaaaattgaactgagcctctactcattttataagagaaattttacaacagcactggccgatagaaaattctgcaaggatggaaatatgtgtaagtgtgctatgcaaggtattcactagcaacacggctactaagtatttaaacgtggctactgtgactaagaaattcaatttttaatttattttaagtgaaatttaaatttaaatattcactaccatattgaacaattagttttaaagcctgtaagttttatatacatgacactcccatccaagttttttaaaatgcctgggtgtttttatgcacacatgaatcagcccttggtctgtaggggtcatgaatatggaatatccatcttgggtctgaactccaattcttcccagcccagactgccctcctgccaaaccccctcacttcttttataacttctgaactatgaaacaggcagacagacctcctttcctgctccatcagggccttgattgctccatttttccaaagggaagatatttattggaggacatcagcaaaactgtcttgagtactgagcgtctttcaaaataataacacagctttctcactatagacactgacagacacaccagtgtgaagccaggttcacacactgtctcagaggctgttcgtgctcatatgcctcagacttcaccatttcagccaaaagccagcatcttggaagctgagcagagacaggactttttgtggaagtaattattgaggcggtggtctctggagatagggcctgagggaagcagggtaagacagaggggaaagctagcaagagtatagtctccactgaagtcaaggttccttcagatgccacaaagatgttctagacctcagactacactgtaaagtctgtcatgccttgagacactgggaccagccttttgaactttgtatcaatctgacactcgctgagttgaggacatgggaagtgatagctcccaggcaagaaggcttctctttggccaaggacaaatctctggaaaaggggatagttctagttgtcatctagcactcacagctgaaggatgagttcacctgctagagaggatctggatagagacctgagaacatcctcaacaagaccactttcaaccctaagagctaagcttctcctctcggtgtttctctctgtgctttagatgccaccctgctcttcagaagctctcaattaatacctgaccaagttggtgtataaaaaccccagctccctcccactcaaatgagataaccctaaggtgcttcctatcccactgggatgaaactcactcacagggatgatgtcctgatgatgtcccatagatgggctttcctttctgctctgcctcatcttcctgggatcacttcccaaatgaactacttgcattcaaatccttgttttgtaactgacttccaggaaagccaaactaagtcatacacagaatcactctccctagacattactcttttggcagccatcaactataataaccgggtctgattattatccaaaatcaccactcccttaggtgaacctcctcttaaaagctcctttgttgttttctgcagactggtctcaatcagggtcattccagattttcttacaggtgtttatcatttttgcaacccacatggtgcatggtgtgttggcaagttcccacttatttatttatttatttatttatttatttatttatttatttagtgatgaagtcccactctgttgcccaggctggattgcagtgtcatgatcttggctcattgaaacctctgcttcccgggttcaagtgattctcctgcctcagcctcccgagtagctgggattacaggcacacatcaccatgccctgttaatttttgtattttgagtagagacggggtttcaccatgttggccacactggtcttgaattcctgacctcagatgatccgcccgccttggcctcccaaagtgctaggattacaggcgtgagccaagttcccactttattttcccctggttaactccttagtccctaattaatgtggaactggaagtgcaggaggcgtggcctggaccaggctgcaacaccttagccttcctgcacctgcccaggagcagaaagattacgcccagggttcttgccaacagctttcctcctcaaagattcttgcccagccacaggtcctattacacatgggtgatcccgttctacagggaggagcaggaagcccttctgagtgctacaagcatgtctgtgaatgttgttattactcttacacatactgcataatgttcgatatttatgggagagcctctttctgttattcattaccattaccaggtagctgtgtccctaaaacatctagaacttttacttacagaggcatcgaccatttaataattaaagatgtggctagtgattcaagttagcctcacagtaatttgtgagaatatgcttgtagtttcatagggccttctggaagacagcagaagtaactgcctgggaaacttgtttcctatagggtttattttaggctttaaaaaaaaaaatggtcaggctgtatttttaaaacagattaggtgtggccaggcatggtggctcatgcctataatcccagcattttgggaggacgaggcgggtggatcacctggaggtcaggagttcaagatcagcctggccaacatgatgaaaccccgtctctactaaaagtacaaaaaattagctgggtgtagtggcgggcatctgtaatcccagcttctcaggaggctgaggcaggagaatcccttgaacccaggaggcagaagttgcagtgagccgaaatcacgccattgcactccagcctgggtgacaggagcgagactctgtcaaaagaaaaaagaaagaaaacaaaaacacattaggcatgaaaatgctatgctgctatgtgtgtgtatgacgctttcaactccagttggtcttggactaaatgtactctctttttttgaaagacggttgtgaaatatcgttttgcagagactagtatataatccattttgtgcccatttccagtgtgtggcatcaatcacttctcatttccctttttgagttagaagtggaaataagtgtagaaactgaggaatttctgcattttctactggttattctgcttcatgcttacagcctaccctagtgtgtgcagtttggaatgcaggattagcaataagtgtcttggtatatagaagtgagcatggagtgactgggaggcaggagatctggttttgttttgttttgtttttcttacttaaaactgcagctgggcatggtggctcacacctgtaatcccagcactcagggaggctgagatggggggtggatcacctgagatcaggagttcgagagcagtctggccaacatggtgaaaccctgtttctactaaaaatacaaaaattagctggatgtggtggcacacgcctgtaatcccagctactcgggaggctaagttgggagaatcgcgtcaacccatgaggcagaggttgaagtgagccgagatcacaccattgcactccagcctgggcgacagagcaagactctgtctcaaaagaaaaaacaacaacagcaacaacaacaacaaaacacaattgcttagaattctccatacaagtctattcttgctttcttaagatgttggttcctattgaaacctcaggcagggacttgaaattagaactgggttggagtgcagtctttagccatacatctgggttagctgcctggcccattgaggctgctttgaaaaaatttaaaaagggctactgctgatttccatgagaatcaactgagatactggaaacaatgtcaaggtgaattatgtttctagtgagaattgctcttatgaggaagcaggaggacaaggacctgagggatttgttggtgcacttgagaggccgcttgtagcccagggaagacctgggtgctggatgcaggtttcctgggtctggagctcctgcattgctacttcctagtttatgatcttggaaatgctacccactatcctgtttgcatgatggagatcatttgagaatctctcatctagtgtgacatcaggaacagagctgggtcttgaaccagattgcctgacttttggtacagcatctctattccatctattcctccaaagtcaaataatatagtttgcagagtatgaggcttggagtatgctagaaataactaagacatagcctccaaatcattttggatcttttgtttgtcaaacatttaaacaattccagatgttctctaaggtgagattattttctctttaaatgcaagtgttccctttaagtgtaaacttctttaaatatcctttaaatttaaactgcagagtttataggaatttttgtagttaatagccattgatacatcagccaaaattacagacagcattgcctcagtcaacaccttcaacttgccaaatgcacttatttgtatgtatgttatacccccaatttagagaataattcagaaacaagaagctagtgtaggtgcagtgcgtttttatagtgactacaaatagtttcttcaggctactttcatcatttgtgaaagcacatttattgtttggtggaaagaatgaaatgtttgccatagcaaccatggcaaccctgggtgtcttccctattagctgtaatgcggggagcatcttcaacagcaggaaagagtcctcggcaattatcacccagatagcatccctccattttaaaagctttggctgaaactcttgggctcagaaaatttttaacatgatgtgttgatgaatggtaacaacagctattccattttggttaatttgggggagattaataagctaagtttttttactgtgggaaaaagggagctatgattttctttagacaaatttgcagaaactttaatgctaaatcattctctatttttttgttttggtttgtcttggtttggtttagctttgatcagtcttttgttattttattctttgcaagctaaatttcttgtcaatttatttccttgtttccattcttcatgtaagttcttatcatatgctaattagaatagatgaaggaaaaactttaaagcatgatgaggaagtctagttgtgaactattgagggtaaaagagaaacagttaaggcttaagaattttcattttaaaaataatgatggtcacagaaacagcaaaagtcctatattatagcatcagctcccaaattgctgtacatattctttacgcaataaatcacatatgagtaataaaattctcagcttataaaagaagaaaatgttgataagggaaactatgttatatgcaaaaatcagaagagtataaaatcactcatacattcaccacagacaaaatcgccatatacatttattttctatcatgttttaatattgctgagaggggaccatttcaacaacattttttttttttactgagaaagaatgcagcctcatgaactgggcagcagaagacattgaataaaataaagaatatgtttagaattattttggattttttgaaatataaaacctccctctctataagcctctctgtcaattttgagaagctagagaaaggcagaggggaatgggaattgtgaatatgttgaggaagacagagttgaatgacaaaaatgtactcctagatctggcatctcagaatctctgctcaaatacctacttccagtgattttcctccttactaattttctggagttttataaactgttttttttcctgttgaagaataattgcaaatagctggatttaccctatgttttaatcctgggtgccaaattttccaaacttgctggacttcagtttcctcaactttatgatggagataatgctatttacttaaaaggatattgtatatttattcaagtagacaaaattgcagtgtcaaatagagtccaatgcacaatgacttaaacacaataagtgtttagctctcattcatctactaggtgaacgtgttcaagtaggcaagtactttccttcatgtgatctttccatactgtgattctgccatcatctagatcttgttgtcagctgcatccatcagtggtggaaaaggaaagcaagtggagaaggagcacgctagcctggaagtggcacaaattattcccactcacattcttattggagagaacttgaccacatggccataaccatgaaagtatggaaagctgaaaactgccattaagccatgcactcactgcaattctactaccaaagaaggaagagagaatggatattagtgactatctgccataactgccactgtattcataaaaaacacttaaaaatcacattccacaatagatgctgagcacattcccttccccttctttcctgcatttgaatcttctcaggaatggtgagaaaaaaaaaaagaaaaaaatcaaaacttttctcaaacaaaatctgctaagggctagctgcttactgaagaaaatcaaccacaatttgcaagatgtgcctttaagtcctctatttttccatccttaaagacagaataggattggctttatgccctctatcactctgtctgcattgcagtcctgtactatgagagactctgcaggaggagctggggctctagaaaactctcagttaccaaggagatgtccaaatgacttcttccaaggtggcgagaaagtagactgaaacatcgctaaaatgattttcaatgacatagattgaaagaaaaaggttattgattaactcctctaaatgaaaacttcaattacctctccctacttgatgtcctgagttgcttctatgctatctctacccatggcataatacagtctgcgatagctcccacatgggcttcagaagatttgtgaaacttgggaacagtagaagtgaatattgtcttttttactcctatgtgaaataaaaacagaaaatttaggctacaagtctttcaactaagagagaactcacattgatcttctgcaaacctcaggtgtgatacatacaaaattctcgggccaaaacagtttttgtatgtgtgtcagaatgcccctacatgtcaggtatactgaatcacacgagatccaagaatgttagagactctgtcatgcctctgagattttgtgtatgttgttccctcttccctggctaatctccatcgaactttccaccttttttcctaggatatggctgcacttgcctcaggtttcacctctactattgctatctctagaaggcctctctgatcagctcctgaggcattctgtgctctgtgtacctgctgtttacctcttgtgatggtttctttcacatcacatgtttttgtcagcctctctctctctcttcagcacccagcatactcctggtgctcaacaaacatctgccgaataaatgaatgatactcttcaaaggcatagtcggtgtcctttcatctttgtatctgcagcacaatatcttgaccatgataggttcatagtaaatattcagagaccgaggagagagaaggtaatgaaagaacactaaaacaaggaagagaaggaagaaaagaaggaacgatatattagtcagagagagagagagagagcacatgtaagcctagttcatatatatctgcaatcaaaggctgaagttgtaagaagagaaataaataaaacaaatgtcactaggagtttgtaagatagaagtcataatgactaaggaaatagggatggaagcatggaagatacagcttctggcatgagtcttaaaccatgagagagattttgatggaggtggagaatggaaagtaccagggggttaagtacagaggcagggaagagtagggcccatttgggggtagagtcatcttagttgaacactgtttcatttccctttgatagttgaaaattgtagctatgtgagacattactacaactctctctcactctctctgatcctgttccaggaactggcggttggtccccagcagattccaatgctcaacagtggctccagatggacctgggaaacagagtagagattacagcagtggccacgcagggaagatacggaagctctgactgggtgacgagttacagcctgatgttcagtgacacaggacgcaactggaaacagtacaaacaagaagacagcatctgggtaggacatctttttccttccaatgaataaaactgagatgtgctaatggtaaccagagtatatttccgtcattttccaatatccagattgttggtagtttaataactggtgagtgcccattagaaataattagacaatttttaaggcccatgcccggcatggttctacttcctaggaaaattaggatgtctgtcgcaaatagtttagtatgttcccctttttgtagtaaactgggtaattcactgactgagcctcactttcttcatctataaaaattaattaaaaaacagataaatgtaccaaaaagtacgattattaatgtgattatactaatttactgagtgtttattgacttattagtttattatatgccaggcacttcacatattttgtaacaacacagctagctcaattacatcatttgatcaacattgcccaatgtatgaattgtgacttggtaatctttaaaatctggcctgactttaaagccacgaagcagcttctattgtagatttacaaataattgaaaactaaaactacaaaacaagtagaaaatttagaattattctgtcattggaaacaatcttcagcttcagagtgaaggacagtttgctccaagttacaaaacagaactttcctccccagtcccagccccacactcttgacctcactgtgtgggtgaaaggctgtcagcaaattattaatggaggaaaaggtggaggtgaagcagatagcaaaagtcacctggaggtagcttcagaacctcaggcactgaataaaataagttgtaagtttatattatttttcattgagaaaataagtcaccattttttaatccaaatgtgtgtaaaatgtgaagatacggaaattaatagcatattctttccttttcagattctgtcctcttaaatcaatgccaatttatactttacattagtgttgtcttcacattcacattcccatgttggccccatctccctgataaaaatgaaataacttctgttttatatactcattgttatttgttaattgcctacccatcacttggggttgtaattgaaaacagtcataaattgaggattaaaattagttatggcagactgaatcctgagaatagtattaatgtcatctttattctgggtcacttgtaatattaggttataatatttataaagggcgtaagttttcttcattttcaaaaatagtctaaacagtgagtatacatggaaacaaagaggggaaaatagacaccacagcctacttgaagggagaggttgggaggacggcgagagtccaaaatctacctattgggtactgtgttcaaaacctgggtgatgaaatcatttgtacactaagccccagggacaagcaatttacccatgtaacaaacctgcccatgtaccccttgaacctaaaataaaagttgaaaaagaaaaaaaattgtattttggggactattttattttttctcaattttgaggtccccataaattattacaggttttcattttgtttcacttttagtttgagataagaaataagcacaccttccattttgaggaacaattttaaggtttttatgttgactttagagggacaaatcgatgtgggattttttgttttctctggtacttgtcattgggactggttgtctttagattgagttgtagctttgagttattgtgcctaatttttttgtttttaatcatgagtttcatcttctttagaaccaaataatctactttcagcttagcccctgggttgggatgtatttcgagggatgacaattcctctgggctcatgagcagggggcacaaagcctctttcacttcctcacccttgtcactttccctgtgtttctaaatgattccaagctcctcaaaggcagggatctctttatatgtccatttagcccctgtgcccggtatcactagacacatggcaggaacttattttggggtgattattaagagaactgcagaattactagggctccctgaattgaagggtgggggcaggagactttccccattccctaccttgcatcccaaacagccttgacatggtagggcaggtagaagttgctggatgggcagagaaggaaaggcagggccctccgtctacagtgaggcaggaaattccagcaacagctccccagagatgcttgcagtggctgcagggcaattgggagagaggcagcttcaggagcagccttttactaagtaagtacagggagaagtgatttgaggagggaccattacaacttccaatttaaagagtaaaatagagtggcgttaggcaggaataccatgaccggtcatgtacagtaactaggctcaaccctggaaaaataggtgtccccttaattaatactgggataactaacagttactaaacacctattacacaagatatgtaagcaaatgtaattctttatgtatattaaattgtcattctataaactggtgattcaatgttaacatctccaggaacaagaggcttgaggctcacagagcccaatccaagctcacacaaccagaaactggtggcaaaatatttcacaactaagatttattcctaaatatagttggttgcaaaactgtagtttctgtttctcttttagtacactgatttattttttatttttattttttgattttcacagaattgatttacttttctcacctcaaatgtcaactttgtcaagccaactctttaagaataatatgaagccctattgtttaattcacatgttgctaaatataaaagtgtgaagataccaataatacctatttgtatttgtgtatgttgtaaatagtgcttggactctctaaaaccctctaggctttcagggtgttttacaaacacttcacagaaatctgtgaaatttgccttgtggctaactaatatttattggtgatttcatcagattacgctgctggattaaagagattatcttgagagcttttctttttactttttatttttaattttaaattagaattaagactctgggtccaccaaaactaagccttataactaagacaagaacaatagtcaaacaaaaggttttgcaaaactgtctaaattgttttgtttaacttttcagaaaaagtcaatgtctaaaacatcaagtactggcttaaaggtggtttatcaagaaaatagagaatatatacatatatatctgtgtgtgtgtgtgtgtgtaaatatatatatgcatgtgtgtgtatatatatgtgtgtgtttgtgtgtatgtatatatatacacacaaatatatatatacacacaaatatatatatacacacaaatatatatttatatacacaaatatatacatatatatatatttggagaaagggtcttactctgtcactcaggctggagtgcggtggcacttatcatagctgactgtagttttgatgtcctgggctcaagtaatcctcccacttcagccttcaaagtagctgggactacaggcatgcaccaccacatctggctaattcttttgaaatttttaaaactttcttcttagagatgggttctcactatgttgcccaggctggtctccaactcgtaggcccaagtgatcctcccaccatgacctcaggtttacaggcttgagccaccgcacctggccaatgaagcagagaagctcttgaatgcttatgttcacctggtcttctgcggaccctcaaattttagataatatatagtttgtagtgctctttaaaattgatttaccaaacaatacatagcacatcctgaggatgggacaatccattcaccagtactgaagagatttattacatttcacaaggttcgcttcagaaaaataatcctaaaaggatacctttgcaatgtacggtagcaatttttcatgccctaaaaatccaatttggagagtttctgatctggcactgagtggaatgctcatgaatgaggtcaccaaacagccacttagtgatgcaccatgatttatgcacaagccagagtccctcgcttcactaaataatcaggcatgaaggtgtgtcagggacaaaccctgcaacaatgttcagaatcttagcagctccaaaacctcttcctgattggtgtgtagacatgccaaatcattacaaatattaaaattccgactctgggcagcaacatgagccaatgcttggtaaagtgggtaaacttgtttggaacaaaggaacctcttaactaagtccactcagaccaggtcctgttaacagtccttttgaaagatatgccagaagaaacatgtactgttcatgttatatccatgaataaccacaatgttgagccctttccttcatgagcacaattcccacactgtcagtgagggtcttctgccctaattcaatgtccccacatcctcagctattcatcacatagctcatgtcagtccccttctctaccctatcatctcctgtgaatattctatattttattaatattaaacttgcagttttctcttattaaaattatgttgcctctccccaaacagacagccatatagtcctttattatagacgcttttggcctgtgcactctgatggtctgtgatttcctgtaactttctggaatctgtcttaacatgaaggacttgcatttgttacctggcagttttctcacacagaggtcaattcaagcaatggattatacattttggtcatcagttccccgatttcatccttgagtgacttccaaattctctgggagatgctctctgatcttcatgatttatacacatttattctgccacgttgggcctagaacatcctgagtattgatcactgtttgatatagtattttaaccctaccaatttcagaaaacaatttgagagtgagaatctcatcaccatcaatatatatcttttaagctctcattatatgccaagcactgtgcaaggtgctaggcttacaaaggggcttaagcaatggtttttcccatttctgggtgtgcagaaccattaaggagacaaatcaatggcatgcaacacagtatatgtgtatatggtagcacggcagcagttcacatgcacgaagcttgtcagagagggtgttcctggcaatatatgaatgtgaggggcttagactacttgaaccagaagagaccatatttaagttatgttggcttgtcagcaactacagagtactgtatgtgtaacaaaaattcaataaatatacaaaaaaatgggaagagaaaatggtgaaagtgaggtgcattcacagcaggagaaatgctataagcaaaatcttaaaggaagatgtattaaggacacaaaaaaataataaattagatataagatatagctggttagtgatagaaaatgaatttgaagagagagactggatagatattgtagactaagagcacactcgtatctttttaagctaatacattattatttattagccattgtaacaaagtttgttaacacttctctgttttaattttttgttaaataataaagactacatgtaggaacatggtctcaaatatatttgtcaggattttttaaatggttctctcctttgttctctcacgcacatatactaataagcttttaatacagatattaatttcagttttggcaattattaaaagctcaattaagaacttagcatgcccagaatcttgctgctgatttaatggagaccaccaatgcaaaagcaagttattacaatgtcacagactaacagaaataaagtatagagggaaatgcagaggcttttgattacgatctgattacagttgcaccactggttgcttgcatgaccttgaaaatgtcccttaacacctctatagcaggtctttctccctacccagggcagggatatatctagaatcttccaggcccattgcatccattcctccacatttccttgctcagacactggttcttggcttaccctgtgggttgcaatgtgaaatacatggagataaagcctggacttcactatgaagccagcttagaatagtcaactaaaggatctcaaagctcatcattcaacttgaataatcccagtggttctgtcctaagctcttttgctgattttagatgatcttataactggatagagctctgcagaaaaggaaacagggaaaaactggccaatcagcattgtgaaagcaacagctggtcttcaccccagcttcagcaggctccctccagccctctggctccacatttagcccatgaaagctcctcactgatgcccatctgttttctcttcttaacactagaatttgctgaaatgtttcagagaatttcccaacatggggcctaacctctttaaggagtaaatgcactcacacatttacacatgtggcatttaaacacatcacaaggacagggagtcaatgtgtagtcttcaggattaatattcatatggacacgttctaggggagaccagatgtttgcagtcccctacaaactggttgcatgtgtagtgggataggatccaacagctgatatcaaaataaggaggatgatctgcttaaaattaattctcctaaatccactgctattaaattaatcttattgttaaggtgcttaatgattcccagcaatctcaacttgtaattgtattttcaatatgtataaacctgttagtcctcactctgattcctcttaatctaaagtgaatgtctccaaaacctaagctctgattttttatcttgcccaaattcctacctaaggggtctgtggagtcatgccctacaaaccatcaattctcctcagatgggttttatttgaccctgtatatcatgacttactttccaatctgactctggcataacaaggaagaaaataaaaatgttttaccccaaaatatatttccttgccatacctgggaattactctgccgtctcttgtggggaaaatccacattctataaaaaatctcctttcccctttgttttccttccttctcagatccaggatttaatcaactaagagccaggcacccttttaagtctgataagaaacattttacaacctgcactctctgaagtctgctatctgagaacttcctctgcacaacttggtctccacaatcctttagcttaacctgaacattcctttccattaatcccaggacttcagataaactcaaccaattgttaaccagaaagtgtttaaatttatctatagcctagaagcccccatccgctttgggttgtcccgcctttatgaaccaaaccaatgtgtttcttaaatgtatttgattgatgtctcatgccttcctagaatatataaaaccaatctgcacctgaccaccttgggcacatgttctcaggacctctggagggctgtgtcattggccacaatcactcatatttggctcagaatcaacctgttaaaatcttttacagagtttgactcttttcatcgacaagagttaatatctcaactttaacatccagcaaagtattcggatttttaaaatgtaaatatagtcaatgatgctagctaggtgtaatgactgagttgaagagatttttaaactaatccttatttatttaatgtttagctaacaaggatgaattcttttgtgtgtgtgtgtgtgtgtgtgtgtgtgtgtatgtgtttctttgttgttgttttcttatatagattatctcagctttgaagtgtgacatggattctgtgaccatgataaatgactaaaaccctaaagcactgtttttcctctgtaaagtggatgtaatgagggtagtcacctcatatgatctgtaaaggagagatttctcaaaaacgagcatgcttcaaaatgtcccacagaacatgtcaaggcaaggcctactgggctccgcctgcagaaagcattcagtagacctagggtgggactgagaatttgcttttgtaatgaaatctcaggtgctgctggtgctcctggttggggacctcactttgagcaacagtgcgtaaactttaaatggactgaaccatacaaggatctttacatagcattatcaataataagggatgtcattgccatgaaaggtaggtgtatgtgatgtgcctgggggagaggcccagaggacactggctctcagggtctgctttcttttgagctttgtatacaaaaggaaaagcaaacagtaagtcagtctttctctcacttgataaactaaatactcagtggaaacaataagatcttgtggttgcagatgaagacagtttacccaagcaggctcattagggaccattcgcatagagtcctggcagcatacaggggagctggaggaggagcctgggggagttactgatgcccaaagaaaaggactctaggtcaaatttcgaggccccaggtgtctacctggctctagccaaatggaaatattccaggcctggcaggaacatcaacaaaaccaagaatctctcaagtattttttttttaagttgaaaaaaaaaaagcaggcttcattgaagttattattgcaatggtaacaatcaacattaagaaggaaagcataatacagtaaccacaagtttctactactcttaagtacggtttccagttttgtgggccttaatgttaattgcagataaaggtaactaattttagtcactgattatgtgaggctaataaaagtagagagtgcaaacaaaataagtgtgagcaggcgttgctcttgtgtttcacgtctctgaccaattgcaattgtccatatgagaggcacatttcctactgccttgtaaccaaaggaccgttctgctgctgtggctgctcttggaatcagagagagaagctgaatgatgcccctaagtttgtctaacaccctagacttgtcttgaaaataattctctaatttagtgactcaagaatttttcggaagttaattcaggagctcataggaaaaagaaacagttttcccccacccccccaagtattggaagtacagagaaggactcataaaaattgggctggagttatttaaccttgaatactgtgggtgatttttttttccttttgtaggaagggagtattggaagtacagagaaggagtcataaaaattgggctggagttatttcaacttgaacgctgtgggtgctttttttttttttttaccttttgtaggaaggaagatgtacttgcaaaaaatctccccaaagaatcatggacccctaacatcctgccttatctgactgtaatttagggtatcaagcatctgttaggcacattctgcaggtactaaattaaggaggattcaagagtagaatgtggaaatttcctgtcagaggtaagaagaatgcatggacaggtacaaaatggaggaatatgcacagatgggcacatagatgagagcatgaagtttctgacttgtcagtagaagaagtgctatgatttttttctcccagaaaatattttgattttgcaatgattcagccacatttttgtcctacctgcctgtatttatgaaacaataattgagagctagagttccacgaatggactgtaaaacagagtagaaagaactgatgaacagaagacacagcaggtaagcatgagcaagctagcccactacgtgtaaacagctcagctgactgggtgtggcacctcccttgaatatgaagcattctgcatgtagatgagagaaaggaaaatgcagtgcaggtgcaaatgacagtgacccaaagccatgttcctctgagaagtagacactttcatgcctgggcatcctccaggccttccctatctagtgcatatttttgcaaaggcttatgttgtgtttcagacactgtgtttatatgtgagggctataaatatgtgagaatttaagaatgtatgtgtgtgtatagaagaagaaccaagccacagcttgggcggggcatcctaaaccccttaataggcacgtaatttaaggaaagatcctgtgcttaccagagaagctttgtttagaggcccgttcctaagtccccttgcatcaagcttgctgctcctgcatccctcaaacccagaaatgccaaagctgcaatgctggcataggtgtatataggttagttcatgtccttgattcatgggtgatgacccaccaccctgcccagcagagtccaggccatcttttttctgagccctctctggggagaggtggcagctcaaaaagcccttgagtcttgtttctttttctttggtggggactctaatctgttgctaatgattccttcatacactcccccctcattccacgtaatgtgtttgagttctcttcttgaaatacatttgtcatttattgaataatttctgaaacaattaaatgacaactcaatgaatggctttgtcaattttgtgtaatggaaagtcaaattatcatgtaggaaaagcaaaatctttctttttataacattgctaaaagacttcaaaagtaactgcataattataaaaaaatttgaggtattaaagtttgcaaaatcaataagaatatctcataaacctatttatttttggaaattgaaaccatacacatggacttatttaaatgtaaatgtaaagatgtgaataaagaccaatatttgtagaaggcgatcttattatttaagacaaagttgaaactttaaacatatacatctgtatgtgtatatatacacatatataatagtacataaaatatatatttatttacatacttaaattatatgtttttatatttgtagatttaaatacagtaagttctcacttaacatcatccatgggttcctggaaactgtgactttaagcaaaatggtgggtaacaaaatcaatttttttctcattaatgttataatgaaaagatattgaagaaaacaatgttatttgaggactcattgtacattgttttgtttaaagtctgaatttccaagaacttgtaaaagacactaaggaattaccgtatatacttttgtatatatatttaaataagtttaaataaatatatgtgtggtataaatatatgtgtctatacatacatatctttaattctcagcttgtttcatcttgatttcttcttatctataaattttggttattcaaactttttaccttcctatagtaaatagaggatttagaagatttttgttccactacctccttggcaggtatgccagctgccttactttaaaaagcaacaattgcaattcttcgagacaattataattcattgctttccctaatcagcaggacctcagataaatggacatatgaagatttgttgagagtattgttctgtggttcaatgacttgtgtgatttccttatttaaacaagaacaaagaagccaaagaaaataatgtattttaaaaataattgggcactacttatcagagtggttggtggactggatactaatcaggatagtagactccaaattattttttttccagttacaagtacctttgtttattcaacagtagacacagtgctggcagcaacctgtaactgtactccatggatttagataagaagatgatggggaagggggatttttaagtcacactagatcaggattatattgtttcatttgagtctcttttaattcaagtgtatttaataacattctcctttatgaacggatttggagcatgaactttggatttaggcaaatctgagtttgaatccctgctacttactgatggtttcaccctgggcagcattttatatcctaagccttagagttcacatctgtaaaatttttataaaacctacattagagcagtataagaattcactgaggcaatctacatagactcccaatgtccctgacatataaaaagtactcaagttagaaatatttaaatccttatctaaagaaaacttgaatgctgaccaagactttagcagaatcccaaaagacacatttcttccctcaaatgtaagaaaatattccctcaaatgtaaatgtatcttcaaaatatcccagctcctgcccccagatgtattttcctaggcctgaggcatttgcaaattccagaggccatggcatgccagtgtctgttggctctgctggtaaggggggcagtctccctttcgtggctcctgcgcagtccagcctttctcctgttgggtgatgctgctaagcatgctcccaggatagaggaagcatctgccatgcttgtgggtagacatgggttactaagtaacatgacagaaaatgtaagtggatctggaaacaaggtaaaccaccaggagagccagaaatttaacaatgaccagattttaagccactggcattttgtttaagtcagttcccagtaaaatcatttgagcatggctttagaataaaagctggggacttggttgatgatgggatgctgtatggagtaacttgatggaggcccagaatctcaggaaccatttgtcaacatctcttcttgcaacactaagtaatagcagagccatcgtacattcatttcagaatgggctgcctagccattcaaaatgagtgagtcagaatactgacttttgactaatttctagaagcatgcagttgttttgcaacttgtcctaccgcagacacagattccttaacctccttccactagataagatattatctaacaaggattcccatataagcgaacattttgttacgcgaaagctcaaatagcagcagagtttgtacaaagctgtggaagaaagtcctaaagaaagaatgcaggttagcaaggagaggtcaggaaagtaacagattttgtactagaagagaataggaataagcagccaggtgtggtggcatgcacctgtaatctcagctactctgaaggctgaggcagaaggattgcttaagcccaggagtttacaatcaacctgtgcaacataatgagactccatctcaattaaaaaataaaatatttaggctgggcacagtagctcacacctgtaatcccagcactttgggaggccaaggcaggtggatcacaaggtcaggaaatcgagacaatcctggccaacatggtgaaactccatctttactaaaaatacaaaaatttagccgggtgtggtggtgttcacctgtagtcccagctactcaggaggctgaggcaggagaatcgcttgaaccaggtaggcagaggctgcagttagccgagatcacgccacggcactctagcctgggcaacagagcgagactctgtctcaaaaataaaataaaataaaataaaataaaataaaataaaataaaataaaataaaataaaataataatttttttttaaaaagtaaataaaagcaatgggaataagggatcaagaaaaatgtaggagtctttaaggcaccaaattcagaatcatccctatttggggaaacttaaaaaatcttttaagagaggtgccaagtacaattatcacaggatttgaagtaaggaatccatgccccattcctggctgtgtcccttattattgtgtgcattttcatagccacttaatccctctgagcttccaaggctgtatcttatccagatgcacgtatgcagcccaggcacatagtaggtactcaataaatgctggctttaaataattaaatgtgatgtcattttcaagaaacattagctaggtaggtattgtgacaagtcacaagattgtttgaaaaaaatacatataacatcttttaactgtgtagaaaataacagaaatgtcatcagtttggctgaaacacagggcttgtgctggggtcctaagagataaggcttgatagatatattggctgatgtatcttatgcgtttgctcaggaaaatatggtacattgcttacatctgttgttctagagtaattattaattgagccacttgtcaatataaaaaaaaccttcgttcggataatatattatattgtcaatgtctttctagctgccatcaattcagagtgagcaacttatacttaactcagaaataaagcaaactaaggatatgccgtacctttgaagtatgtgtgacaagaagctggatgatagtattagttgctattacatggtgcttataccagtgtaaattcaggagagggctggcattttttttttaagtttaaagtttaagcatgaggaaaggcctatcgatagataaaactttggttgtgagtctccaatggttttataagttcaccatctttaggaacatacatgaaattagagtgtacaataaggcagtactgtagaaaccctaactgctaaggaagttcctgcagctggctcgtgaaaataatcaaggaaggagcttacctgcctctgtcgatttttattaaaagcaaaatgagtttatttggagaaaagatgcccaatagaacatggattagcaaattaaagaaggatatacttagttttactaagtttcagaagaacaaagtcactcttctattctatggaagtgtatgtaagagctataagattaaactcacttctttgggttagttttaaacttgtgcacaaatagacttgatgtggtaggttgaagagtgctcccacaaaattcctgtgcacctggaacccagatgtgatgttatgtaggaataaggtgtttgctgattaagtacttaaggatctaaaggcaaaatcattctgaaattagggccagataaatctaatgactgatatctttatgaaaaacagaggggacacctaagacaggtcatttaaagaaaaaggcagatactagagcaatgcatatacaacccacgcagtcccaaagactaccaagagcctctagaagctaggagaagaaaagggaagattcttccctggggttttcagagatcatgtgtccctgttggaattatgcttctggacttctggcctccagaaatatgaaagaataattttcttttgcaaatcccccagtttgtggtaatttgttatggcaaccataggaaaacagtactctttaaatattcattattttgcaacctctgctattactcctcacttaactctgagctcctctgctagggtgtggccaccatgcactgaacacagcagcctgcacacaataatttgtattcctccagggcacctagcacaatgccactgctggttcaatacgtccatgactggttatgcattgccaatcttctggatcattaagcctttgctcatactaccatcttcacctggaattctccttcaaattccccatactctcttgacacatacgtctccaccttctgtaaattcttcctcatctttcaagatctagttcagctctaatcccaggtctacaacaacacttctcctgattcaattacttcaagtaaaagtgatcctttgcacatctgcactccctttctcctttctgggtcatctcttcggacttggaacaattcttctctagatttggttataatccacccccctccgcccccacccaacatgttgctccatgcgagttagtcttgtccatgaaactggatagagtgattttggaaaacaaagtctcgtctgatttttaccttcatctctctacttggtctggtatggagtaaacattcaatagtaacttgctgactatttgccctggctgtctcattccacagtgataaaaccgaaatgttctctaaaattacttttccatcattataaatttgacttgaaagccatgcaattgatgcatttgctggggattatctttcgcccgtcactcattaaatctgtcctcatatagcaacaatatttataggaacagctagacgttagcccccaagtgagaaaatgacccatgcaaatgccctggcatgacataaatacccacagcaatgcagattgtgtgatgactctgctgggtggctacagttctggggtatgggcgatggatgagctaacttggagaaggcagcctagagtcgtcaggggaaagaagagggtgcagtacctcattaatttgttcccagccaacagttttcaaagattagccacataataatgcccctagaatatgctctttgtacatgaccaaagatgatctgacaggcatttcaaaacagtaattgttggattgatgacgctgctgaggaaagaggactcattatacccaatttggaagattgtgaatatgtcgtataaatgggttatgaggatgcatttgggtaaaagagctggacaaatgcatgatgacattacagtaccccaatgggtgtctcagacatacagtacattctctcacccttcattatttgaagactggggaacaatactgcatgtttaagaaagtacaagttcaaattgtggccagatgtacgctatggtaagggaatgaagtggttctctagtgcatatgcaatcctctagggacataggcagttgtgactgtgctatcctgtgcctcacttaaaaagaatccactggacaaaaaacatttcagcaaagaagattttatgatgactgccttctatgactcacatgccttcctacaataggacatgtatgcatcattggacctttgacattaaacaatctcgaataattttaaaagcatgtattaatatccagtaatactttttttttttactttaagttttagggtacatgtgcacaacgtgcaggtttgttacatatgtatacatgtaccatgttggtgtgctgctcccattaactcctcaattaacattaggtgtatctcccaatgctatccctcccccctccccccaccctacaacaggccccggtgtgtgatgttccccaccctgtgtccaagtgttctcattgttgaattcccacctatgagtgagaacatgtgatgtttggttttttgtccttgcgatagtgtgctgagaatgatagtttccagcttcatccatgtccctacaaaggacatgaactcatccttttttaccgctgcatagtattccatggtgtatatgtgccacattttcttaatccaggctatcattgatggacatctggattggttccaagtctttgctattgtgagtagtgccgcaataaacatacatgtgcatgtgtctttatggcagcatgatttataatccattgggtatatacccagtaatgggatggctgtgtcaaatggtatttctagttctagatccctggggaattgccacactgacttccacaatggttgaagtagtttacagtcccaccaacagtgtaaaagtgttcctatttctccacatcctctccagcacctgttgtttcctgactttttaatgatggccattctaactggtgtgagatggtatctcattgtggttttgatttgcatttctctgatggccagtgatgatgagcattttttcatgtgtcttttggctgcataaatatcttcttttgaaaagtgtctgttcatatcccttgcccactttttgatggggttgtttgtttacaccgataacagacaagcagagagccaaatcatcagtgaactcccattcacaattgcttcaaagagaataaaatacctaggaatccaacttgcaagggatgtgaaggacctcttcaaggagaactacaaaccactgctcaatgaaataaaagaagatacaaacaaatggaagcacattccatgctcatgtgtaggaagaatcaatatcgtgaaaatggccatactgcccaaggtaatttatagattcaatgccatccccatcaagctaccaatgactttcttcacggaattggaaaaaaactactttaaaattcatatggaaccaaaaaagagcccgcattgccaagtcaatcctaagccaaaagaacaaagctggaggcatcacactacctgacttcaaactatattacaaggctacagtaaccaaaacagcatggtactggtaccaaaacagagatatagacaaatggaacagaacagaaccctcagaaataatgccacatatctacaaatctctcactttgacaaaccggacaagaactagaaatggggaaaggattccctgtttaataaatggtgctgggaaaactgactaaccatatgtagaaagctgaaactggatcccttccttacaccttacacaaaaattaattcaagatggattaaagacttaaatgttagacctaaaaccataaaatccctagaagaaaacctgggcaataccattcaggacataggaatgggcaaggacttcatgtctaaaacacaaaaagcaatggcaacaaaagccaaaattgacaaatgggatctaattaaactaaagagcttctgcacagccaaagaaactgccatcagagtgaataggcaacctacagaaggggagaaaatttttgcaatctactcatttgacaaagggctaatatccagcatctacaatgaactcaaatatccggtaatactttcaaccagcatagcttaatatgcatcataaaacaaatggttttggatgagagaggtacattttttagctttaaaaggaaacattcattcattcacagagtaagagctgtacactgaaatgaaaataccatccaatgcaaaatatgtggaatcccttccccacagctctgactctagttagatataatacatgtcatacttatagacacacgtacacaaatggagtgcaattgtcacatcttaattttgaaaaatgactgtatttaccaaataattattcccttttaatatgtcattttaaaagcatcttgagagataattttatatttttattttttgtgggtggaaatacacctcaaattttataataaaattagaaatggcaaggagttctatgtatcagaaatttctttatggcaatttaagaaataaaattgtcattctgaaaagcgatacatatcaatatcaatgatagcccacataaatgaaggccatgttcatctgctaattcagtgaatcttattactaaagaggtagtggctattctgtgttgggactcatttaaatatagagatatctaaaaatataaatatcctccctacataaaactcttcaacaaaagcctcgctgcccaaactcccaacaatcttccctctcagcagaattcattgtctcaggagttttccccaactgtcccatgaagagaacacgtcgcactttattttataagctttttatttgtcttgctccccaaaagagagtgagatttgagagaaggcagaaactgtaacttacataaaaatatcaataacgattgatgataagaagcagcagcagcagtagcatcgatagcatttcccaatacccctactcctgccccaagcacaaatctgcctcattatgtcctgaattcccagcgtccaggtgggtggcagtgggagccctcctcctcaggagatgttccacctgcctgctacctgccgcagtgtttgccttgtaaccaggccattctgtactcaggagctacaggcaagttactatttctgcagtgacatttccttatttcttggctgtcaaaaacagaggctgttcaggtaccagtcctcctgctcttgagtaagagaagaaaatgctgtatttgtagtgaaaagggtgctggttcaacgctagcaggattttccaattgaaggggtcaaggaaacatgtgcagattaaacaagcacaatttttagtttcattatatttatatgatgattgtagctacttattagttatttataacccaccacagctggttcggtggctcatgcctttaatctcagcactttgagaggctgaggcaggaggatcagttaagcccacgagttggaaacctatgggcaacatagtgagatcttgtctctacgtttcttttttttttaattatccaggcatggtggcatgcacctgtagtctgagctactctggaggctgaggtgggagaatggcttaagcccaggaggtggaggttgccaccagtcaaaatcacaccactgtacttcaatttgggccacagactgggaccctgtctcaaaaaataataaatgaataacccaccccattctaagcaggactatgatgaaagatatataatagaaaagtatgatatgaatcaattagtgaatagtggaaaagaagaaatgattgtacacacaataaatccagtgtgaggctaatacctcaaattagattacatacatagtagagttttctatgacaagcgtcatctttgctaacattgctattgcttaagaaataccagcatcattctgtaaacttaataaattcagagagaaatattagcaatttatccccggttcaccttttacttctaaatgctagtcagattacaaaactgcctagatattttgcaggtcattgaaaagacactagagtttttgggtggaggacaaaatagaatttttccaacagcattctgtttttttttttttaatactttaagttctagggtacatgtgcacaacatgcaggtttgttacatatgtatatatgtgccatgttggtgtgctgcaccgattaacttgtcatttacattgggtatatctcctaatgctttccctctcccctccccccaccccacaacaggccccagtgtgtgatgttccccttcctgggtccaagtgttctcattgttcaattcccacctatgagtgagcacatgtggtgtttggttttttgtccttgtgatagtttgctgagaatgatggtttccagcttcatccatgtccctacaaaggacatgaactcatcattttttatggctacatagtattccatggtgtatatgtgccacattttcttaatccagtctatcattgatggacatctggattggttccaagtctttgctattgtgaatagtgccacaataaacatacgtgtgtgtgtgcctttataacagcatgatttataatcctttgggtatatacccagtaatgagatggctgggtcaaacggtatttctagtctagatccttgaggaatcgccacactgtcttccacaatggttgaactagtttacagtcccaccaacagtgtaaaagtgttcctatttctccacatcctctccagcacctgttgtttcctgactttttaatgatggccattctaactggtgtgagatggtagctcattgtggttttgatttgcatttctctgatggccagtgatgatgagcattttttcatgtgtcttttggctgcataaagacgtcttcttttgagaagtgtccgttcatatcctttgcccactttttgatgggattgttttttttcttgtaaatttgtttgagttctttgtagattctggatgttagccctttgtcagatgagtagactgcaaaaattttctccccttctgtaggttgcctgttcacgctgatggtagtttcttttgctgtgcagaagctctttagtttaattagatcccatttgtcaattttggcttttgttgccattgcttttggtgttttagacatgaagcccttgcctatgcctatgtcctgaatggtattgcccaggttttcttctagggattttatggttttaggtctaacatttaagtctttaatccatcttgaattaatttttgtgtaaggtgtaaggaagggatccagtttcagccttctacatatggcagccagttttcccagcaccatttattaaatagggaatcctttccccatttcttgtttttgtcaggtttgtcaaagatctgatggttgtagatgtgtggtattatttctgagggttctgttctgttccattggtctatatctctgttttagtaccagtaccatgctgtttttggttactgtaataatggtttacattattagctactggttatttttgctatatgtaggaagagaatgttttcaatccctacatgtcagagaaatggaaaccagactccccttaaaaactgtctggatgctcaaaccgtgggtgttcataagaaacttctgagttgattcacaaagtgagttcattttaaccttgtaaatgtttgatactatttttataagtaacaagaacaaatggccacttcctgtaacataacatagaaataatattccggttgagagtgttcgagtaaacaatgcagtacccaaatctatacccttcccccacacacacaggcacacacacacacatacacacacacacacacacacacacacacacacacacacacacaccaatcgccatggctaatatcaagattaggttcaaagacaccagaactcggacagttgatccttttgaggcaacataaatatggtcagcctgagagtcagtccagtcaaggttcctgggaaaactccagaatcatgtctgagggatgtactaacacagggcaaaaggttaggagcaagactgaaattaggttgtcagtggagagctcaggctcatgtggggtgggatggaatgagaccaactctggccaaggtaggagggtcctggctgattcccctcaaccatctgcagtggttttgtggctttgctcgcatgccagaggcagaacagacagacagccgacagcagctctggtcattcctgatattttatttgtgttcttcattggactggaatgctctgctactatgcgtgtctacttgtgtctgtgaagtgtgtgcatgggcacgtgtatctgagtctgtgtctgtgtgactgggtgtgtctttgggcatgcgacatttccttttcccaagttagtgtgctttgtgctgaaagccacatgaagcgtcagtaacacagacctcctaagagatgacagagtggctgttctcacccataaatggtgttgctagaggatgtggggagacttctcacttaaggtgctttggttaggaacatgtaaattcactgtttttgaaatgtaagtttcagacagggactggtaaaataatgtccagcctctctcacactgtcacttccccacctaggtgcacaaggatgtgaataaagctcccactgtgcactgctttgccatctggaatcccttaagcgagaactgtatcttttccagcgcagctcatccctgctcattcgcctcattccttggtgtcaatttcaccttctgccgccattaaggtccaaatgggcggcagggcacctctgcacactctaattatgctaataacggctcgctgactgcactaatggggtcattatcgcccctcatgaccatggggtgcaaatcgccactttaacatcatcattcctgtcctaatccatcactatccttcacactagccattcttagaacccaaaaaactctccctaaaaaggatgctttgtgcctgtgcttccaggaagcattcagagatgaaagcatgggggactgagggcaacatgcctggcagagattacagcaagttacggaagagagaaggccctctggcaaggttttgagatgcagggaatgaaactaattcatgggtaaaggattctgacatgaaattggaggtgcacactctggcttatctaggtgaccgagggccggcctgggagctagggacctgtcttctgctccagcagctctggttggactacacaaaattaatgggccttcacgtttccatttgcagcatgagaatggtaaaaaaaaacagagtcagtcaggttacgggtcagtgcaaagtcaaacctccaagcggataattcagtagccacaaggggacaaactgcaaagtcccaaatgtgtctagtgttgacaaccttctctcagctcgcactacataaccaaagcttatgaattcagcctccatgttcccaccaccaggctcccatccttattagctccgtggctttgagcaagttgcttaatcttgccaaagcttagtctcctcatctataaaaagaaaaattaaattattgggcccataagactgatgatatgttaagccctattcccaaaccttatacatggtaagggcccatccaatggccattgatattacttttatctacagacttggatctaagtttgaggcatcttgcactatgatatcccagcatcaccatgtatgctaaccagtcagaattttctagtctacaggactacacatgaccatttttaagaactaaatcaacatattatattaaactgagtggatgaaatcaaccacatggcatttatgaatatagtatcaatttctttacagactttagaaaccgatttgactctacttgtctctgggagagagctaaatttcgccttccaaaaaaaagctgaacagccctcagaatgatttatgaataggtctttgatgcataaaatctcattttctttagtgcatttgtcaaaagatttccccatgtgtgtcttgtgcaggacttggttgttgtaaccctctcagcctcccatgcaggaggagtatttttcctgatgctttctcttgataggtcttgggatgatcatatttgactgatgtgttagtgttcttactttaactcgtgcactatgaactttatatcatgttttacttcccagcatattaatgctctggtcttcagtgcagatggagtgaagccctaaaactcagccccgtcagccaattaggattcatctgacaagcgacactttgtcttttgtgtgctagcctgggaatggcaaaaagacagcatcttgtttgccttttcaaaaatacacccccatagaatagaaattacgtacgcttttgctggcttaagcataatatagatttattatgtgggaaagatagatgagagattttttttttttttacaatgctgggaaggctttaaaattatttactgtcctcattatcattaggaagcagacattatctgatctatctctccagttttttatggtaaaactctattttaagattcataatttttaaagactgcctgcccctgaatggaatatgcaggctgcacggggaggagtgatacctgatggggtgtcccactgccatctcaaaagcatacttgaaaagttgagaaaacattttctaacaggatgtgaaaactgagtcttgaacggagtggatactgctcagaagaatatttgcgaaggaatgactgctgaatttatgtagtgtgaacatttaaagtaaaaattcaaatcctcacctttggggtcatggtgattaatttccattccaaatgtaactcttcttataggcaagaaatccagtaaatattcccctgtgaccaacaaccccgtgagctgttggcagaattaataaagctgtcaggatttctttgggatattgcacgtctccctgtatgtcatttaattgtgaagtgtaaatatgcatatggcccatcaggaagactaaatatattagtctttagggcttcagctcctgtttctgtactcatttatcaattttgattaaattaggggagaacattttgatacaaaaatgtataaaatttatgtagctttctaggagaatgacttgcattgtttatacagcataagcatctggggagaaatatatatttttctaatatgcagctttggataatataaaatgttctgtatacaagattatgttcacagcttgggagaatttggggaaaatgctcctggcaagcaaactgtttttaagaagggaaagttgaaaaccaggagcagagggaaaacataatgcaacttctattttctcgaactttaaaatatgcagcttccgaggctgactcacaatccaagtgagacctctgtcagaagagtctgagtatgcagagggaggggtgcagatggagtgagaacacttatggtaatgtcaggatccagctcaatatttcaaagcaatgctttctgtacaagcgaagcacatttgcaaggggattggcctttactgtgtgaactcagggctatctttcgaccaatagataccggccaagctaggaatgagtcagtggtttgtgactgtctgcactggttttgctttgaaacagtcaaagaagagaactgccatttaaaagagtagcaagaaatgtgtgagcattgtaattggacattagtaaaatccaagtgtgagtttgttgttgtgttgttttgttgtgttttcccttccctttgagtgtcgatttgtaaattgatgtactgaccactttgtataagctctgtgttgtacagatattataaatttaaattcaagcaaaagataggtaagaatatcccccttttacagatggaaggatcgtgttcatagacattaagaaatctaccccaaccctacagtgatgtagtgctcttctgaccaagatgggtcctggggccaaatcgtaaatagaggcctacctaccatatgcttacttaggtaaatgttataaatgatgctaccaaacttaaataatttgtgttctctactcctttgttaacaagtatactttcacagcaatgtggaagtctagggtgaaatcagagcaatacatgatacacatcacccctgcccattcaatatctgactccatccttcaagtcactgggggccaagcttacatttccgggttgcccacactgccccagtgtctacaccttggtcccataggtgcccacactggtcttgtggcctggcctattttcactgggagagtccttcacaggcccacaagtgagcttagagccctttggtcaggaaattctgaagtttggatgcatgaaacatggtgtagaccagaatgagagggttgggtggaaaggcagggggagggaaggcttccaagttcgctcatagcctgccaggacccctaagtgctcgtggcatgggaaaacaacagcaacacccaaaggaggaccaaagcaggggccctttaaagcaggaagcccaggagagtaccccctgctccccaccacccatctaagggaaatactaccacctgggcattgtgattgaaaggaattaaattcaaatcaagatcatgggactccaagctgatattttatccactctactttgctgacttcctagtattttaaatgaaaacctaagaaaaaataaaaatgtgaatctggtcatctatttcaggaatccttttcatagtaacaaaataaaatattttaagagtcacatcccagtgcagaacctttgagtaccttgtgcccttgagaagtggccacaggtcccaaaccagggcccccattaagctgagctaggtttctttctttggggtcttgttgaattgagccttaggagcaccccaggactgcttatctgctagtaatgcctgcgataagatattcagggctctgttgatttcccagctgtgcttccagtgagcgacaggagttttgggacactttgtgcctgcaatcgctgggagagaacagccatgataagcaccagggagagggatttttttcgcctgtagtctgaacacggaaagtgataagagaggaaggcctctgcagactgacccgaaaagcaaatgcaggtggaacaaaaggcagccctgactataagaagataaggcagctgcacaattggtagctggctgcaggatctccatccattcaagtcacgaccttatcctacagcatgtgatggagcaaagaagtaaaaaatgtatgttttaaaaaagaagtctcaagattttctgtagtaaaataggtcaaaacatccagtcaaattgaaagaaagcaatgtaaaaatttgagtcaactggaaagctgggcattgtttggtcagatcgatatcccacttactcaaatcatgtctgcggatgttaatgaggacaaactagtgctagagtagcgaaagcataacagttcttatattttttaaaaaatatacaagtataaataagctatcatggggaccgggtgtggtggctcatgcctgtaatcccagcactttgggaggccgaggcgggtggatcacctgaggtcaagagttccagaccagcctggccaacatggtgaaaccccgtctctactaaaatacaaaaattacccgggcacgatggcctgtaatcccagctactcaggaggctgagattggagaatcgcttgaacctgggagacggtggttgcagggagccgagattgcaccactacactccagcctggatggctgagcaagactccatctcaaaaaaaaaaaggactttatgaaataatttttaaataatcagatgtcaaatctctcatagggagcttagcagtgattctgcataaaggccataggcccaggtcccagccacacacctcatttcagagatcacagtgaggatgaaatgacaaaaataaagctcctaggtcaggggctggcaggaggtgagtgtgtaggacagtccaacttcatttcatgcatgtttggagacgggccagggtcacgtctgtttgacaagcagaatatttgagttctctaagtttttaaggttctgtaagtttttaaggaggagagtgagaatgactactgagtatgtaatttggtcattttaagtttgtaaattaaatgccacatgtgcgcgtgcttgcgtgcatgtgtgtgtgtgtgtgttttaggccaagacaaaatgttaccacatcaaaattccttatccaaaaaagtcatgtcaaataatcacattccaaaatacatgtaaatggccatatcaaaatgacagagtcaaaatgtcagatctctttctcttccacctcaatcctcccactgttagaatatgtatgcttatcacactacgtgcccccatgttgggttcctaagttatggtcttcaatcccatcaagcgaagttttctgactgctggactgtggcaaggaataggatttttttatagagagatgtcgattctttcagcccttggagctgctggtctgggcccgtgtagaacccctgtccctgtggtcgtgagcaatctcctactgtgctatacctatataatcaatgaatgtttcgatgtgaaaaaggttggaaaccatggccaggcaactctagaaagggaaaagatgaaaatggtttgaataagtcagaaaaaaatgtatgaataggtagatttttaaatgcacagtcttgagagaagcacagaatttaaaaaaaaaaggaaaataaattccataagaggagaacagcaagagacaaaattaggagtgcaggattagaaggtgtgaaggaaacagtagtgtggctgacattctggaggggcatgtctgggccaggagactgcaaccgaagcccatttcatggtcagagaggcctggagatgggggttggctagaaggcaagagaaaaaggtggcctctgggtaacgatgtaacaggatgaatgtgtggtttgggaaaatgcactattaactgcatgcaggactgatggaaggaaaaggtaatggagtcaacaaaatctgatcagggtctctctgaagttatacttcttaggttttcatcagaaaaactttggcttggaaaagatacagctttaatttccttcatttagtttttttttaatctatctatctatctatctatctatctatctatctatctatcatctatctatctatctatctatctatttattgagacagagtcttgctctgttgcccaggctgtagtgcattggcacgatctcggctcaccgcaacctccacctcccaggttcaagtgattctcctgcctcagcctcttgagtacctgggattacaggagctcgccaccattcccagctaatttttgtgtttttagtagagatagggtttcactatgttggtcaggctggtctccaatacctgacctcaagtgatatgcctgcttcagcctcccaaagtgctgggattacaggcgggagccactgtgcctggcctaatttccttcattttaaatttactttatatatttctaaaacaaataaatacagttttctgcttgagaaattcctcttggtatggtttttaagctttaattgtgtatgcttgtgacataaacttatttttcttgtcctccacatttgagactttgctatagatagctaacatcaaaaattaagcagcaaagaagcttatttctgagatatttttagttttcccaattcctgatctggacttccagttttcatttattttcttaagttctgataagatggattgctttggcttatgaagtaggtactttttctggcaataaactttacttttaaatatgttatgaaagtggattgaaatgctctttaatagaaactagctgtggcatatatataccagacatttttatacagaatgtgcttacagaaagggaatctgaagcctgagaactttgcagaaaccatctgctctctcccccacctcttcagaggagggcagaaaagaaacagagagacaacatgttaaaccctagaattttaaagtcaagataatgtaattctggctttgtcattgcacagaagaggaagaaggagtgggtgaattaaataaatttgaatacagcttcctcaccattcattagctatatgctgatcagattgcttcagtgctctgagcctgtttcctataaaattagataacagtatctgcctgacagcactgttgaaatgattaaatgtgcaacaccagtaatgaggtaaaagttcattaaatcatatctatacaatattatttcattaatatttttatgaaaaataattcaaaacatcgtagaaaagattattaggttctgtttggtaaagtaaagaattcaatgcatgaatcttctaaaaactatgtctaactattggatgaacaaatgcatgaccctgtaggtcatttcctcaagaattctgcttagttcttgaccctcttctccaaaggatagtgctaaaatatagaaggcacggtgacggacttgattctgatactcactagctgtgcagccttaagaaagccattcagattttctggctaagagatctaggagtattaaataagataaagtgtgcaacatacccagtataatgcctgtcacatattaaatgctcaataagcattggtcctgtattcttagcacctcatctgtagtgctagaatgctaccagacttgcctatttctcaggttattttgagttcaaaagatatagtgggtgatatagtgagagacattatacatatgcaagctaaaattaaaagcaattatccaagatcagtgttctgatatggaacaatagatgagaaatggaaatcctgatagcttgaagagaaagatggacatccaggttccccttattgagtatctgctctcgtcctcatttaatttgtcagcttctggagctgacttaatgagtttttctcagctgctgtcattgtttccttctccatcttccccttacaattagagtttcagaccagaatccctacaatttccatttcccaaagacagaacatatacacggtgtgctttcaggatggatgccatgttgacctaccaaccctggaaaggaacaaagggagtgtcccccttaaccccgacctgctaagctgtaaaccctggttcacctgaatgtgattggagcatggtattgtggtctccccaacaaagtccagaaggagtcaagtgggggcacaacttgtaaaatttccttcataatgaaaatgtgtgttctttataaatgacttctctttgcagtaattctcttccctataactttatttataacaatatttttaatgttgaccttgaagctcaaaaactttaaataacttgaccaactacatatgtccagttagcaaaattgctggagaagaggtacaaatttgtgtgagtccacatttgtaggctggcattggcctggagaaatatctagcaagctgcatattcagcattaaatgttcaaatcacctcattaaaaaagctcaaagagttgacatcaacttagcaatatatttaagcaaatgtaccccagatattattatttcaatatatgataattcaaaattatcagttagcttgctgtttttgttttgctttgtttttgtattaagatctttaaaactcagtgtgtatgttataccaagagcacaccttaatttgcactagccataggtcaggtgctgaatagccacatactggacagccacctcactagccacctcccatttttaacatctttcacagacagcatctaagttataaggtacactttaattttctaacacttgtggaggcttgaaagtgaccaacagtgaaagaacaaaaagtcctatgtttattttcaccgctttttccctccctcaatattgtcactggtaaactgagatcttttcccattttgtgtggattgcacagaagaacctccagctggaaaagacaatcaggtttttttttccgctggccagggaatggagaaggcactctcttgctctaaatgcacctctccccaaacattagaaagcatagggtttttaaggactgggtacatggccagagaggaatgtttgcatgtgcagagtgggactccagacgtgcagacttaattcataagtatgtcttcatacaacccacgtaaacaaaatagcagaagttttcttttagaggtggaatttttgcattataataatatgttaatgatctaaaggccactagggattgtctgctccagtgttgctggtttggggttcttatctccctctggtaatctggacagaggtcaagaagctctggcaccatcccaggccatctgacttctttaagcagctgtgcccataaataaagggactgtattaacccattttcatgctactgataaagacataccagagactgggaagaaaaagaggtttaatggacctacagttccatatggctggggtggcctcacaatcatggtggaaggcaaggaggagcaagtcacattttacatggacagtgtcaggcaaagagagagaacttgtgcagggaaactcctctttataaaaccattagatctcatgagacatattcactatcatgagaacagcatgagaaagacccacccccatgattcaattacctgacactgggtccctcccatgacatgtgtcaattgtgagagttacaattcaagatgagatttgaggggagacatggacagaccatatcagggaataaagaaaaacagtaagaaaaagaacttttccagttgtttaatcagggctgtcctggtaatgaggttgagtttctaaatctcagtatcagaccattcattctaattccattaccctaaacctaaaccactctgtccaatcagctacagtcacgtgcctgcttatgaaccacaaatcccaggatgatcacctcattgcctaaatccatattttcaaatccagcacaaaaaaaatctactgcatgggcccaggtcctgacacattacctcattatctatgtgtctgcaccatcttctggctgttgatgcctcatattgacatctctgtgtctatttcaatttctgacccaatgttttatcctaatctctaatcccccttccaatggctgccttgcttcttgacccatggtttttcttacattctgccaagagtacctctttaccatggtttttctcacatggcataagacttgcttgagtaggatgactttttagttttgtctacaatctccagtattcttggcatttactgcatgcttactcaatttcagacttccacaaactacatgatctgaatttcattagatgcctcccaagtgacccaatgagaacaacagacttgtacctggtcatcagactttctcctgacttggattcctcatgtgacttttagttgccctgccaagtttgctgccaatggaactgtctaatgtctgccaagtgaaagggttttttgttgttgttttctttatttgtttgtttttttcccttaatttcaagtactatgagatttctcagaaataaacctagcatccttattcagcaaacttcacactgaaacactctgtactcctgggaaatattttaagagccacaaaagccaaaagtatatggaacagcttcttaaataagattttccccatgaacttagatttaccttgtgtgatataatacaagtctaaagttaacaatttcagaggaaataagaaataaagaggaaagaaaactaatatcccatgcctaagggcatatcaggcacacttcaaatatgaaatgatgtaaaaacaaaataccttaataggcaagattatatccctgcttttaacataaaggaagtattgacttatctaattaaagactgaatcaagaaaacaactgagtggaacagcttctcctagttggcatttttacaactatgtcccttgatttatttaaatgatacatgcacctagtagatttcaaaatattaattcatcaaaatctgtacatgtttggatgatgagcccaatccaaggagtggacatatttgggcccaacctttcaaacttccaagttcagagtctagatgaaaatgacttcccaagtctaaagctgatattagctaaacatgtgacagggcctttcccccacgattcatctataaatcctttaacactatcattctctgggctggtcagggaaaatcttcatttgggcgttatttttaagtattacacatttaaagactattatagacaaatgagtgtgcacccaggggacaaacaccagcagagtaaacatattaaaacccagtaacatgtaaaaggttggaaaacattacagatgctcagtctgaaggctgttattttggcaggattaagagaggagacatggattccatgacaagaacaagaagccacagaaaaatggggctcagcaaacatcagtgggtgggaccacctcctacctgaagtggtgcagatattagatgggggaggtgaatttaatgaccttgacaggcctctccagccctgagattctatcataaaatattcctttcccacaccacatgtaaaatataaatgttgctccctgaaacccaaccaagaacaggctgcttttaaataagtgagaaaagagaatgcctgctagtgaggactttatactttgacctggggtttgtttctctataaataaccagcaatgcacatcgccatgcaagatgggcttggcctcagcatatcctcctggtctcattttccttatacctgaagggtagaaagctcaggccctttttggccttgggcaagagagcttttattgattgcacttgtcatgagtaatctgcagccaaaggagagaaaccatatgagtcctataaacagcaagtcctggtattgcatttgccatattttcaaaatggatatgatatacaggagtgatgcagaaagctaaacagtctataggtttattcctgtctccatgaaaccccaacatgtatttctttaaaaagtgatggggtaaaattagtctttattaactttcatttccaagaggtttactaaatactaccattttacattaaaataaatattgggccaataattctttttcattatttttataattgccatttcaaccatctgtcaattaccttagcacatcatttgtgaataggttgatctgctagcaagaacagctctaatggaggcagggcatggatttgtcttttgccatcagaaatccaggcaattcaaggctgatagggcaaacatcaagaaactagtaagtgcaggagctatgattttaatctagattcatttgcagtcagggtccatgcattagcaatcaccaccatgcggatatgcagaaggggccagcctcaggaaacaggtcattccataactgcccttgttaccttcccatcaagtgcccctgttctcccagcagaggaaacagccacgtcattgtgttaagctatcagtgccagttcctcctccagtgggtatctgcaacatcttcactgggggagattactgttaaaaacgctgaaagaaattttaagacagagatggcagatttcacaaatacagatgaagcccattcttaagttatatgggataataagctcattggagttgcacaaaaaatccaagatcatcaaggcaatggacccaatgctatatttaaggagagacattaaaaataagttcataataagatataagcagattctactcatttaattaatttctaccaaaagaataacaaattaacttgaagataaaaaaataatgggaaagaagtgataattcgattaaaaagtaaggcatttgctcctatagagaaataacataaacagatttttgaaaacatttacctttgcctaattattcattacgctcagctttatatggaaatgaccaaatcttaatatcccagatggcccatcatgggttcactttctatccacaatcaaaacaaagccctagacagtcagtgagttcaacattttctgcaaattagtagacattttgagcaaacaagcctcatgtggatgatgcagtacttcaactgaatgatcaagagcttaagatgatgtggaatgctgtcatcaaacccaatctgctcattccaagctgtgatttctgactgaaaaacaggtgacctttagcaaatagcttgaactaaggtggaaagatatgcatacatattgagttacattggtttctagcctttgattttaccagtgttttaaattaatctcctcttctttcctccttttccaatccttattcttttctcatattttcttatttgtgtcctaagttcagtatgagtaaacacataccttcttaaagaacatttctaacataatttagtattgatcttgtttatacatcagtttaggatgtatgtagaatttgtttctattcactcatttaattttctgttcgatatttactgaacacttgccaagtgtcaacaggagacctgaacaagacaggttctagaggaccatgggctgccacatatcctagacagagctaacactagggtgacctaatagccaagtatttcctgggacagctctgattgacgccgctgtctgagcatgactatactgactttttcatcttcaagtgttctagtttggaggacaaagtctgtgatttatctatattcttagttaaaactgtaggaagtgtgtgtgtgtgtgtgtgtgtgtctgtgtgtgtgtgtgttttaaattggtgagcttggcagcctgtcttcctatgtgtagtttccactaggttaagaaacctcaagtcatatgattgacaagggagtgacataatttgcatatggaatgaagctctgacacctaccagaaaacagaggaaccacccagaattctgtgtagtatgagctcatataacagaggtaatgataggtaacattcactgactctacactatatgtaccagactctgtgctaaaggccctcaaacttcattcaaacctcaccaatatccatatggtagggaaggacatttatttctattttcttattgaagacacagattctgataagtaaagttagttttacttatcaggggatccaaccataacctctctggaacctaactagggaatgatgcatattgactcactgcatctaaaaagtgctaccaattacacagaatctcttctcacccggctgtaaatagggtagagagaaaggatgtgagaggagtcacaaccattgcatttgatgagcttgtgtggtttcccactttctggtgaaacctgttggattcagggattcatcccttaccacccatactccaatctccttaccttcaccctccccagtccctacatatacatattatacctttgtcacctaaaaaaaataaaaaatgtacatttaacctctgttccatgcctttcgtcctcctaatatttttctttactttatacttaaacatgtaacttaaatatccatccagcatttgcttctagaaatttagtgttctctcaactatatcagaaaattcctactgcatgtgtttcaagacctgattgtcatccttaacctcttatttctgtttaaacatctcagccaccttctctgtgattattttatatatatacatatatatacgtatatatatacatttttttttatttttgagacagagtcttgctctggagtgcagtagcacgatctcagctcactgaaacctctacctccctggttcaagcaattcctctgtctcagcctcctgagtagctgagattacaggcgcccatcaccatgcccagataatttttttgtatttttagtagaaacagggtttcaccatgtaggccagactggtctcgaactcctgacctcaggaaatccacccgccttggcctcccaaagtgctgggattacagtcatgagctaccacacccagtcactgtgattattttttttgccacaagttttctacaccaccagtggcacaaggctgttcgttgtatagagtgagattttgctgacattttggtgacaatggcgagtgatttcagcaccaaagggagacagcaaaacgttgagcattgggtgtcattctacctatggccatcagctattatttagctctagataattaagtggcctctagctttggaggccccagtcccttgcaactattatgtcttcaaatcaagacacttctcttatcccatcttgttacatgaccccagttctctaaaaaaaaaatacatttattttgtctagttattaaacaattctaaaaataacaaaaagtccccatgcagcagaataatcatttcccctgagaaaggaagccaccatttctgttattgtaccttgctttaactactttggtttagaccttcccataaccaaaatattcattaagctgtttctctaaataggataccaagatatttcttctactgccactctagaacaaagaaatactgaaattagcttttaaaccaaaaattttgtcctaatgatgtaaataaaatatatttaattaagcatgaaaaatgtatttattgaactcctgtaacactccagcaatgaggggaagaagattatggggctataaagcagcatagtatatgaatcctcaaagaattgtcaagtcagtttaagagagaaaatttttgaagaataaatacaaaggaaaaagaggataaaaaggctatgcttttcttttacacccccttctcctgcctcattagagaaaattggtatgaagattaaaagaagtctacgaaaataaacatattctttaaactttaagtaaattaattgaaattaattcagtgcttatttatttcccaaactcctatcccttgagaaagtgatggcactcggagattttgcaaaaagagtattctaaattgctgttcagtaaaatatctcattgagcatggtcaaagtagaaaacatagacttatgaaaaacattttaccatggaaagtttcaggtgagtaattcttttctcaaaaaagatattgtcttgttatgtttttacacatgaagatatttaaaagattaccatctttataaagctagtgtcatcctacagttaagcgacaagaagaagccaacaacttgaggaaacttggcaaatgtggttctcctgggaccaattaggtaagaacaggagaaatgagcttttgcttgcttttttctgcagtggtttcacaagcgggcttcagggttgttgctgaccgactacggaagccggatgggaccttttaagccagaaagcgagaggcatcttttagagctctacttcctcaggctcaggccgaacagcaatctctttctgtaactaacccaagctcttccctcacgtaatttctcccaggagcacataatttctcccaggattcccggcggcatttgtctgcaggcacgttacatcttcactctttttcagaaaccaccctccctgtcctttcctctttgcctgggatgaatccccagtcccccatatgttagatgcaaagatccaaggcaatgaggttttcagggtctcaagactagagctgctaaaaagtttagacataggtagagatcccaacaagcataggcacccaaaaagggcaaagcattactgatggtaaaacaaagggctttgaaatctgacacacttgtgtttgaatgccagattattagtatactaacggtgcaccttgtgtctaatgtttagctacaacaaacctcggtatacttatttctgaaatgggaatcatagtgagttttgaggtttagaactgatcagtataaagaactaggtgttcaataagcaaatgtcatgtctttgaaatgaaaatgataaacctacgtggatttattttccctttattcatctttggaattggttgtaacagataatttatgccctacatgccagagagtgttcacagccagtctgttctgactgatgcagatctctccagaatatgctcacagcaccaagcacctctctgtaattgacaacagctgaaagtttctatttattaatgtatgtagtttaaaatgtgttttctaatagactgtaaacttcttcaggtgaaggactttttttttttttgcatgaatgtttccaaggcatacaaagattcctagtgcaaaattagcacacaacagataaatacattaaatcaaattttaaaatgagccttcaaaaatggttttcccatttcacaggtgagaaagctggggctctgaaagaacagtttttctaaagtagcataggtagtacagagggtctgagattcagaccaagaagtgattctctagagtcaatattagtttctattatatatgaaatagataatatatcattactgtcatttttcaatcagtgaataaacagaagtccagagaatgttaaacagatgtttgcagagttggggctcaaacccaggcctccaattagatgtccattgctcttttttttttttttttgacctactttcgggtcaccatgaaaaccattctcaggatattcctaccttaactttgctcttggctggctgtccaggatttgcttgcctaggcaggagcaaatcttttttccactgtatgaatttgtggagtcagtagtcctgccagagtcttggtttggtcttggttgaggaggtagctttcagctatcacctgcttgcttgttctagttttgctggagagcattttcccctcaacatttttggcaggcagccaggcctttttattatgtggaactgctcctcaggacacaccacaatggaatgtcagagtgtgatgctgttgggaggttaagtaaaagaggtcacaagtcttgccagctcaggggcaaagaggtgagctatctgaccctagcatctgctgcagcactgctgtgagtgccacagttggagacatcctggcacatgtgtctttgggactcaggtgtgggctctgtgagttgtggactcttgtaagccaactctggttgcagagaggctggcttcaatcaagcacataggaataaattcaggagacaatggaaacctactctgtcttggcaatattaaatttttgctgagaagacttgccttgatcatggagaatgaaagagggactattagtctgtttgggctgctgtaataaaatactacatacgaggtgacttataagcaatatatttatttgcttctcacagttctagagatctggaagtctaagatcaaggtgctggcacagtttatatctggtgcgggctttctgtttcatagatggcacctcctagctgtgtcttcacatggtctctggagattttttataagggcactaatctcatttatgagagcctcaccctcatgaactagtcacattccaaattgtgcacctcccagtgttactgcattgttgattatgtttcaacatgtcagtactggggtagggaagacacaattattgagaccatagcaggggcttttcctcttagcccagtacttgtactttacctatgttctcattgttcagctcccacttataagtgagaatatgcggtgtttggttttctgttactggaacacaggatgttctaaatgccatgctgagggtgaggcctacaagagtaagccaagcagagctcttgcccttcagaagcttatagtttagcagaggaaccagataaatcaaaacaatgtataagttttgttaatagttccaaaaggaggaatggtggtttttcaaatataaaacaagtctttttccacaaggctactgcctggggaaccatttctagatgggtcagggaggcccccagatgtactttttagatgctcaatcatgagaagagttggggtttcctagggaggggctaggttggccagaagctatttggaagctatttgttcccaggaagggaacaacacacactgacacctctcaggaggatgggggaagggagagcatcaggataaatagctaatgcgtgtggggcttaattcctaggcgatgggttgataggtacagcaaaccaccatggctcacatttacctatgtaacaaacctgcacatcctgcacatgtatcctggaacttaagattaaattaaaattttaaaaaagaaaaaagaaccaaaaagagagcatcttgtgttctcaagaaactaaaaggcccgggcaggtcttaatagagactaaactcacagcattcagtgatgtactggaaaagaatgaatgtttgaaacagtgtcatcaagctttacacacctataaaattgttatgcctgcttctaaggtggagtgtgtgctgggcagaagcagtaggctatccccaagaacacatgagtcagtggggaatgagagaaatgacactcccaagggaaaggcctgtgtgaaccagggagttcacccagggtattctgagacagggtcttgctttgtcacccaggctggagtgcaatggcatgatcatagctcactgcagcctcaatctcctcggctcaagcagtcctcccacctcagccttctcagtacagtttgtgaatttgaaacaggttagttcttggagtgtgaatatgcattcaatagtttggatgtgtttctgttttccaccgggcaacttgagtagctttagtttgtaagatcccagatagcgttctcttcactgatagttattatccgaatacctttgtaatgcctgagtcagtgcagttttgcatgagttccctggagaataactttcatgagctaacaccactttgatagctttccctccctttctactcttgggaatatctgggacataggctgagctcccttttcatagagttatcttaagaagcgagattaactatatactatgtaatgcatacattaaacaggaggaaactagattatatggagtcatttaaattgctagccaattttatgtgttggctctcatctcatctacagttttagactttctgtctttctacgtgctcataaagaaaaccctggatgtggcctggtgtggtggctcacgcccgtaatctcaacaatttgggaagccgaagaggttggctagcttgaggctaagggttcaagaccagcctgggcaacatggaaaaaccccatcctctgcaagaaaaaaaaaaaaattagccaggtttggtggcgtgtacctgtagtcagagttacttgagaggctgaggtgggaggatcacttgagcccaggaggtagaggtgcagtgggctaggattgtgccactgcactccaatgtgggtgacagaatgagaccttgtcttgaaaaacaaacaaacaaacaaacgaaaaacaagaagaagaaaagagaagagagaaaaccctgggtatgtaaatcttgttgacactgtctcaaacattcattcttttcaaggacattattggatgatgtgagtttagtctctattaagatctcatttgggtacccttttattcaggtgataaaatattttgttattaataatattttcattgagtcaatacttattatttactgatctctcattatacagcatgtgttttaaataaatcacattttattttgataacagaacactaaactaggtatttgaatcctgatttttaactatgaagaaaccaaaagccggaaaggtaaaatgatctccagcaggccatagagctactgattggtggttctgggactcaattcgaatctgcctggctctggctcacaaaggcctttcccttgggaatgccatctctctcattccctgctgactcatgccttctcggcgacggcctacttcttctgcccagcatgaactgccccttggaagcaggcataacttctttacagttacattccagagcagcaatgctcaaatttggtggcaccttagaattacctggggagctctaggtcccacttctagctatcctaatttcgttgttctggactgggactgagcatctggatttatgaaagttttctgtcaatgtggatatgcagcaaagttacaacaattgttttagagcagtggccctcaagtagaatgtgaacacaaacctcctggggatgtgttacagaaaatcctgattcagcagaattgaggttggacctgagatactgaatttccaaaaagcccccagtgatgctattctgttggcctacagaccaagacattgctggcaaggccccagaatctccccattttctctgcatagcccgcccatctcctcttttccaggtcacccttctcctgggagaaattctccagttcagggtttgcactgtgttttcaatgtagctgttctctttcagcagctcccgttaatcattggaaagttccatctcaactaaaactctctgttagctgagtagaatagggggtggcatgtaaagaagtcgaggtcacaagatcaatacccaagtttaatacccacagggaccagttagcttttctgtgccctgaacccaagtctccaggccagccatggctcagatgtatgggattgtccctgagagatgaatgcttcatgtccatcacacatgcaatacttaccagaacagcagccacagtctgactcccactcgctcaaaggtcaatagcatatcttgataggaaataaagacacagcaatgttagctacaatcgggtgcttacctgtgccaggcactgcggtaaacattttagaatccttgcaacattctttgaggtaggtggtctcattatctccattggataaatgaggaaatggggttcatggttttcaccttctgacagcatgcaacctgtagataacccaaaatccaaggacttaggccagtatgccgggtgctaaccaatgtaaattagggttgataaaggatttgcagctctttggcgttggaaacttcaaaatatgtttttctaccatgtccctgtcaagcttcgttaatctcggcattgtcccctctctcaatttatactgatgatgactgccttgtttatttattgtgtttttagagaagctcaaattagaccatccgtatgtttaaaaagaaaaattgaagaactgcgtaatattgggagcattttagcttcatcgaatctgtgcagcaaatgtatccacagatttacctaccataatatgagtctggtccttccaatctacccctcttttgatttgtcatcagtgtacaaggtcataattctcatctaagagcctagagatttccccagtcaactttgttttattctaatgtacctgactagtggagtctgcaatatttctataggttaaagaaacactaatgttttatttttaagtgaaaaattcaaggaaagctacatcttttttgctttagtgttcagaaacacaaatttttgatatttataatgaatactgactaataaagactacggattgtataattttgatgtttgatgttagtttgtttatttgagacagggccttgcttgctctgttgcccaggctggagtgcaataacgcaaccttggctcactgcagccatgacctccctggctcaagtgatgctcccacctcagcctctcaagtagctggaactacaggcttctgtcaccatgcctggctaatttattcttttttcatatagacaaggactcaccatgtttcccagactagtcttgcatgcctaggctcaagtgatcctctagccttggtctcccaaaatgctgagattacagacatgagccactgcacctggccaggacagtatcttttagtactaaagacaaactgctaaaaattaagtaccagatagcaaaactttttagaagtattcaccattagctttctctgctcaattcaccaattatactctcactgtaaatcaagtcaatcaattagtcaacagatttttattgaaaactctatacatggggcactgtgttgagacccaggaattgaaagagcccaatctaaggcctcctcacaaggagatgtgaccctttcttgtaaatagaattttaaaaatttaattgtttgcttcctctataaattattttctcttggtgtcatggaagatctataaattctgataaatacttttattttgagttaacttccttcagcatgctttggataataataaaaaatggaactcatgattcttgctattttaattaaattaaacccttgaaacccccgtctctcaagtgattttccactcccttctatgggtttatttcctaataggcactttattactcttgaaagtcatttatttattcctttagatacactgcccgtttttcctgcaatgaatgtttaagttctatgctgctaaaagtttcttcctggtttggtgttcaaagccaagaacagtgactggaaagtcagagaaactcaaccaactttccttgaatgattgtgtgaataaatgaaaattggctatgaatgtagtagaagtgaattctagccctagatgacaagttaaacaaagatgcctttttaagtcctctgtcaaaccataagactttagaattttacaattcagttttctaattaacaatgataaccactacttgagcagaccaatatataatcagaggggttaggtggccagtgacccaaagatgctagtcatcaaaacagcactcagtattgacattttctctgttgtattgtgctgtgtttcagtcttcaaaggtgtctggtatatatattttactttttaatcttctaaagaccgtttcactaattagacacctatcatttttggcaaagagccaaagttaaccttcactgtattgctctaataaagattgtttttaatgaaataggtgactaagctattgttaacaatctagagtaataaatgtatggaggattttcagctgtctaaagaaagagttaagtgatatagatataaaatttgtttcacatggcttaaaagtgtagacaattacagaagaatgtttaagggatatgaaaatgtataaggttgtgaatacaaatttgtcatcagtctccataatattaaaataaaagtctatttcttgaagcataagaaaattgtttcagcattagaagaaacgtaataaaatgaaatctatacatttataaccaattaccacttacgaacattcattgcatagccagacagaggaccaggccttcaatgtatattttttaaatgttactgtaatcctgtgaaatagatatattgccatcattttacagctgaagaaaccgagagctggacagattaaagaattaatgtgaagctaaatctgggatttgaaccaggtatccttcctgtgccatgctctttgcctctacagcattgcctcttgtgggtctggctgaaattacacacagtataaacttgatatttgaagatgcttaggtgtgtgtacacttttacccagtagtgtggcttttgagaaactctacttgtgggattatgagtactttttaaattttctagtttatatttattattccaaatttattcaagaaatatgtcacattttaaaatgtgcatctaaaaatattcattgggttttggggagggtgtttataaatctttgaagacattgcaaagggtactatctgtgcttccctcgacttccccttggaactgctgtgagaaacaagctattaggccgggtagatcgctggtctgactcagcatggcatatctgaagatgaactattcactaagtcatattgaatgtgccttccagtcttatagccgttcctgaaactcgatagctaatagaatgccatattcaaaaggcattgagcactgttttccccagtgctttgagtttggaaatcatgatataagttattactacaattattttccaccttcatctgccaaagaaagtgaaatcaattcatccacatcttgactgcaacgctgttgtaaaagatcctctacctactctgaacatggatctttaaaattgaacctactgatgcaacataaattttagaaaagtcatcttcaactgccaggctggccgcagtactatttaaaacatgatttggggacctctatttcaatttccattactcacaggtcacaagtcttcacctttgtttaggcaagtcctagactaatgctctcaccgaacagaatagttctgctgtcatccacaggttacttgacctctctctactatagtttgttttcgtgtaaattgggaactgttccatctgcaattcactcagtaggcattttgtgatgctgtttgtcatggtggtcctatgaggaacccatgagtgtttcatggtcctgaactttattgaagttacagaatgggccctccttctgatttcaactcttactcaccacaggcattgcagaggccctgagccatgccaagtctcatcttccttcctttatttatttatttatttatttatttatttatttatttattttaagcagggataattgtagatgttcctcatagagttgttgtgaataggaaatgaaatagtatgtgtgaaaacttgccacagtgacagtcacagagtgagatcctcatgggcagtagatgcaactgagcagagatataaatgccaatcattttgaatgtgataatcttgtatttattttgtaattaataatcttgtagtaattattgtttgttttttgttgattcatataatttgatttgcgtatatagtcattgttgaaaaattggcaaagagaaaacggaggcagagatatctccacagatagattctatcactgctacctacaaccattttaaattactgttaaaattttggtgttttttgctttcatttttattaacacaatcaatattttcactgatataattatatatacttatacaagttttatgataccttcttcattctataatgaaagataaacacttaatattgctattacaaatactggcaactattaattaatattttcagtctgtatgtaattatttttatctatttagaaactatagatagtaaattaagaaaaaatcagtatttgtaattctgtacaccagagagagccacattttaagatattttcttctgtttttttttttatatgcgtagacctatgatttaatctaagttgccagtgattgtcagacctacaattatttcctaaggagaaaaaaatgctgccaaataaacactgacacactgctttgtacctcttagaacttctgttttgtatgccttgaaatggccttcaaattatataggcagaggtatttattgtagtatcagtctcggtcatacattaaaaatagatgcaaaattaattgggtaacatattcctcggacaaaaccacattcacagtctgtctctcttgactcctgtttggcttattcacatctgtgtccaacatggtgtggtcttctgtgctgctgtttctcccaagtaaacaatcttttttcaatgttgaatcacagcataatattttaaagccattttaaatagcaattaaacttaaaattgactcataaaataatgaagctgtgcccagctttgcccaagtctacacagttttcatgtggccaagcacaatcatatgaggaccaacagtgacctattgacaggagggtgcaccccagttttaggcatgctacagtgcaaaaaatatacacagctagaacaacttgaaaaattacatattttttcctttagggtgctttatttagttttatctctcttttttttattcccattcaatattgagaacatttcccagtatctttaagacccttagaaaaaatctctttcaaagagatttcaaatgctcttcaattaatgtagcaccaaaagccttcagcttttgaggcttttagaaaattacgattattgaaaacaaaccttacaaacaggaatatattgaagattattcctacaaaagcaaaggaggaacggagcaaattaaatgatggacactcagatatgtacaaaatttaattttaaaaacccataattacatgttggaatctcttgacttctgggaagaatattttgatagagctcctatttttaaatagataaattcatatcttatatcagaaagaaataaaattgagaaagtctatgatttcacataaacctcaatctgatcatagattgaagagaagcatagaggcttatttgacaagttttattgtataatatttttattaaagaaagatattataaaaggaggagaaaacacttcgcatataaaatatttgactgaaatatgttaaaaaccttatgcaaaaatattagaattaagaatatcctccacttatcaatgtttttctgaattttgcagagatctcagcatctaaagacagaataaataatatcgtggtctacaaagaagccgcaggtagttatgtcaacaatttccaacatataaattttaaactataattctgaagaaaactgtaagcagttttctataaaaattaccatattgaaagatatgtttttcagaaaaatgcaataatgaggtagtagagacagagctaaagtataaagtatatgaataagcaaaaagaataattgttattttagtttttaaaaataattttattggtgaaaattgttttatttcttaagtttaaaaatcccaccaatataataaagtcagtttgtgattcagcaaataaatatttttaaaaatttttaaatttttttatacttgaaaatcatctctcatatggtgtttaatatgatatttaaccctttccttactgtagatcatttaggatagttctacttcctctactgtactcaacagaaatgggtatctctccctttgcaattctgatcattttgttaggatagattccaagtactggaatttctaaatcttacaaaaatttcaaaactgaattgcattgaatagtattctctgaatatcaagaaataaaaatattaaaattccaatgcataatttaattctatgcataatccaatgtagttaataacaatccaatgcataattgaaacaaaaatattttgaaataggttttaaataactaaaagaatatcaatagcactttgtagtaacataatgttcagcaaattatatgaatagaacttgtgaaaattatttttaaatagttataattttcaatcaattatatttttaaatcaaaggcatttactaggtattggccgtgttctatgcattatgcatacttctctctgaaaggaaaagaaagaaaagatcttgttcttaagagattcttctggtagtgactgaaatgcatacaccgagataatcaccataatcctctacaattgtcctagtaaaacacccgaggacagcaaacacagagactgaccaatctcacctgcaggaaagtaggactgggaccaagcatgcttggggtagatttcaaaggaagcagtgagagtggagctgagtctggggggctgagaagtttgatagcagagatgagaaagaatgtagatatatagggacaacatggatgtagtcctcaaatagggaaaagcatggtgtatttgaggaacagagaccactgtgaagttgatcccaggatgcatggggctgggagaaagggtagggtggaaggaggctgggtgtcttgtattaaattgggatgtgtcttatttgtcccgacatggaagctctgattgcattaaattgcacttttctctggaggctggtaattatgctactatcccacatagcatatttattcaagaaatatttagtgataccttgttttctgcgtactagacactcttctgatcccaggaaaagagtcttgggcacaacagataaatgcaatagcaatacatgaaaaaaaataaggtaatattttaagtaatgagaagtattataaaataagtaaaacaggaattttttttttttaatcctcaggctggagttcaatgtaaacatattctgaattaacacagcaggggtctctcttaaaagatgatatgtggtctatagagtccagccatctttagtaccagaggagaagaaatctaggcagtggaaaccacaaaatgacaagtgcaaaagccctggggcaggatcaagcttggcagtttgaagaactggaggaaggccagtacctgaagttccagaacagaataaggatgagatgggtacaagaagggaatgtagaggtatttggaggcttataggtctttgtgaggagctcgaatttgatgctaaatgctatgcgcagctactggaagtttttagactaaagtaacattttccggcaacaaaaaattcgcactttcactttaatgtggaagtgagtacatgccacatatattactcagtataatgcatccatggctttatataatatttaaaaatatagctttgtataaaactagagaggagatggctgggagcgccgaggcgggcggatcacaaggtcaggagtttgaaaacagcctgaccaacttggtgaaaccccatctgtactaaaaatacaaaaactagctgggtgtggtggcgggattacaggcacccagctactccggaggctgaggcatgggaattgcttgaacctgggaggcggaggttgtagtgagcggagatcctgccactgcactccagcctgggagacagagcaagacttcatctcaaaaacaaaacaacaaccaccaccaaacaaacaaacaaacaaacaaacagacaaactagagaagaggagagcttgcacatggttctcaggttgatttctttttttttttttttctttttttgcataactgtgaagatcaatttggatcgctactaactctagttttgatcatttgggctcatgtttggcagaggtgggagagtcgtttatatggaatggattatgtggtgtacagaggcctaccaggtagatacctcagtttcagccttgtatgctcgaatatatagagaagactttctgacttttctttcagtacaatattatttgagaaatgagttaattttccttctgattgtccttatggcagtggttactgaggacagcgaaaatcacctggtgaccattgaataggtctgggagacaaaattgagtgtggatcttcttctgtctgtgtatttatagatgttgtttctgtgtgatacaaatgagttttcattaattgacttaaaaataattagtgcttacaacaaatattttgtcaggaaagtaaaggaacaaaagaacggctactccataggcaaagaagccccaagacctgctgtttgcctattttatgtttatttctaaacaaaaggtggattattcatgagttttccaggaatgaggtggacaattccagaactgagggttcctcccaattttagaccatatagggtaacttcctgacattgccatggcagttaccatcattctgactttgattgattttcactcaacctttttccaagaggtaatcatctgcaagaaataagtgattaaaggaattctttaggaaattaataataacaaaaagttttagataatcctcccctgagcagtatattatgtttgcatattcaatgaagaaagtcctaaaacctattatgtacatttatatagtacctttcccttctattcatattttggcctattcttttttatatgtatatcttactagatccattcatatcatgcaggctgctattcacttgattatagtgatagtgcacttttttttcatgcaatgtgtcaaggtaattaatattagctgctcacaacagaaaatcacccttgaaattccagtggtttaatgccacaaagatttatttctcaggtctgtgattgggtggccattcaccatcttgtagcatgctgcttagaacaagcaccctgcaaagttgcaaaggcaagtgaaacaaaacagaagatgcagagcggctcttaactgcccgcaaatggcccacagcacacacccttacagagtactgggcagatctggtttcatggctaagtgtaatggaggacatgaaatggatggtgaacactgtctttgtcaccaccagcctttctgtcaccaaatatctgctaccctcttatacatgtacactcccatcttttcctgtccctccactcattggtggtcatgatacaccacacttttgtcattcatgcttttgaaagtcattccaaagtgccatccaattaccttgtctacttccaagaccacgtgtgtggtagtgttttcataaagtcggcatgtggcctctcttagtatagagaccttgacttaaaaaagaaataaaattaaaaaaatgaatatcatcccttctcctcaataccccctctccccataaatgtatacacatatatatccaatgtgcaaaaatagaacaggaaaaggatagctgcagtaggcactgctattcattcagagggtgagactggagaagggctctctgccactcaacagtccccagcctgcagccgttctgcaatcctgttcagcaaacgttgcaacatcctcctgccttggaaaatggaagcttgatttgctctctggggcagctcctttgtctatcactatccaggctgttagactcctctctggaaggttattcttttcctattactttctctggcatcagcaaaaatggaaattaggggatatgccttttggggttatactttctcctctcacttcctatccacagaaagttagagccacaaggaatattttaagcaccaaatattaaaaagtccttttggtccaaactcatggtatgtttgataaaatatttgcctcaaaaactaagtgaactactggtcaatatgcctggttctccgtgccggtaaccacacccacagttctttcggaagttttgacttccgtcgcagcaccccctccctgagcctgtctctctcaatttgatttcaaataatctttctgggaaaatgcacaggaatgatacaccctttggatctttacactgaattgctttatctaactgagagattgtactgggtctttgctgctgaaaatctttataaaatcctatcatttcttttggttatctagaagcaccgttttttccaatcaaaaagttcccacatttctgcaatcttccaatgtctcctgctccctcatatatacaatcttttttctcttttttctaaatcttaccacacacagctgatatactcttctgatttgcagcttcttcccttaagacttaagtcctctgtgcatatagtctgccttcaaaggtcatgatttcaataaaggtttcaccatcaccagacgtagtctccatctttccaacttccattatcaggctccttgccacccatcggagaactactaagccaggcaatccacatccaattatttattattattattattattattattattattattattattattattattttgaaatggagtctcactctgttgcccaggctggagtgcagtggcgcaatcttggctcactgcaacctccgcctcccgggttcaagcgattctcctgcctcagcctcctgagtagctgagattacaggtgctcaccaccacgcctggctaatttttgttcttttagtagagatggggttttaccatgttggtcaggctgatctctaactcctgaccttgtgatctgcccatctcagcctcccacatatccaattatttactggcactcccttcttccttttttcttatttgtttcttttttaaaacttttattttaagttcagggatgtaaatgcttgtttgttacataggtaaacttgtgtcatggaggtttgttatacagattatttcatcacccagttattaagcctagcactgttcccagaccgaactgagggtcgggctgcttattttcatggcccaaaaatgagatgaagatgagctgggaaagaagggagtttatgtctgtaactgggtacagggagaaggcttggaaaatatcaccagaccaactcaaaattacgaagttttccagagcttatataccttctaagctatatatctatgtgtaagtgttcattcatcaaaagtcataagtgattaacttcctctaaactataactaaggtctgagtcctgaagaccttcctctggagcctcagtaaatttacttaatctaaatgggtccaagagctggggtgattgaccttatcttgtctcctgctaaatcatgaaggtttggggagttttttcagacccccaataaacttgttgtggaggccttgggagttccttcagaccccccaataaaacttgtttaatcctaagtgggtcctgttaagaattccttcattatcttgtcatacttcaagacccagggatggcctaggcaaaactcttggtgggcttttgttaccttccagcctttttgtaaggacactggctctatcagcttttaatgtttaacttaaccacttagtgctgaaacaattgttctagaggcctgactgctgactgttcagccattaggaagacctggcctgccacagtgtcataggactatctccttagtttagctaaacatgggggatccttgtcacacagccatgaaaaataagtctcgcagacaatttgaaggggaagaaaaatggaatttattggacaaaaaggaaagaaaagggaaacagggacacgtcacaaacccagagagagaatcctgctagtatatgcttcccacatcacagattaaatcccaggttccacgcaggaagaggaggggccaggctcttccccactgcaattggtgcatatttttgtggctcccccacagtgtgcattcctcccagtgcacaggctggttggagtttctcaggggacccctttttacccggctgtctcaacagtactcattagttatttttcctgatcctctccctcctcccaccctccaccctccaaaaggcctcagtgcatttttcccttctatgtatccatgtgttctcattgtttagctccctcttataagtgagaatatgctgtatttggttttctgttcctgcgttagtttgctaaggataatggcctccagctccatccatgtctctgcaaaggacatgatctcattcttttttatggctgcattgtattccatggtgtatatataccacattttctttatcgagtctatcattgatgagcatttaggtcgattccatgtctttgctgttgtgaatagtgctgcaatgaacatgtgcgtgcgtgtgtgtagaagcacttgatttcaagctaccaatttccatactagtctaagtaattaatactaactgttcatggaagacaaacttccaaactctcaatgttgaatgcagcaatgtatttctcacattataattggatgtggatgaggcatccttccttcatctaaagcttagccacctggaatgcctggtgtctgaggtcacaaagaccatggtgaagggaaggactaatggatgtgttaccctagcttttaaccatcttgtcccatagttaatacacaccactcttgcttgcgtctacttgctggaactagtctgatggctccaatctcaattcaagtatggctaggaagtttaggagaacacatgtaatatttggtgaggattaaatctctttctcacactattacaaatcagctttcctttgtaaaactgctttcacatccatgatttaatattaatttcaactgtttcttagaggtgagacagcaaagtcatgactcattccagctctgtggatgagaaaatctatgagtatccacctgtctttgattacactgacttccgtagcatttcctcttatcttaggtttactgcacacagaaatctgttttcttattctccaaacactatcactgaacccaaacatttccgtaatcacaaagacacataatcacaaggaaggcaaataagtctgataaactataacaagtgcagagtcacctcactgagtctataggaaggatctgctggaggaagggtggtttaagctgatgcatttgggatggataggaatgagtcacgtgaagataggagaggagtgtagttctaggcatggagcagagaatagagcaggctgggaggaagaagagcgtaagaatccttggtacgatggaggaaggtcatcaggtctgcaatgcctcctgtagaggggacagcagtggggctggaccacaggcgagtggcagggatagaagcactggcaggccacatggaagaggttagtttatgctgaagatggaagatttaagcaaagtagggccaggaactttttcattcccttgccttcctccattgctctgcaggctgcaaggacttagaacaggtttggcctgagggacaacagcagcttttcagcaggcagtttctccagatgattaaacaaaggtaaccagagggccaaagggcatgactctgctgcagctttcaccttgaaacactgaagggaaatctacttgcccacaggaaatacgaaatccaagcattctagatataatgtatttctgctttggagaaaaatatatcctcaaatacttcagtacaaaataccacagtgaaaagttttaaaacatggtatgcttttaaacaaaatgagctccctgaagaagctgcagtatctaagctcacacttgtttcttcttgaatttgtgatttagcagttttgggattaggcatcacgtgctttacaaagatgttgatctgtaattgctagtactgactcttttgctttcatgatggattatataccatttgcaattgatagtctctgaatctttattttctttgcaaaagtagcatgtcatctccaaaaaccggacagcagtgcttgctaaataaagtgtagtatcgatcaacgtgttaaactatcatgcctttcacaatttgcgaactaacattgcactattcgttttgctcttatccatcacacttaactcttgcctgcatttctgctccccaagcagggacataagaaggcaatcactagtgaaggatttatgcataatgtggtattcttggctatcctcatatagttaaatttcattgatgctgttttggaaaatgactttataatgaggtgaaattatgctgctcagcttggcttactacctatagtgctatgtgacactcatgtacattatactccacaaaagaaagcaggacacactcatatcccattcactgtgtacttcctaaaacctcattcccaaaagcttctattcaaaccatgtttcatcctctcccagatcttggcactgtatcaggcctatgatgatactcctgatgcaacagcaactgttgccattttgcctctgatctcttgggtgactaatttctggatccaccttaaaaactccacttcagattattgttggaggacactcaccacaggtgactccttacgggaaaatgtcactgaagtactgttatggactatattttattatccccaaattcatagattgaattcctaacttccaaagtgactatatttagagataggacctttaaggacataattaagattaaatgaggtcataaagtgaagctctaatccaataggactgatgtctttgtaagaagaggaaaagaccctaagatggcatacacagaggaaaggccttgtgagaatgcagtgagaaggcaactgtctgtaagccatgtagtgaggctgcaacagaaactaaaacagctagaactttgatctgagatttccagtctccagaactgagaaaacaaacttctattgtttaagccacatggtctatatttggttatagaaattctagacaactgttacacagactatatactgttaagaataaacaaataaataaataaataagtaaaagcatgctatccctatccctttgctctgtttcacatttatgtgccggtcttagcttagtttattctgctataacagaataacacagactgggtaattttaaataaacagaaatgcatttggcttatgggtctagaggctgggaaatccaagagcatgtctctggcatcttatgagagtctttgtgatgcatcatcccatggcagaatgtgaagggacacggagggtgagggcaagagagtgagagaggaaaagtactaaacctaccattttaccaggaacccactcctggagtaactaactcactccgcaaaatagcagcattgatcccttcatgagggcacagcccttgatgaccttaatcacctcttatcagtccccacctcccaacactcttgcactggggattaggtttccaacatgtgaactttgggagataccagcaagccacagtggtacccatttttgtcatctgtagatttggctctttaccctgaccaaagacttctgggcttgagtaagctgagtgtgttgcaaagagtacttagtttagaaagtagctagtccaatgtgaaactccttttttgcctttggtgaaatgaatcttgtcaccagattctggcctggatcttgcatgtttactgctcagagcttcttcctaggaattaaatcctttgttgctctttgttttttgtattctgactacgtagatttgctctttgcctacataaagggacaaacccaccttcctgttgttcctttcttagctgatctagctttttgtatttgactgcagtccccccttaaattgtgttttccaccagcttccactgtgttgtggaaacaccctcactccttctcatgaacatttgggaggtctatttttttcattttttctaagccctgctgaatcattaccagcatatggggaggagggaggcagaaaccaagtatcactcccctgaagctactcaaacaggacagtgtctgtttggacacatagccagagtgttatggaagaaattcttgtaaactatgtattcagtcatgatacacatttctaaatggtgagtttcaaaaatagatgattccaccttgcaaacttgtgcaaatgtatataacagacagagaagcagcagcctgtccatgtcaacagccatagaaaatgtctgacacttcctctgaggctagaaacagctgttgatggagctcacagcaaccaagacaggtgttcaagttagaatcaaacagttgtcaaaatttctacttctctctgtttctttaaaacatcgacacattgaagtgtaatgtagttttcagctattaatggaattaaatatatagattatctaaaagagtaaaaaaggtttaaaagagcaacttatttgggatcagttatttccacatgatgaggcatgacctaactcaccttctgaatcataatcatcataataataacaataataacagactgggcaccatggctcacatctgtaatctctgcattttgggaggccacagaggggcatcgcttgaggccaggagttcaagaccagcctaagcaacatagaaagaccctgtcattacaaaacattaaagaattagcccagcatgattttgcatgccagtagttccagatactcagaaggctgagagggaggatcacttgagcccaggagtccaaggttacagcaagctatgtttgggacattgcatttcagcctgggcaacagagtgagaccctgtctcaaaaagataaaaagtaaatacaaataatcataaattttattaatgccaggaactatgctaggtcctagggagatatgatgctcaagacaaaggctctaactgtatatattgtatactttagcaactttataagttgtatactttggcaacaaggataattgaataaataactaggcaaatcattagaaacataagtaattataatttctatgctaaggagaagtactttgcaaagggagaatttataaattgagcccttgacctagggctggggaccaagaaacacttctgtgaagcactaacatttgtgctaagatatgaaatatgagaggggataaccacagggagaaatggcaaagtagactctgcaagaaaacagatgatataaaaacactgaaccaagaattgttcattagaattgcagaaggttataggagccagataggaaggggccagatccttcaggtttctgatggcaatgataagtaattagttacttagagttctgaaagcactagacagctgtaaagaattcttaagtagggaataatatgaacagaacctcctttaaaaaaataacattctggctacaatgttgagagtcaattggaaagagacaagaacagtgatgagaaaacgaaggaggaaactagtagccatcaacaaggaacagtggcatctctcagttcatgccatatacaaatggccagaggcttcctaatttgcttcctaattttcaaaagtattctcaggacctaggtgtttctttgaagatgacctcattcattcattcaacctccattgtttgtgcactgaccctatgcgaggcacttgggttcgcggagggaatgcacagccctggcccccaaggagtcctctagggacaggtaattgagttatggtagattgggggttatcccaggagtaaacaaaagaggaatagtcacactgcaggccacatgtggtggcacacacctgtaatctcagcactctgagaggccaaggcaggtgagttgcttgagctcaggagtttaagaccagcctgggcaatatggtgaaactccatctgtacaaaaaatacaaaaaaaaaaaaaaaaaaaaagtggggtgtggtggcacacacttctagttccagctactcaggaggctgaggtgggaggattgcttgtgcccaaagtttgagactgtagtaagctgagattgcaccactgcactctaaccttgatgacagtctaaaaaaaaaaaacagacaaacaaaaaaggtgacactgcaaatggcacctaaccagaagctggggagttaggaagtgtttcacagaggtaatgctggtaatgcacataagcgaaggaagaatgaaaattatccaagtgtttctcatgagtattggctgttacctataagttattagtttgacatttaggaaagttgaaagcaagaccctaaaaactattttgcttagttatgtcattttttttaggagaaaaatagttaccatgtctgctatggcttgattgtgtccttaaagttcaagtgttggaaacttaatcccagtgcaacagtgttgaaaagagaattcctagtaagaggtgattaggtcattaggactttgtccattactgttatttcaagtgtgaccttgttataaaagtgagtttggccacttcttgcccttttgctctttcattctctcttgcctttctgctttacattatgggatgacacagcatgaaggctctcaccatgtgccaacatctttatattgaacttctcagcctccagaattgtgagatataaatttcttttaaaaaataaattacctaatatttttattcttttatagcaatacacaatggaagaagacaatgttgttttgcctgtgtcccttatggcacattttattatttgcctatatatgtctctgctcagttctcaaatattgtttttaatcaggtctcatctttcctactcaaactaatttccagttctttgcactcttcctgcttctggtgtataattccgtctccttagcatcttttattagtcagagatcgtgagattgcatttgacagaaccacaactgaaatggcttagtaaaaacaggaacatggttagtttatctagcttgtaattgaagactacaccagttcaaggcacctctggatacaggaatcaaataagatcccagctatgttgttcctctcttcctccccaaagtgctcccagtcgctcccaccctctcagtctcagccaccctttctgcctctcacttctgcttcactcccaggcagatctttccacctggaagtgagttagacacaagcagtcttaggatgacagcctaacagtgtgtcccaaacagaagaaagcagtctttcccccccaaataagtctatggaaattcagaactgagctccaaatggtcagagagttaatgactctggccaggaatatgacctatgttggttgcccagacatcagcccacacacacactcctgacaaagaagaagtgtggcacctgcttcacacagatggcatgagctaacagtgtgcactgcacaggttctctagagagtgttgaggtgctatcaccagaacgagaatgctatggaacaatctctaccccagaacacacctgcatggtcatcatggtcatgtatttgcaaacttggtttctctctctctctttctttttttttttttttttttttttttgaggtgaagttttgcttttgtcacccaggctggagttcagtggcataatcttggctcactgcaacctccgcctcccaggttccaatgattctcctgcctcagcctcctgagtagctgggattacaggtgcctgccaccacgcctggctaatttttgtatttttagtagagacggggtttcaccatgttggccaggatggtctcaaactcctgacctcaggtgatcctcttgcctcagccttccaaagtgctgggattataggaatgagccactgcagccagcctggtttcccatctaattctctttctcccgtggaggcagggatgaagaagattatcttagtccaggatgctattagcctggatggcttgaataacaaacatttgcctttcatgactctggagcctggaagtccaaaatcagggtgccagaatgattgggtttttgcttactgccttcttactagctatattgtcacatggcccttccttggtgagacagagagaaagagagagagagagatcttgtgtctcttcctctttcataaggacacaatcctatcatggtgctccattctcatgacctaatctgatcctaattagctcccaaggtcccatctccaagtaccattacactggggattagagcttcaacatacgatttggggaaggacgctaacctactgtctacaacaaagctctactcactgaaatcacctacatttgcttctcctagaactcatcttgctgggcattgcttccaccttcaatttttgttaccaaactggagcactgtatccaggacctgaaatctgtgaactcaagggtttttggctttagcctcagccattatttttctattggttgtattctgatataatgtgaccccagattcagaaagtaggaagacaagttcttgctttgggggctgaaatgcaaactgaaggtgaaggaaggacaatgaatgctcagttggcatttcttaggtttcaagcaaagaagaagagatacaggtggggaagcaagtgatgatgtagcaaccagattatgtagttgttgatactcactgctttatttcccccactggccctccatagctttaccagagtcttccctaaacctggctggcagctgattagaaatgccaaatttctaatgccactccaggcctgctggatcagaacctacaatatatgacaaagctggcgggtcattcacaacaactttacagttagagaaacaccgctctgaaagtctgagtgccaggtactctgtggttcagggtgtggggagagatttgagatcctacacttggctataatgttaatgggacataattatttactaagctcctcccacaagcaaagtgaatttcaaggaagaaatgttgggcttacatgaacgtctcttctctttatggaaagttacttttcattgctaatattggaagactttttttttgtaagaaagttatattttctttcctgtagaccaaggttagttgtgacctcacatacctaaactgccagtcttggtcattaattcacaccccaactctgcttacaaaccgtttatccatcccctgccctggtttctaacatgattctttattacctgctcagctagcagactaaatttattcaattttcttttcctttggcacaatcagccaatcccaatgttgcaaactaaaatcaaaccagatgtgctaagaattttattgactattttatgtaacaagctgaatgaccagaaggctcaaaccaaattaattgaaaattaaagcagagaagatttaagccagacactatttaaacaggcttaaaaggttagcaaaggaaaagcacataatcagtttgtttgagtgataaaataagaagttaagctgaattggggagagaaaacttgcctcttgaactgtagatttatcttctaaatgaagtatcaggtgttttaatgtttttgcaattaaaaatgaacaaatatataaataaatataaaagcactaactgggccaacttcttgcatgttacactgaaaaattatctggtagatttgtaaaattgaaaacagaagctttgggaagtagtaaaagaatctgtgtctgtgaaccagagtgcactggcttcaaattcccacagaccctgtgcgtgttacaactcaccagtcaagctgcacaaccctgagttatgctccttacctgtgaatggaaatagtccagtgccccaacttatccaaggggaatatgtgccaagacccccatggatgcatgaaaactcagatgagaccaaaccctatatatgtttttttcctagacatacacacctataataatgtttaacttctaaattaagcacatcaaaatattaacaataataactaataataaaataggacggttatgacaatatactgtaataaaagttatgcaatgtgttctctctctcttaaaacgtcttgctgtactgtactaacctatctttggactgcagatactgggggcaaactaaaacctaggaaaggaaaactggatgggagggatgactgtgacagcaactctaaaggaccattgtacagattaaatgtgagtattgatttacagagcctgacatatactacagatattcagtaaaggagaataagtaatattgagggtaaaattgatagaggaggcatgtcaggagtgagattgtttgatgccagtgaacatttatttgacaaatccacttaaactgaaaaaataaagtcacctctctattttcatatttgatcttcaaagccagcagttacagtaggataggtagataatttcccaacttaataaatatggagggaatacaaacagcaatggggtccaatgatgatgtaaggtccccagccattctgaggcagagctagggctgaatcccagcttcccaatgacaaaagtctggggcctttagccagagcggtgcctcccctgaggatatgctactacgcatgtgatgtcccttgcagctgtgtcccaaggcccctgctgatgaccatgtttcccatcaagatagttgagacatgaaagagaagggctctgcatagaatcaacaaaatatcgtctccacaaggcaggcgatcttttctattccacggatttatctgaaatacatatttatcctaagggcataacaggaacagtgtcttgcctgtactaggcatcgggaatatttgttgggttaatcagcaagcatgtgcttccgtatagcaatggaaggtggctagcttacacagtctgtctgctctgggcaattttcatcttcacgaggcctgaatctcttaccttttttttttttttatgagcattaagttcagggagatggagtggttctcaaatgttagtttatgcataagaatctcccagggtgtttattgtaactgcagatttctattcctagcatcagaaactaagtcagctgattgaggtggttcctggaaccctgtgttgacattaatgctggcatattggggcaatgcattgcggtccctgatgtagattgtaggtggaagtgtgggctgtgtgtctgtgtttttgtgagtggaaaaggagggaggaggaaggtgttaagtgagaaagaaaagatttgaatgagtggaacttcctacttagtgggttggtaaactctttcccctctattaataataacttttatctccacctcccttctgaaggaaaggtcgggattggctagaatcgtaacttcccattacagtttaatttccttccttcctctaatgccccctttcccgtgcccaagccctcccttaacaaaccctcggagagagcaagaaaagaaaacaggcctcctcaatttccctaatgattcttttgaaaagcctttttttttttaaatttgtatttttagatctcttcaaacaatgttcctattagaaggttgtcaaaggccccgtgggatttatggaaattttcattaagaaaaatagggaataatttcaaggacagtgtctaatgtcataaaaatggctatttttaaagttatggataagtagaagaagcttccttacctcatgaaccgcacttgcagtgggagcttgaggctggcaggtggcagagggagacccacataggtttaagcccagcgctcagcagccccagggccttgtgcaagtgcctaaccatgctgagtttaatgccagtcctcgacactttcatgactgtttttctttaaatttagatgaaaatgagacagtctctgtaaataaaactcagtatatattcctggtagtgagagaagcactccagtactattgggttccttactctgatactgcaagacaacttcaagtcttctcacgtcttcctaagaatcccttcagatgagcttctttgcttcatttttttcttagattgtatcttttttctagactatttctaataacctatcatttttttccctgcctgtattaatccactaggattgccataacagaataccatagactgggtggcttaaacaatagaaatttatattcttacaattctggaagctggaatgtccaagatcaaggtgatggctggtttggtttcgagtgaggcctctctttctagcttgcagacggccgccttctcatggagtcctcacatagcctttcctcagtgcatgtccttggatggaggaaggaaagaaaagaatagggggaaagagagggagagaggagtgtggggagaaagcgagaaagaaggaaagaaagattttttgtctttttacaaggacaccaatcctactaggtctccacccttaattacttcctaaaagtcctttctccaaatatgttcacattgggggctaaggtttccattcaatttgaagctcaaatttcctatgaattttgggtacacatgattcagtccatagcactgcctaactgcagtccttaggttctctaattttctaatgctcccataggaggaagtaaatcatttgtacaagtcacctgacggtcacgtgtattcactcagtgaaactttgctaatagctgtctatatgatgaactctatactaggctctggtttgcccaaattagtaaaacatgatctctgcccttctggaatctaactgggagaggcagacacttaaaaaaattagagcaatagcatattacagatatgatcatacaaactggctcatggtactgcagggtacaaaggaagggatcatcacttatgactggaaatgaagattccagggaatcgtgaaataatggtagaatgtgatgtggaaaggaaacagaaggcaagaaacagcctggaacagcaaaggtaataaacaaactccagacaactcaaaggctctagaagctgaatggaagtaggtgacccagtgtgagccataaaaccagcatttcatatgggggctccttagtggaagaactgatagcttgctgaagagcaaattctttgtccttcaaggcattaagtgtattttaacaataaagtaaagtgtttgaaataaatattaggttagagatatatgggattgagtcaaaagtgagttttgcaagtgagtaagtctttagcagaattcttagtgatgagttatttctttttttatttttattttttatttttctgagatggagtttcactcttgttgcccaggctggagtgcaatggcgtgatctcggctcactgcaacctccgcaccactccccacccgccccccggcttcaagtgattctcctgcctcagcctctagagtagctgggattacaggtgcatgccaccacacccaactaatttttgtgggggtttttttgtttgtttatttgtttgtttgtttgtttgtttgtttttgagacggagtctcgctctttcgcccaggccggactgcagtggcactacctcggctcactgcaagctccgcctcctgggttcgcaccattctcctgcctcagcctcccgagtagctgggactacaggcgctcgccacagcacccggctaattttttgtatttttagtagagacggggtttcaccatgttagccaggatggtctccatctcctgacctcgtgatccacccacctcggcctcccaaagtgctgggattacaggcgtgagccaccaggctcggccaatttttgtattcttagtagagacggggttttgccatattggccaggctggtctcgaactcctgacctcaggtaatctgcccgccttggcttcccaaaatgttgggattacaggcgtgagccaccacgcctggccagtgatcagttctttcatcggggctattgaatgaataggattcagctctgggctctgaatagactggaaattactgtgtgtgcattttaacaatgtatcgagaacatttatcatgtttctcacttaaccctgtgccatcatcgatatgtaacagtcactcaggcttgcacattcaattcgtaccaaaaatagtctatgaggtaactactctcgattattatacgattaatcaccagtcaggagtggttagatttgttttgttttgtttcgttttgttttgttttttctgttacatttaggcatccaatcattaaatgtatttgtaacagaaaaggcaaaacttctagaatctctgttactgcaataggaacttgttcaaggcatagtccctaaattttaggatcatttgacactgaactgttacatcagacccacccaagaaaggtgtgaacagtagccaacagaaaatcaagctgcaggcactatttttgttcacagaattgcctagaaactcaaaattcagcttctgctctcacatacctctttctttttctgtcttaacatacatttctatttgtctcttgacctaaaaacaagaaaggaaaaaaaatctagctgtggctgtgtcctcacaccccttccacccgtggtaactgtctagaatttagattgtgccattgtctggatcatgccatcatgtctttgtggctaattgaggatacagcatacaccctaggcaggccagcccatggagagtaatgtggaatccaataaaaccacagggcaggcagggggagtgatggtgcgagggataccagaaacctttaatccagatcattcctgttttccattcaattggtggtggtttgcctaggaccccaaaactgtacttgcagatgaacttactacttttcttcctaatggcatcttcagacttagaactaaatctcagacttcagttgcttcccttaataactgaaaatatactgcattatattccttgtccttcaaagtagcttttgatgtgttggcccaacgggtcttttcagaaataccgtgcgtggatgatttgtagtaaaactgagatgctgtatattttccaagtaccagattcacaaggaataatgcgataatgatgccttgttttctcaagctttcagacgtgccggcctagagctggcaacatgcaatctcgtactacttcatctgaattactgaaatgggagacttctgtctgcattctattactgatttccgtgtttcacaacctgcagtttcctagtcttcaggggtaaaggaaacatagctcaaattcaaaagtgccttgccaaagccagtaagaaaagctatttctccttgatttgcagcgactcatttgaatctccgtagtgggccctgagagacccatattttgtctttgggagcaggcgcaacacagagttgattcatgattttagctgaggggacacattgaggcaccaattgactaaattattttcatgtggataatggatttagggccttcacttgattatgtctgacttctcccagtctaagctcaggattcccatcttgattattttaaattaataatatttatgagtttgtttgttttcgtttagaaatataatgcatgcttattttatacaatacaaaatatatgaaaaagaaaataaaaatctctaataatctcatcatttttacccaggcatttcaaaagccacctatgtatgtatttatccaactatcagttcatctattcatccatccatccactcctgcatatcctactttacgaatgtatttgacagcttattttatattatgagcatgttcttatctaataaaatatcattaattacatggtcttagtgtcggttgcaatttttgtttcaaaatttcttttaatattaagggaaatttaactgaatgtgtatatagtatatgcataagtatataatgcatacatcaaacaaacaagccttttttttttttgatggggtgttgctctgttgctcaggctagagtgcagtggtataatcacagctcactgcacccttgaagtcctgggctcaagcctccctagtagctgagactccaggcacatgccaccatgcctggctaatctttttaactgttgtagagacagtctttctatgttactcagactggttctgaactcctagcctcaagtggtcctcctgtcaaggccttccaaagtgctgaggttacagggcatgagccaccacgctgagcccctaatacgcctttctgtctggtcagtcagttttggatactacttagcctatgctatccttcctccatcagaggaaaacttgattatataatatgtaaaatttgaaggctaaaagggagctcagagaccatctggccctgtggttttcaaatctcaagggttccaaggaggtgcctcagggtttgctttgggccaaggtagaagcaagcagaacaaggcttctgctcggctatcactggagctgctccacttctctgttttataaatagtgtcaggtttcataagatgatgtatttttaatgtaatttaatttaatgtttagtataaacgttttgctgcttttaaaaaaatacttgaaagctgttgatcttgttcaacttctttctcaaggtggtcgcccctcctacagcaagcctgacaggtggctctgagaagctactttatctcccccagggattcttggctccgcatgaaagtacaaaccctgagctgcaaggggatcctgcatagcttgaaaaaaatctacccctcatggcagtgattaccactttaggaatttaggtatatagtctcttttgggtctaatgcatatgcagcatgagaaaaaaaatttctaggagtttctgggaaagaaagttcttcattctcatcttgaacagaaaagatggctctccttcctacctgctgatgtaagtcctgatataactactgcaactcccgataccagcctgaggatggaccatatacagaggaagccagagctaagagaactacagagacatagatgcagactccaacagaacctcaactacttaccgcccttgaccccaccttcaactctcaactgagttggttttattgccataattatttgggccagcaggagttggggattctgctgtacatccactaatgaatgtaagatgtgatcttcaccatgcctgcagaccacactttcctggaaagggttagtagccctggagtgggttagtaacctgctgggtgttacaaaagagaactagcctggggtcggaggacctgaatatgattccaagcgaaaccagataaattttcttcctgtgaagttgcctaatatctctttaactcaattagcacatgagtgaattggtgataaatatctataatacataagtcacaggactgttaaaaggttcacactgaagcatgttatgtattatacaaaatgtaaggaggctgtctcatatttgtgatatctgcagtgtgctaagaatggctctcacagccgggcacggtggctcactcctgtaatcccagcactttgggaggccaaggcaggcagatcatgaggtcaggagattgagactatcctggctaacactgtgaaaacccgtctctactaaaaatacaaaaaattagccgggagtggtggcaggtgcctgtagtcccagctactctggacgctgaggcagaagaatggcaggaacccaggaggcagagcttgcagtgagcccagatcatgccactgcactccagcctgggtgacagagcgagactccatctcaaaaaaaaaaaaaaaaaaaaaaaagaaaaagaaaaaaaagaaaagaaaagaaagaatggatctcatagtgaaccttcctgtatgccaaggtctacactaaaaacttgactttcatggtcacacacaaaaaaaactgtatgaggtaggtacagctactcaattttatatctgaaactcagatgttctttagaatcccgaatgatctgggttttagaaaggttatgttgagcatgcagtgggtgctatgcagcaacatctgcttagtctgggcagcacgccattattcacacataaatatttctgctgaagaatatgtggctatttacaccgggtggcttcaactaagaccataaaaacctcacatgacttcagggcagacttacctttagattaagttcaggtcagatttgacaacccaatgaattaataataatactaatagtaatgatgataacagtaataattttcaaacatttttgaaaattggaactataaactgtgctgttttatccaatgttaccaatacaaaaactaaagcatgcaaagtttaagcaaattttcacgtcactcagcttttaagtagaaaagctaagactgaatgcaagctgtctcaggagcctgagacagaccactttgcttgccactttgctcgccagtgctcacaaaggctgcctgcccatctaggccctgtccaacccaacagttaatggagccatctacattatctttctcaaagggcatttagaacatcaaaccatgtattccaaatctcagaatttttttttttctggagggaaaacaaatacactttttctgctttaataattctgtataacatattatttggtctaaagagaagttactaataggcaattattaaagtctaagagccagttgagatatccaagtacagttgcccaattgcagatcactgaggacactgatttaaaatacacatacacatatattcaaattcacaaacagacacacaccatacacacgtaggtgcacccttaaagtaatggaacatgtgtgtgtgtgtgtgatacacattattatattccagaacttttgctagagatgtgaagccagcagtatgctagacacagataagcagagacagcacacactccttttttgtttctttaaaaattgcagtgtgagtgataagatctggggttgaagtgtttgtgaggcttcataggggaaatgtaaaggaagtaagtgcttcccaaaagatgcaaaagtgcagcaagactgggacgatgagctgagactgcactggaggcagtggaggagaggaaaggagttgcagtcagcggccacagcacacaccagtgggtcctggttcagtattgcttggccccaaaactacaggcagagcatttgacagggatgagatcacagggcgaagcaaacaggggcaagtcacgcaggcctcttttgctatgtagaagagctgaattttttaaaaacattaacatctaaaccttaagtagtgttaagctagaaactgctgttaaaatataccttcaattcaaacagaatatatattttaaccactcatttttataaggcctagtgttaaattatggcttgaataatcagtaattcttcaaagtatggatgaatctgtctcacatttcaggtacagtgcagagacttgtgatcaggaaataatgagataattatattactttttgctccacagtcaggctttatcatttttaaggaatgtctaaaattctattaagtgtaattgttgaagctattaataaaccaagggaagagtttgaaaaacagcacttagagtttccctttagtttcagatcatgtctgagaatagaaaaagaatctgtataaaatcctggggcagaatattttgcaatattttagctcaatccaatgttaatcctggctacacagcctctctgttccctaagccagaaaccccaaaatctccttccccctcctctcctacctcccacttccaatcagtcttccatctctatctcctaaatatgcctccctctatttctctccagtccccctgcccacaccatcattacagcacctactgggtccttgtgttgtcatcaaagctcaactctccaggcagtcttcctacatcctctcctctagttgggtagaactggtaactcccctcttttgcgaaatacccaaacctcctgggatagtttttagccttttccactgggtatctgtctcccttcctgctctagctctggcctaccctacctgttgagaggaaggatggtgctacactccgttttcctctctgcacttggcatgctgccaacacattcacttgttgagtgaatgacaagatacctataaaggttctcttgcccagttatttcattccttcatttctgtaagtggcttttcctattaattaacatgctcattaatacataagtccaaagcagatggcagttcttcacttttgggattttcagcacattgatatgataagtggcaaaaaaaaaatgtatgtaaacaactcattctccatgatattaatgaagggtctctcattccctgttaaaggtatcaaagactattttgtatcaggattctgccttctggtcacatgaagaaaagctaaacctcaaactggcacagttgaaaataagtacctgattttgtatttcagtgtagactggggtatatttgactcttttccagactaatgttattgattttgatcatgtgtttggtgtgtgtttgtgttgtcatagactccttttagaaattatgcagtcatttttattttccacattactcatctccattctcgaggtcagggtttctcagcctcagcatggttgacattttgagccagataattcttcgtgggggcaagctggtatattgcaggacatttcacagcatcactagcctctacccactagatgccagtagcacctttcccctatactgtgacaatcaaaaatattcagaaaggaagggggttgggaaggtggcaaaattgcctcaagtgaaaaccactgctctaggtggccagtgcaacgtgatggctatgtttttataactccttccacagctttataactatatattaaaaggcatgcatagaattttttgttattctttgtttataaattaagattgtatcccttctctacttcctccaagtcaatagatatgataccaactgattctgttttaatgtccacaaaatcttccacggtacaggtatgttacagtctttttagccaacgctccctgtgtgaacacccactctgattccatttacgtcgtaacatacaattccacaacaagcacctttacagttatatccatttatgctgcctcatttatttctatagcctaccttccctgcagtgagatttctacactgttaagcatgtggatatttaatggaaacagatgttgatagattgctttcctcaaaggctgtcacaatagaaattttctccagcaatgtatgagagcacctgcccaccagcactcattgtcaaggttctactttttaatagatctggagtgatatcccattgtcactgtaatttgcatttccctgactaatagtaatattgaagaacttgttgaataaagtgtctaactgaaatagtgtgacctcagacatctgcaaggccccaagtcccgcatttactgcccacttctgatttctggagcagctgccacagccactgacatgcaagctcagactcacctgacctcacatgctctaaaattacgctgtatgttgtaaacctttaaccccttcatcaaacaagctttctgtgcaccaaaagaaggaaaaaagcataaagattcaagaaccttatttggcagcattcaaggaaaaaaaaaatactttcctcataattaaattgtctgtatttaattatttaaagtattttcacattttatgtgaagtatttctcacattttatgtgtgtgggtatttgtgtgttgagcctgtgtgtgtgtgtgtgacccctccaaacagaaaatgtgagacatgttcactggtggaccgtgcatttctgatgccaaattaagtattctctgtttttaggaatgcgtcacaatgggaaaagagatcaattgtaaaatgaatagctgctgggttgagtttaagggaagatggaatgctctgtgagggagaatggagtcgctatgttccagggctatgataagcagtcattctggagatcttgtaaagtctttcaagcagcaactgcagcatagctccacagaggatgagctgaaggaaacaagcttaccccattgtaaggatgcagaggaaattcagtgctggagctaaaaataaagaaaaggattagaatggctgggcgcggtggcctgtaatcccagcactttgagaggccgaggcaggcggatcgcctgaggttgggagttcaagaccagcctgaccaaggtggagaaagcccccgtctctactaaaaatacaaaattagtcgggtgtggtggcacatatctgtaatcccacctactagggaggctgaggtaggagaatcacttgaacctgggaggcagaggttgcagtgagccaagattgtgccattgcattccagcctgggcaacaagagcgaaactctatctcaaaaaaaaaaaaagaaaaagaaaaagaaaaaaagaaaaggattagaatttcttttgccttgtgttttcatcatctaaaaaaggggaaaagtataaattccactatgaatttttttgaaaaataaatttcagcataaaggagtacctgctcattagagtaaattcaaaacaaaagcaaaaacaaaaatgttttaatagacatcttgcagtggtggtctagaaaatgtatttttcaaggaagtgtggttagaaattaatagaatgtctccaaggttgtagtattgggttgatagtcccaatttccattctgagtttttatgtactctggatcttttaaaatataaaaaaattaggaagttaaggcaggttctgttaagaggattctaattttaaggctctaaatttaaatttaaaatgcttatatcggccaggtgaggtggctcacgcctgtaatcccaacactttgggaagccaaggtgggtggatcacctgaggtcaggagttcgagaccagcctgaccaacatggtgaaaccctgtctctactaaaaaggcaaaaattagcagagcatattggcacccgcctataatcccagctacttgggagactgaggcaggagaatcgcttgaacttgggaggcggaggttgcagtgagccaagattgcaccactgcactccagcctgggtgacagagtgagactccatctccaaaataataataataaaataaaataaaataaaataaaataaaataaaataaaatgcttatattgcttttataaaccattttcttatagacttagttttcaaaacaaatctgtaaagaaaatatattattctcattcgacagatgacaaacaaaatttgtcagggcttggcacctgcagcacaggttagagattgcattcattcccagctctgccagaaaccaggcaagtcatttaccaccaagtgttagtttgttacatgtttgagagggcttatcatctgtagatactcaagttaacctaagaaattttactacagtcaaataccaggtaggacaggcatgtaatataaagggggtaagaggataaatgagtaaaagggtaaaaatggtatttgagaatctatattgcagcaaaatgaataatgaaaatcatgataataaatcagggtcatcggtatgtgtgcaaagtaattatttagtagagctgttctgtccttgttcgtatagtctcagctgaaaattgactaacagatatggcatattattagctgctttgcaatgactccttgggcagttagagttttctgaggaatacttgtccatggagcaggtcctcaggtgatgaaaccatcacttccttctggatcccacaacctcaccaggcagaactactgtctacttgcagtcctcatgctgcctctctaaaattcaaagaattcaaaattatcttttcaataaacattagctgagcatctaacatgtaactagcaatgtgctctgttctgtaatatagaaatattaagaaggattagactatgcttcttcagtgcatagtcttctaaagtagttggcttataaacaaaaaacatttatttctcacagttttggaggctggaaactccgagattaaggcaccagcaggtttgataacagatatggcatattataatcttataagtaatttggtaagtttatgatgttatagaagttaatgtgcaaggcatacaggagacccatgtgtgcccaagcgggtcaggaacactttcccagaggaggaatttgatcaggtgacagaagttctcatgcaactcagaaacttacaaaacagagatctcagatccttatctcatagcatctccagttgcctgacttgatcctaaggctgtaataggggagcaccaaaacagaatcccatagactcaagtcaagacctactcttataaacaaatggaaataaagcttagtacaagtgagagaatcttgtgtgccctatgagtcatacccttcagcaatgtgtctcttgcatcactgaagctgtgcaagggaatcaagtgcagcaaataagtcaggggcagaggttccatctacaggagaggacgacacctgtggacccgactctgggaggcagaagcacctagcctgaggtggagattcaagcctcatctatgtatagccctgacacagcttccacagcaccctcatatcacatgcaaaggacaggtgtgtcttccatttagcctgctaaatcaggcctgccaacccctgcctcctgaggaggctttcagaattaactagaccatgttggcagctaactagacagctaaggaaagaaagcattacctcatctttgcactggctcatttgatattccaccttcaattactccaactgaaagttgaaataaaaataaaaagttatggcctttgtgtgtgtgtatgtgggtgtgtgtggatgtgtttttgtgtgtgaaaggagaaatagagaaagagagcaatagagatttgaggttttagagacagagagaaaagaaggagaaagtatttgtgttaggttctgggagtgcaatttgggaaaagtagagagcattacgaaaaaaagagccaaaaatacattcattaatattcattaatttgcttgtctttttaaagacttgactatctattatgggttaagtactatgatggacagtgaggatgtagcgtgaaccagacagaaatagcccaattccatcacacctttagttcctagggaaccactgaattggtaaaaagttcatgtattcttggaattctggtggcagttctatttcaccctgaagacctgaaccaactttctaggcagcctgggagtccaggacacagacacagaaggagttcccagagccagagtgaatatgaggttgtactgacattgactgttgggcacagagcccttgtaatgaaatgtctaggccatagatgtatatgtcagatttaaataggtctgagagacatcaaagaaagtggaacttggagaatgataacgaaagggagtgagatttgcggtaaatggaatatgggactcaagaagaatgcctggagtgcttgagcctaacagccagctaattgggtcccttgagtttggagggacgggtaaaaagtgggaagccaaattagatgtgccaaccaaaggaagttcaaaggtgaatgggtttctttccttaaggactttgatagccttgtaaactgacaatgctgaaacaatgtggttagtgcaaggaggaggagacagcctgcatgctgtattactgatcagacagagaaggcaagcaggaggactttctgtaggactttctggaggagaactcagggaagagaaagaggaagttagcttttcgacaatggaaaaggggcattttataagacaagctttcatgaatctaaggtttttgtagttctatgagtttcaaggcaatcttgattgaagtattatgagtaggaaagacataagcacacggtttgtgaaatgctcttttattctagctctaagtagaagagtttcacacttaatgaaaataaaggagacagagttattcattcaggaacaggatgctatggcttgaatatttgtgttaccacaacattcatatgttgaaattctaacccataatgtgatggttttaagaggtagggcctttggaaggtgagggtgaagccttcatgaatgggattagtgcccttatgaaagaaacctcggagagctgcctaacgttttcagccatgaaagaacatagtcagaaggcaccaaccatgaacagggaagacagttctcactagatatcaaacctgctggtgtcttaatctcggagtttccagcctccaaaattgtgagaaatacatgtgttttgtttataagccaactactttacaatattttattatataaacttgaacagactaagacacagcgttttcatgatgaggtagtgaggaattaaactggtatcattaccactaatgtgaaagggagaagacaattcacaatcacatcacggaattctgtaaaagctttatctcatcaatgatgtttctctaatacagagtgtctccatgaagtgatttgtttttttatttcatttttggcataagataaactggtagaaaggcattcatcttggggtaaaaaaactttggctgtgagctccaactctggaactcattaacataatttaagacattgatcaagtcactttggctccctgagcctctatttctctacctctcaaatatgaaagggaggtgaggccatttcgaagcttccttcccagtagaatactgtacatttaactatatattgcaaatgagagtgaggattgataaataggaatctgtttgccttaactcatattcatttaaagaaattgaagaaattatgactatagacctccactagggggatgagccatgcttgctgggccccattctacttgcagccctctaaaatgagtgagatggctcagggctttgtacagggagtatgagcatgaaccacaccagctaaaggcttaagatttcagctcagccatgctggctgcaacaatgaagacatgaaatgagtataaggaggataaatgaagataacaaataagtaatacataggattaaatgtttgcaaaatgtgccagagtggagtgcagccacgggagacagccaaagtacattaagtggagacagaggagggaaggtgaggatgatgtttctttgtggaaggctcatcatcaagactgtatccccagggagcctgtgcatggggattaccattactcataagccatgtgcatggcctgtgcaaaataagcctccacaaagttgtgctgtaattatgaggatttcagcatgatttttaaagcactaaacttgtttttcagccaagatcttctggtgtgcatttgtgtgtgtgcctgtgccaacatgtgatagtcgtgggcagaaactccaaaagtaaagcataaagcttttctcatatgtacccccaactatgattaaaaagcctgtgcttgacagagaaaaaaacaaaataatattttattagaaagtaagtttattaaagcagctaagaacatgggctctggaggcagattccttcagagaggaaatctctgctgtcaaatttattagtagatgtgtgacctaaggcctacttcagtttcttcattcttaaaatgagcattataggccaggcatgatggcctatgcctgtaatctcagcactttgggaggccgaggcagcctgatcacttgagcccacgtgttcaagactagcctgggcaacatggcgaacccccatcttgacaaaataaataaatatacaactataaaaataaataaataaatacatacatacatacaaatattagttggggatggatgcacacccatagtcccagctacttgagaggctgaggtgaggagatcacttgatcctgggaagtagaggttacagtgagccaagattgagattgtaccactgcactacagcctgggcgacgaggttagatcctgacttttttttttttttttttttttttttgagatagagtctcactctgtcgcccaggctgcagtgcagtggtgcgatctcagctcactgcaagctccgcctcctgggttcaagcgattctcctgcctcagcctcccaagtagcggggactacaggagcctgccaccacacctggctaattttttgtatttttagtagagacagggtttcactgtgttagccaggatggtctcgatctcctgaccttgtgatctgcctgcctcggcctcccaaagtgctgggattacaggcatgagccactgcgcccggcagatcctgttttaaaaacaaaaactaaaactaaaaaactgaaaagaaacaagcattatacaaatacttgtaaacaaaattctaaccctctccccctacagccatctgaaaggacccctcttttcagctgagtgcattccaaggtcaacctgaaaaactagttcaggccatgatggaagtggggttttgacattataccctcctcagttttgtaattcaggaaaagccaaccagcattaacatcaacacagaccttaaatctgatgaaaagcatttactatctattctctctgaagtctgctagctggaggcttcatctgcataataaaaccttggtctccacaactccttattgtaacccagacattcctttctattgatgataactctttcaaccaattgccaatcagaaaattttaaaatctatctaagaactggaaggccccttcccctttgagttgtcctgcccttccagatcaaaccaatgtaaattttacatgtatttattgatgtctcatgtctccctcagctgtacaaaagcaagctgtaccccaaccacttgggcccatgtcttcaggaactcttcagactgtgttaaggacctatccttaaccttggcaaaataaactttccaaattggttgagaactgtctcagatacttttatgtcataagattgtcgtgaaaattaaatgagtatttttacgttacaaaagaaatagagcagggattgccatatagaatgtgctcaaaattgaaggcttttctgaaaagaatgttttaagaaaaaataaaaaaaagcagagctacagaaagaagaaaagttttttaaaaaagttatgtttaattcaggtcctacaacacatttttttttttgaaggacaatgtattgttcccatttttcatttatcatatataagataaatgagttctagcaagttggtactttagagtaaaaattccacaggggaaaagatggtttctacattgcagattttacattgatgttctctgttcttcaaaccagtagttttgtttttatccttagcttccatgcatgaggcagtgggttcgtagctaaccttgctcacattataggcatgatttaaagtatcttgcttcttactcagaattatttaagctcattcaattcttgaactcatcccagagctcaatccaaaatctccattttttgtcccctaaattagttccttctcccttctcacaccccaggagatggattaaagtttccttctttttatcactctatttaagtgcttataagcgttgtcttttagcaaggcttctcctcaaagaaatgcaaatgataaaggcgcctgtttgttcctgcagaggataaaaagaagagtgaagtatgcgatgtctctgggagaataagtttttttctgaacagttctaataggatggggtgagataagtagttctttaacagatatacaaaagaaaggcttgggaggtctaaagggggtagttttttatcctgatcaggtgaaaattaaaatctttagaaagaagatggttgtagaaactgctggggaaaagggtaagcttcctctttaccgccagaaggttcactgaaataaactgacaatagacaggttaaaaggagaaaaggcatccatgcttatgaacctgcataaccatgggagccatatgaaataggagactgaaagaagggccagatggctgaagcttaaataggacttcgtaggcaagaaggagacagggaatgtaggcaactttgaagggtaataaatgattgctaggggaagtaaatcggcccaaagagcaacattttgtaactggttctctgaaaactgaatagaaccaaagacaagacagtagcttgggataaagttcgtctgagctctggaggaagtgggaagtgaaacttcattgtgaacaaagattattttattacatagataaagtctcccaggtaatttatggaaaaaaaaatgtgtggtgtggtgacaacttttagttctttcttttctcaggtggttaatctttccaggttatttgataagactcttacgaagcaattttaagacttgcatttcttttgaaagacctttcctcagtcagataggggaacttccagagatagcccctcagagaaacaggtgaaggtgggggttgagaaataagagaaggttagaaagtccttggttctgaggctgcttctacagtcttccaactgcctttaattcaaaggtgctcagcatgccaaagctccataccttggtatattgtgctctgagccctaacatttccctgctcaaatatttctaaaagtttcatacatcaaaaactaagttggtggccgtgaagaaaaaaaacatatattttagtagctcggtggcaaaggataccattaaaccactctcctatctccgggtatttgtcagtccaattaaacagttggtttgtatttcagaaggtagtgtttggaggcttcccattaaagttaagcctctatatggctcaagcaaacaggtctttagcaagaggcatttttgtgggcacagaggaaaaacaatggttaatgtttggtgtagtctacaagctagttttttgtttgtttacagtttagaaggcagtcagttgagaagattcctagatttgggtttgaagtatcttcacttggaaatgaaccaggcagtggcaatctcacagatttttctgaattgtagtttatatcagatgttcctgtgaactcgccccaaaattgtacctgtaagatttgggtggattcttctcttcttgaggctcgaaatagcatgaggctctgggacctgtcaggaagtgacattttttacttataagactagaaactctgtgaggaaatcctttattcaaggtatgaggccaggtttccaggggcttctatagctttataatatcaacctcagttcctcaaagctgtctactcatattggaagatataatattccagtcaaagccttggtaatataatcagtgcttccaattgtcctgttacaaaaagagcagatacttaatgaacttatgcaaataactatattgccataataaaagcatactcacaaatagtgatatggttggtccccactcaaatctcatcttgaattgtaatccccataatccccacatgtcctggaagggaatggtgggaagtaatggagtcatgggggtggtttccccatgctgttcttgtgatagtgtgtgagttctcacgagatctgatggttttataaatggctcttcctgcttcacttagcacttctccttcctgctgccttgtaaaaaaggtgccttgcttcctcttcaccttccaccatgattgtaagtttcctgaggcctcctgagtaatgcaaaactgtgagtcaattaaacctcttctctttataaattacctagtcttagatatttcatcatagtagcatgagaacagaccaatacaaataatttccaaattttagagaaatcatgcaaaaaaaaatgcttcaattatgtttacaaaagtatatattaccaaattgctggaagtcatagaatgcttaaaaaatgtctttttgcatctggaaaacaaaacataaaaagaatcagcaacgtttcaaacaaaattcataaaaattataacctctcattagtttagttccttataattaattttgttctacttgatgttgagttagcaatttcatgagtccagtttttgcattagttttggaaattcttaccaggtccaataatatcagaaattaccagaaactcatacttgtcggagtccttttttttccatatatctttaaagacaacagtttataattaatttttcccatatgtccttaatgacaacactttataattccctataaaaaagcttcagacaaaacatcagaataaaacaattagctttaagcaacaagaattaaaatgaccatggttgaatatctgatggtagttcattataataatgtcgcaaatgacaaggaagtttgcttatatttgtagccgacaataatttaatagccaaaattatgactgataacatataccatgacatatcagatatttaggaaactcataaaatttggaacacatatgaatagtatatctatgcaagtgtaactcaaaagaggtcaaacctaattttttatttggcagtgctctctatgtattaaacatatcaaataaccttaattggtttgttatctctgttttgtacctttaggtgctattctggaacttccaaaactcagtttgaggtcaaaaagacttcatttgtattttggaattttttttttttaaataaaggtttaaaacacttcattaaaaataggatcacagattattacaaaataatagtcattcattccactaaccagaattagaattaaaaggctcaaaagaaaatacaagatgttaaatagatgttaaaaaaaattatttactctttcatagaaagtagactccatttttacagctaatcagaagacttagaaaagagagcacaagctcacagaatgtgtctctctcactcatcctctttttgtaattcactcaaaagattaacaatttttttaattttaatcttttatcaatattacatgaaaatcttaattcaaagaaaacattaatgtttacttttgtatcagtgtacttttgatattaaagctcatcttaagaaaagttcataaataatttccttttaatctttgtcaattgattacacataaaatttttatgattcatcctttataaaatttttataactttttaagacattttacaacttttttaaacagatatatatgttttactcatgtaactttctataaatctctctcttctacttactgatttctttctaccttgtttatttctgtactaaatccatatttttaaagaaccttttaaaaacctctacattggacaaaaattactttttctttaacaaaaatacattttcatgtctatttaaaataatttttctcaccaaaacacacttcttacttctcttgtatatcttgcacacagaattgtttccattaattttagtaattttaattacatatattaattaaaattttaattattagcaattgtaaaccagcattctgtagactaacacaattttatactttctataaatatgtgttacctcatagaataacatttcaatgtggaatagtacatatttactaactggcccaaatatattttgtctttttataaacttaagaaaccaaaaacaaataaacatatgtttaataagtaatgttttaatatttcatcttacttggaaatgacctagatattcaatgaacactcatttaatttaatttagtaaaactctaatgatgtagttaccaaagagatttagaaaaactttaagtaaacgtaatataaagcataattattattttaaaaagttcatttctaaacttttattccagttacatgtatttaattaacttgcatttaggtcaaattcatactgttatgattttaaacatctaatagtgataaaagttgtgtgtctgtattagatttaatgttgacagacatcctatttttaaatcaagtaatgttatttttatttaccaaagattataaatccacataaactttagaagcatttgagcttatttttttatttataaatgctcatttatcactaagtcaattcagtaccatgtagacagaatacaaacccaaagatatacacacgcatacataaaaatataggcagaccaaaataaagaatttatagctctgattttataattttaatcatgaggcaagtaaaactcactagtttaaaaggataattggagcctggcgctttggctcatgtctgtaatcccaacactttgggaggctgaggtgggagaaatgcttgagccttgggaagttgaagctatagtgagccgtgatcgcaccatggcactccaacctcggcaacaaagcaagaccctgtcttgaaaaccaaacaaaaaaatgaaaacacacacacaaacaaaaaaacaaaataaaaggacaattggatacaaactgtgtctttgtaaatggagcaagttaaagactgtctatctcacatggacaaagcccttattgaattttagaaaagacaaggtaggaaatttacatatcatcagcacagagaaagaacataagtttttccaagaaggtgtttgggtttgtcaggtggaacaaagaggaagatttaaaatatatgtcaatgtaatataaaataatagcaatccattacaggattttataagaaagtatacaaatgagagcctataagaaaagtttagaagcctgttttaaataactgattgaatataagaaggttgtagttcaaagaccaattttgttagatagatggtttttcaattcattttttgtttcttaactggattttgatttcaaggcagagcccggtaacaaataggaccaacaaagaatttgtggcttctggggcctaatacttatacatgtaaaagacaggtgtaactggaaggcaaagtactaagatctttaaaaattaaggacctaagcatgcaaagaaacaaaacaaatctgaatttgcccgctgcataatgaccagtactgtaattgctgccaattatctttaaaattgctggtcttgctggtgactcatgagttaataaacacccaaaggtcgagtgtcctcttacagtacaaagtagcccttggtactcctaaaaacccaaaagatcacacagctgactgtaaaacagtgcagagcttcagacctcagtggatgtagtccaggactctcggggctccatgaggaaggctgaggagcccaaaaatgcgttgtgtggtgccttttctgtgttccttaaggggtgtctggattgctaaaggcctatttttgatgtttttatgtaataaccagaagtgtgatgttttctattggtaattttttatccactgaccaccaaatggaggaggtagaagctttaagaaaaatatatcaagggaaccagatggaaggttgaggccatcagaaagaagtggaggcatcagtaaatgaaagaacaaatcatagaagagtcagcttgggagtttttcagaaaggcctatggagttttacactatccctggcaaaaatcatgtccacaagaaagaaagacagaggaaacagtgcatatggttaacaaggattcagaaagaggaagtttcagtccactgtgaagttttcatgggagaaacaggatcctatagagagattagaaagacctaaaaatgtggctgtttttaataaaacagttttttactttaaactgaactgaattggggaaggaaaagtctcagtcaggaatccagacatccaaatgatcttctggtcaaaaggattttacttttgttttaggtcagatttttgcttttcattttattagaagaatttctaaggcttgttgtgacactattatgtgtttttctttcaattcaatcttcccataaatgccaattgtgtaattgcataatatgagagttgtctaattttttttttcaaatatagaagactttccaacttaaagaatatattgtctggttatcgacaattaggatctccgatggtacatttattccaacagagactcaatccaatgaacccctttatggaatgactagatgctaaatctccaagttcagaataaactctttaagcaggaggtttccaaaaagggtgcagaagatgcagttgccattgcccccaaattttcatccacagaaacagactaagacggcaaaaagatatctgctaccacaggtggttaaagatggtgcttacaaatagtgtctctagtctccacccaaaatatggggtgctgctagtcacagacctgtcaatctatgacattgggtaggcacttctggtattagactttctcaacactaaccaggcaaccgaagttgaaataacaaaaggcccttagggatgggacttcttattaagagaaactcccctgagagctttgtacattcagacaaagagagtgctgctgaataacaatttgtgtcttgggtttccagtcttctcagactggccacttggcaggacccaaaaattgggctcccagctagcaaagaccaaaggaggaagattcccacctggtcacaaagccaggctgtcaggatataagatgaaaagagaactttatacaccaaagttctttttatgatgaatgacacaaaaagacagggacagagcaaaatgaagaccaattctgggaggaaaaggatgagacgacatgaatattcatactagatataaaccagagttgtaaagaccagtccatacaaatgtttttctcctattaatctaaatttgaaaaggaaggaaagacaggaagtgatgtttaccactcactcaactggattttgtagacagaaattaaggaggctgactggtaaaggtctcttacctttttgccagcttgtcagtcctaggttttctcaactgtagtttcaagtggatcacgatgattgtggtatactgccaactatgccggatttgcaggggtgaaaaacaaaacaaaacaaaacaccttctacctcaccctctgaagtttgctgaaataaacggataacataatgattaatacaagaaaggacatacatatttatttatgtggacaagcttaggagccgtacaaaacacgagacttcatgaatgactaggtggctgaagcttaaataactccctccttatagggatgagggagataaaaaaaaaacctaggcaattctgaagcgtagtaaatgttttttatgagaaatgaatgggcaaagagcagataacagattttaaatgatattctttggaaatgaaatgggaccatagtacagataatagcttggaccaaggaaggtgaggtacagaactctgctataaacaaaggttgccatattatacaaaaaaagtcttccctccctaaaggggtccaatttttgggtcctgccaagtggccagtctgaaaagactggaaactgaacacacaaattgttattcagtagcactctgtttgtccaaatgtataaagcagaggttttctttttttttcattatactttaagttttagggtacatgtgcataacgtgcaggtttgttacatatatatacatgtgccatgttggtgtgctgcacccattgactcgtcatttaacattaggtatatctcctaatgctatccctcccccctccccccaccccacaacagtctccggtgtgtgatgttccccttcctgtgtccatgtgctctcattgctcagttcccgcctatgagtgagaacacgcagtgtttggttttttgtccttgcgatagtttgctgagaatgatggtttccagcttcatccatgtccctgcaaaggacatgaactcatcattttttatggctgcatagtattccatggtatatatgtgccacattttcttaatccagtctatcattgttagacatttgggttggttccaagtctttgctattgtgaatagtgccgcaataaacatactggtgtgtgtgtctttacagcagcatgatttataatcctttgggtatatacccagtaatgggatggctgggtcaaatggtatttctagttctagttccctgaggaatcgccacactgatttccacagtggttgaagtagtttacagtcccaccaacagtgtaaaagtgttcctatttctccacatcctctctagcacctgttgtttcctgactttttaatgatggccattttaactggtgtgagatggtatctcattgtggttttgatttgcatttctctgatggccagtgatgatgagcattttttcatgtgtcttttggctgcataaatgtcttttgagaagtgtctgttcatatccttcgcccacttgttgatggggttgtttgttttttccttgtaaatttgtttgagttctttgtagattctagatattagccctttgtcagatgagtagattgcaaaaattttctcccatttttgtaggttgcctgttcactctgatggtactttcttttgctgcgcagaagctctttagtttaattagatcccatttgtcaattttggcttttgttgccattgcttttggtgttttagacatgaagtccttgcccatacctatgtccagaatggtattccctaggttttcttctagggtttttatggttttaggtctaacatttaagtctttaatccatcttgaattaatttttgtataaggtgtaaggaagggatccagtttcagctttgtacatgtggctagccagttttcccatcaccgtttattaaatagggaatcatttccccatttcctgtttttgtcaggcttgtcaaagatcagatagttgtagatatgcggcattatttctgagggttctgttctgttccattggtctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtgggaatggccctgaatctacaaattaccttgggcagtgtggccattttcatgatattgattcttcctacccatgagcatgaagtgttcttccatttgtttgtatcctcttttatttcattcagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgcacattgattttgtatcctgagactttgctgaagttgcttatcagcttaaggagattttgggctgagacgatggcattttctagataaacaatcatgtcatctgcaaagagggacaatttgatttcctcttttcctaatcgaataccctttatttctttctcctgcctgattgccctggccagaacttccaacactatgttgaataggagtggtgagagagggcatccctgtcttataaggagttcttctataagggccttttgttattttaacctcagttgcctggttagtgttgagaaagtctaatgccaggagctggcctcaaaaaatagataaaaagtctgaatgtgtgtggtgataatttttagtcttttctcctctctggtggttcatctctgctgattagtgagattcctagggagagggttttaatacaattgcaattttctttagaaaaaatttcctcagtcagataagggaacttcagagagagcccttctctgccattggaggttgcggaaaaaacaagaaaaagttaaaaagtccttagttctgaggcagcttctgagaccttcctgttccctttatttcaaagtgctccaaataccaaagtgccatactttgggatatttttcactgaggtccaacaaaaccaaaggttatggttgctcatttgaaaataaacattcaggtatggtgaatagtgaggtgaaatgtcatgaataatgtcaaaagaagagcagatggtcttatggattatattcacagaagagctgtaacataatctatctgagacttggggtagtcatggaggaaaaaagttagatgggcttagagagaaaaggaagaggactattcttgctgagtgccttatgttttctcagtttcattcaatcacactgtaactttgagaggtaaattttatacccacctttacataaagaaagttcttggacttttaaaaactttgacaagcattgcttagctagaaagttctagaaccctctctctcccattccaacctgaacagtaaaaacacattctttaactttattcaataacgagtcaaggtaggtctcttgtcagggagacaaatgaaaggctcatattttatatgtctccagtgcacttggcataatcaagagtgtagtataattaaaattgtagacaaaggaatgaagaggattaatgtgttacaagtttgttgactaggctggagaaaagaaaaagagacagctgactagtgtggagtgtaatatcacagaataatgatatggtaaactgggccttgtaagggcaaagggaattgtttccttcccctctgaagttttgagtttgcaggaggaaatagacaatagattaactggagaaaaggaatacaaatttttaacatacaaatatgtgtaattgcctgatgggtttttcgtgctcactgtacagacaaaaccaattcactgagaccatgacattgtattaaagagtttaattgatgtgcgggcaacccacatggggaaactggagtcatctctcaaatctgtttccccaaaggcttggaaggttaggtttttgtagacattttggtgggcaggggtgagggaatgggtgatgccgattggttggagatgaaatcacaggggtgtggaaagtggttttcttcccctgagtctgcctctgtgtggggccatagaatcagttgagttatgagtcacaagtcttgctggcgtcagtctgaaaaacatcttaaaaaaaaaacttagaatttgcaatagagatgttatctacaggaacattgggaaggtcacaaatcttatgacctctgtccacattactcctgagcagtaaaggattataggaagtatgtccacaatttcagcagagttctgtcctctctcatattcataatcttgtagcctttcattatttttacaaagggagattagtctggggaagggctattatcagccttgttttaaggttaaactgtcaattaaattcctcccaaatttagcttggcctatgccaggaatgactaaggacagcttagaagtcagaagcaagatggagtcaactctatcagatttctcttactgttataattttgtgaagatggtttcatgtgcactggaaacatacaaaggataagactcaaaagaaagtgtcagatagctgagactcaaatattctctttatgggttggggagcggggtaggaaaatgggatatgtaggcagttttgaggagtaatcagtgattttcagggaaattgaatgtgcccaaataatataccatactctgaaacaaagcacctctgagctctggagttgtggcaacaagttgtgggaaggtaaagggtagaacttcactgtgaataaagattgtactattattcaaacaaagtcccagtaatctcttggaaataccctaagaagaacagataaagtccaggctcacaggtataatcccaagctgtttgggagcctgagatgggacgaccccttgagaccaagagttcaagatcatccagggcaacatagtgataatctgtctctaccaaaaacaaacaaacaactatatatatacacatacatatatatatgtatacatgtatatatatatatatatatgcgtgtgcgtgtgtatatatgtacacacacactatatgtatatacacatatatatatacatatatatatatagacacacacacatatatatatatatattaggtgggaagggtggtgtgcacctgtagtcccacctactcaggaggctaagatgggaagactgcttcagtccattgcagttccaggctgcagtgagctatgactgtgccactgcactccagtttaggtgacacggtgagaccctgtctcacacacacacaaaaagaatccataaaaagtctgtctggtgtgtctcacacacacacaaaaagaatccataaaaagtctgtctggttatttaaataaaacttctatggaggagttttaagacacttgcatttcttccaaaagaagtttgcccagtcagacaggggagcttacagagacaacccctccctgagttgggtggagtactcagaaacaagacatggttagaaagtcattggttctgaagctgctactaagtctctttcattttctttagttcaaagcaataggcaagccaaagtaccatactttggggtatgattttctgagccccaacatttgcctctctgaaatttccttagaagttttacacattaagagctgagttggtggctatggagagaaaaatgttagtaatggaatggcaaagaatctcattaaacaagccttccatttctgggactaggttggtccaattaaacaattgtgtcttatttcaggaagtggtgtttacagagctcccatcacagttaaggtgaacgagtctttaatatgtggcatttctaaatcagaagaaaaacaaaggttgaagtctgcggcaatctatacactagtttctctggattctggagggcagtcagttgagataatttctagatttgagtatgaagcatcttcagttggagcagaagcagtcagtagagatctgacagatttttctggattgtagtttgcgtgttatgagagaatgtctataaataagctgttgtggtgatttccctgaaggttatatcaagctgaccagttttgtcttgtagggcttcagaaaactgataattttaattttagttatctcaagtcagaaaattgggagaaaattggaaatgctgtaatagtttggagactcataaccaggtaccggaggagaccacaaggaatgaatatccagtccaaattacaagcaaaggataaaatctcaaacacgataagcagggttagaaccgaaaaatgggtatattatagttttcttctgaaacatgtgttttctctcttcagtcactctaatttttaccaaagataatcacaggaagtccaatttgtttgcaaaaatgagtttaaccatctaggttcttcttaagactgtgttgctgaaactttgtatgaagaatctcaaattaggcttttaaaaggcctcttacaggtgtgcagccaagccagagacacaacctcaaattctgcccataatacctgtagatttgggttaatcctgctcttctcagtaaagttctcaaactatctccaagttcttgggtttgtcagagagtgacattctttacttaccagcatggcagccccgtgaaccgtgtattcatagtactagaccagtttccagggggctttttattggcttcataaagtcaaattcatttccttaaaatggtcagattatatctgaaagttagactattcagccaaagctttggtaatataacagtgtttccaattgtgccttattagaagaagaataaattcgtattgaacttaggtaactacattgccataaaatgagaatactcaggaataattcacaaattttggagggatcaatcagggagaaaaaaggtaaatgtttcaattctgttcacaaaagtacacattatgaaattgaagcaagctatagaaagtttaaaagaaaaacaaagtcttgctaaatacggaagacaaaatataaaaagaatcagcaatgtttcaaacagaaagttgtaaaaaatcatggtttttcatgagttcagtcccaaataattaattcttgttctgcttaatgttgggttggcaattgtatcagtttagtattctttttcatttgagtcttggaaattatcaaagttttcagaaacctgtacttgtcaaagttctttttatttttcctatatacttccttgaagaaacaacaccttaggattataattgcctacaaaaagctttcagaaaaggcatcaacataaagcagttagttgtggacaacgagacaagacttaaaatggcaatggttaaagatctgagagagttcattataataaaaaagcaattgaaaagaaaatttgattatttctgcagtgtttatacaataattaaatgtaataaccgaaggttataaatgatagcattatcttaagacatatcagagatctagacattgcatacaatctttggacacatattaataacatacccatatgaatgtaacttaaagaaagttaaatattatttcttatttgacaatgttttcatataatttaacatattggataagcctcattggtttaatatctttttagggggaattttagagactttccttaattgtccaaaagttagtttgggggtcgaagtacttttattttgattcttagggggtttgtcaaatatcaaaggtttaaaacatttgatcaaaataaaatcacaggtcaccataatatgatattcatgtagccagagtgacaataaaaagatttcaaaagcaaaaacaggaagttacatagttgtagagaaacttttactctttggtaaagaggagactcagttttcctaagtaatcaaaagacctaacatgacagtataagatacaaagaacgtgtttctctctctcctctctcttttgagagtttttctcagtccattttgtgttgctatatcacaaaatatctaaggctagataatttataaagaatagaggcttatttaactcgcacttctgcaggctgggaagtttagccctggcttctggtgaaagctttcctgctgcatcgtaacatggtagagaatgtaaaagggaaagcagatatgtgcgaagaggccaaacctgtgagcagtctggctttatactaaccggttcttgttgaaactaatctatccccatgagaactcattcagttgtaccagaacaagaacccataaattattgacagaatggctccaagccaccacaagggcagagccctcatggtccaagcaccacccattagtccccacctcccaatgcaaacacattgaagatcgaatttcaaaaagagttttgattaagagaaataaaccatatgcagaccatagcaatttcacccctgccccccaaaactcatgtccttctcaaacaaaaaatgcaatcatatcatcccaatatttccaaaagttttaacttggtccagcaccaactcaaaagtccaaagtctaaagtctcacctgagactgaaggcaagtttcttccagttgtgagcctgtaaaatttaaaaaaaaaaagttatttatttccaagatacactgctggaacagacatttggtagacatcctccttccaaaaaagagaaataggccaaaagagaggaatgataggccccatgtaagtccaaaacctaggtcaggtgcagtggctcacccttgtaatcccaacactgtgggaggccgaggcaggaggatcagttcaggacaggaatttaagaccagcctgggcaacataattaacattatttaaaagttagctggatgtgatgatgtgcacttgtagttccagctcctcaggaggctaaggcaggaggatctcttgggcccagaagttggaggttacagtgagccatgatagcaccacttcactgcagcacgggtgacagagtgagaccctgcctcaaaacaaacaaacaaacaaaaatgtctaaaatccagcagagcagatgtaaatggtaaaacacaagaataatcttctttgatttcatgtctcacatgctgggcaaactggcatgactgttgggctcccaagcccttggaaacccctgaatccatggcttctctggatgcaacctacatggctaccagtctctgtacttggaagtggggagaagcaggaaaatgttacaaagttatcagttcggtgactgcttgtaagaccttttaattttctttgcttaagtgctcagcatgagaaagtgccaggtttagggtattagtttctgagctccagtggcatgaactagcttaatacacgtgggagaagaaagtagacaatgattgtgaaaaacatttcagtgttacagagtcctttgtatggaaagcaatccagtccttagactttaagccatagaacattttgtagaacgttccatggagtagtgttggaatgcacttttcttctaaggtattctaactatatcagaatattcatttttcatcacctctgtgatgggctaggcagtgcttcctagagcttctgaggcctagtttcctctcactcatattttcctctattactgtgacccaaataaaaactcagtggaaacaaatccaacatcacagcaagctcattatcagttgtgtggaggtggagacctgctgtcattagtatgggggaggaattacacagcaacttggagaagcagtttagaattaaatagaaatggaaagaagtgcttatgaaaatctcagctttcataaataaaataatgttgtgggtgggttaaagaggtagatataactctttcatatgtctgtctttatattttcatagtatccattatttttcaaaaaagttttaatcttggctgccaaatttgctcatcacaactaattggaatagagaagaagagaaaataaggacagagttgaagtgacattgccacaatgctgctaaatctctcatgatctcattttcttcccatattcagcaaaattatccgttcctctattattcccacccttctttccctccctcttgcttacatttacccaaagcaccaatcagcttgaactagttactaaaactgagaaataacaaaaagaaaaattccaagttgtttgaacttgcagttttctgaaaattacttaccataagacaagttacaaacatgtgaatctaatgctgttttttaatcaacagttggcaagaccagtgaggtgagattctaaaatgtgctgcagatattttgctatcataataaagtgttgaagtttgtgaatggtttactttaaaaaaataaactaaggtgtacttaagatgatcccagtggtattcctaaaataccacactcacttgcttacttaaattccaagacgttttctgggcagcagaaaaaaagcatgatttgagagtgagcaaaagggtaactgcataacactgcagcactggagaggtaactgtcagtgatgaaataagactagtattcgttcaaggtcattagcaacattgagttgtgactgttatggcttactctggtttattttttattttaactatagatagagatttagtctgaagaaaagcaagatagataaagtaaaatagtgcaccttttttcaaatgagtaagaacacaatgaacataccagttagcaacagcccagcacttagaacttctaaatgaaatgcaagagggtgatgcagatgacaattttaatagtgctatctaattcataacgtgttagaatatataaattctattgattgcaatttaaaaaatcaactaccaatgcttctttttcaatggcacctgcttgctctcctaattaacattaggtaaaatggagagctaggggaaaagaccaagacctgtttttagtagctaaaaatatgtttattaaagaacaaattttgaagttgtttgattaccgattttactactcagatgcttatagataactttgcatacagtattattaaaatccagtactgaccaggcatggtggctcacacctgtaatcccagcactttgtgaggctgaggtgggaggatcacctgaggtcaagagttcgagaccatcctggccaacatggtgaaacctcgtctctattaaaaatacaaaaaaaaaaaaaaaaaatagctgggcatggtcatggtggtgcgtgcctgtagtcccagctactcaggatgctctggtaggagaacccttgaaccccagagggagaggttgcagtgagccaagatcatgccactgcactccagcctgggtgacagagggagactccatctcaaaaaataaataattaattaaatccagtactgtaagataataaatttgtgttttctgagccactatgtttatggtaatttagtacagtggcaataggaaactaatagagacaccaaagcttgaatggtttattaactgcctggtcctgaggcagccccctctcatgacggggcatctggagaaagactagctaaggcgttctccagtagtgtttactatttatcttctttcctacctcttcttcactgcagagcgtgacagagtctgggagactgagggggcgggggcacaagccctctttgttgagtggctaacagctcagtgcagacaacaaatttaccaggaaacctctttcccctcctccaccagggcagaaggacacgtctgagagcactaggcgggcagattgagcagaagaaagctgggaaactgctccacatggggtgattcccctgaggttttatttccaaaattaaatttgtgttgctttccagggtgcgctcctatgatcctatgatccctgtctattgacacacgttttgtgcttatggttgcctacctgactgatatttctatttaatatgacactttagcagctaattcacaacaagcattgcagacatagctctttgtggccgtcaacttagatgattaaaaaggtgaatatgtaagtgtgtatgtgtttacatatacacccacacaaatgtagacatatacacatgtagtgtgtctccttgacaattttttttttttttgagacggagtcttgctctgtcacccaggctggagtgcagtggcacgaactccgctcatttcaagctccgcctcccaggttcacgccattcttctgcctcagcctcccgagtagctgggactactacaggcacctgccaccacgcccggctaatttttttggtattttttagtggagacggggtttcactgtgttagccaggatggtctcgatctcctgacctagtgagccgcccgcgtcggcctccctgataatttttacccacaatagtactcatactatctccacaatttttcagtgtacaagtcttatctttattttgttaaaacgcattttaattttttaaattacctctgataatgttataaattattttcttaattttttcaggttggtcattgctaatacatataagaaaacagaattttcaaatagatttttacttattccttttaatttagattaattttatttcatttcttgcttaattgctctggcttaaacctccagtataatgttgaataaaagtgacaaccgagggcatcctcgttttgtttctaaacttagggaaaaaactttctgtctctcactattaagtatgttgttagttatgggcattttgtagatgctgtttatcaatttgaggaagttgagaaacttttaaagaaatgttctaataataaaccttagtttgctaattactaaaactgtataattattatattaaatttagaaaatgcagacatgtagaaagaagagtatttttaaccaaccctaaatagactaccaaaataaaaccatcagtaacatccaatttggcacataaccgaaggaagatatccgagttcatggtttatctactatttttcattttggacataatattgtatttaacatatttgtatttgtaatttttccaatattatattttatgtctccccaaatttctagaaatagtgttatagaatcacaggatataaacattgtgtgtacatgagtgcatatgtgtgtgtgcatgtgtgtgtcaagctgtttcttatctattatctatgtataattctctctatatgtctatgtatataaatacatatataacattaatatttattttcaagaattcttgttaaattgatgcccttcccagaggtgtgtgttcttgccaatttttggcatctttaaaaaatgtttgtgaacttaactagtagagattgtgtagaagtgttgctttgattggacatgtctggcttaaaatatagtcatgtcactcacaacggaaatacattctgagaaatgtgtcattaggcaatttcattgttgcgtgaacatcatagagtgtactttcacaaaacctggatagcacagcctactacacgcctaggctgtacgatgtagcctgttgttcctagactatacacctgtacagcctggtacagtgctaaatactatagacaattgcaacataatggtgtttgcatatctaaacctaggaaaggtagaataaaaaatgttgtattataattttatgagaccaccatcacatatgccatctgtcttggaccaaaacgtcattatgtagtgcatgactgtattagtttgagcttcttattttcccgtttgtgtaagttatttaattttcttcctttgtgaactgatgttcacatccctcatgtttgttagttttccagtgctttcttttacattgcttgagtcccgtatatagtaaaagcactaactctttgtctaacacacctataagaagactgattctttcaacataatagaaactatacttccaattcagtggcatttccttcaacatagtcacagtgggaaattacacttacttcaatgatggtcccacttattaaaacactgtaagatatttttactctgaaatagtctttagagctctcatgcaaaccataggatcagctcagcccttttttaaatcattgggagcctaatgcagtgtagccatcttgctcattcatctattccctagacttggttttgaaatgacttctggctatttcttttttttttttttttttttttttttttgagacagagtctaactatgtcgcccaggctggagtgcaacggcgcgatcttggctcacttcaacctctgcctcctgggttcaagcgattctcctgcctcagccttccaagtagctaggattacaggcacccacaaccatgcccagctaatttttgtatttttagtagaggcagttttcaccattttgaccaggatggtcttgatctcttaacctcgtgatccgcccgcctttgcctcccaaagtactgggattacaggcgtgagccaccattcccggccgacttctggctatttctaaactcaaattcttcttgaaagatgaaaatttgctgccagtaatagtatgaaaaatatgagacctttgttccaaagtaaatttgttagaaagagagactcttctaagcaagcttagtgttattaggaaaattggatctccttccagctatgactgcttggaatgctaaaatattcattatattttctgatgcatttaaatacatatgtatataaatttaaagtaatttgtgtaaatgcagatggtttgtggcttgttttttttttttaatccttcattttccatggtcagttcttacgccttcacattcgtactattaattctttacacttcttcaataaatttactcaaatataaataacttcagaaaaatttaaaatctacccccgcaaaagcttcaatatctgaagtttatgtggagaatgacttgaggatttttttttaagaatagaaggtataaaatatttttattaggttattttatctataatttctaaatcaaattaacagaaatttattggagatatagtatatgtaaggttatatattttgctaaccaaaaataaatgattaagactaaaattcttggacccagaatgtacatatcatgaagtctttgtgcatcctgagatagtaactcagttaccttatggccctctctttaaagccttttttttcggcatgttgcctcatatttaaaaaatacaggcaagccaagcttttgtgtgtttcctcaaagaggctcctgccctgcacatcattagaaatgtttccctttaaactttctatttttccaaagaacttcgatttacactggcttacactcttctgtatcattctctgatatcaccttatctgtacacgacagatagtgtctttgatagttacatttctctagagaagagaacaagttttgaacatcaaaccaagaaactcattcttttggggaactgggagatgggtttgcagaaatgttgtagaaaagaggcttccagaaaccaaagatattctttgcattctttaacactttgcagacccctgagagtgacctgatttcagggttgatttccttcagggcagccactttctttcatgccaatgccagagttaaagtacggagagaaggccagtcttagagcagtgcttctcattctgtgactatacatcctggctccactggctgtctatcatttgttcagttcaccttctctggcaggaagaccagccagcctggcagtgttcttgttggcataatagaactgtcatgggttcatctgtagccatggacaaggagagctaatggaagctggaaagagtggattccagttggcatattgaagaagcttaactgaatagttttcaaaacaagaagttgtggaataagagttacagggagatagtagcacaaaaggaacgaggaagcagaaagactacaaagagaagcagaagggcaatcatggagaataagaaagaaatgtttccctacatctattgagtgacctggccaagtttagttaaaagacctggggcattgtataacaattggtagtgtcgaagaatattttacttgggaataaaaggagatcagccgccactcattcacacattaatcaaatgtctaccatattacttataacttaatttctgtaattacattactgaagcaaaaatgctgaatacacaacactaagagctggtagttacatggaggagtaaaaaggtaaacaatttaacatattaacataaattatggagctggaagaaacacagaggaaggacttgaacttaattggcagtaggggaaggattccaagaataggtgacagctgagctataatagtggcgtgaagctatttctttagagaaaatttctggggaacacgaatgaccagtgcacttttgcttttgggtacacaaacaggacaggcacacaagataattatctgctacaatgaccttgcctcatttcatcaaatccatctaaaataaacattatttggaagattcgtttttctatgacacattaagttgtatactggtcatcatgttgaccaagtaattttgaagggaataagaagaaaattaatatgaagtgtttattacatgtccagttccaccttacctgtcggaagtctcaatcacactaccgttttataggtgaatattacaaccatttcacacacatagaacagagcctcaagtgagttaagtagtttatggagggcacataaagaaggtgagtgttgggccatcctgtgaaagacaaaacagtgcctggacgcagagaaataccaagtctagatgaagagttttcagagtcctcggtgtctgaacatctgccactttctagctgtgcaattttctggaagttacatgacatttctcagcttctgaagtctgctttggaaagaaaaaacatcatccaaaagtactgtaaatacaaaggaccagagaatgttttgcctcattttttttagcatctgtagtaaaacctgtggtttaataagcacaattctgaatagaagtttagcttccagggcctgaacacaggcaaaactgttctgctcatgagacaggtaaaaataatttggtgttgcttcagactgtgcctagaaacagcaagataactggaagctgaaaatccatgaattgaccccttcttacaatcccatgcatctgtggtaaagttactgaactcataaaatgcttggataaagatgttttgttttcacaatgaagtagtgatgctttgggcctctgtcaaggtgaagcagaactagagaaagatgcacaggctcagatctcaaagagaaaacaattagttctggacccttgacagggccacagaactgggtgagccacattgagcgaggtctccagggaaaggagagccccagctgacatcttgtggaatgacacaaagatcacagtagacaaaggaagcacattttcaatgtaagcgaattcttctatgaatcaatacaatgagcttgaacgagaactccttgctctcagggacttctgaaaatccagcttcagtctttgatccccttgtttcaaatttctcactaaaacaacaaaaacagaccaaaaaaaaaaaaaaaaaaaaaaagatgaaggccattacagcaccataagaagagagtgtgacatttaatctaatggcccaaaactggagattttttttctttgtttttttttcttcagattattaggctggaggagctaaagcatgaagtgaaattctagaatcacacatgctctgcaaacagcaaggttgtctgcctggaagtagcatgctcttgggtcagacaggcaatgcatattttacacagaaaactataagcctgtcccatttcaggtctgctctcaggcaggcggagtgagaatttgtattatcctctctccgtgcatctccatgatacagtgcctcaaattcttatacgaattttctcacttctagagcactatagaacagaagcagtgatatctgtacaagctttaaacaagagaaagaatccagaagtggaacattccatcaggaattaacagtctacaacagttaaaagtgtagacagtactggagacaagaaggtgcataacaaggtttctgggtattgtagtttttcatgggctccattttaattgtgtcacagagagagtcagtgaggacaggtcagatcacatttcagttgaagggagttcatgcatttgataaatgtgctgtagcctggacatttgtccaagagttataagtgacagtatgccacctgtcaggcagatgaaaattatctacttcctgagcaaaaataatgaaccataaaaacttaacaggattccagaagacttgactatgatgaaaccagatacaagtatataaaaagaaaataaagagaaagagacgctatgttgttgagaattaaagaacaaaaacaaaaaacatggattaaattccaaatgaatgaaaagacattaaaatgaccaggtaaaaattattgtctgctttgtttgaggcagtaaaagacacaaataacactgcggatgtttttaaaaaggtgaattaaaacaaacaaaaaaaatctttgagaatctagttcagagcacaagagaactagagagacagtgatttgggatctttagtaatgtctactgacaaatctccaaaaacaacgaaaaacacactttgccaaaggaaaattaaatgtattggacctgccataataaagagaaccttactttgtcagtcctggtagtgtctagaaggcaggggcagatatttttagtagttagggcccaaagtgtattattttaaagctaatcttgccagatgggaaattggctgggactggacagagtttttgacctaagatctttggattgatggccacagaaaatcaggaatcttgacgtgagtctctatgagtaagctgccagtcttgagcaaaagctatttgagccagttctcagttttatcttatgaaacacgtatttcctggggcaaggtctaagccactcttgcttattctgagtattgtttaacacagggacaaaacatgatcttagtttcagctctcaataggtaatctagttttcatttctgactagatttttttatttttctaatttaaaaatatgaccagattttttatatgtagagttttcgtcaataattttgcaagtatatagcccggtttttgataagcataatcagatcaatcttcagtttaggaggtcactcccattgagtctcagagatgactcttgaaccatgagcttggtcttctgtagaaatagctattcttaaatcaggtccatggtctccatgtcccatatcaataatatttttccttttcatttaaaaaaattttctaatactctatttataatataatatatttaatatttctaattacatatgctttgtataagaaatgaatgatactttcaaaaattaaatatagatatttaagtagatgtctacaaaaaataattaggggataaatgttccacagtgtttattaagtatatttttctgcaaaatggaccaagtaggtggattttaaaagtctgcttttttcatttttcacatttctttaaggaacagaaataatgtttgccattggtagaaatctcattttaattttacagaaatacaataaaactagcttttagatcctcttttcttaccctaaactttcacaagggtttgatcagtgtgtgagggatggtgttgtggaatggagcagagctggtcaatgtgttagcaaacagcctcccaagcagcaggcaccctaccctcccactgaaccaacttttccatgtcagccctgtatgctgcatgatttgtctttggtagaaatcctgggaaaatcaagtgactttcctttacttcattttgcaggtgagcccagaggttcaactttcatcacctttttgggaagtaagattctcctacttctactttcaggagtgagctcaaagtcccagcaggcaaaaagcctgcaacattgtgtgggttttacagccaggatccattattatttttttctgagttaagggatctaaacatagaaaggaaagttggacatttgtaatttgcatttactgaaaatgataaaaagtcatggatattgaagaggaaggaggccatttctatggttagaaagactgaccctgtgagctctgcttagcctttggaatatctagtgtctaaaagaatagaggcaatgctaagatgttgtaacacgtctgcaaatgaaatggaaatgattctacttttctcatatattttataaatctgtgagtgttaagagtaggtaagaaaaacaatgcttacagataaaatatagttaaaaacattttcctctttctaagccttggtagtcatatagtttgaccaaatgacagaataaagattgtcccatgatttgaaaactgtcttcagtacaaatcttataaaaatatgataaaattataacaaatattttagaaggtataaaaataaaagataatatcctgcttctactaaaatatggacatactcaattatcttaacactttactttagaaatatgctttgacagatgtggatccatagaacctcaacatcttttttttttttttttatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatcatgatttccaattcatccatgtccctacaaaggacatgagctcatcattttttatggctgcatagtattccatggtgtatatgtgccacattttcttaatccagcctatcattgttagacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgctttgcatttctctgatggccagtgatgatgagcattttttcatgtgcttttggctgcataaatgtcttcttttgagaagtgtctgttcatgtccttcgcccactttttgatggggttgtttgtttttttcttgtaaatttgtttgagttcattgtagattctggatattaaccctttgccagacgagtaggttacgaaaattttctcccactttttaggttgcctgttcactctgatggtagtttattttgctgtgcagaagctctttactttaattagatcccatttgtcaattttgtcttttgttgccattgcttttggtgttgtggacatgaagtccttgcccatgcctatgtcctgaatggtaatgcctaggttttcttctagggtttttatggttttaggtctaacatttaagtctttaatccatcttgaattgatttttgtataaggtgtacggaagggatccagtttcagctttctacatatggctagccagttttcccagcaccgtttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgccttggcgatgcgggctcttttttggttccatatgaactttaaagtagttttttccaattctgtgaagaaagtcattggtagcttgatggggatggcattgaatctgtaaattaccttgggcagtatggcaattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaactgtgaatgggagttcactcatggtttggctctctgtctgttgttggtgtataagaatgcttgtgatttttgtacattgattttgtatcgtgagactctgctgaagttacttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactacgttgaataggagtggtgagagagggcatccctgtcttgtgccagttttcaaagggaatgcttccagtttttgcccattcagtatgatgttggctgtgggtgtgtcatagatagctcttattattttgtaatatgtcccatcaatacctaatttattgagagtttttagcatgaagggttgttgaattttgtcaaaggctttttctgcatctattgagataatcatgtggtttttgtctttggctctgtttatatgatggattacatttactgatttgcatatattgaaccagccttgcatcccagggatgaagcccacttgatcatggtggataagctttttgatgtgctgctggattcattttcccagtattttattgaggatttttgcatcaatgttcatcaagtatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtccaggaatttatccatttcttctagattttctagtttatttgcatagaggtgtttgtagtattctctgatggtagtttgcatttctgtgggatcggcggtgatatcccctttatcattttttattgtgtctatttgatccttctctctttttttctttattagtcttgctagcggtctatcaattttgttgatcctttcaaaaaaccagctcctggattcattgattttttgaagggttttttgtgtctctatttccttcagttctgccctgattttagttatttcttgccttctgctagcttttgaatgtgtttgctcttgcttttctcgttcttttaattgtgatgttagggtgtcaattttggatctttcctgctttctcttgtgggcatttagtgctataaatttccctctacacacggctttgaatgcgtcacagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatctctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggttcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagccggttattatgctcgttagttgatgcagtttcttcctagtcttgatggtctttacattttggcttgattttgcagcggctggtaccggttgttcctttccatgtttagcacttccttcaggagctcttttagggcaggcctggtggtgacaaaatctctcagcatttgcttgtctgtaaaggattttatttctccttcacttatgaagcttagtttggctggatatgaaattctgggttgaaaattcttttctttaagaatgttgaatattggccccctctctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttcccttctccccatcactttcaggtacaccaatcagatgtagatttggtcttttcacatagtcccatatttcttggaggctttgctcatttctttttattcttttttctctaaacttcccttctcgcttcatttcattcgtttcatcttccattgctgataccctttcttccagttgatcgcatcggctcctgaggcttctgcattcttcatgtagttctcgagccttgggtttcagctccatcagctcctttaagcacttctctgtattggttattctagttatacattcttctaaatttttttcaaagttttcaacttctttgcctttggtttgaatgtcctcccatagctcagagtaatttgatcatctgaagcctccttctctcagctcatcaaagtcattctccatccagctttgttccgttgctggtgaggaactgcattcctttggaggaggagaggagctctgcattttagagtttccagattttctgttctgttttttccccatctttgtggttttatctacttttggtctttgatgatggtgatgtacagatgggttttcggtgtggatgtcctttctgtttgttagttttccttctaacagacaggaccctcagctgcaggtctgttggaataccctgccttgtgaggtgtcagtgtgcccctgctgggggatgcctcccagttaggctgctcgggggtcaggggtcagggacccacttgaggaggcagtctgccggttctcagatctccagctgcgtgctgggagaaccactgctctcttcaaagctgtcagacagggacatttaagtctgcagaggttactactgtctttttgtttgtctgtgccctgcccccagaggtggagcctacagaggcaggcaggcctccttgagctgtggtgagctccacccagttcgagcttcccagctgctttgtttacctaagcaagcctgggcaatggcgggcgcccctcccccagcctcgctgccgccttgcagtttgatctcagactgctgtgctagcaatcagcgagacttcgtgggcgtaggaccctctgagccaggtgcgggatataatcttgtggtgcgccgttttttaagccggtccgaaaagcgcaatattcgggtgggagtgacccgattttcccggtgctgtccgtcacccctttctttgactcggaaagggaactccctgaccccttgcgcttcccaagtgaggcaatgcctcgccctgcttcggctggcgcatggtgcgcgaacccgctgacctgcgcccactgtctggcactccctagtgagatgaacccggtacgtcacatggaaatgcagaaatcacccgtcttctgcgtcgctcacgctgggagctgtagaccggagctattcctattcgaccatcttggctcctcccagaatctcaacatcttaaatatcattaacaagatagtcctgaaagcgataaagaggatatatcgactaagtattgttgactttcagaatcctatctcactgtctagcatcttatcatacattagacaaatggttctacttatttttatattactatcattttaaaacctagactcctacctttattttttaaatcactgtttacctcagtaacttcgagcatgtctttcagcttctctatcatggatgtcagtacataaagttagaaaaagaaaactgttatttatggggctgtgaaggaataatcattgtagtactgcctggataactctccctgtacctttctgtcaattttaattattctcagtttgcaaggctcagcctcagatttgaccttcttgagattgccatctgtacctttgaagagttcagttcccttagctcaacgtacacccaactgcttaacaatggattttacgcctcatgagcacacaccacactctcaataagtaatcgactacattctatttttttgttcagtgttctatcactgctcaataaatattcaattactgctcaataaatatgcagtcattgttctttaaatatttttgaccatacctactatgagtcagtctcctttggcaactcaagatacagcaaaaaagcatcaatggatgtggcttataataaggtggagaaaacatattaagcaagcaacacacaagtaagtttcacttgtgacagttgtggtgagtgatatgaaggcactatgatgtttgtaatgcctcatattaattgccctgttgctggctgttaattagcacatatccaaccccaattccactgaaaatcttatttgatcacttcttcagttacttcttggacacttcattgtttggattttccttccactttggtgatagtctgctgtcaaatttgtttgtaggaccagattcttttccctgacttgatttcatctattctcatgttcccaaatgtgagtctccaaacagactcccctcctgaactctacacctgcagaccagccctccttcttaacatctccctgtgtcaaactcaacacacccaaaataacatcactttttctccatacttgcctttgaaatcccagtggattgcacttccattcttccaatagttcccaaatcttagaaatattacttttttctctttttctcatatctcacaataatttatcagctctatctccaaaaaatataaacagaattatttatgcaagatgagtgagttttatagatctgttgtacagcatagttcctatatctaataatactgtattgtgcacttacatttttgttaaaaggatagatctcatgttaagtattcttaccacatacacacaaaaggggcaagaacaaaaccttcggaagtaggtggatatgtctattaccttgactgtggtgatactttctagatgtacgcatatgtccaaactcattaaactgtaaacattaaatatgtgtagttctgtgtgtagcaattatatcttaataaagatatatgcatatacagaatcccattaatttttgccactgtgtcccctgctccaagccagtgttgcctttcccatgacaatgtcctgcttctaccacgtatctccttggagactattgtcacttcagaagccagaggcatgcttttaaattttgaatcagatgatggctctcctctactcagtcttgaagagtagctcccatttcaactcagagtagtaagaggcaaaatccttactgtggctacaaagttatacaggatgcatgaaacttcctgagacctcacacttctcctttcttgttgctctttcactctctccagccacattggctgacttgttttttctctaacacactagggtctttgctctagctacttcctaattctggatggctccagggataactacatggctcactctttactcctttaaccccccttttatttccagacctcacactctgcaaatgcgtttgcaatgaacctctttaacgttgcaacctgcctcacttctgtcacctcagcaattgagctttcctaaccctgctcacctttttattttttccacatcacccaaacccttctatcacacgatatcattatcttacttattttgtctctgcctaaacttctgctagtcatataagctccaggagggcataaatcttttcccaatgtatacactgaggttttccaagtgtctcaaagaatgtctggcacagattaggtactcaaggaaccctcagtaaataaataaatagatgaaagaatgaacacatttagtgattctttatttctaaagcaagaaagagatatcatgatgccagttaatttcctgagatagaattccttacaatacattggattcagacattaactgcattaagtataataccagaaagaaaataaaaagtaccagaggagaaaaaggaaattaatggaggataatacagtagagctttacttctaagagttgtgagacagagcagagcagtgtgcttatcttcctagggcattcctcattatgccctaacttcttgcttggcacatagcacatagctggcacaccatcaatgtgtgctgaactaaactgaaattctaagagacataagttaatcactaaaaaactattggccatagagttgatagaactcttcttcatggttcttgaatgaatttttccaagaaatattagaaatcctaatagccgataagaaaaggagggatgaggcatttgagaccaacctggaaagggtagtaagacctcatctctacaaaaataaaatgaaataaattagccgagcatggtgatgtgcaattgtggtcgcagctactcatgggactgagatgggaggtccgcttgagcctagcaggttaaggctgcagtgaaccatgattatgccactgcacctcagcctttgcaagagagcaagactctgtcccaaaaaaaggaaaaaaaaaaaaaaaggatggatgtcaatggggaagaatacttgcgggaatctttgcatatactttgccatttctcagaaatgcacaattcacattaacatgttaggatttggggagatatttctttcttgaaataaggaaacaaatttaacaaagttcagcttagaatttccaaatacttcacaaactattggtgctacagagaacatggcattggaaacactgaaacagttggccctgcatgtccctttccaatagtaacaccattgggaagcagagcaaaagatttgctgtaattccttagacctgaatttgagatccagctttactacctcttataaaagtttcctgggaaagttcttcctactttgtgaaactcccctttatgcattcctaatatgagactgacaattaacttaaagattatataggtcaatgcacatgaaagatctaaaagacacccgtttcataacagtatgttaataagtgtatgctgaatctgaagatcccattcttaaatcttagatctttcatctttaccaggagctcttgcatcaaatagtcaattatgagtaagtactggagctaagtgattatatttcttatattcttaatttacaagtggtgcctgggatgcatttttaaggtcatgtaacttttttcttattcaattgcttgtttatcctataacccctgttacattacaggtatttttaacattggtttttctttggagagatagtctatacagtggggactagcacaggtagggtgagaccacacattcaaatcctggttcttctctttactaagtacttgatttcagtccaattaattagcattagtcatctcagtctcttaatgtaaaaccagaatcacagggctcattccaggaggttactgcaagactcaaatgcagcactgcatataaagcacataccagggtacccagcaccttatgaagcacaaaataacggtacgtactttcttttttactgatattgatagtctttctcttcttccttcttgtttttaatcttcattttctgtagtcaaaatataacacattaaaaaatacaatgaaaaataattatacccaattccaattgacattgaaattcctagcccaagactagcagtggccaccaaggggcttccataagagaaagaatggcattccaagtgcagtgtcctttaaactaccaagtctgtgtcctcaggaaaagaaaatcaacctcaggctgaagccctggatctgaagggaactttctttaaagagaagcagtagcgtgacttttgcccaattctacccctccaggtgttattttaatgacaaaccacagcaacatatttccaaccatttcttcctctgattgacttgtaattggagtcatacctaagacctcaatcatctcatgggaagctttggggctgggagagcccttcaaatttgtccaaattgagaaaagagggctgagtcttatcccagcctcgctcctacacatgggccagtcttaggtaggccccaggaaggaggcataacattggccaaagaggttctcttctgctgagagagcaatgtccagagagaggctcagcagaaggctggtagctgataagacacccctcagctgagcctcagtctggaggggaatctgggccacacaatatggcaccaccccaggggacattgtaactgggtttatgtcatgtctatgtacatgtttgatgcaaagtcagagaaaagaaaaaaggtaactataagttcagagtgacccttagtctgcagttaatgctgaaggataattattagtttcagtttgggactgttgcttgacgaacagagacaagcatttgaaatggtaaaaacagagagaacagtaaccattggactggtggcaggaggcctattagtccattctcatggtgctgtgaagaatacttgagtctgggtaattaataaaggaaagacgtttaattgactcaaagttctgcagggctggggaggcctcaggaaacttacaattatggtggaaggggaagcaaacatttccttcttcacatggaagcagtaaggagaagtgcaaactgtcagatctcatgagaactcactcactatcacgagagcaacatgtaggtaaccacccccatgattcaattacctcccactgggtccctcccatgacacatgggattatgggaaatacaattcaagatgagatttgggtggggacacagccaaaccatatcacctggtttttgctcctattgggctacctccagtgtgacaccatgtaagttactagcccctctggcttccatttcacatctgaatgcagtctgttggcataaattaatctttgagggccttgaggtttaaagtgtactccatctgaaccttagaaaggacctggctccctgacgtgaaggaaaattacaaaattcacaaaaccttctaaaatgctaactcttttattatggctgcttaatgacctttgttcaaggtacaattacttatagaaagaaatcagttcttggaagaggactagcaggtaatttctgaatgtacttgctgttcagtactatgctgtgaatctgaacagatatttacttcccatcaaatatgttgcacatgtgtgatgtggagcacagagagtgtcacgctggacatcgcatgcctttcaaatgtgtctataattcagttatatggaactataggtgatttttttcccatataagtaaggttgcaaatgctggttagattcccacactagcccatgcgttagcctcgtaagcttaggttgaaacaaacaattgcaataataaatagcaagtttgattagtgcaatcctgatattatgtaataaaatatagtataagaaaaacacaggagaaaatggttttagaaattagtttgtaaagcttgattctgtaaggagatacacaaaaatgaaactatgctgaaatgccatttccattcatctgattgacatacagatcaaaacttctgtaatacgcagcgtttttgaggctatgaggagagtcagatattcagatgtgctgctcggaataaaaatcagtacaactgctacagaagccattttggcaatatctaccaaaattacaaatatgacccaggaagttcatttacagaaatctatcttagaaatatacttcacatggacaaactcatgaaatacattagtttagaagttagtctataataataaaataattgggaaaaaaccaaatacctatcagtagaagggtggaatatcattgaacaaggacataagaaagaatgaggaggcacctatatactggtatggaaaactattcaaaattcattaatccatgaaaaaacaagatgtaaaacagatctgaactggtgaacacagagagtggtaaactttgtgctgggggtgggaggcctggtttgcattcctactgcatatactgtgttattatttgtagaaaataagaacaaaaaatatttatttatataggcataagatatctctgaaaagacacagaagacactggacttaggcagctctgacgagagaagctaagtggctgggaactcaaggttggaagagaaatctactgaatacccattttatcttttacaatgtttagccatataaaattgtggcttgtttaaaacaaataattttttaaaaaatagttggatagctgagagtatcaagacaagccaatttaattagaaaaggggaagagagagacaagagaaatggggttgtggaaagcttggtggacccctggctgtcttacagctctgggtagtgttaccagagatgattcttggggcaagggaacaagagagctatctctacccatccaattgtttcaggagagccaggggcttataattgcagagtctttgaatgcctttgtatattttcatagaaagaaaccttggaggccactgagcctaatggaaagagaacttgggtagcaaccaggagactatagatctaattacaaacagtcaattatgtggttttagctgaatcatctaatctcgtggttctcgattctggctacatgttagatttaacaaagaagcgttaaaaaactatagtcaaagttggttttgatggtgggggtgggatcttactcagaccaattaaaacagaatctgtaaggaagagacataggcattggtatgttctagaagttcctgcggtgattctaaatcagagatagggttgaaaaccttttctttccttttgtagttttattttagtgttataacctgtcaaattgtgatttataagcatcaaatgacacaatttaaccttataaagtgttcttaaaataaagacaaggtttgtaagagcttgctacggtgttcactacatgaaaatcactcaaaaaatggtatgtatgcatatgtcacatgtctgttcaaaaatcttcatcggacaaatgcaaggaggtcttgactatatctattgtgcacatcaaaacccaggaaaggcagttccctcaggcttatcagaaagagcacagaaatttataatcagagcaatctggggtcagtttcactagtaccctgctgtgtggtcatggagcagtttcactcagcatgcttcctctggtacaaagtggtcataacaatacttggtaaggttgttggaaaaaaacagacaatgcaattaccacacaatatttttacataatcactactgtatccactataattaaagacaatgtataacaaatatgtagattattctagagatgcaaaataaattctctgatgagaaaacagcatctcaagaattgagaggaaaagggattcaaacaattatcaagtgagaaaatacttcacaaagaaaaactgcaaaactaaagctacgtacgtgaacactgttttgcagagaccacatctagaccctcagcagtaaaggttgtgctttttggaaaacgaagacaaagcagcaggaagaagagaaagggttgcaatggctagagggaagatgagggcttccaggtaggttgtgtgatgctctgaggaaaagccggtcatatacttgggtattccaggtcactctgctggaaccctgcttttaggacttctcaaatgaagtgactactagcctcttctcagagtcacatggaagacaaagaatactgatggaagaaacagctctggacagcaactttggagaccatgatgtccttgagagaaaactgaactcttgcagatgcaagatgttttaatctaccttccactccagatcaaggaacggtaaattagggaaataatgaatacgaagtacaaactgctggttattgatttgagatttgatatcacaatttgatttaccagatccactgtttagatgtccatagcactgactcttggctggagattgagtgtgctgcatgggggacataagggaggaaaatatctttccttcttctgatcttaggttcatggttgaagcctctataacaaaagacagattaacaagagaaaaacatgcacatttatttcataaaacttttatgtgacacaagagttgtcagaatgaagacctgaaataacagttaaacctgagttttgttttgttttagagtaagtttgaagagtttatagtcatgcagaaatattacacagcaaaaaaaatgatctgattgtaataaactggaaagcttagcggagactgtttgtgcagaattttccctgtgttcctgcatcttcagagataaggatgctactgtcctccagatataaggagggtacctctcacataagtgtctatgacctgcttcaggggaaggtcagaaaatctttcttaggttttacgacctgcttcagagaagaagggtgagggaaagtgagagtaacccttttgcttttgctgttttctcaaaattgctttagcttaaaatatcgtggggtaatgtgtcccgaacctcattaggtatgggaagagtacacttgctttgacatctgcagtctcatcataggttcttagtctaccaaagtatgtaacaagggatggaaattctgattgaaataattattatatacgatatggtagattttctcaaagtattcccctagaaaaccttgtaagattcaaaaagacaacatgcaacatgggagttccataatccattaggtttggaaaatgaggagttaaatatctcaaaagaaacattttcaactgcaggatttcttatagagtttagtgtgctaataggctttatgagtcttctccaaacagatctaatacatggcacttcctaaattttggggactcttgcaactgaagcactcttagagaaatgttgtagtagctggtaagataaagctgggtaacagtaaatgtggagggagatatggaaagatacaggaaatcatacatgtaatcttaacatactatacataaattcttagccaatgggtagggaaggaagagaatgtttgtctacaccacttccactttcattgatggatccaacaatacagagactctgctgcactgggtagaactaagtgttctaaattttcaaatcaactgcaaagaagatgtaatagttaatattagatgtcatcttgactcgattgagggatggctaggcagctggtgaagcattatatctggtgtgtctgtgagggtgtttccagaggagattgacatgtgtgagtcagtagacagggagaggaggaatcaccctaaacctggatgggcatcgtccaattggctgccagcctggctaacagaaagcaagtagaagaagggggatattcagttttgcagcgcttcctctctatcttccttccccagtgagatgaattttcatctcctgcccttggacatcagactccaggttctttgatctttggactctgtgacttattccagcagcctatcaggggctcttagtccttcagcctcatactggggactgtgctattggctcccctggcttttaggcatttggacttgggctgagcatgctaccagctttttttgttctccagcttgcagaccgcctatggtgggactttgcttttgtaatcatgtgagccaattctccctaataaactcctttttacatatacatatattgtatttcttctgtatctctagagaaacctgactaatacggaaggatttatatcttactgttgaaggtatataattgtttcctaattcacaagacctaggaaccaacttgccaggcagtgatttgtagccaacttctgacaacgaagtgaatcaaccttaggatgaagctggacctatggatggtagcagagttgcaaagaagttaagttcctgaagctatcatagaattactcaatcaatcagcccttaagctttttttacttctatgcttacgaatgtgtggagtatttaattcctttttatttaaaccaaattgactcagggttcctgttattatagacagaattgtgctaactggtacatgtaccaagaattaataatgcaacacccattaacacaggacgaagcactaactatgtgcaaagcaatgagaatcttgaagaaaaaggaagatagtatcaaatatgcatgtgaggaagatatgctatgacctggaattccttcaacctgatggttgaagcacacttgaggaacttgacatagatataaaagacaaagatgacaaaaattatatccttgagggaatagactaccattcaaactgaagatgagaatttggcagtccaaagacagatatcagaacagccacagatgaaaaataccactgtgatagaggagcagtgccgttcttgacattagcttggagtctcagcagggagaggaacattcgataaattttttatttgccttacaggcaacttcaaactcttggaagacataagaaatgatgacgagaactattatttctaatctaaaagtaggtgttgctgtataaattggaaacaacagaggactcaggaaagcactgattctcatccattgaaaggatcctggcatactcattcaaaattgaccacaatcaggatttccctaaaggggaattataaaagaaacagatcaaggaatggagagacagcccacaaggaaattgtggtttaataaatgaccagcaatgacaaagacaaatgaataaaaaggaactaaagtggtgccacgaggagttcactgataaattgagatttttagcaacatattttccagttttattaaaaaaaagacatgtaacaatagagaaattcaaacggacagcatataattataaaaacactatctagaagactaaggttcagaataattgaggttttcaaaaaagtaaaataaaaataaaacaaaaacccactttcaattatattaaatgtattttcagttatattatgagcaatgtgattaggagggctgggtggtgattataaatgtacacaaaaatttctgtatgaagttatttattacagtgttacttaaaaggatacaatatttgaagaaaagacctgataacaaatacttagttaaaaattttaataggcatatagaatgatgtactaagctattaataaaattatatttatgaataattttacatgtaacattcattttatgatatgttaagtgaagatcacaagacaatatatttgcagtgtgatatcacttttgtgtgtacatgtatatatgtgtgcatgtgtgcatagaagagataatatttatctatggtggtgatattttgagatacttaattctacagtgatcctatattactttgtaataaagagactggtactatatttaagtaaaaataaattcttagattttaagtacaaattaagttaaattcaatacattaaaaacaattatattagagaaatgtcaattatattatggttaattatttctttcactagttacaatatagggttacataaatagaacatgttctgacaaaaaccagatagaaagtcaaagttctgtagttttctatcaaatataatttttgtcaaattggaaagggttgaaccaagttgatcaataggaaaatgaactcccaatagtagggagaacatcaaagattctagttgctctaaatgagttcacatttcctggtcctgctctctagactgttacatctgtgagtactaagagaagaagtcaatcatactctgttcaaaatttgagcagatgctctgaaatactgaaaatagttcaaactaattatcacttttaggaaagtagagaaaacagagttgataaagtattctaggcaaaggtttaagatgacttaatcgatgatctgtgagtgcctagcaggcgacatgctcatcactacaagttagtaagaggacatgtcacataagtcagaccaactctattaggaatgaccacacctagtggcaaaatcttggtttctaaacagcattctccaatgcacacaaccagggattcttggagaagtgattgacagtggagctggggcagggagaatataagatgggcctggaacgtcctatgactcacaaaagtaaggcaatactgaagaaaggttgaaggcctatctcaaggacacagaagtcaagctaataagagctcccaaacttagaacaatgagagagagaaaataaatcatggctatatcaaattataactcataaattacactaaaattctatgaatctaacttgatataaataaatagttgaataaataattaaagggaaaaggagcagctctttcttacagaggaattctaatgaacagaagtagaatgggcaagatagaaaatcaccatgagcacaccacagtaataatggtcgcaatacatggatcatctatgcatggtaaaattagtgggtgaaaatttcaggagagacaagatgtttgcatggcctgaaagtatctctccaaagatatttattaattacaaagaaaaaaaaacagtaaatttcttttatacaattaaagaaacctgctgaccccagcataactggtaagattaacatcaccaatgaaaaagcatacttgcatcatgattctcttaaatgatgctcaaacaaaggcaaaatgtcacttctgtggccttcttgccaagaatgtataacttcaatctaatttgtaaaaataaaaacagacagactcaaactgaggggcattctataaaacaacctgaaagacaaagaaagactgacaagactgtcacagattggaggccacatggtaattaatgcaatatgagattatggattggaagctaaaattgaaaagggacagcaatggagaaactgataaaatgaaaataaagattgtagttgagttaatagtatgacatcagtgtaatttcctggtttgggggactgtgctatgatgatgcaagtttttcacattggcgaaactgaccgagtggcgtacagattctctctgtacagtttttgcagtatttttgtgtgtctaaaattatttccaaaaaaaagttaaaaaactacatcattccagattaatatgttaatggatatctaggcagacaaaatgaagaaatatactacatagtaacactgttaaactcaaaactacttaccacagaatattccaaatgctttgatgagaacatcaccttgaaaagtgtcctcaaaatggaaccaaaggtcattccaggctttggcctgctgttctgcactggaatcaggtttggatgagtaccaaacttgtatatttttcataagaactgaaactggggagaagaaataatatagtagatgaaagcacctagtacccaagttaactggaagaaaaacatattctaagagaaataagcaataattgccttttgtttcaaagcaaccgtctataccaatatagaaaatgaaagatgctgcttatcatgaattcaggcgaaataaaatatgtgagtgacagctgccatttatttaacataattaagctctctttattgaaaatctataatgaggaaaatggaactttttgtattattcccaaaggcagaagcaggagcaagcatagacattactaggaagcaattactggttcagaacaagaaaacccttgcagtggttatttacaaagcacagagtttcatttgggtaagtggaggtattcaggaagaatagaaggtctctgagatcacggaactgagatttgctctgctaagataaaagtttttcatgatctttatgagtgcctctaaactaaaataccaggatgcttgacattactatatgtaccgtgtgtgtgtgagtgtgtgtgtaaaacaaagttgaatgtgctagctattttattatcataagtttatcatttgggaggtggaaatttgtgattgaatagctgtgtgatcatgccattccatgctaatatccaattttgtgtgagcatgtcattccatgctaatatccaatttcttttatttttcaaaagatatttactgtcctgtgagcatccacagagagttcggatggccctacctttttttcttttaagcttaagaaagtaatgagaaatgaattagagttcttccatgagtcaggtttcacgcaccagagaagtactggggaatgcactattgatctattttcttcaactcatttcctgtgtttaaatggaaatattgatacctatgcataggcttcttctgaggttttggggatgtgagcctgtgtcttgtgtttgaatcaaagtaagatttagatttcgtggtattaaaataagaagtgtgagggacaaaataaaagtctccaaggagaaagaagttggaaaaaatctttaatagccttaaggttcctctcacgtagttaccactaaggttttggatgagaatgcagtagacagaactcaggctcaccaaggagttaactaagatggtggttatttacattgggaacactgtcttccactgaatacattatttttgctttaatagaaggatttattcttcaaaaaaggtctcttcccatgtatttaaaggttagctaatgggtcactctttgcctaagagaaagaataaggagtgtaaaaggtgtagaaacaaaacaaaagaaattgtagataaaagttttattaggagctaccagtaatttctgcaatcaaaaatgggcctgtgggtggctgaggtgggcagatcacctgaggtcaggagttcgagaccagacctgaccaatatgatgaaaccctatctctactaaaaatataaaaattagccagtcgtggtggcatgcgcctgtaatcctagctactcaggaggctgagacaggagaatctcttgaacccggaaggtggaggttgcagtgagccaaggtctcgccattgtactccagcctaagcaacaagagcaaaactccatctcaaaaaggaaaaaaaaaagaaaaaaaaataaatgcaccttttttttttatggataataatgcaaatccctgggggaaaaaaaataaattttaggaaatgttatggctaccagagaatgtcgtacctaaaaattaagtttcaaaaaaattctaggaaatacaagagcttttgagctacatatgtgaacaatgaaggaaaaactttcacatccaccctgtaaatcttaagaacaattttgattcaagggggcctcttggctgagtctagacagcctacctttgaattcaagctctttgctacttgtgtttctaggagccaatgctaatttctgggaatgttgtttaagaacttctacttactgtgtactcattttggcaccattgcactccacatactcacaggattttgttaatagggactgatgcttacttaaaagctttattagattatctgagtggattgcactggtccaggtatatatatccatcacaaaacctcttcatcctttaaattaagtacttcatgaggacaacaaaaagactggagaaagtctgaatttactctatggaatcaaccgtatgtaatttacacaattaaaaaaaaaacatgcttttttaaaagcagacattagagaaaaatgtaaggataaaagtaaagttctctatttcttcctccacctaccccactctctctctaactcccactggtaggattatgaaggcgaccatttttagtatttttgcatgtatttttgcagatttttctttaaatataaaagcataattacatattatcaatgtaaaacagtacatattttttaaaactttcctattatcacatgtacatatgtctgatttttttcaacagctgcttaaaattacattgtatggtcttacccgtacttcttcaacaaaagtccttgacttctgtacaattatgttgctgtcagttaggctttcgtgttttaaaaatagtgcagacatggtcgtaaacttatcttgacatacttttatgagaatatttatgggatgtcttcttgggtatgaaactgttgaggttcagagtgtgtatatttatatatctattcttgttggatgatgctcgtatcgaggtattgctgacttcatttattagtgacataggtggatactcgttactctctgtttacatcttgagaaagggaaacaactttctatgtgagaacaacatggaacaagttcactttgcatatgaattaccttacatgtgaggattgctttctccaatgccctatgaaatatggctactgctatctttttttctaatattttctaattttttttctaattattttttagagcagttttaagttcagagcaaaattgagcagaaagtacaaaaatttcccacatacccctggccccacacatgcataacctcctttgttattctctaccagactgaggtacctttttttttgttttttttttacaactgtgcaattgatgaacctgcattgacacatcattatcacgcagagttcacagtttatataagggtgtactcttggtgctgtacatgctagtggtttggacacatgtataatggcatgtgcccaccatgacagtatcagacagtgtatctgcactaccctaaacagcctctatgctctggctattcatctctccctcccctgacccccagcagctgctgacctttttgctgtttccatagttttgtctttttcatacaatatgtatcccattttagtctggcccctttcacttgtcaatatacatttacatttcctccatgtcttttcatggcctgatagcttattccttttaagtgctgagtgatattccattgtctggacataccacagtttatctatttacccactgaaggacatcttggttgtttccaagtttggtcaactaggaataaagcttctataaataactgtgtgcaagttttttgtgtggacatgagttttccactccttgggttgctgctaacattttattaacttgggcatggcctcccttgtgaggtctggcagcgccctcacaagggagttttgtaaccagccctgggattttgctcctgtcagtggtaactgcagctgcctgagaggagtcagtgatgaaattgttgcgcagaggtgtagatggtagcataacctatcttttggaatactgtaagtttattcaaggagaggagagggtgaagagggttacaagttagacccattgttcctgatactttggttgtggaaaccccttgccttacaactacacagaaatcagaattagaattcagatctggattaccatgtttgtttatgttttattatttttcttaaaaatgattctctgtgattctaaacacagtttatttgcatatctaaaactattttcctagttattaatttactgttataattaatcagattttatataaattgtaatagttgaagacattatttcagatatcaatagtttattaagcttattaatagcttaatagtgtattaagattaaccatgtggcaagaaccgcattttgtacaccatcccatttatttttaaaagccatcttatagaataagaaaactgagaatttccatgagagataaggaaaattgccagagctggtacatgactgggctagattcaaagacaggttcctcttcctgcaatgctcgtagtttttcacaataccgaccagtttttattgaatttgtccttggggaaattgtggagcataatgcatttgtactctggtgaagagagagacagataattgctgtaattctctggaaatcacaggagcctagcctaagtccattctgtctccatcaaataagcatattccttacagcacttgccatacatatcatgtactttagcacatatcatgtactttagcagtaaattacagactcttgtactgctcactgttttcctttccatgggtttatatcatctctttcgaaatttgtaataaagtctgtatccaataaatctccctcccctacctccactctcttttgaagcagtttaaagatgacagccagtcagtgaatattctctgggtgtgtgctatgcgcaaggcactgttttagactctggggatagagcagcaatcaaaacagcctgtgccttcagaaaatttacgttccactggaaagaaaacaaggaaacaagcatgctctaaagaaacaattttagataatgatatgtgtcacgcaaaaaagtaagctactagttaatataatagagaatagattggaatatgaaggacctgatatttccctggggaagagagggctggaatctctgagaaggtggcattggagctgaaacttgtcccttcagaacaggacgccatgggtggggacctgggagaagtgagctctgctcagaaggaaaaagaagtgcagggaacttgacgtgggaactagctgggtgtgtttaaggacagatgaaagtctgatgtagctgggtggctgggggcaagtgcacatggcaaagagaatagtggagtaaagtagccacaagtcatgtggacctgagtttgaacttcattcaaatcagaacaggataccaacacaatactttacatgggggagtgatgtgatcttttttattctacctattagaaccagtacaccagttctgggaggatggacagcaggcagaacaagtgcaggagtgacaccagttaagaagtcattgctgtggctcaagaaagaaatgataggtcttagacaagcatgcaacagtaaagaaattaaaagtaatcacattgggatagagacagtgggaaagactgatgggtgatttctgaggcattaggggaaatggtgataggatcacccccccctccaagactgcacactgtgggaagatcctcgtagagaggtgccatttgctgagatgtgtaagtgctgggcaagagctgacttttcagggtcggggtaaagtggggaaatgaaaggctttgcttgactactacaaagtttgagtcacctatgagcctgggagaggtcgagcgggacctacaagtgtatttgctccagggttagacatgtgaatatgggaggtgttgagcctatcagtggtagttacagccatggttttaatgaggccacttagggaaagatcttcctgtggttgatgaagagaatgggacacacgacagagccctggagcctctagcaattaaaaacaagaagggaagaggcgtgaagcaaactgagagagacagtgaaggaggaaggaaatgacaaaagcgtggtgtcagggaagcaacgaaggtaagcaggagcaacaaggggaagtgaaatctaggtcatttttattgtttgcttgctttgtgtttgttatttgatttgtgagatgtattaaggcatacttgcatgcccaaataaataacctagtagaaaaagaacactcatgatagaaggggtaactcaggaagggaagaatgggcaggagggttgagataagccatcaatgtggctaggctggcccttcctgctagaatgagcacttggcttggctctctgcactggaaagaaggtagtctatgcgctcagatgcaggcacagagagaggtggctttgtggatgggtagatgaggtagttctagtctgtttctgttatgttctaaaaatatgaggaagtcatcagctaagtgtgggggtgaggaagaaatattggagatgtgaagagagaagattgcatgaaatcatcttggagagtgggagagtgaattttcctagggaagcatcactgggtggttttaaaaatctgaacaatacatttgagtctcaatgtactcctctttccagcttcatgatgttggaaaaagcagcttaaatactttaaacttgctttcccatcagtacaatcattgtgggtttttgcataacatctatgagatgttgggtaccttcatatacactctccaatttattctgtaaaattgggataatgacacctactagaagagagattatttgcaagaactaaatatctatatgaaaggctttgcaaacagtaaaaaacaaggcacttaaaatattttcctgccgttattcttatccacaaatcctagctcaaactatttagttcttgatcgatttttagaatcccttctagtttgattcctatatctgaagtttggaaattgagcttgtgtttctctaaaggaaaaacaagatgtttaacacagaaaaagatttttttttcttttaaagtgttcttaacattcctcggattctggcattttcttgaaataaaattaggtatgtgttttgaaatgtcaagttttcaaataaactcctacaaacccgctgcgaagttgctccctttgctttgctaccttctgcatatacaccttcagtttcctccaggtgtcccagctccagccccacattcctgtgccaagaatcacaatgacccgtacatttccacatcacctttcttgcaagaagtttaacacatttggcgaacattattgctggagtaataatagttcctcaggtttgtagagctccagctttccctggagcttacaatctgcatgcatattacctgatttagtctcccatcaccgtcttggagcaaacattagtattagacttgcagacgggaaaaccgaggtcttgaaagtttacaggcccagctatatcatttgctttttatgtccttcttcctaactttccagcttctagtagtcttttgaggcccattgcagcctgtctgcaccatgaaacctttcctgttaaccgcagtaataattgattctgctcccaaactacttacatcattgtgcttacagacagccccatacactctggtactgcagtccagtgggaggtaatgtggtactgtagcttggaaagaagacacatcagaacaaaacttgaactacaagtaaactctgccatatgctagctgttatttaaaatctctgaacctctatttctttactagcaaaaattgcaaggctattatgaaggagaaggctgatttatgcaaagtgccttactagcagagttcctaccatgattggcactccatgaatcataactctcgggttacagcaaaagtgtattttatcatttactaattgtttcacatgaatatactttttactctttaataataataaagtcctgcaggaaacaaccaatatcatattatggaatggaattcttaggttttgcttctcttcatgcaattttaatcaatgcagccaagttacacatttttctctaaataattctttagttttgctgtggagtttttcacatttcattcatctttaaatgtattgtcatttcttttatttctcttattattgccccattaatccgtggtttaatatctgtgtgttattgagtttgcagatgtataattttaaacatacattattatattatatattttaattggattagattgtagtcaaacctgtatgtccctatgtggttatctctttgaaagttaaagaggtctctcttgtgacataatgaaggtcagatttttataaatactccaagtgtgctgcagaagcgtgaggatccttggctatgtccagttcacacggtcacattgcacaacatttttcctatgcataaaatgtatcactttgcctttcttctctttcccatatggaaaaatatatacatttatatgttattgtagtaggaaatttggaatttcacctgagtttctttagagaggttttttaaaaaagctcctatgtaggatagagcatagagaaaggaggtgtattttggacataaagaaaggggaagatgcttatcaagtaactattgtatacatggttctttagatatgctccattttaactcccatttggaaaaggcacattaccttcattttaaagataaggaaactgagacttagaaaaagtaagttagatttttgaagccataaatctatttaattagaacactgaaatttcaatccaagttcatcagagttcaaaatctgtatccttcctctgaggaagaagaaaaataactaagtaggcaaacgtgaaataaactgtggatttcttgtccctccgctttgttcttcctctgttatctgatttccccagcgttctaacccgcaaagtgaaaagggccagggatgatctcagagacaggtgccaagccctttcttttgtgatcaccacgctgtgcctacctttcccatccacaattccactcctgacaagtgagagtgcagacaggttgaacaatccagaagaagacagagatgccatatggactcaaaggtgagacaggagcctcactggcttgtgtattcccacagcagcagcaggcacttagcaagtgatgggaggtcactttgcaaatggcaggcacccaacccttgagcaagaggtcctctaccatacctcagtttttgtcataaaagacatttcatttgaacatgaattaaaggtatgaatttggtttgtatgtggatgaggaaagtttagcatgaaaatcagaaagaaaaaaagacattggtgggtaaggatgatggttgtgtttgtttttacggcaggcattaatgggagagaaaacgtatcattattatgaacataatctaatagtgaatatgtgcctattattcactgtgccatccaccctgctaagaattttgcatgcatcatttctctttaccccacttcaatcttatgagatatacatgcctattatctctggcacccatgaccaaactaagtcccctgctcctcccacttatcacaattgtgcaatataagaatttaagtagtttaatctgcaattaataactacctcccccataagactatattctctgggggcaagatccatatcttccttttttataactctatcttcaatgccttgcacaatgcttgctgcataagtaggcacagaaacatattttttggataaatgaatctgcttttacagatgttgaagtagtaagtaagtggcagaatcagtatataattccagacttgcctgagcctcttaagtgctgcaataaataaatgttcacttccttcttgggcaaaaataatcatatatattcttagaggcaagaaaactgtcccatccccaagaagtgccccctgagtactctatccctggaggggttcacattatcctaccaatgtccacttccttttttatcgtgttctgagataatacattcattctttttttgtttgtttgtttgttttcggccgtttggctatggattccttcagagtacatcattcactatgtatctccataatgttgagcacgtagacaacatcgatgtttgttgaatgaattaatgagtgagtgagtaagtgaactgcccaggctcagtgcaccaagagatgtacagtcagttaaccttgttcattgagctgcatttcctgtggagtgatggggggtacctcactgtccttctctttcacatggtctactggaaccaaatgcctgcctttgtatgatagctgcgcagaatcacctaaggctgaagaaacaatgttgtttaaatttcttttccattgtgtgaaggtcattggccagtaaagagatactattcatgcccttaagaagcttgcaatacaggtttcctataaatgaggtactaaccttgtttgaaactcagaatcacagactctacattataagtaaccttggcaatagtttaatctagttctcacccttggccagaatcccctttcctgtaacatacctgcagagacttgaaaatatgcagggatagtgatgttgctacctcatcaagcagtctcttccatagttgaacggcatttctgccaagaaatgttttaattgttttgagctaaatctttcttacaataacttcatccaatttgctgtagtttacagctgtacaaaagaagttgcagccttcttcaataactatctgatggtaattctgaccttccctttcaccttttccccctacacactttgacagtctatttccatatggcacacctcagtgccttcagtgttcctcttgtgattatttcaaatgtctccccagttttgttcacttttctgatcatgctctgtaggttctccccaaaaattgccactcctctgcaatggagtggatgtttgtgtccccccagaatttttatgttgaaaccctaatcccaatgtgattgtatttagaggtggaacctttgaaaggaaggtcattaagtcataagagtggagccctaatcatgggattaatgctcttataatcagaagccagagggctaacttgcttttttcttaccatgtgaggatagagcaagaagatggttatctctaaatggtgaagaggacccttacaaagaaccccaccatattggcaccctgatctcagattgccaatgtccaaaactatgggaaataaatgtgtattgttatgtttaagcaacctaatttatggtatttggttatagcaatcagaggtaagaacccctgcctcccactaaaccctagttgtggcctgataaagatgagtacagagtccgactagaatgtcatcttttctgctggggatagcaaagccatgcttaggctattttggctaagatgccccaccaataattttcttcaaatctattatttctatttctgttttttgtctctgagcttatactctgagatcaaagtttcatgcgcgtccatgtgaagagactaccaaacaggctttgtgtgagcaataaagctgtttatttcacctgggtgtaggtgggctgaatccgaaaagagagtcagcgaagggagatggattatcattagttcttataggttttgggttaggcggtgaagttaagagcaatgttttgcgggcagggtggatctcacaaagtacattctcaagggtggggagaattacaaagaaccttcttaagggtgggggagattacaaagtaccttcttaagggtgggggagattacaaagtacattgatcagttagggtggggcaggaacaaatcacaatggtggaatgtcatcagttaaggctatttttacttcttttgtggatcttcagttacttcaggccatctggatgtatacgtgcaagtcacaggggatgcgatggcttggcttgggctcagaggcctgacacaaagcaagtagaatgaggaccaatttcaagctccttccacagccctcctatcttagccacagtgtcctgaaaaatacactctgagtccaaagcttttgctggggaatgcaatcctagagaatcaggagtgagggaaaatgggatggagacaggaaaacagggaaagtcattctaaaggggtgacatttcaaactagccacctctcctcataggcttcagagtggccttaggaagagattacactttataacagtgtgtctagaggatgaaaagaaaagaatttgtcctccaactctgtcattgatacgttaactccccatgctttcagatgaacatttgtgagcacagactacctcctaaaggcatcatgtctcaggggcaggactccagagatgtgaggcttaggcatgagccaaggtgctgtcagatggtggctaggccagctgaagcctgggggagcagtggcttcagagggactcctggtctgcagtggcagcagtcattgaagctaccaccagaaccctgtgttgcaaagcactgctgatgccactccagaaaggcaagcatgcggttctgcagggatctctgagtgcagcccatctcacctcctgcgggctctagccttcccatatttagcaaaagccttggcttttaagaagcttagggagccagccttaacttatgcatcaattccctgggaaggcattttctgaaccttcattctaggcccagtgccagggttatacactctcagagcatttatatgttcccgctccttgtctttcataatcgtgcgttcacttgtgtgaatatttgctaatgtccatccctggtctgacttcaagcaccaagcacggggccttttttttcttttcttttcttttgtttttgagatggagtcctgctctgtcgcccggagtgagactccactggcttcaatctccgccttccggattcaagtgattctcctgcctctgcctcccgagtagctgggattgtgggtgcccattgtcatgcccggctaatttttgtatttttaggagaggcaacgtttcaccatgttgaccaggctgcacggggtccatttttgtgctcaccgttattcctacagcctcacagaatcctggacacaaagaaagacttaacagggttcattcattcctgaaccaaagcggctgaacgatgtcaacaggaccagagaggctacaggaacgccatattttcttctacatctctttttttaaaaatcttatttcaatggagtcaaactcaataaggtgaattaaaggaaaaagagctgacccaaacaaacaagcaaacagaaaccttttctgtcctgtaatgtttaggcgcagataagaagtgcaaatagagagtttaaaaagctaataaagtgttttgtttgaaaaaaaatatgtgttgctacaacttggagaaaagactgtctgctgcaaatattaatataattcactgtccttttttccaaattctactcgaaataaaatattcagtttttttaaatgattgtcagtaataagaatgtaatgcttagtgtctgtgacattcttttgacatttttcatgtagttcctgctatagctagttagcccataggttttgtcccttgccttctaaaatatgtttttcccttttgtttttcacagttagaccagttttatttttgtcagacaaaaaaattcatctatgtttaacaaatgagttaattattcacatagtggagattctggtctcaattgctttgacacaataaacaaggcatgtctgccttccacaagtagtagagatgcaagtaaataaaagaagaatctgcacacctttttaaaaaataataataataatttaggctgggtgcagtggctcatgcctgtaatcctagcacttagggaggcttagtgggaggattgctttaggctagaagattgagacagtcttggcaatatagcaagaccctgtctctacaaaagaatatgaaaattagctggatgtggttgtacctgcctcttgtcccagctacttgggaggctgaagctggaggttctcttgagcctgagaggtcaaggctgcagcgagccacgattgtacctctgcaatccagcctgggcaacaggagaccacatctccaaaataataatagtaataatagtaataacaataataataataatttaaacagcaacaacaacagaaacttgggatgtttgtcagctcagagtctctttcagctaaaaaatctgaagtatgagtgtccccaaagcacgatcaatgataacaaaagggagatgagcatgaatcaatctttccattgatgatcaaagggctagaccctctccctggctctagataatccaacagctgacagtcaactcctagatctttctctgccttcctttttaaatttttctttgtgattttgatttctcatctgcatcttccgattaacttctcacctgtcaaccaaatagcttagcagctaatcctgatgagtggcttctgactctaaatttagttacatctcttccatgatacagaaagggttaccttccagcacagaattatctactaaaaagccatgacagcccacctgtccctgcttctttcagtgggacgtcactggctagccccaatctgataaatattattatgagaaataacaccacgaggacaaagtaaatagaaacatactggaagcatgtgtagagtacacaaagcagagtgtagtagggtgcagttaatcaagtagactaaaacacctgggaaatacttctttttctagtagctgaggcaaaaatggcaacatgtcagtttgtactaacagaaaatgcccatttagctgtgcagtaaattcattatttttttctataattacactcaaggaaaaattatttggccaaacccttatacaaaaacactgggtgttataatgtacaatattttgaatagtggttttataggtggtgcatacactgtgtgatacaatatataaaaaccaggctcaacaatatttttgtacaacattcaggaagaggtacctactttccataaaggcagaagactggaattgagaaatttctatgaaagtatttctgtaagggagataaaaagtatttgcgttagacatgggttcagagaactgctggttccagtattattctgcatggtccagttagaaaagttaaattctgaagccaaaccagcggcggtttaaatctgcttctgcatattaactaagatgtggccttggacaagtcgtttgaactccatggatctatatcttcatctatgagatgggtataataaaatatacctcacagagactgtctaggaaattaactaaaataatatatttctcgtgtccattttaaaaatacctgttacataacagatacaccatttgttaagaagaatgtataaacagtaggatattttagatctttgagaaattttagattttaatatattaaagtatttagatatgctaattagaatataaaatttagaaaatttaaaatggaaagaagacacaatgtgatcacaaaaatgggtggacatgataaagtcgtctttgtgatgttttgacctgttcatatcactttttacctgatgtaactcaggtaataaaaagaagaaagcagccgcctctcctcatcgtcttctctaaattgccacttgcattgggcaaatggctatttgtcagtccacctcattgcttttctttgcagcctctgagtcttttgttttaactcttgtggaagaaataaaaaacaaaaaggaccagtgacagtcttgtgaatccagagcacttgctgttcttaccgcaaaaaaagaaagggaggccgggcgtgctggctcacgcctgtaatcccagcactttgggaggccgaggcgggcggatcacgaggtcaggagatcgagaccatcctggctaacacggtgagaccccgtctctactaaaaaatacaaaaaattagccgggcgcggtggcgggcgcctgtagtcccagctactcgggaggctgaggcaggagaatggagtgaactcgggaagcggagcttgcagtgagccgagatcgcgccactgcactccagcctgggtgacagagcgagactccgtcccaaaaacaaaaacaacaaaaaagggaaaggtgagagcaggcactgagaatgacaggaaaataaggcaaggagtaagtgatcaaaagtcagggaggttagagaaaagcatgaatctggatgaaggacacagcacaaagtgacttctcccatctctgttctgtgcccagaaaatttaaattgaggcataaaggtatttatcatgggacccttttaaaggaccaattagcatttactatacaccaagattgcttactgtgaagaaatgttagcaggaatgaagaactataaaagctgatgaggaaaaggtcaaataatctaagcaggattactctggtatatgctcaacaactgcccatgatgatggaaagaaatagctttgattgcctttaaaaggaaaactgttaaaagattactaatcttttaaaccagttgtctttacaaatctctaggagtaggtcagttaaatgaaatctctaaatactccgaaagtaagttgacaaaaccaaaatctcttgaatggagacagagctataatgtattgtggcagcttcattgggaattaagactgagattatatcacaaagaagtaaagccatattgaaatttattcatacaccctgtcatctctctcagaaaccctagctcctgctctgaataatttgttcagatatgcttcttaagtatgacatttgaataaatctggtttttgatttgcattttgtttttctttgccaaaaaaaaaaaaaaaaaaaaaaaggaaaagaaggaggggaggaaaaaaaaaagaaaggaagggaaggagaatgaaaaaaagaggagaacaaaaccaaaaccaaaaacacaaaaacaagctttggtcagtttgctttggctatatggttctcaggttaattaaggaattataaagaagcacctttggtttaacactcatcaaaactcttccttaaatatattcaggcatgtacagacaatgaagtctgatgtggaccaatcccaggacaattctcaaagttgtttagctttttaggttactgtgtaaacaatttttaactcttattttattttattttttgttttgttgtctttgcaatcccaaaattttctgttagtttccttatcatgtaatctaaaaagaagaatgggagaacctctttaagtgagcacagttttattagatttgaatccctgccaatttaccactgtagattgtagagtcatatgtggaggctatgtgtaatgtggcatgcggcatcctcagatgtcaaacttctctttaatttccaagtgacaattagccaacccaccgtttcccatgacttctctgactcctaaatatttttgagagtccccagtgattgctcatgtgctcttcaaattcaccttggttgctgctcttcatctcagctgggactcctgccctttttgcagtatcagaatagacttctccagtctgctttcataattctccaaaggctaggtaagacttaactgtaaggcttggagacaagcagaaggtttgcagataggtcaaagcaaattacacacagaaagctttatactgattattatgtgttaaagatgctagacctatgcatggggttcagcccctaatgccaggcaaccctgctggacttctctgcttcacccatagtatgacacttcgttgtatggattcactcagctgtcctcacagggtgctttagaccagatctcctgcaccccaaaaccatgggtgcatacaaacttactgtagggggctaagtaaagcggggcaggatgtagttctgcccagcccaggctcaggctttctctgggacatctcattgtgtcaggctgcacctcacctgaacagggatatggttttactttggtaaaccaaggggcacattgaagttttgtgatttattttctgcaaagtaaattgcaattcttctctatatacgaatgaacaacactgtcagctttaagctagcggtttatcctggcttctagtcaccaatattttaaaatgttttgggtaagttagagaacccagttacattttatataaaatatcagtcatcgtttacacatttctaatatttaactgttatagctattatatgttttctgtagccattaataaaaggtgaataagctgggcacggtggctcgcagttgtaatcccagcactttgggaggccaaggcaggcagaacacctgaggtcaggagttcaagactagcctggccagcatggtaaaaccccatctctactaaaaatacaaaaattagctgggcgtggtggctcacaactgtaatcccagctactcaggaggctgaggcatgagaatcgcttgaacccaggaagcagaactttcagatagctgagatggtgccactgcactccagcctgggtgacagagtgagactctgtctcaaaaaaaaaaaaaaaaagaaaagaaaaaaggtaataaataaatagaaaaaggtgaatgcagagcatgaaaagaggagagacaggaatgaatgaatgagacatccctggacatccctggacaagcactacaaacaatttctgacagagaatggcttagacttccatggacaattcaaccccaaatggcatattaacaagaaggagaagttatatattgaacactcaatgaggatttgctatattcagggacccacaagtaattgacatatgctttgcctttcattcttttaacagctctcttataaacccagtgttgtcattcccatttcacagaggaagaaactaaggcttagaggtagagtagcttgcccaagtctcattgtggtggagacaatattgcagcccatctgcttttccttcacccttccttctcactgcttcgcctctgccgagacacatacattctgctgcccaccagggaatcttgtgaagctccaattcaggcttaatatcccactaaagtatcagagcttcatgtagtggcagtcttttacaaactatatatatttataactcagtaaaatacataataaaattctcttgatcttatcctatgacaaatgctggggtaaaatagtcttccaacaattaaattcacccaagaaacacagaatcttatagaggaagcaaacatgcccattgataaagcaaaggaacaaacaaagttggaatcggggaagggaatctatatataaatatatgagatttctgctctaaaaatacacattcttttataatgaaggtcaaatatgtacacacatagttataatacaaaatagaaagaatcaagtaccatgagagatggagaaataatgtgccatagcagttcagaggaaacagaaagcatgcctcccaagaagcaacagtgttgagcagagagaaagttagtttgcacaggggaacagacctgggttcacatcccgagtccactgcgggcaacttactgacttgtagttctcagtttcctcatttccaaaatgcccagaaacagcataggatgtgacaaaagactgatgtgaaaacatgcagctggatcattttctacatccaataaatattctctctgctctcctgcttggaaaattaggattatttaataaaggagtcagtagttgacatgagcctgaagaataactacaatttaactaaacatgtggaactagcaataacagtagttaacacttatataggtcacatactgtgccaaaacttcatacttcatgctagaactgttctaagcaatatctaaacactatgtccatgtatatggcatgttacttagaataattctggcataaattattagcatacatgttaactaatatgcatgcatatatttatatgtctacacacacacgtgcacgcacatacacatacacactcaccatcctcttgagaaatgcactctggtccctattttaaagttgggcaaatgctagaacagaaaagctaagtgtgtgcctgaattctcacattcagtaagtgggagagcaatgactaaacttaggcaatgtgccccagagtccatcatcaacaccttgctacagtaccatgcaggaatagcaccaagaccctaaaacaagactgcatgtaatgtgtctggccaatgacattgagcagtctaattttttggagtttatagtacattcagggattgtgagaaataagactcaaagcagaacagggccagcttataagaccttgcaagtcaagctaaggaactccatatgcctgtctggcttgattcaaacattgtcaacaatgagatcagaccaagtatagaattaccaagctggatagtctgaaaatcactatttaaacttgggagtgaagcaaagtataaacagggcctgagtgttccttaacacagcaaggtacaaatacgtttatccagcgttaattccctgcattcgatatggggcatacagacctccctggtattggtgcagaggagctgctggaagcatgattaatatcagcagtggaagcactgttgcaaactattggagaaggctaatcaattcacagttctagggggtcccttttttctggatacgaaatgctttaataaatacgttgtaaagaactgaagtgaaatgcaggctacaacaagcattattttgcccccttttctcctttgtaaacaatttatcaaatcaaaaatagcttggtactttaaatacagtgtcagagtcttcttttcaatattataccttttctaatgaatagttggatctagatgctccagaaagccatgaaaataaagaaaaactcactgaatttcttagttgagtaaattcactggtaatgtgaactagggcttgagatagatctttctatatatgaattcaatacctctgctaacctgtcaacaacaacaataataatagcaataacgataacgataacaactgtttaataaacatttggtgttagaatacaggtcccccagtattttgctccaggactttttgtcttgaactatgacaatctgtgcagaaaaaggccagtcttagagtcaaatgcagacagggctactgaccaggagttaacactaagcatcactgcatcttcttgagtctcagtctcctgtcttagcacatcactatattgcaatgatgaaagctttcaggcatttctgtgtggaagaaaaaattaggtgacactcttgtggataggagaggccagagaatttctttgacactgaatttgcatagtgagcaagttttttttctatttagattgtgtgattacttggtgcaggttgacaattctagagcctttctgtcttagaaagttctagctgctataacaaatgtacaatagacttaaacaacagaaatttatttcccacagttctggaggttgggaagtccaagattaaggtgctggaagatccagtgtctggtaagagcacttttcctggtgcgcaggtggctgttttctcattgcctcctcatattagggaaagccaagatagggagggctagttctttttctattcttagaaaggcactaattccatcacagagcattcattctcatgaactaattacctctcaaaatccccacctcctaataatgtgacagtggcattagaatttcaatgtatgaatttgcaggagcgttcagtctatatcatcttctgcaaagtcatctttggaggtcactacaatgatgttatgttactctgaaatacaaataaatgtatgagtgtttaatatatatgattcttttcccacggtattgttatctccatttaatagatgaatagactaagattctgaaagatgatatgaatggcctaaggtgatacacgaaataatggttggaggtgactttcaagggaacattccttcaaagcccagtggtttcaccttgcacatgcagccagcgatccagtgacacttctcaaggggatctagggatagcacgtgaaatgaagaatgaaaaatcgcaactttgtagagccaccagcaaaacattgccatcagacttcacatttatctttagctcaaaggaaataatttcatgataactgatacctgagttaggcaaaatgtttacattttttgtgcttcataatagacaagcagaaatttcctttagtgctgtcctctcctttctttgcactgtgatttacacaaaattccactgagtttctgggaacaaccatatattctctaccttctgtatactatagtttgtgcaggtgccagggatgcaaaatgaatcagggcagtggccctcaaagtacttgttgcctagaagaggagaccaacctaaatacagacattccagctcctttgctgatttccttccatgacagcaaataccattaggatgaacaaggagagtgccaccagcttaaacacagaggttggggaaaaacagagctgagaatatgctttaaggaattagttccctgttgcctttgggggaacatctcgcagtttgatgtaacagaaggagaacacggaaaggagagaaaaagcaggagataatttggaaagcagagggctttatagggaatattaagaaatttttactttatttatttatttatttatttatttatttttgagatgaagttttgctctttttgcccggactggagtacaatggcctgatcttggctcaccacaacctctgcctcccaggttcaagcgattctcctgcctcagcctttggagtagctaggattacaggcatgtgccaccatgcctggctagttttgtattttttctccatgttggttaggctggtcttgaactcccgacctcgggtgatccatctgccttggcttcccaaaatgctgggattacgggcataagccactgcatctggccctactttatcttaaaggtaatgaactcgcttgtcagattgattagatgggagtaacactggaggccaaacaactgtctggaggctattgcagtgatccaggaaggacacgatgaagatgatggtgatgatggagggaggtgggctgtataccaggtatttccttgggtttgtgtttactcaaggccagatctcagagtttacagtaaatatccagtaattctgtctcaatttaccagacaacttggcaagagaaattaattcctttagcttgtaaagatttttcctcctttctctctttcttctttattccattattcttcttgtgttccttttaaaatttgcctcctcaactgctcattttccctaggaagggaaaaatttcattgcttgggctacttacaattcaacagaaaaagttgaaagtcacctaagaaaagaaaaggaacagaggagtgaagaagagaggaggagatcatgataaatgtgggttattatgtggttttgccaaaggctgtcagtgagcttacatcttctccatagagtgctagtttaagatcaaaatctcaataaaatgaatgattaaaaaagacacatgatgtctgccttcatattcctctttcctgcaagaatctgctatctcctcaaagattcccattcagggaggtgaaattatctttggcgaaaattgactataggacaggcaagttggggcttttctgctggtgtagacgttcatccctggaagtgatcctggaaagctctggggaggaaataaggatgagcgagcatcctagatttatttagtcatcatttgtttctcatgaaaccagcaccagccttagcttattctctggtcaattaaatgtaaaggatggcagaaactagagcccacagtctgtgagtagtttgtggggttaacaagctgactttctgcggtatggaatggcatcagggatgaaacacagacttcatatgctgcccattcactccttttgatacttccacctcaaataattttgaatagtctgggtaacatagggcttggtgaaccttgaacactgacactttattatttgcctctctgaagcactctagcctgacacttaagattcctaaatccactgtggtagtagaaggagctctaaactataacgtcataccagtttcctcttaaactaatgacatttcattgagaacattcctcaaaactcctatcctttgttttccatccaaagccatgaccaggaagatctcccattaagacattatattcagattcccgaggagcactattccctcaagatgcaccatgaaaacataacagggcttataatgaaaaaaaaaaaatagggaaaccaatgctacatttatttcttcattcaacaaggatttatgggccacctgttctgcttgagattttaggagaagactctgctctcatgaagcttagagtgtcatcgcagggagataggcaagtaaatgaatatatatgcatatatttagtttgtcaggtggtgataaatgtaggaaggaaaataatgcaagacagagagaaagagaaatcatgctgggaagacaaaaaagatttgtcaagatcacttactaaagctactgccatgcacataagaacataaaggcattatgaagactggcagccttttcatctttgtttctatttttctctttgccccaaggctttaccctgtatacctgagttagcctctccctagctctgggcctggcccttgctgcaatatcactccttaactccaggtgctctaatagaaggttgggctgccctgcctactcccatgctctagttccctacctcattggcaagaaagttgaaaaagatttctatttaatttttgaaaggataaaggcattgtttttttttttttttttttgttttttttctttagtggaatgtgaaaagtgtgattttgctaagagggtatttcagtcttttccaggcatgtgccatatgttggagctgccatacatgttggtgttatctctcagtgcagagacagaaatataaatatatgacactgttgtcaacagtcacttcattaccccctacactttttttttattactttttttttgagaccgagtctcgctctgttgcccaggctggagcgcagttgcatgatcttggctcactgcaacctccgcctcccgggttcaagcgattctcctgcctcagcctcctgagtagctgagattacagacacgtgccaccacgctaatttttgtatttttagtagaaacggggtttcactatgttggccaggctgtctcacactcctgacttcatgtgatccacctgtctcgtcctgccaaattgctgggattacaggtgtgagccatcgtgcccagccaattatctcttacacttaacacagcagaagtcacgcaaaatccagaatttcagaacaaacacagcagtagcaacagaggagtctggtgtcatatacatgccgtcaattacttaacaaacatttatctttacatgcacaacgccttcaagaacaatttctcttctgaatcatacaaaccagtgggcaacaaaggcatgtttctctttgtttctgggttgatgtacataatatcagttgtcatattttatcttctagtactaagtggctcagacacttatcattatcatagggatgctgatagactacttatatacaaaagttcatagtgttctaggaagaattttgagaactttattcagaaacttcattctaaattagtgtttggttgttaaagccataaataggcagaggcccaatggtgatttaggttcttccacatgtaccttaaaataactttatcaatgccctttcttggtgcttgtaactcttgactttcaataaattctatttgtacttacgttattgatggaggagatttaatgcaaataattcacaggcaaggacatttgttcatcaaagtagaagaaggatgagaaaatggaatatagaagtaataactttcatggggcagtgagggtagcgatgcagtagctccatggtcatggggcactgcccctacgggaagctgggcttttctgcctggggccaggtgctggtcactctgacaacactggagtctccagtgggagagtcacttaatggaagacattaccccctgcaaccttcacgggtttactgagtaacttctgctgacaagttctattatatcccctcactaagaataaaaagggatataactgatggtttaggaaggggttccaggagtgtattaggagactctatattgataagatttgcatcagaaataactttcacaggggtaaaagaataacaaagtggtccatgttaggatcccttcatatttcattttctgaagtggccacatcaagcttcaggagaatgaatgacagtgaaggccaggacaaggagactaggaggaaaatgtcaagttgaccactggtggcacgggagcacatgtgtcacagaagatgtgccaaggctgggctgggaatgaggaagcactaatacccactgaagggaatttttactgccagagacagaggcataaacaaatacaccttcagtgtcccaggtacacaactccaacagagtaagagcacagagtcgatagcgactccctgagagaagggagagaacatgagcacgtgattgtcactagcacagctctgagagcctatacccacacaactggtggtgagatcagactggaatgccagcttttctctagtgttggctgaaatccttgtgttgtttctctaatctggaggtcataaccaggcaaagcaagcagggtggcaagtggtgccaatcagtcattcccctcttgccaactgttaagatacaacaggattcttagacagcaatcaaattctgagtggtcttttaagctaatcaaataactgtcgctattaaacgacaagtagatacacacatatgcacttatgatataatagaccctgtgctccaaataaggaagagtgggggaaaaggagagttctattgtttaactctcatttttgtctcctcaaatctatcatttcagagttcctcttagctaccagtagtggccagtgcctaaaacctatttctctcattttcttttctataaacgcctgtctgaaatccatttttgcgctgctctgaatagcagtttggaactttgaaggctgaatgggtttgtcaattttagctttaagtctgtggtttgcatgttaattaccctttgccttattaaatgtatcttcttaaattagaaaagaaaaccaatcatttctaattacctctgtgctgctagttcctccttaactttagtttgtactcttctggggggacatccctttgaaagtcattcagaaaatgtaagtgtcattgacacattccttatatgtagctcgaggtattagcaggtcgttgcttcagcatacactgtcatacaaagatatttttacaagtattttctattggaacccgcctttcttttttttctctctgtctttctttctcttgaagagtattgcatgtattgaagaacctacaaaatgaagtgtcatctgcatatgtattagatgtaagattcacatcttccctggagacttcattttctctattttcttgatgagtaaacagattaagaaaagttttttttatgtttctttgttcattcattcacccagttattcagcaagtctttaataacagtatgtgcagcattaagatgctgtttgtaaattgactgattttgaaaaaagtacacatatttggcttgggttactgaaatccatttcaatatacctttaagaaatactgtgctccatgcactgttctagacaatgcagtttaaaacgagatacaatccagattcaaagaggaattacagtccgggtgccttgctggggatgacagggcaaatcgtattagtccggtctcatgctgctaataaagacatacccgagactgggtaatttataaaagaaggaggtttaattgactcacagttccacatggctagggaggcctcacaattatggaagaaggctaagaaggaccaaacgcacgtcttacatggcagcaggtaagaaagcatgtgcaggggaactgccctttctaaaactatcaggtctcgtgagacttattcactagcacgagaatagcatggaaaaaaacccacccccgtgattcaatcacctcccactgggtccctctcatgacaggtgggggttatgggagcaacatttcaagatgagattttggtggggacacagccaaaccgtatccgcagggatgttaggattagcacccaaagttcatctcttttctttcccactgcttctcttaacatggacccttaggcaaggtggtgtgtttggcagagcaccagacttgcaacagagtctccctgaaaattcccgacatcccctgtcaaggtcactgatgcagaattttgttgttgtacctgtcatttcttgcacagactgtagttaggcaaattaataacatctgcctggtggcaccgggatacttgtaatctcactgccagtcaaagtcaacagtgtaggtcggctggctacagtgaattcacagaatccaaatgagtggctctggtggcagccagctcagacctgtccactctccactgatcagtcccagcaccaatcttgccttagcctcacagtgtctccccataccatgacctgcttaacaaagtcaaggaagagcatcagcacctttgtgtgaccacaggttcttccattcattaaccaaacagtgttgaacacttaggaatgactgagtggcagaagggcagggggtgaatgctgactgatactcttttctttcacttctggcatattcttctgtgtgtcaatcccgagtaagctctccctgtgatctcctttctatgtgcttattttcttttctaatattcaggccaaatatggtggagagttcttggaagaagatgggagattgagattctctttgaagagcaaatttcactctctctgtgaccattacaagaaacttaacttctctaagcctcaagttctttaactccagggaaggaaagacaaactcctaaactgtgtttccgtgtaaggataagatcagtgaacagctttgttaagaatcatatgaatgatatttgagagtaacaaatataataacatttatctcattataactttaaaaggtctatggataaattcagtatattagtacttaaggttgtgggggtggcgggtgggggcggctggggaaaagagaaaaatcaaatttctgagaactagtgcatataatatcattcagaattgtaaatggaaaggacctgcactgattttgcagtgtgttcttgccattaatctctctgagccccagggttttcctcatgaggcggcgagactacattaatgagccacatgtttgtaagatgtactgcaaattcagaaggattaaatacatgtggaggggcgggaacagggtgtctcttttagtgaggaagtgggctgaaaccttctttgatgataagtgggacaaagtgaactaatacatgcaaagagcctagcaagtgcctggcatggaggagacccttgaaaacggtagctatgatgcagccactgcaattacttggttgcagaaaccggactccacttatatatgcaggtgattatgggagtgaagtaaaagggtcactagactctcatcagaatctctataatctagtctcaacttctgataattttttttacttacgacctcggatcacttaacctctccaaaattaagttttctcacctttaaaatgaagataaaacagcctacctacttcacaagaatactgtgatcaaatgaattgatgaatgttctttgtagttattcgtggcctcacactgtcaagaaaagtactgatctggtttccatcctcagagcttaggtctgcctagtttagaattttatatgcatggaatcgtgctgtttgcactctttatggctggcttattttgctcaactagtgtgttgttgcagggatcagcactttgttactttttattgttgagtaatattccaatctactaatattctgtattaaatttcctgtcttgctaggctctagaagtggaaaattagatttttaattttatgttgttcttcttatgtacaaagcactgaagccacaagtttttctctaaggtctgctttaactgtgtcccacaagctttgatacagtgtttttatcaccatgcaattcaaactaatttctaatttccgtttagatttcttctttgacctacgggttacataaaactgtgttgattaacttccaaatatttgaggtttttctagataatttattattgattcctaatttaattcaattgtggttaaaaaacaaactgtacggttttaactaagacctatcttattgtgcaggatatggtctcagtgaaggtactgtgtggactttaaactaatgtataatctgtagttgttgaatggagtgttacatgaatgtaaattaggtcaattttactgataatgttatttgaatctttcatatcctttctgattttttgtcctcttgtataattccattttctgtactttccatcctttttggttttgttcgcatatattttccttctacatgccttgcaaacattacaagatattattttttgaaaaactatgaactgacttttaaaatgtttaagaaagaaaaatagtcttttatatttaaccatgcagttttcatttgatttttaaattgatgggtaatacttgtacatagttatggtgtgcatgtgatattttgatacatacacagaatgtgcaaagatcaagtcagggtatttgggatatccatcagctcaagcatttatcatttatttgtattgggaataattcaaatcacctttcctagctattttaaaatatataatacatgttgttgttaactatagtcactctactgtgctattaaacattagaacatatttcttctatctaactacatgtttgtacccattaaccaatcttttttcatcccaacctcacatatacctttcctggcttctggtaactatcattctactctacctccatgagatcaacttacttttagctctcacatatgagtgcagacatgtgaagcttgtctttctgtagctggcttattttacttaatataataacctccagttccgtccatgttgttgcgaatgacatgatttcatccttttttatggctgaataatacatatactacatttcctctaactattcatctattgatggacacgcattgtttctatatctttgctgttgtaagtagtgctgtgataaacatgggggtgcaggtatccttttgatatactaatttcctttccttttgatacattttcactagagggattgagagctcatcattccttcctatacaccacaaattttacctggcatcaatttcttctacttttgtattagcatttcttagcagctttatagctaataaattatttattttgttcatggaactgtttcttttccttcatatttgaaagctatttttttgagggtgggttgtagaggtcaggggaaagcttcctctcttctttctaaaggttcactgaaaactaacaaatgtaacaaattaacaatggcaggatactagaaagaaaaggcatatcagtgtatttaacatggataagcccaggggagttgctagagactcaataactcaatgaggttcaggtacttcaatacccttcttcacaggggaaagggagatggcagaaatgtggtaattttgaagagcagtaaactattttcagggaaaatggatgtacccagtactcagactatttttaataaataattctttttaggcattgtataggattagagataaagatcatctgggttctaggtgtggtgtttaatttttagttttttcctctctgtaatatgagttgcaatcttccctacttaattacatttcagggaggggattgaagacaattgtgtttctctttggtgggttcagtttccaagtagataaaagaacttcgggaggaggagccaagatggccgaataggaacagctccggtctacagctcccagcgtgagcgacgcagaagatgggtgatttctgcatttccatctgaggtactgggttcatctcactagggagtgccagacagtgggcgcaggtcagtgggtgcgcgcaccgtacgccagccgaagcagggcgaggcattgcctcacttgggaagcgcaaggggtcagggagttccctttccgagtcaaagaaaggggtgacggaaggcacctggaaaatcgggtcactcccacccgaatactgcgcttttccgacgggcttaaaaaacggcacaccacgagattatatctcgcacctggctcggagggtcctacgcccacggagtctcgctgattgctagcacagcagtctgagatcaaactgcaaggccgcagcgaggctgggggaggggcgcccgccattgcccaggcttgcttaggtaaacaaagcagccgggaagctcggactgggtggagcccaccacagctcaaggaggcctgcctgcctctgtaggctccacctctgggggcagggcacagacaaacaaaaagacagcagtaacctctgcagacttaaatgtctctgtctgacagctttgaagagagcagtggttctcccagcacgcagctggagatctgagaacgggcagactgcctcctcaagtgggtccctgacccctgacccccgagcagcctaactgggaggcaccccccagcaggggggcacactgacacctcacaaggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaatctggaaactctaaaatgcagagctcctctcctcctccaaaggaatgcagttcctcaccagcaacggaacaaagctggatggagaatgactttgacgagctgagagaaggaggcttcagacgatcaaattactctgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggaagaaaccctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagctcctgaaggaagcgctaaacatggaaaggaacaaccggtaccagccgctgcaaaatcaagccaaaatgtaaagaccatcaagactaggcagaaactgcatcaactaacgagcaaactcaccagctaacataataatgacaggatcaaattcacacataacaatattaactttaaatgtaaatggactaaatgctccaattaaaagacacagactggcaaattggataaagagtcaagagctgtattcagtgtgctgtattcagggaacccatctcacgtgcagagacacacataggctcaaaataaaaggatggaggaagatctaccaagcaaatggaaaacaaaaaaaggcaggggttgccatcctagtctctgataaaatactttaaaccaacaaagatcaaaagagacaaaggaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaagaattgaactcagctctgcaccaagcggacctaatagacatgtacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacaacctgctcctgaatgactactggatacataacgaaatgaaggcagaaataaagctgttctttgaaaccagcgagaacaaagacacaacataccagaatctctgggacgcattcagagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaggactaataaagaaaaaaagagagaagaatcaaatagatgcaataaaaaaagataaaggggatatcactgccgatcccacagaaatacaaactaccatcagagaatactacaaacacctctatgcaaataaactagaaaatctagaagaaatggataaattcctggacacatacactctcccaagtctaaaccaggaagaagttgaatctgaatagaccaataacaggagctgaaattgtggcaataatcaatagtttaccaaccaaaaagagtccaggaccagatggattcacagccaaattctatcagaggtacaaggaggaactggtaccattccttctgaaactattccaatcaatagaaaaagagggtatcctccctaactcattttatgaggccagcatcattctgataccaaagccaggcagagacacaaccaaaaaagagaattttagaccaatatccttgatgagcattgattcaaaaatcctcaataaaatactgggaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaacaggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcctcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatgtcatgaaaatggccatactgcccaaggtaatttacagattcaatgccatccccataaagctacctatgactttcttcgcagaattggaaaaaactactttaaagttcatatggaaccaaaaaagagcccgcattgccaaggcaatcctaagccaaaagaacaaagctggaggcatcacactacctgacttcaaactatactacaaggctacagtaaccaaaatagcatggtactggtaccaaaacagagatatagatcaatggaacagagcagagccctcagaaataacgctgcatatctacaactatctgatctttgacaaacctgagaaaaacaagcaatggggaaaggattccctatttaataaacggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactactatcagagtgaacagacaacctaaaaaatgggagaaaattttcgcaacctactcatctgacaaagggctaatatccagaatctacaatgaactcaaacaaatttacaaggaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcgttcattaaaaagtcaggaaacaacaggtgctggagaggatgtggagaaatagcaacacttttacactgttggtgggactgtaaaccagttcaaccattgtggaagtcattgtggcgattcctcagggatctagaactagaaatatcatttgacgcagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcccactctggggactgtggtggggtggggggaggcgggagggatagaattgggagatatacctaatgctagatgacgagttagtgggtgcagtgcaccagcatggcacatgtatacatatgtaactaacctgcacaatgtgcacatgtaccctaaaacttaaagtataataaaataaataaataaataaattaaaaaaaaagaacttcggagaatagccttaacctgtgctttggaacagacaaagtattgagagatggagtgaggaggggaaggtaagagagatttgaggctatttctttagttgtatgtcaaagtgccatattttggggtaccatttcctgagttccagcattggatatagaatgctagattgatagtgttttactttcagtatttttggatttccttttttttttttttttctgatgagtagtttgttgtcattcttgttgttcacatgttacattcaacaactgagatggctttgaataggttggtggctttaatacatctaacaggaagatcttttcttgctattcatccggcacataacttccggcattgataagtgattgattgactttgatccactggtgaacttggggaggggctgattgtagctttgtttagattcaatctgcctctactgttaatgctttctaggtgaccttaagctgctagcaccaggaagtccctgggaccatgcattgaaaacttccagatctcagaactgtgagaccttggatctgcttgaccatgagcctctaagactatgaaactgcaaatgatatggctctgggatagtaggactttgagactgtgagattgcaatactaaggctgcctcttctcagaatgagagtccaagattccttctcattggagcacaccatacattagtcacgggattaactcctataaagcattgccaggtcatgaaacaaatctttaatctggagcatgcgatcaaattttaaacattgttttaagatgtgtgtatgtgtgtgtgcgtgtgtgtgtgtgtgtgtgatattcaatctacaaattatgccaaactcagaaggggcagccagtcatttgaaggtggataagtttctactgcacatttggattagataaataatgctacagacctacggactcacatgcctggggaggtgggatatggtgcacacaatcagtagggaattgagagtgctgaagagaaggttccacagttaggctgtagaaaaacatgacacacttttactctacccaaaacagtaagaaaccaccagaacccatctcccttccttccctcatacatatcaaagtggtatggacgcaaggacattttaaaagaactaaactccacagggaggcgtcctttccaggtgagcagggaaggaggacagcttcatacctgtgccagatgctagtgctgggagcaggggatgtggaagagcatttctgtcaaataaagccattctccatctggataaagagaaaatgttcaaagtttgacaaacctgggagctgaaatgttgaatttgaacctcaagaaattcctcaccactaagtcattcttttatatgagagttttgctgcagaaggggctgcaaaatagaaagtgagccaattccttctttataagccactttgtgatacatgatagtaattacatcaatcgcctaatttcagagctattagctagcgggtgttttgtgcgtagtagaaatgtcaaagattatgcaagataacctaaatccacaggtgctattaaaatataatcaaggttaaggttaaggtctttgaaaatggatttcattaaatagacaaaattatcttacttggttttcactttggtcatctgcgaaagcaatggatcttcttttcattggttgacattgattgcacaccagcaagtaggttttatctatgaatattagaaggtgaaaagaagaacgttgatgattcataatgaagcaagcaaatcggtatgctagctgacatcccatcttaaagatgaggtatgattgggatgatgaaaacgttctggggaaggatggtggtgatggttatacgacaacgtgaatatgcttaatgccctgaattatttactttaaattggttataatgatacattttttgctacgtatatttactccaattaaaaaaatatattaggtgtgagcctttggatttcatcttcagcaaaaaaaaccccccaataattttcagggaaaatgaatgagcccaatgctcagagtatttttaataattcttttttggcattgaataggattagagataaagatcatctggattctaggtgtggtgtttaatttttagtttttttttctctctaatatgagttgtaatcttccctaattaattacatttcagggaggggattgaagacaattgtttctctttggtgggttcagtttccaagtagataaaagaacttcagagaatagccttaacctgtgctttggaacaaagtattgagagttggagtgaggaggggaaggtaagagagaattgaggctacttctttagttgtatgtcaaagtgtcatgttttggggtatcattttctgagttccagcgttggatatagaatgctgggttgatagcattttactttcagcattttggatttcctcttttttttttttctgatgagtagttcgttgtcattcttattgttcacatgtcattcatgttgttcacatccaaataaaggctatgaagtacaatattagtagaccacatagcttttgtgctgtgtattcttttgcttaaacttcacaaggaaatatgtaaaagaacaagatataaatctgagttgcattgtctccctcctgtaacaacaatgaaattgttgaagagtagaaagctgtagaaatttcagactaattactagccaattgggtgatttggagatttttttccttccctttttctctttctaggcttctttttttaaaaaatctgtaaaatggtgataatgataatggaaagtgcttagcatagtgactggcctcaattaatggtaacaattacttcaataaaatcctttccttctaaaagcagattgtcagttatcttccattcctcagtgagtatggacattaggaacatgggaatttcattgtattgttacctttgtaaagcttttaggtgtcatgcctcaggacttgctagaattgctttattcataaaatgtttaagagggatttctttttttttttttttttttttgacagagtctccctctgtcgcccaggctggagtgcagtggtatgatcttggctcactgcaacctccgcctcctgggttcaagtgattatcctgcctcagtctctcgggtagctgggattacaggcacacaccaccatgcccagctaatttttttgtatttttagtagagacagtgtttcaccatgctagccagtctggtctcagactcctgacctcatgacccgcttgcctcagcctcccaaagtgctgggattacaggagtgagccacttcacacagcctaaaagggatttcttaaagaataatgtgaagtatttctgaaaacaaacaaacatgatgcaggattttcacccaagtcatatttcaattgaaatacgtgagaaattaggtatgttctcagtacgagttcgtggagtaacaaatatggttttccactgaaattccatgatagcacagacctcactgcctctcctttcttctctgcagacctttgcaggaaacatgaatgctgacagcgtggtgcaccacaagctattgcactcagtgagagcccgatttgttcgctttgtgcccctggaatggaatcccagtgggaagattggcatgagagtcgaggtctacggatgttcctatagtaagtactcacatgtaccctttaccattgctgagtgtgagtggcaccgcctacgtaacatcagtttatctacattgagattgacaatcatcttattttaaagttgtttctagactttcatatgcatatttaaaaatgttcaattcaatcccaaagtagaaaaaacattctacttaggactgtaggaatgtagttgtgatggtgtgataaaggctcaatgaaacattcaaaattaataactcttggggaatcaagtaaccatttgtcctttgcagttaaacaaaattgagtttaattcttccccggaagtggcattaggtattataaagtcttctctgccctgctttcccagagctatgagagaaaagcattcaccttcttgacttgttctagaagacgaggagaaagaacaactaaatgtaattcacaaaatgctttctccttgaaatgatctccttcattcattcatctgtgaattgtttgtattaaatttgaaattagagttctatcttgcacataaagattataaagatgggtagaactagtgatcactctagaataaggttaaaattattcagggaagattcccatccctataattctttcctgcgcgctttatactgaaacctgaaattgcatcataataaatagtttttctgccgtaagcagtgacatattctgcttatatgctaaaattcaatgacccctaatgcataaacacatttgatcactaacactttcatccaaactagttcagtagattcctgttttgggctgtaggaattcttaatgagtacatgtctgtactgttttccatagtgagatcaactgaatgcctgtatcagaatcaataggagtgttgcctagaaaatgcatttccctcaccccatcccatacatactggattataatttctgaaaatggaaatccaaaagcggaatgtttacaaattctccaagtaaactatggatatagagtgtctgctaaaaataaagccctgcacacagggaatttactggtaaaatgactgtatttatcttgaacaagcactttcagaaagaatatggtttagaacagatgcatcaacaaaccattaggcccaggaggaactgccttccactccaaactttgtatgataaagcacagaacacctacaagggtatatgtgtcctatcctgggatgtctggggcatcaagctcctcttgtcacctcctgtttgataacaatttgtcactgctaggttattttaaaatacagtatgggccgggcgcggtggctcacgcctgtaatcccagcactttgggaggccgaggcgggtggatcacgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgccgtccggcctgggcgacagagcgagactccttctcaaaaaaaaaaaaaaaaaaaaaaacagtatgaagcttttatgctacaattaaaagtttgttaatattattatgccagccatctattttgatctaagaatcttattactctttaacatgtccttatccttttgctttttctcagtctgttcagttgtacttatttttcatgccaattgttcacccacagtgtctacttgcacagaaagagtcacagcatcgagttaaatcacaggctgcagggttgaaagatgtctttgagcagcatgtttagcatcttctggtgatgaaccccttggagaatctgataaggaacactctatccagaaaaataataacgataacatgtatcttttctacagtatgagaaggttcagaggtctgctaaagcccagttctaagccaaggaaagaactcctgactttgtgataacagagtctacctttttccatgtaggctccaggtctagtgcatcttccaatgggataaactgccttcaggtcaacctcaccaataatgggaagttaacaaccttggggagttgtcggacacagaatgtctttatgatgtgcctcaagcaggaaccctataatcttcaatcactagtgctgatgctttggtacttttttttatttgggggaaataatttaaaaaacgaatacatttctcagtttgtatctaaaaccaatgggttagcatgccttctgaacctaattctccctttcagcattatcatgttttttatttgactggattggttttctttctttctttctttctttctttctttctttctttctttctttctttctttctttccttttctctctctctctttctttctttctttctttttttttttttttttttttgagatggagcctcgctctcttgcccaggctggagtgcatggcatgatctcagctcactgcaacctccgcctcctgagttcaagtgattctgctgcctcaccctcctaagtagctgggattacaggcgtgcaccaccatgtctggctaattttcgtatctttagtagagatggagtttcaccatgttggccaggctggtctcgaactcctgacctcgtgatacacccagctcggcctcccaaagtgctgggattacaggggtgagctactgtgcccaagtttgactcgattgtttctataaacctaaaatcttactgtaagcaccaccaaacaaaacagcaaaagctcatggccctctttagcaactacctctccttttcctcctctctcctgttcacagaatggcttctctctaaaacttctctttagttgctctccccacctgcttacctcccttcacactgcaactgattccaatcactattgagacatttgatgggcagtttaacatgtcaacttggcctttttatagtcccctgttacccaaccaaacactaatatagttactgctgtgatatgtttggtgtctacaatcatttgactttaagtaaaggagattatcctaagtaatctgaatggacctaattcagtcagttgaaatgcttcaagagcagaacagaaatttccctgagagagacgaaaattcacctgtggactacagtttcagatccttcctgagagtttccagcttccccttcttgatggcccgccctatgtacttcaggcacgtttaaccagacccacaattgtataagccaattccttgcaattagtctcttaatatatataagtatctactggttctgtttctctagggaaactctgactaatacagaatgttctagagaaactacttttctcaagatcaccagtgatttccaagaagcccaattcagtggacacttaatgtttcttaattcacttaagctctcagcagtacttgattcaaaaagctatgtccatatttttaaaacctcgtttttcctcctatctcacttgctaattggctatctcagtttgctaattggctatctcagttcttctactacttttccatctacactgcatgctttgctgaattgacagagttttgtaaacttaaacacatctacatgctggtcaccccacatctgtatctcatggcctgacctcagagatgatgtatgcagcagcctacttgatatttccacttaaagtatagtagatatattaaatagaatatagcaaaatggaactctagattagtggtgccctcagcaacctgctcttctctaacactcctccccatctcagtaaacagcagcactctccatccacttgtctatgcaaaactctgggaagcagcctttgttcttccttctctataacttcaagtcctgcgcaacttatctacagctcacagtaactctatcagttgcttcctccaacaggtatcttaaatccatgtacttctcccacttttgtgagtagaagcctctgtcagttcttacctggagttgttaagtagcctcctgtctggagttcctgcttccacactacactcaccccaaaaccatcttttacacggtcaccaaaatgttctttataaagaaggaatgaaagcatagcattccccttcttgattcatgtgaaataaaattgagatttcttactggcaagtaaaagtccttgttgaacaattgttcccagaatttacagggttgactccttctgccaatgtgattcttaattataatgtcacctcctcagagaagtccccccgactgttcctctaaagtcacctgccttccttcttgtacacccaccattagcccatgattatatgcccatggatatgtgatgtgctgtcatttactttgtggtgtcggccacaacccagaatctcactggctgggtttgcttacttctttcctgtttacctactctagtacctgcacaggaaaaagtaccatgagaccaggcaccttgtctactaacagccagcacttaattggcacaaaaagacagtcagtaagtatttgttgaatgggtacatagatatatcaatccagcctcattctctcagcataggcaacaaggttcatctggaattacttgattttcataatctgttgtagtttctaaggaattacttttgtttctatgggcttaataatttttccaaaagtttagttgagtatgttgctaaagattggtagaattcttacagctctatagtttcttcagacttaactctctacattttggaaatattaacatatttcttccactaatttattcattcagtagataccatttatttagcctttaagataccaggcatcttgcaacactctaggaacatcagaaaataagacctttttctagactttatcagtcttgtatttgtactttgaagcacttttcttgtgattacatgtcatcagttaactgcgtgattgtctaacatctgcttcccctgactcgacaagatagttttgcacagtgccctggattgtcaacattgccaaatgttggaatctgaaattctcttggagataacacatcctaatgaatcttctaatacccagatactttttttattcacaaaatcaaagttagcaacctacgattcctgagcatatgcagctccacgtacaaagtttagctgttgactgggccaagagcttctgggcttgcatgcttccaatcctctatcccttgcctgtgttctcagacctagttctacctgagaatcaccttgggacatatatgcttttaacatacctactctggctgcacttcaattagatcatgatctctgggtagggtctccagtgcttgtataagcattttgttgttgttggttctaggcaagcgtgatgaggaaccagaatttaaagctgttatctcaaacatcacttcattcttagtctgcactatcatttccgtgtctgtgattgctaatcctaaggattttaaatgaaatctgaaaacttgagaagtcagtataatgttaaatatatgggctctgaattcaaaccaacagacatagaaacttgacttcaccacctactagttgggtaatcttgggcaatcttgggtcctctgtggacaccagtttccttttctatgaaaagaaaggtaatactagtgttgcttcaaccaagtaattgtatgaaacagtgctttgcataatgtaagcacccaaaaagtgttagttacaagcatcgttaccttcgtcagatatttaggctgctcaccaaacttccctatatttttttttcccactcttactcaggaccacatctcatctgtatgtccaaggaaggtcagcttttttatataccaggtatccaaggatttcagcaccttcgtcaggccatctggagtctaggctacctgaagttctgtctgggggcttccatttgaatttctttaaatatgggaagctaattaactttatttatttatttattttttgtattttttagtagagacggggtttcaccgtggtctcgatctcctgacctcgtgatccgcccgcctcagcctgccaaagtgctgggattacaggcatgagccactgcgcccggctaattaacttttttttttttttttttttttttttttttgagacggagtctcgctctgtcgcccaggctggagtgcagtggcgcaatcgcggctcactgcaagctccgcctcccaggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcccggctaattaactttaaaaaacattataaattctgataaagttaatgatctgtcaggcctcccagtctcattatgaattacaaacatcattttgtacttcaggtcgcctctgttccacacaagaccttgctcctatttggttaattactcgcaagtggtatcatccaaaattcatcactctcagagctgaagtcatattctccttcctcagataaatactcttgtaattccagcttcagctgccctctttgttgctgttctcatcatctgggatcatttgtcatacatggtagaggccacacagttgtaaatctcacctctgacatgctaaggcccatacagccctatcacagggaacttcagaaggcacagtttacagctctgtcagccctccaagtggggagggacaggatgacagcagtcagacctggggcattggcagtccaatgtgaactttgattcccactttgtaaatcatagcatttttaagagttggaaaaatctccaagatgccagattcattgcagtcccctcattagatttgagaataaatgaaatttcctacccttctttctcatagttcctataggaatgactgaaaaatctcttctatgaagagacaaatgtacacacatacatggaataacaacactaaaataaaagacactgtgatcttccatcttaaatcaatgacttctttataacttttctgactggttgaggatctgaaggctccttcaacagtcaacaaacattacccagtaggctccctctgctaggcttcagagatacaaaaataaataagacaatccttgccctttaggaactcacagattttcagaagctacaaaaggtagataaacaaatgctcataaatatggaggtttaggaaaccaagtctttggcaaggcttgcaaaggagaaaaaaaatacacagctaacactgtttcctgatgaattaatgccctgctgcccagtatgtgatttgactggcgatattgctattattcctgtgacccatatgctaatggcagtgattttaaaggaaacctgaaaagggaaaaatgaccaagtagttggatcaaccactttatgcaacagtacgtttccacaaaaatgccaaggccttgcctcctacaatttgttttgcatttactccctgttgaagtggtcactggagtgattgaccgtgactcccctctgcctcctagcactaagtggcttagtctgtgcccaggtagaatccttaacaaagactgttcaccttcccttaaacataaaaccatactaaatctttttattaaaaaaacaggtcaactaccgtaagggagaaaaataataactatcgtctctaattttgacattgctatttaaatgactctcattgtatgaacatccttttagtgggcaattgtgtcaacactgtggcttaagactactgatgacggtagaagtcaggaagcagcttgtcattgcaggatgctgctgccacaacacgggttgatcattcctttccttctgtgagtttgtggctaagatttctgaaacctcatccccatagtgaaaccttttgctaacctgtctataccttagtggagtgatcactatcttctcactgcccaccatgcacctcttacttaggtgaccatatgtcccagcttgctccttagagttctattccatttcattatttatagctccccttttcaatcccacaagtcctcattagggtaataagttgtagggatcaccataatgcttccctgtaccgcatcttacagtggcatagtgatgcatttgctatgtcgctgttagggtgttcgagttcctcggtggcatggctcacgtctttgttatctttgtatctcagagctcagtacagtgaccagaaggagtacagaatatgcttaatacctgccaatgaatttaggagtaatgaataaaatgatacctactatggaagttccctaaaatgagtacattatttttgtgtaatctttgtcattattcaacagtccagttgaactacaaattttaagtgcaccccgaaagacatctatgcatctgaaatatctaaaaacaaaacaaaacaaaaaaaaacctaagcattatgagaaggcgagtcttactgttagagctagaatgtatttctgctgaggttacgactggaattcagagttttgatttttttttgtactatgattgttttcatgttttcttcttgaaacgcatcctgttttttcatgtgctatcatgcataggaatgtcagaaattttgaaagaaaagctatgttaggagttgtcacagttagctttggaaactttcctcattttcatagttcatctgaggtaatcagagttactgataaggcctggcagtcacagaattggtggaggaatctgtgcaaatttgagctgctgtggaaaccctggtggtttgtggattgctagccaaagcccttgagtcttcagtgcaagagtatggtctgaataataatcatttttcttatataatgtatcatgacataagcttcaaaatgtaattgtattgaaaatcatgtttactgtgaacaactgaagagtccaagtgggactgattgtctcagggtgaatcgatagcttctcctgtcaatgttgagcttcggctttctggcccgtgaggaagctgactctttgtccctggcccactcaggagcccagctggcccacttggggattcaagcttggaatcttctattcagtgaagccctttttttagctggtttgttgacaagctaccaacatccatcaaatatgccagcatatgcctccagaactctgtctttctcagaaaacaagctgtggcagccaggtcagcaattatgggcccagtgggaagtcggccagtgctggcattctcagtactccaggatgggggagcgcatgctggctctgtcttgacccaaaaggagaggttgtgcactgtagagcctgccttcattctaaggactctggagcatgattggcctctccttcatattctagagaagactgccaatgtatcagcatcttaacaaaccacgaattgaattgaattaagtttgtaataatgggttcttaaaaatcgattttgaaaaaaggggaagaaattgttcactccaggaagtaaatatctaacagctgtgttctgggtcactggcatggcagataaaatagagaactctgaggaacagataacaggtattaatatgaaggaaaacattccacaacgaccacattagggttttactaccttggcaaggcacaataaaattgggtaacgggggtaggtagccaggattatgcaggctgaccatgcaagtaatctgatgcattttctaaaacacaaagagctctttctaaaaacccaaaccaatcatacattttccctactttaaatgatttagtagttatttctccattgatatcagggtcacattgaaacccatattattttattttgtttttttattattatttatttatttattttgagacagagtttccctctgtcacccaggctagagtgcagtgacacaatcttggctcactccaaactctgcctcccgggttcaagcaattctcctgcctcagcctcccgagtagctgggattacaggtgcccacaaggacgcccggctaatttttgtatttttagtagagacggggtttcacaatgctggtcaggctggtttcaaactcctgacctcaggtgatctgcctgcctcagcctcccaaagtgttgggattacaggtgtgagccaccgtgcccggccaaacccatattattttatttttaatttgactctccatcatgagacttcctactctagttccgacctgttgaatccccactgcccttggcaccctacacttgagcacagagctcctcaaacctcatcaagaagagcagctactgagaaggctccttaacacaccacttgctgggtcccacacccaggtttttattccttaggtctgcagtgaggtcttacattctgtatttctaacaagctccttggtgacctcaatgctgctggtccacagggtatggttcccttcagcaagtttgattcctgatagatcctagatgggaccctgcactttgtctctctcctccttgccttgagcttgcagctccttccttctggtgggactgcccttcccacttccactccctccttctattctcctattcccaccacacccccacctcaccagcctgactgcctcttatgtctcaggactctggagaaacattgaccctgcctggacaccctcctaaccctctgcccctccctggagagggttcagcgctccctcagcacacagtgctcacctccttccaatggatgtagaattgcgtgcttgctctctccagcttagtcctcgagagcagggacctctgtagagcttgaacacaagaatgcatgagtgaaggaaaaccacaaaaataaaaaaggatagagggtttgagctttgggaagatggtggggatagagagggcattgtacctctaccataacaaagcctcccacatgtgtacatggtttccctgctctcccagaaagggagcaagtgaaagagcaagtgaagaagagcagggaacccagggaaattcagagcaacatttaaggaaaagaaaacttcttatttaacatcatccttcccttctttaaatcagcaatcagcatttttttttttttgagctttggttttcctactttacaaatggggaaaaatatggacctttcagggctactaagaacattaccttaggtaatgtgtgtatattagttccttttccccctgggaaatggattcagagaaagaaatctccacaagtgtgttagagaagttgtgatagagaatatgggagatatattcagttttatgtttttggtacctttaaatctgaagtgatcacacatttcccatctgccataaagagcccatgtctaccctttttactcctttctacacactttctttttttccttttaaaagagaatctgccaagatgcttgtacaacacaaataaagattttgatttctataaccagaccccatgcagcaaattaagttccaaagagatatccagaaaaagtcgttatgatactacctcatgaggaaaaagcagcatataatagtttatctcttattaacagcaacctataaccatgtgggtctttattattatcattttaaatctgcttttccaagtgaagttgggagtgctgagtattcttcttgaaactcatcctgttttttttcatgtgctatcatgcataggaatatcagaaattttaaaagaaaagctatgttaggagttgtcacagttagctttggaagctgattctaagttaatgtacatgctaaatcctaaagaaagtgttgaaaaaaatcaagcaatagtataaaaagcattaactatattaaataaaatagtacattataaaatactcaatactagtgtctgggaaggagtaggaagtattcagttggggaaacctttaatccttctttgaaagttttgaaaacccttttctctctctgggaaatggctggagcctgttgtgtgcaatgtaattaatattgcagaagtgcagagtgtttggctgaaatctctgagaacagcaaagtgtagctcttatcaggtactggtggtggtcggaggaaagctcccgcaccccaccaggctagttctgtgcttactaaaggccgtgcatcctctctgcaccaataagcatgtgtgagtcacacagggatcacagctccagtggctgagcatggcctgcagaagaaactaactctcccagtgtggatggtaagctggctctgaatggtgaaatagatgatgcgcaggaactcaggggagacttgggcaacatcacacttgggcataggcacctcaatggatcacagctcatttcacaggtggttctggatggcatacccttccgagtccattgcgaggctctgaattaatgtggcaaacagcgtacatctggcccttgtcctcatgagatgcattgacgtgttggacaactggactataaaccactgagaaaacagatgagcatctaatccaattgcgaggtgcattatgaagggaatggcaaggtgcttagagggagactaacagggatggaggaccccttagaaaaagggccaggtgggaaccgacagatgagctgagcatcgtggtccaagtgggcagcgcatgggaaagagctcagtggactcagcgtgggtgggtcagacagggtaggtttgaatcctggccctggcacttgctcactatatacctctttgtctctttgtgccgtgtttgtcttatttgtaaagggggaataataatagtattttcctcaaaggttaattgatgtgtttaaatgagttcctgtgcaaaaaaacatctagagaattgcagggcttatgatgtgggctccacacacattatcctagccccacacatacatgcatatgcacatacactaaaatcacagcatgcctggagcagtgtgagggttgaagaaaggaacagaagatgaggtgggagaggtgaacagagcaggatcatgtggagtcctggagactgaaattaattatcagggcaaaggaagttcaatgaaatactttagcaatgctgaggtatgatgtttcttatgctttttaacgttaaaaactgtgtcaggtgaaggtggcaaaagtgaaatctgggaggcagttctgaaactattaatagaaaacggaaagcaggcaatgatgatgaggacatgagtgcacgcctactcagtgtgatgtgaaggctaccgaatcccaaacccagacagaattttttcacaccaagttcttgatagcatctttatgctgtgcttgaaaatcttcactactgagtactttctttctataaataaggaaatgtggggataaaatgttgttgaatgcctttgtattttcaggtctgagattgtgcaattttcacaatgactttgaaggtaggttcctataagccccatcatacagataggagaactggagctcaaagaaatcaagaaagttgcttcaaccaacacctgcccccaggtagtaaggagtaaaaccagaactgaaacccagctctgttagactcgttctactgattggcttagttttctctaggtctcatgacaacgtggagatgtgttttcttaagagataacctatgtccctttgccatcaacatttgtatcctcagttaagtcactagactagccagacattggagggaatggaatgcagatcatagtaacgatgatgaatggagagggaggtgagtgagtgagtggactggagaaaagaaaacatttggaattcagtacttgacccaagaactcaggcctgcatgaggggtccaggcagccaagtacactggagtatgacattataaaatgaagaggaatgggggaaatagcagcaacataatgaatatttatatttacataaatttctccataaccattgcttggacaaaaaagtgtcaaagatatatatatatatatatataaaatttctttatataaatattatatataatttctttatataaacattatatataatttctttatataaacattatatataatttctttatataaacattatatataatttctttatataaacattatatataatttctttatataaatataaataaattttaataaataaaatttaataaataaatattatatgtaatatttatttatataaatattaatccaaattctctcactgctttcttataatcagttgtaagtgtaattgaatacattgttatgcaccattttacaaggatggaaagtgaggcccttagttttgacataaacttaaccccagtcagacacctggtgagtagtagagctgctctatagagggctcctctccttagtttaatgtctttaccagggaaccaaaggcaaatttcctccatgtggttttagttcaccacacaagggaccccacctgccatgttcaggctctgtgctcagtgctggtgctggctgggagatgaagagtatagtggtggtatgagtgagtggacaggatgtatataatttgtggatggtgattctcacatggcatgtgatagcaaaaacagaggggtgtacccagtgctagggaaacccaaagttcagatgcaatatctgtctatgggggtgggacaaatgcatccatgaataatgatggaattgagttactgcttcaaagacaccatgtgtggtatgtctcagcttgcaagaaatgcctcactgggaactagagatctttctgtcccttctccatcatgctggcctcctgcagtactgagatgcaccaaacattctcacgcctctgttatccctcctggagacactgggtccctcctttccctggggtaactcctacatattgttaaaggccaatataccactcactttctctaagaaaccctgtctgaatctaccccctttgaactgagtcagttcagttagcattactgtgagtattaatgtctgcatttgccattagaaactctatgggacactatgtggtccttccactcactgctgggcactacaggggctacctaggacacaatttctactccacagtctggtacagtggcagagtagaagcaatcagaagagaatattaatattgtgtacattgtgatgtacgcactctgcacacactaatttcagctagaatgtgagaagccaaaacatgacagaaaaagaagcttggggctactttggcatccctgggcagtaaacaactgaatcaaaattgaaaaagcatcatttggggtaagaaggtagagtgccaaccaatagagtggccttgataggaactaaaagattcctgttatttcaattactactaatacctctcctatctattattgatttaacacaaataatgtgccatgcacaatgagttcacattgatgtgtcataactttgtaagtcttagcacatgtacttctcaaagcagttttctctaatggatataattatcttcatcctataaataatacaatcaccttagaccaaggtaacccaactaacaaactatgaccatcacagtttagaatccattatgttatctataccacagtcctcactattccatgagtggtggcagctgttggtctgtggccccactttggtctgggtggaatcctagttgagataacagtcataagtgcattgatgaggtagggaggggaggtgctgagaaaggtggacatttgtgaaagtctctttgtatatggacagtttatttttaaagtcaaggtttccatcagcaacattttggttaggacactttgttccgtataaataaattgtgaaattgggttttaaaactaattacagaaaagtattatttcattttccttttcatttcagatcctcagattcacaaagagtgtttctagatccttggaaaaaaaattatcattgtgtatgctcaggctgaggattttaattacatgctgaataatacaaaaattgagttttcttgggtactcaattttaaatagaaaatcccaccccctccacataatcaccacaatcccacccacagaacatggtatataatgaatcagtttcaatttgtaattaaacagtcttacatgtttttctacaataaaagctcattataaaagtttttgtaattaaaaaaatagaaaaaaaaacccgcaaaaataacctagaacaacacattccaaatagaatctctattagatttttggcataatttgtcagatatgtttacacatacctgttacataagtttatctaaatcatggttacttgaccttcaccttgttttgctttgacaataaggaattaaatgttttgtataaaaacactaaaatgataaatatcaccagcacagataaggcagtgatacatttgccctctttgttcaaataacaagtcttcttttgctgagtatttttttccactgaacccagtagaagcctcagaatccttctcaacacagacttctagggagacagtactatgtggagttggcatcataattatatctatttttcatctctaatgttgtgtctgagataaggagatcaagtggttctgactgtcaggaagacaaatcaagagagattattctaagccatctgacatagtaagccagacataggtacttgcggtattttcaccctgtcccctccagcaaaagctgacatatcactaatgagagtttttacttctaaactaatgatcagttcactttgactcagtgtgtggtgattgcttgtaaacgaataattcccttgagtctaattagggtggttctagtctacatgtttcctgttgagactagacctggcagatctcaagaacatttctgtgaactggacatgaaataagatgggaaacagtaacagcagtcatgagaatatgcactaatttttctttcccgctccttctttgttcccagaatcagatgttgctgactttgatggccgaagctcacttctgtacaggttcaatcagaagttgatgagtactctcaaagatgtgatctccctgaagttcaagagcatgcaaggagatggggtcctgttccatggagaaggtcagcgtggagaccacatcaccttggaactccagaaggggaggctcgccctacacctcaatttgggtaggctcagacttcctcttccaatgccaagggatggagagctcctttactccacagctcacagtgtctgacacttgcagtgtatctggtggaagtcactggagcacaatataagtgatattggtggggatagaaatgtttaaggcatgtatagcattctttgacaccatataatattgacatgtagggagagttgcaaactcattgttatgtatttattgacctaactacgtatttatccatttagttttcttagtaactcaaactctaaaaaaactttcacaagtttaagtatatacacatattataaggaggcttgctcagaatctatgctattaggtacatataagaaagttaagtttcagagggaaaatgacggggaaacattttggttgctccgggttattttgttggggaagaggggatcatatgtgtgaggtgaaaaatctaagtttctaggcattcccatgtctttttaagggaaactcttttctttaggtgccctcactgttccagagtaagccccagactcaccagattccattaaacttagtacagaatgccctcctgactccacacagttaggacatggccttccactgtgggctggcatccatcagggcctgttgcactccaggcaggtcgcgttcattgtcaccaacttcttatcccagagaaggaggagagaggcccagcctcctgtacatgatcaaaggcacttctgaaggaagggtaagctgagtacaaaaggcaggagcacagttcccaaggatgcaaacaaaaaaacactcttctatagaaaaaagaaagaaagaaagagataagctgaaaaaaaaagtaaatggccgtttttcataagaatgactccctgcctcccatctgatatttactaatattaaagggagaggaaaatagttatctttttgtcttcactataaaatagtaaagaaggaaagaaattgcaaaatgtaatttgtaaccctaagttgcatggaagactgacaaaaatccacagttaaatacattttagcaattagctggagagacataaggatgaatattagtgccccaaaactaaacaatataggtttttattttgaggcatttctgaggatcttcttggagccccatggtgactataggcagcggtagcagaaagaatctctagatttcaaagtttaactcaaaattgacacctaatatattagatatacacaccaaaatacctttaaaagtagaatatcacctagaagagagtggtaaaaaaatttgctggtaacctcattggttgtaattaccataactaaagaagcaagcctcagagctttctgaatgttgggcgtccaaatactacacaaacatgcatcaatacatttactggttttcagttttccagaaaggagatcagatgaatgaagttgaacctcccagttacaagtggcttacatagcattgtgtgttgggggtacagttactattacttatcaatagtaaagcgagtgtcttctactgataacattgtgaaatatttcagttactactatttagattcccatttcagatatggcatttcacatccaaaactctgctccaacatacaaaatctaatgttgtaaaccagatacattcatggtgtgaatggtagaaatagcataggtgtggtcatgtaacaatttttcttttgattacagatgtgcaatcaaattgtgttttttattttatttattatgtgatttattatggtggatgtcttctgagcctcagtttctttatttctaatctggggctaatgacttgtcttgcagagtatggacatgaaaaccaagagcactgtaaatacattttctatagcaatgagtaaacatggacaaatgccaaaaaatagaagctccgtattgctcatttattcaaacagtatctgaatacctcacactgtgctatgctggcttttctgaaaataagtggaatattaagataaatagcacctactccttgctatgttacatagatggcaggataagtctttcttcccagtttccatcttctctatatttccaaccatggtggtgattaagtaaaaccttacttgatggaggattaagtagtaagaacatattttatctatattctgcatagttttaagatttcttcatcttttttatctgtctctgcagcttttccctttctatcagtttaccacagttgagtgttttctgtacttacctgttttaagcagtcacctaggatacttcttaaatagcataagtttctaggttcctcttctagagaaacactgccacagattagtactttagtccctcctacctcattacagctagaagatctctggaagcactaagcaaaggggagtggtaatagctttgctttgcccataatgggaaatctataatgtaggtttcataaacaccaggataacaccttgttcacttctgtatctctagcctccaggagaaactcttcctaaagtaggtacttgaggcagattgagtacattaggaacagggttttcatctcaaatttcattattcctgttgggcttgttcaccttcaagcctgcactcctgactcctccatgatccaccactctctctgacaatggggtatatttacagaatattcacagtgtggtaatgtccagtccgatcctcaaggaagacctatggcataagtatacattagcccccatttacagatatgaaatagtagactcaaagaggataaattacttgtcccatttatacagatagtgattagtgtagctactattaccatctccaggtgttttactattaattttagattataaaatatatatcagttttagaaaaccggaaaataatataaaaaaaagaaaaatccaactcttacaacctggttatctcttttattaacattttagtatcttttaagtatttatcttagttatttatatgaattctttaaatattattctaaaatactgttgttttcctgttgtcacacagccttaaaggggaaagggtttataacatccatgatcaggattgttcttttaaaaaaatgaatcagaaaagcaagagaaatacaggagaggtgagagagacagagagaaagagaggcaggattcaagttaatgggttaaagaatagtgctggtcaaataaaggagagagttttggtttttccctctccagtttatatggacatttcagcagtgtctcctttagtgacaattcttcatctgcaatgtttattcattttctaatcagttacttgcaattcagaaattcaggctaagagtgaagaagttcagcaccacggtcagctgctcaggatggcactggggacatacatagtgtactgttgttcttctctagtgatgctctttgatgagtatccaatttacattacatagttaccctaacccttactgtgtctggcttgggtagagacagttctatggcaaaattgaactatgtggttcctctttgcctactttcttaaagtagaacattgatatttttccagaactactagatgggaaagagatttcttctttcaatccataaggggttagatatgtttcctttctcactttttacacatctcattcaaattgcccatggcagtctgccctctgccgaattacaatagtctgaacccattcatgcaggtagagaatcaaagagcagagatattacgtgacaagagaactgttgtaagaataaagaagacaacaatagtacatgcaggtcaatcatccttataagagcccagtgccttttaactgaggcaggatgtttatgcaatccccaatacatacagctgtagcaaagtgagactcaagtgagactcctagaatagaacaaacatctgaggagcacctgggggccgagtacagggttcaggcgccaaagcatgtgattgcataatcaaccactgagatgccagagaaagttctttccattctccaaagagtcaaatgaacatttaatttagctcttttgaaactcaggcattttagtcagccaactcacacatatttatggaatgtttatcatgtttctcaaattgtactaaatactataaaagtttttttttagttgccattttttgagagcccacatttaggcattgcattaaacatttaaaatacatattttatttaaattacatgacaatcctacaatctgtatccaaacccatttacagatgaagaactgctggtcagtgattcccagtcagtggctcaaggtcacatagctgcaaagctgtagatatgggattataaccttattcaatcctaccccaattctctgacattaatcactaaaatgtaataaacttttataaaacaaataataaaaattataaaacaattcataaaaatgttaaatatcaggcaaacaatatgtatgtgttaagttctgagaatggagagatcaggaaggaacagagggatccaggatcaaccttgagtaatctggagattttattatggagaggggagaaaaacaggtatttcatacaaagaatcaatgggataaaatgcatcacatttttcataaattctgtcattatgcaataagaataggttaaacaagtacagtaaatcaggcactgaattctgcactgggggttaaaagttggatttatcagtctctattttcaagaggctgtcagcctggtaaaatagttatttctacttactttttagcttggttatattaattggaaataaaataactatgcatcatcaaaatcatataacaaatgtattaagataatgttttcgaagatagcaaagtcacagaagacggacacaagttagacaccagagtagagcaacaactcctaaatctggagagtgtttttagtcaatacaatctagaaatttcttaacagctaaggacatgtgtttcattgctttagagaaacatagagacttgctctggattgagagtcaagtccattgaatcacattgcttcctgtccgtttcttattttcttcagggctctcacttggatacttaggagaccattcaatagctttgcgtattgcccaacaaagttgaaagggggtacctttacaatactggctgggacagggaggtaaaacttttcttcttattctgtgtcatgtcctcccttcttagtgttgccccattttacttttctacagctccctgttttccaatccattaaattcctttgcaaaagaatgccctccattcctactaagctacataacttacatgcatatatgggagatacagatagtaagagcgtaagaaatgagggagaatgagagtatccatttttccactaagagtagtgaagacagttttagctttggagtcaaatagagttgggttgtaacccctattctttgagtccttaggtaaatcttgtggcttcttggagactcacctttctgcagggttattatagtcagaaataattataacaacatatgtgaagtgtttaacttgtgtgagaagcttaagaaatacaagtgaatatcggtgttgatagcctgacaaattaaaggtgggtgggaaagttgattctgatgatctgatagaggcagtcatgagggaattcacgtgactagccacctattttatcaagagtaaatcaaacccttttcaagaatgactttttttttgtcaaatacaatcttaaacatgagagttcccatcccctttttctcaggctgtctgaaattcacagattatgaaagttaaagtggcatccatgtttgaacagttaagataagacctagaaagaagatttaatcaaacaaggcatttggttgaaaatactgcaacatgcatgccctttaccagaaaatgtgagttctaagtaaggatgaaagaattggcatgcttatccacagcatcttggggtggagggaggagaataaactggtaaattaaacactttttgcaaacatttcaagcttcctataaaaattgttatatttcttagggccttgggtagtatatatcttattttgttttaactatattttaaaccccatgaaaacaagtttttatttcattagaaataattatttcccttatctatttctgtcccaaaagttagtttctgtatagttttattgtttttgtccttcacaattgcccatgaaaatttttatctttgtcttacgaaattagaaacaagttaaaactagtaattgaacctcaaatgccactgagataaaacttaaaatagatattctaagatcaagagtttgataatttcgtgagaattaagtgttttgtgatctctaataatggaaatttctagggaaaatgaaacatttctgaggaccaccatcctacacttctcataaatacaattctaaacatccttttttaatgaagagcagaaattttgttttcccaattttttaaccaaatcaagtttcactaaacttgttttgatataagatatctgagtgttggtatagcataactaatggaaaaagagtgatgaaatttatccatatgtgctcctttttggttaattaataagtaacttgtaattcccaagagactcaataattacacgtcagtgatatatagtcttcaacaaatatactatgcagcgtgaggattgtgtttttaatgaagtttatttttctcattatccaaaatagttatgctcaccctaaaacacacagaaaagaaaaaaaaaatgattatgataaatgcattcttcagttttatccgcacatagtgcttatttgtgccttttccagaattgtttttagtctagattttgtatttttgtcttctgctcatgtatattttaaatcagtatagtctaattattgagtattctatttattaaatattacttttaattttatcaaaaagggcagtcactactgagtatacttttgaaataatgtaagtattttataaatatcattttgatggctatttaatataatacttcatctggtgagtctacataaatgaactcagatttttttttctccttccaaattattggacattatatccaatttttaaatcactagccacttaaacacttttccacaacaaaaagttgtgaacataagtttaagtcccttgatactaactgaaatgtttctccatagaattggtgggactcaattttgcattatctttgggcatatatatatatatatatatgtactaagtaaatgaacaatgtaaacaaggagcaatgctaatccacttttgaggaaaggtcaacaaattgctttaagtattcataaaaatttcatgagctactttgcataaaatgataagtgtgttaattaagtttatggtttcattagatggagtaagtgaaaggtagtcactatttaagaagaagtacttttattttcctaaagtcttaaaattataaggagaagaattgttggatgcaatgagagtggcaaactttctgagccaaagttaagacccaggagagaaagggctgactttagaccttgaggagggtaaaggtaaagttactgatgctagctctgcttcccgcagtggagatgttcctgcccattgagatggtggtgatgatggtggcagtggatgcaagaagggtacagtgaacaacaaccgacataacctactactagaagctttaggatttgaaggtcccaatcatgtacttagagaaccttgatccagtcaacataacaaataccaccctatccaatttactagcgttctcctgccattttaaagttatacaatctatttcactaaataaggccactcaaggattttaaaatagtggaatttagacaattggtagccatctcaaaacataaaggtagaactgtgcctcataccatacatcagaataaatttcagttgaaagtacttagggaaaactagaagaattcttcaatgatctcagaataaggagaaccttttaaactattatacaaatccagaagctataaaaggaaaatgatagatttgttcccaatacacaaatacctgagtggtgaatttaaaaaaatcaatcaaacaaacaaaaacagaaaagcagcaacaaacacaaataaagaaaggcaaaaagatattttcaaaattcgtatcacaggcaaaatataggaagagagttcaaagaaaaggaaataaaaataaaaagattttcaaccttattcttattaaaagaaatgcatattaaaatttcagaaatgcacttttttaacctaccagacagccaaattttaaagctagaccgtatgttgttggcaagcctgtggtaaaggcactcctaggcatttaaatagtcatggtctttatataggacaatttggcagtatttgcaaaattgccaacatgaaagcctttgtcctccagttctttatctaagaatgaacgctacaaatacgcttgtgcccaagcgagataatatccacataataaagtatctcaacagttttaaagatctaaagtaaatagaaacatctaaatttatatcactaggaagctcattaaatgaaatgtgatatgccctatatatcatatatatgattatatattatttatatataattatgtatcatatgtatatacatcatatgttatatttatatatgtatatatattagagcatggaatactatgcagctataaaaaggatgggaaagctctttgtattctgataaagattttcaggatagatgaaataaaaatggaaagttggagataaatgcacattctattttaccatcagtgtaaaaaattaaatgagtagaaataaagaaaatctatctttgctgcttgcatacacctaatatttttctggaagcacaagcaagacattaatagcggtgattacctggggctatggaagatgagcagatggaggaagtgaggaagggaggcagggagggtgttttactatacccaaagttacataaaaaataaaatcagtttgactgattcataatatttataaaatttatcttttgaagcaggatagggtgattaaaatattttattttaatcattgttattattggctctattaaagaacttagtagttgattaaaggccacaaaaacagcacatagaacaaataagttggggaaagggtgtaattccttgccgtgtgtgtgtgtgtgtgtgtgtgtgtgtgtgtgtgtgtgatgtataatgactttaaattttcaaatgtttaatatttggacttattattaataaatttttgttcaatgcctttcttattttaagaaaaaagtgagatgcagctcaatttcaaagtgaaaactccaatattaaatctacctgccttgttacatctagaaatgacagtttataaagcatagtttccttcagccaatgttagctcctgagtcatttcattttatacataaaaactgtgtgtggggtggcggtggtggtgttctttgttctatctccgtcacctggaggccacctcctgccaacgcctcataattacttggataccattcttcctgtactcttcttgcctgaacccctttatgccccatctatccagattatggccggtcttatagccagtcttaccttctaatccaattcccacacagctgccaaaataacctttcttaaaagtaatctgctggccgggcgcagtggctcacacctgtaatcccagcactttgggaagtcggggcagcagatcacttgaggtcaggagttcaagaccagccgggtcaatgtggtgaaaacccgtttctaccaaaaatataaaaaattagcctcatgtggtggcctgcgcctgtaatcccagctattctagaggctgaggcaggagaatcgcttgaacccaggaggcaggggttgcagtgagcccagatcatgccactgtactcactccagcctgggtgacacaggtagactgcatctcaaaacaaacaaacaaacaaacaagcaaaaaaatacagtaatctgcattagtaacctctgcctactcaaagttccatttcttaaaaaaggtgtaaactgtgtgacctagcctacaaagtcctgcatagtgggatccaggccgacgagctcctggcactcagccgctggaagtcctgggccacgcttccctacatctctaaacctggctgctgcttctcctggccttgcaaccatgctcctccttccctcaggtttcagcctgtccctgctgcataaggagggtttcacagcaccgcactctgcatttccatggccctgtgcactgagtgctggaaacctgcatacattttatagatttatttgatgagcatctctacactaagaccacgaagaccttcagagaggacagtatacctttaaactctatgtctccttaatacattacttgtcactgtgaccagctcaggtggatcacacaaatatctttttttttttttttttttttagatgaagttttgctcttgtggcctggcccaggctggagtgcagtggcgcgatctcagctcactgcaacctccgcctcccaggttcaagcaattctcctgcctgagcctcccaagtagctgggattacaggcgcccatcaccttgcctggctaatttttttttttctgtatttttagtagagatggggtttcaccacactggccagcctggtctcaaactcctgacctcaggtgatccgcctgcctcggcctcccaaagtggtgggattacaggcgtgagccactgtacccggctcataatacctttctataggagaaagaaagggaggtaaggagaaaaaatgaaagtatcttttaattcattagcataatccatcaaacaatgaaaactcagaagttgtggaacaaaccaatgaaatcaagtcagctattaattcatcagctctacttttctaattataatgagtctgatgcttctaaccctatatgaagcaaccaagttactcagtgaaggaaataatgccttgggccataatggaggtgggagtgagcagccttcggggaagtggcagctaccgcctgctgaatgtcacacggttgaacaggctgctgcagctgtactggagaaaacacttcccaagagggaggagacagacatttagctttcagttactaaggaacctaatatataaaatgttacaaaaattgaaaatgtatatatacacaaacgttagttctatttaattgttcattttgctaaggttgacgcaagttcctcaggggaagatataagctgtaatctttttggtagaggggtatagccagggacttccataaaattgagagagaaggaggcggagggggaaccaggcaggttggattgcaaagcatgcctttccagctgcatctctcatgtcttctcaaaggggtcttccaaactcaacagaggctaaatcctcaacagtatgacccgagccatgatccatagctgtggtcaaagtaaaaaggatgaggcaaacctagattcaagttctgaccgtacctgaggcatgcatgtctcacctccctgagcctcagagttcttatttgtccaatggagatgataattttcccttagaggattaaagatgaaagttatttcttcctaagtgccgtgcatacagtaggtactcagccatgacatatgggatgattatttccttgccactgcttttgcccacaaacttactagctgtcttccctttacgtatcccagctttactcctcctcccaggcacggctcctaattggctttctccactcaagaaccattcaaactcaaagaatatgcattctttctaaaaacaaaatccccattttcaatcatatttatgtagccataaggacatagttcctttcattatttaatttttcaagtcttgaaaacatgccctattttgtctggaaggaggtatgcatattgaacttgattctggaatctgtgggccaagcctgttattccttcccaggtccagcacagttccaggcctgtagggagacatcattctttgcctttagaacagatatagctgcttttgcttgtggagcattctggtgtgcaaagctgcccttggacacagacatcatcttgcctctctcccctcttcacaggtgacagcaaagcgcggctcagcagcagcttgccctctgccaccctgggcagcctcctggatgaccagcactggcactcggtcctcattgagcgggtgggcaagcaggtgaacttcacggtggacaagcacacacagcacttccgcaccaagggcgagacggatgccttagacattgactatgaggtgagttgatcctccttcctgcacctcctcggccccttgcttcaatgaacgcagcaagaaaatcagtgagcagaccaactgagagaagtggtggggcactgaggagtcttaccctgggacttacttcctccatctatgccagatagtcaacaaggaaaggagtgcagccagagaatctgagcagtgaaggagtgatgggctaaaccacaagatagcagctctgtgcattttaaaatccagcaggtttccttctcatttttttttttcctgcgtgtagactttctgtgctgctgcctagtctattggttatgtatcttcttaaaaaaaagacctcagttatctgtggtgatgaaagatatttacattataaacaaaacccatggaatctaaaacctgcagtcgagactaccctttgactttcattcttccgatgcaagcttttgactaataccgtggcgagctgtttcttccctgctctcttgtagaagaggtacagtgaaatgaaccagttcaatgcaaagaaggctgcacaaagctctgcaaactggcagccaagagtttgccagctttgttagtagttcagttcaaggaatgcatgttgtgcccctgctgtacaccaggctctgctgggccataaatgtccagtctctgagttggagaaactgagataagctcttgcagaacaaggaggttaaagctacagtggatgaagcccctgtcactggaagtttagaatagagaaattttatatttatataattatgtatttatataggaaacagggcacttaattcaaccttgaaaaatggcagaagttttctagcaggagatgctgctaagccttgaaagaatagggttagaagactggggaggcaagacagagcatggttcaaaaaatgtcaaacagtccagtatttatggaattcaaaagaataggccatcagtggtgtgtttgagtcagcttgttaccagttcatgagtttcaagtgttagattttcagaaattttgtgagcccttggttaacctaggcattattaaaaattaagttggctgggcatggtggctcacacctgtaatctcagcactttgggaaactgagaccagcagatcacgaggtcaggagatagagaccatcctggctaacatggtgaaaccccgtcactactaaaaacacaaaaaactagccgggcatggtggctcgcgcctgtagttcctgatactcaggaggctgaggcaggagaattgcttgaacctgggaggtggtgcttgcagtgagcctagattgtgccaatgcactccagcccgggagacagagtcagactccgtcttaaaataataataataataataataataataataaagttatgtaaacttgaaattagttttaaaagctaatacattcattgatttctaattatttcactatattatatcgatttgcctgtctcttttaactaaaggtgctctggaggtatttcatgactattctatctgtgttgtggggatactgtaggttgggctgctaccacacagctcttcccaattctatgttcagtgaaatcccgttgacagcttgaagtctaccatagtggaaatacttataccacagaggttgacatacattacaaatcagggactgctttattgttttgtgcattgtctagaccaggggtcagaaaactacctggcttgtctggcttgaggcctgtttttttatgatgtgtgagttaagactaatttttacatttttaaagggttgtaaaggcaataaagaaatttttcaaaaagaatatatgacagagactctaagtgctacagataaaattattcaacaaaggtcagcaaaagcattctataaaactcaactggtatacagaacttacaataatagattattgcatattttatcattattcataaattgtgtgctacaagttgttaatatcattaaaagaatcttacgtttggatacacagtcatggcacaccaacacgtacatacctgtgggtatgtgtgtgttcctgtgtcccaccttggacagcctgctagcagacaacttcaatcactagtgggatagataatagaacagtggagatggagatgaataattgagaaatcgggacttattttttcaatcactatcatgagaataagagagctcttttgatcttaaccttagtttagtatactgtggataaaatatgccattcattaacttcaaaaaggaatttgtcactctttgactcagaatacaagataacaggtggatatttttgagttgctgaaaactggaaatctgtgaatatcaattgctctcctttgtcaacttgtttaattgattgacaaaagaaagaacacactcaatattggaaccatctcaaagaaaagagatattttttataaactcaaagacaacaacaacagcaaaaaaaacaaaacaaacaaacaaaaaaacctataaaatcatctggaagtctcgtcattcccccgacatactttccctttaatgtcccagaagatggttctaaaattcactctgttgccagatttaatgtttatttacaagcccatgtctgcttatcttttgtctcttgtgtgtggaatctgtataaaatcatagctgagtgacattacagtgaaagtcagcatttagggaaatgaaatccgatgaagttggaactgatttcttcagggcgtgcacggatgtcttggtgctttataaaatgtgctccctaggaaagaggcaccttgaaacgtttctctgaagtaacctctgctttagggaattcaagtcttctccagattgttcagccagcttgctccaatgattataaaagaagatagattggctgtaatagcggcgtttgacattagctgtactggaagacaagagttacgtgtcaagagaaacctccagcctttgaagattcaccccaaagtctgtgtggagatgaaagaacactggtgcagaaaccctgtgttctactcaccacatgaccactaactggctgtgtaaacctgggaaataaaaagttctaacttcagtcatccagaagcaagatccagacccctgttggaaggaatggagctaaacaggatatgtaaatctaaggtctattttatcacaacgttgcatatcaattagaatctacattgatttgctttctgccatgcgtccatatgtgcacaaatgaggcctggacatcaccagctagaggacaacagtcgtgtctttgtgtgccaatgactaatttttggagcatgtactactctgatatatacttctgatatatatatatactctgatatatacttctgatatatatatatactctgatatatacttctgtatatatcagattttatatcaaagctaatataattatgcaaacctatgtttctttttactctttaccatgatgtggtaataatggcaagaaaaggtagtagctttcattcttcatcttagactaccttaggggatatcaatcaagtgacacaatgactttctataaagcaactagcatgaactttgctgcactaagatgtctgcagtggtctgtttcccttcctgcccagaaggcaaacagacaagagctcacagaatctgctgtcaaaaaaaaaaaaaaaaaaaaaaaagggcagaatgtagatcctttacttctcattaaaatgtcttctcagtttacatcacttaacccatgtgacttctccaaacgctgcgagaaggattgtagcagctcagtttacttccagcctggagcagaagggctttagaaaaaaagatatttttaggatctttagaaaaaatagttcttttctaacatttttgtaatccaagaaggcttttcttatcaaaagtgctcagtaatcttgttttacatagctattttgtaagctcttaaactgttgaaaacatatttgaaaaatatatatgattcaggagtcaggcgtggtgttttttctgtagtcccagctacttgggaggctgaggagggaggatggcttgagcccagtttgaggctgcagtgagctatgatagcaccactgcactccagcctgggtagcagaataggaccatgtctcttaaaaaaaaaaaaaaaaaaaaaaatatatatatatatatatatatatatacacacacacacacacacacataatgtatatatgtacacacacaaatatataatgtatatgtatatgcacatacatatttgatttacatattatcacttcatagatactgaaaaggcattttacaaagtacaaaatatattttcaatgaaaattcttagtcaaaaaaacaaacaaaaaattagattgaactaaacattttaaaatacatagatgtttaatctctgagaataagtttcacagaagttttaaatagagatcatattttttaaacgtaagagtgctggagttcttctaggaatggcataaaatccagaaacttggaactaagatatataaaaaatttcgtctatgtaaaattttttaaaaccatgtgactgttcaccaaaaaaatctatataattatgtcatcctcccaagaactttaaaaagtactacaaaaaaaatcacacttttgaggcagggctggattgcagttcccactcagacaggcaaaacagcgtgtggagactcgcatcgtgaactttggctccagaacgactgcagtaatacattaggaaagcccggaggacacacagaccctccaaaagaagcagattgcttctgcaggacccaggaggcaccccaaatactgcgagtgcccaaactgtggagggaaagggagatcatcccacaaaaggaggatcatctgcccctgaacacaaacccccactggggaacccgaaggtctagattacgggagaagattttgaccttacttggagctcattgaatttagaaagctgggcaaaatacccaaatgaggaaaaaggaggaaaatccctgtgggcttgctgagtcaatttctgccttgcttcacagtggaccttcaggagggctaccagaggcactgagaaaaggccatagggagaaggaaatctctaggtgaacttcgtaacaatttgaacccattgagaagtctcctggccggcactcaaggaagggcatgaatccagtgtccagaatccacaggtcggggaagcaggaaagccctacttatttttgcagctgtgaggtgggtagcctaggacaagttcacagccctgcttttccactgcttggaaacagacttggtgctattgagggtggggcacggtgagagtgagaccagccctttgtgttgcgtgggagctgggtgaggcctgtgactgcccgctttgcccacttccctgacaacctgcatgacacagcaaaggcacccataatccttctaggaacataacttcattgacctgggaacctcaccctaatcctccacagcagttgccacaagacctgcccaagtagagtctgagttcagacatgcctagcccttcccccacctaatggtccttctctacccaacctagtaaatgaagaaaaagggcatatactcttgggagatctggggccctggccaccacctgttcctctccatactactaaggctgatgctttcttgaaaatgccagctcctgggagaaggccaaccagaacaaaagtagtgcattaatcaaacaaagctgcagatcctcacagagtccacttcaggcccctgcaacctccactggagcaggtgcccatatccgtggctgagagacccacagttctgtgtagtcaacccgcagtaccagcacagagcctggtagacttgctgggtggccagatccagaagagagacaacaatcactacagcttggctctcaggaagccacatccctaggaaaagggggagagtactacatcaaggaaacacccagtgggacataaggaactgtacaacagccttgtgtcccagaccttctctttcacatagcctacccaaatgagaaggaaccagaaaaccaactctgattatatgacaaaacaatgttctttaacaccccccaaaaaaattacactagctttccagcaatggatccaaatcaagaagaaatccctgatttacctgaaaaataattcagaaggttagttattcagctaatcagtgagataccagagaaagtcaaagcccaacataaggaaataaaaaaaaaatcatgcaagaagtgaagggagaaatattcagtgaaataaatagcacaaataaaaaacaatcaaaactttaggaatcaacagatgcacttaaagaaatgcaaaatgctctcaaaattctcagcaatagaatcaaaccagtagaagaaagaacttcggagctcagagacaaggtttttgaataaacccaatccaacaaaggcaaagaaaatagaataagaaaatatgaacaaagcatccaggatgtctgggattatgttaaacaatcaaacctaagaataattggcattcctgaggaagaagagaaatctaaatgtttggaaaatatatttgggggaataatcaaggaaaacttccctgtctttgctagagaactagatatccaaatacaagaagcccaaagaacacctgggaaattcatcaccaaaagatcattgcctagacacattgtcagcacattatctaaagttaagatgaaggaaagaatcttaagagccatgaggcaaaaacaccaggtaacctacaaaggaaaacctatcagattaacagcagatttctcagcacaaatcctacaagctagaagggattggggccttatcttcaacttccacaaacaaaacaattatcagccaagaatttttacccagcaaaactaagcttcataaatgaaggaaagatacagtctttttcagacaaacaaatgctgagagaatttgccactaccaagccagcattacaagaactgttaaaaggagctctaaatcttgaaacaaatcctggaaacacataaaaaaaaagagcctctttaaagcataaatctcacaggacctacaaaacaaaaaatacaattgaaaaaacaaaaacaaaaaacagagtatacaggcaacaaatagcacgatgaatgaaattttacctcacatctcaaaactaacattgaatataaatggcctaaatgctccacttaaaagatacagaattgcagaatggataagagttcaccaaccaactatctgctgccttcaagagacacacctaatacataagaactcacataaacttaaggtaaagggatggaaaaagacattccatgaaaatggacagcaaaagtgagcaggtgtagctattcttatattagacaaaacagactttaaagcaacagcagttaaaagagataaagagagtcattatacaatgataaaaggccttgtccaacaggaaattatcacagtcataaatatatatgcacctaactctggagctcccaaatttgtaaaacaattactactagacctaacatacagacagcagctaaataatagtgggggactttaatactccactgacagcactagacaggtcatcaagacagaaagtcaacaaagaaatgatagatttaaactacaccctggaacaaatgaacttaacagatatttacataacattccacccaacaaccacaggtattctattcaacagtgcgtagaatgttctccaagatagaggatatggtaggccacaaaatgaacctcaataaattcaagaaaactgaaattatgtcaagcacttgctcagaacatgggggaataaatctgaaaatcaactccaaaaggaacattcaaaaccatgcaaatacatggaaattaaataacccactcctgaatgatcatttggccaaaaatgaaatcaagatgaaaattaaaaaattttttgaactgaatgacagtagtcattcacaacctatcaaaacctctgggatacagcgaaagcagggctaagaggaaagttcatagccctaaacaactacatcaaaaagtctcaaagagcacaagcagacaatctaaggtcacacctcaagaaactagagaaacaagaacaaactcaattcaaatccagcagaagaaaggaaataacaaagatcagagcagaaataaatgaaattgaaacacacatacgaaaaatacaaaagataaatgaaacaaaaatctggttctttgaaaagataaataaaatttatagaccattagcaagattaaccaaaaaaaagaagagaaaaaatccaaataagctctattagaaacgaaatgagagacattacaactgacaccacagagatacaaaagatcattaaagactattataaacaccttcatgtacataagctaaaaaacctagtggagatggataaattcctggaaagatacaaccttcctagcttacatcaggaagaattagatatgctgaacagaccaataacaagcagcgatattgaaatagtaatcaaaaaattaccaataaaaaaagtccaggaccagacagtttcacagcagaattctaccagacattcaaagaagaattggtaccaatcctattgacactaatccacaagatagagaaagagacatgatagagaaagagagaaccctccctaagtcattctatgaagccaatatcaccctaataccaaaaccaggaaaggacataaccaaaaagaaaactacataccaatatccctgatgaacatagatgcaaaaatccttagctaaacgctagctaaccaaatccaacaacatatcaaaacaataatccaccatgatcaagtgggattcataccagggatgcagggatggtttaacatactcaagtcaataaatattatacactacataaacagaataaaaaccaaaaccacatgatcctctcaaaagatgcagaaaaggcatttggcaaaatgcaggatccctttatgattaaaactctcggcaacattggcatgcaagggacatacttccatgtaataaaagccatctgtgacaagcccacatgcaacgtaatactgagtggggaaaagttgaaagcattccctctgagaactggaacaagacaaggatgcccgctctcaccactcctcttcaacatagcactggaagtcctagccagagcaataagacaagagaaagaaataaagtgcatccaaaacagtaaaaagaaagtcaaacttgtagctgtttgctgattatatgattggttacctagacaaccctaaagactcattcagaagctcctagaactgataaaagaattcagcaaagtttctggataaaaaaatcaatgtagctcttctgtacaccaacagcgacaacgctgagaatgaaatcaagaactcagccccttttacaataactgcaataaataaataaataaataaataaaatacttaggaagatacctaatcaagaaggtgaaagacctctacaagaaaaactacaaaacactgctgaaagaaatcatagatgacacaaataaatggaaacacgtcccatgctcatgaatgggtagaatcaatattgtgaaaatgaccataattgccaaagtgacatacaaattcaatacactcctcatcaaaataccaccatcattcttcacagcattagaaaaagcaattgtaaaattcatatggaactaaaaaggagcccacatagtcaaaacaagactaagcaaaaaacaaatctggaggcatcacattacctgatttcaaactatactataaggccatagtaaccaaaacagcatggtactggaagaaaaacaggcacatccaccaatggaacagaatagaaaacccagaaataaaccctaatacttatagccaactgatctttgacaaagcaaacaaaaacaaaagtggagaaaggtcaccctatttaacaaatggtgctggatatttggcaagctgcctgtaggagaatgaaactagatcctcatctcacaccacatagaaaagtcaactcaatgtgaattaaagacttaaatctaagacctgaaactacgaaagttctagaagatggcattagggaaacccttctagacattggcttgggcaaagatttcatgactaagaaccaaaaagtaaatgtaatttaaacaaagataaatagctggaacttaattaaactaaacagcttttgcacagcaaaaggaacagtcaacagagtaaacagacaacccacaaagtgggagaaaatgttcacaatctatacaatctttgtcacatccaatgactatacaaattctagaagataacattggaaaaatccttctagacattggcttaggcaaagacttcatgaccaagaacccaaaagaaaatgtaattaaaacaaagataaatagctaggacttaattaaactgaagagcttttgcacagcaaaaggaacagtcagcagaataaacagacaacccacagagtgggagaaaatcttcacaatcttcacaatctttgtgacatctgacaaaggactaatatccagaaactacaatgaactcaaattagcaagaaaaaaaagaaaacatcaaaaagtgtgctaaggacatgaatagacaattctcttttttttattaggaaaatgtctttttattaatcaacttttatgttaagttccagggtacatgtataggatgtgcagatttgttacataggtaaacgtgtgccatggtggtttgttgcacagataaacccatcacgaagatattaagcccagcacccattagctgatcttccttttattttttaaatatacatatatatttattatactttaagttctagggtacatgtgcacaatgtgcaggtttgtgacaattctcaaaagaagatatacaaatggccaacaaacatatgaaaaaatgctcaatatcactaatgatcaggaaaatgcaaatcaaaaccacaatgtgataccatcttactcctgcaagaatggccataatcaaaaaatcaaaaaatagtagatgttggcatggatatggtgagcagggaacacttctgtactgttagtggcaatgtaaactagtacaaccactatggaaaacagtgtgaagactccttaaagaactaaaagtagaactaccattggatccagcaatcccactactaggtatctacccagaggaaaagaagtcattatatgaaaaagatacttgcacacacatgtttatagcagcacaatttgcaattgcaaaaacatggaaccaactcaaatgcccatcaatcaattagtggataaagaaactaatatatatatatataatatatataataaatatatattatatataatataaaatatatattacatatacaatataatatatataatgtaatattttatatatatatatatatatatataaaatggaatactactcaaccgtaaaaaggaatgaattaatgtcattcacagtgacctggatcagactggaaactattattctaagtgaagtaactcaggaatggaaaaccaaacatcgtctgttcctactcgtatgtggttgctaagctatgaggatgcaaaggcatgggaaagacaccgtggactttaggggttcaaggggaaagcgtgggaagggagtgagagataaaagaccacaaattgggtgccttgtatactgcttaggttatgagtgcaccaaaatctcacaaatcaccaccaaagaactttctcatgtaaccaaacaccacctgttccccaataacctatggaaataaaataactaaataaataaataatgctaaacaatcatacttttattaataagttaaaagtgtctacaattttttaaaaaaacaggtaacaatgaaaaaatatgtaaagaaaatgaacacataaaaatacaaatgactttcatatgtatgagaagatgctcaacctcactaataaaaaaagaaatgctaatccatgctaaaatattttcaacttatattgtaaagaccaacacttataatataccatgttgacatggaagaaaacagaaatattttatacactgttgatggcactataattaataatatataaaagaaacagtgatgttattcaaaactggaaacaaatgctcttcaacccaataattctgtttccagtaatttgtcctacaattattagcaaatgtgtgcaatggaatatatgctaggtataatacaagatttgaaattacccactaacttatcaaaaagggatttgattaaaaattgcggtcagccctgcatgggaacagctttgctcacggtgctccttgcaggtacccagagtacactcagccacaggcttgcaccgcagctgatctgagtcttggcaggacacctcgaaatgtgagaaggtgaaggccagtgaacaggtgctctgaaaacttacatcatttgcctccctacccctgtgggaggccaccatgtttctcatcacctctcagattgtgataaagggtagagttctctgccctctcctctcagaatagagctgcataatacaaaattgtttagctcaatcaagaattgcgttcttggccaggtgtgttggctcatgctcctaatcccagcactttgggaggctgaggcaggtggatcacctgaggtcaggagttcgagaccagcctggccaacagcatgatgaaaccccatctctactaaaaacacaaaaattaactgggcatggtgcacacgcctgtaatttcagctactcgggaagctgagggctgaggcaggaaaatctcttgaacctgggagttggaggttgtagtgactcgagatcacaccactacactctagcctgggcaacaagagtgaaattcctctgtaaaaaaaaaaaaaaaaaaaaaaggaattgtgttcttagcaatgggaataatacagcccatgttgtggtcatctaacccattttgtttagatgtcatccttcttggtatctacagctacagtgaatggctattctttgcttagctgtttgtgcaaatacaaaactgtctgaatcgaaatgactcttttatctttcccagtctattggtcaggctttggtcttaggctcaccttatgtattggtgcctgacaaacctctatgaaagtgtaatgcactcattaaaaggaatgaggcaatcctatatgttctgatacagaaatcatctccaatataaattgttagaggaaaaataaaatcaaggtgcaatgcagtgtaaacagtttttttgtgtttaaaaaacagaagagaacatataaacattaaagcacatataggcatagaaatttctgaaaggatactaaagcaagaggtaagttagaatctcagagagtaggacaaaaaggaagaaagccttactttttactgcataccctctttaaactttctgaatattttactccatccagaaaagtactttaagaagaaactgaggcagtagaaagaatacattatttaaaagacagttcttatatttgttttaaagttgcatgcactgatttatttttattcctagttttctttaaaaacacgtattactttataatacataattaaatatacttattttttaaattgtctatctcatcatctctagtccagccatagaatttaagctcatcataaaggttgagattttcttctttactttcatttatatctatagcattttgcctgacatataaaatatactctgtaaaaagttgctgagtaattggatgaattttatttctgtgaattataaatgatattaatctgcattctacctttcttcccttaagaagttcctaataggttctccatgctcagaggccaccccttgctgccttccttacttttacttggcgttgcctaatggacatctctctaataacagacctgatttgaaaactggccagacataataaaactatttatttggtgatcatatgatagaatagttatagatcctttgtttcctttggaaattcagttgcagggttaaaagtgaaggcctccatcgaggaaaataaactgaaaaaaataaagaaaaaggaagcaagtagatgcaaagggaaaataacaaaaatctcacaccagttaaaatggcaatcattaaaaagtcaagaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaagactataaatcatgctgctataaagacacatgcagacgtatgtttattgcggcactattcacaatagcaaagacttggaaccaagccaaatgtccaacaatgatagactggattaagaaaatgtggcacatatacaccatggaatactatgtagccataaaaaatgatgagttcatgtcctttgtaaggacatggatgaaattggaaatcatcattctcagtaaactatcgcaagaacaaaaaaccaaacactgcatattctcactcataggtgggaattgaacaatgagaacacacgaacacaggaaggggaacatcacactcaggggactgttgtggggtggggggaggggggagggatagcattaggagatatacctaatgctagatgacgagttagtgggtgcagcacaccagcatggcacatgtatacatatataactaacctgcacattgtgcacatgtaccctaaaacttaaagtataataataaaaataaacaataaaaaatacaaaaattagccaggtgtggtgatgcatgcctgtaatcccaactactcgggaggctgaggcaggagaatcgctggaaaccacccaggaggtggaggttgcagtgagccaagattgcaccattgcactccagcctgggtgacagggtgagattccacctcaaaaaaaaaaaagaaaaaaaaagtcgttttttatcattatatccttcaagttttaaaaactgaagattaaaatatttgtctcaggtcaggaaataaagttcactaagaaaaaaaataaaataaaaataaaataaagagttattattatgtatggcattttaaaattttgtttaaccacccaaaacagccctgtgagaaaggctattatctcctatatcacaaatataaaaggaggacacagagaagttgaagaagtctccaatccctattcctcaatagccaccaagaaaaacgaacaggatttgagcccaggtctgtgtgaccatttgaccagaggtttatctggggagtaggttttccctctgaggagagaaaatcaatgtctggagatacaagcacagactctggggcttggcctgggctctgcctgtgtataagacatgaaatcacattacttggtgccattttccttctagttttaaatttaagattattgtgatttgtggacttgctaactttatatttcttcaagttttatgtgagtgaaataagatacaaagacttctcttaaatttgttaaaagcaaattaattgttttacatatgatgaagggaatattttaatacaagtattatacaaaaatgcattgttttcattaacatgaactaaaggagcaaatggtaacatatcttgttttctattagctgctattagggggatgctagtaggttttaattagtgtgctacttctagtggaagtggccaataagacatttggagactggccaaatttgggctaaattactgtaatccttaataaactcatgtaaagctagccaagcccctctagggtgtttgtaagcctgaggcaagagtacagatagagaaccacatatcatgaatctaaatttgtaaagagttacaaaccaagctaagaaacgaatgaatcaaatatgctctactcccctcccttgacagatagacatccattcacgcccataccccacaggtcaaagttctgcccacactgcaaacagctgcctgttggccacccctcaggaaggcagatgagggacgagaacggtgaagacccttgaaggactatcagagctgttgaggcaggaaactgggtgttgtgtgcagagatcatgttctggaaggcggtggcaacctcctatgtcatctcccctgggctcataaggccctgcccttgtgacacaggatatgaccgaggaagaccacagtgagaccctttaggaacccagttcagggcaggaaggcccactggcctgggtataagggggatgtgaatggaggatttctattgaactctttgcttgaatactaaaatgtacataatttacctcattggccaaagaatctaatgtaaaaatatagtaaattcattcagacaaaaaattataaaatatatgttaggcctgttgggctgtgtcagcagctgacgtctgtcagtctgtgaaaaaatacctatttagagaaaggaactgtaggcctggcattgatcaggtttaagccaggagcaataaggacaaccaaaacaataagaaaaatggtctgaatataccccgttgcaaaacctgatggtagtttgagaatatagggctgccctgtcagcagaaaatacgaggagctgatttatgctgttaagaaaacatgcgtggcgtctgctgctatcactgtgccccacttctgcttttcatctcctccagggctgcaaaagactcaccaaataacatgggccagtgtgctcactttgcctgagacaagggggcaaattttgccaggtttcccagaatggagagagccgtaaggatgtggaacatttagttttaaaaatggcaatgtttcaggcaaatgaggacaagttggtcaccttagcctgggacttttcattgagaaggctgctcagtggaaccaggtgtagaagaagctagggggacactgtgtgtgtggcacttagagttggggctctagattgaaggatgtggaattccagctctttaccttgtggctccaaggtctcagtcaagctgctaaacctctgtatgctgtcattttttttcagctgttaaatggagcaaatcagagtacccaactcaaaggttagagaaaaaacagtgaaggtcagctctaagcatggtgcccgatatataaacatgatcaataagtcctactattgctattactaaaacaatactttgagagagtgcccagggttgaacaagagagacaaaatccaggtgaaatttaagggcaattattggggttgggtcagaagccataggcagaatgtagtaggagggatgtgagcctggagcactggggcaggatgtcaggacatggatgaagcaagggagcgcaggcactttctaaatgaggagcactatcaagaacagtgctttctcttactcaatgctgggctgtgtctgggtaagaaatcacccactctctatcactggcaaaaaagaaataggataaattttttgcagaaaaaagaaggacactggaaacttgtgaaataatagattgtaaaaccaataaggaagaggtaattgttggtaaaaatgtaaacaattgcctcgactcattatttggctccaaagtcgaagcaaaaataaggcatgatatgtactacgagcatattaaagtgacagacatcagaagttccaaacatgggacagactgagtcattcatcctgtcaaacagtaaaacataagttacaaaacgatgaccctgggcaagatttggaaagccatcgtccaattttgcctatatgctgttttactttcttttttaaatactcaactttcaggctaatttttaaaaatcaggagatttaaccagaaaattggaatttttgtcctcatttgtaatggcagaaattcatccacccttgactagtatcccaaaggctgatgatggtgtgtttctccttttgaagggccatgagctttgcatgtacctcagcaaacacccagccagtgtaagtcttaaaagatgaaaaagaagacagcagtttggatcctttttttatacctgtttctttaagaagtggactgtcagaacaaaagtgagacaaacatttacaaatgagaaacttcaaaagtatcagatattcaagtcagatacaaagtgggatctttagaacaggaagactccaaatttaaacaggaccagagaaaaagccaacaagggaggaatgaattccttgctgtggaagtaacatcaaagattgaaaaagagacaagcaaataccaaaccaaaaaaaataaataaataaaataagatcaaagaaaaagagagtggtagattctgggacctcatgcatttaacatcaatgcaggctttctccggggatttatcctgttggagctcacctgtgacaacagtaaatccagcaagttaccagatggactatgttgtccaagacattgagactgtgagtgaaactttgcaatctaatacctggcatttttgaccactaagatcaatgaaaggcacaccattcaatgaccactaagatcaatgaaaggcactcattcaatatgccaagaccaagcaagcaagaaaagtaagaaaagaaagagaccgaattgccaaaaaagacaatgaggcaaaagcagatttagaagcaaattgtcagtgctctttttaaaatccaatttaacaaatatctgttgaatctattaatggtttaatcatacctcttggaattacatattcaaaaatgaatcagatattatctgtgcctctgagaaaattttaaggaggtattccacaaacattcaacaaatgtttctttcagcatctactgtgtttcacgtacccctttaagtaggtgaaatatctcaatgcaaaagacaaaagattcctcccctcatagtgcttgcattctagcaggagaggcaaactataaagaataaacacaagtaagtgaattatatagtaagtaagaagataataaatgctatgagaagaacaaaaatagatcaaggtaatggatctaggagttcttggatggagggaacgagattgcaattttagatatgtcagtcagggtaggcatcattgagatggtgccatttgagaagagacaaaaaaaagtcagttttccaggatgctgtctgagagtgcttgctcagcgtattgatctcttttacctaccacaactagactccatttttcatgcttccaccacctctcacctgaggccaaaataagcctctttgatctaatatttgccctctttgtttatttatttatttatttttccatttttacttcaagaaaataattttctttaaaggtggttattatttttctccaaaaatccttcagcagaatagtgtaactattctctgaaaatccttcagagaatacaataactctattcttttcagcctagccttcaaatatcctatcctatggcaccaactgatcttgctttctttacttatgacttaaaatttgatggtttcctgtagattttggtcactagtatgcttgcattgtttctatcatactttgtcttccatcagtctgttggagcatgaatttgtctttagtgactggccctacacttttagatagaggcagcatgtgatttatccttaattccaccacagggctttgaatcatgcttcacaaaaagtaagggttcagcaactattaagtgaatcgaatttgtaccaaacaattggaattaactttatcaagtgtttctaagagttggtaacagaataataagaataaaagagtttttgatcagtattcactgaaaattactggtcagatgagacagattttgttcggaaagtctgtgacaactgtaagttgccaacgaatggatgagcacattacctaatggaagcaggatttccagctcagtcttccatatactgaaggccctgggccatttcatacagactatgtactcagaaatacaatctccattcagtatcatccacatctgccaaataatgaaatattctagagtatgaatagaaaggcataatcagatcttcagcatcctcggaaatgaaatctgtgaaggaaaattaaaaatgattaaaaacaggtttgaaatgcggacaaaggtacaccaattaaatgtagacagaaagaaagcagaagtggaaaaactagtacctttgaaagtaaatattaagatcaaaacaggccgttgtaaaataatcattatagtctctaattaaaaacacatactaaccccatgtgtatagcacataaaatatcaataaatgcaaaagtaaaagacttctaattgttcctatgcagatattggtcaatagtgcccttatgtgagtacctgtgttgcagttccaacatgcagaggccctagagcctggttgaggaagatggttgttggtttaaccagctatgctgccagatgaatgaactaatggacagagttcaagaggaaaagccaaggttgggaatgttggagggagccaatcagaagccagcagaactaagcaggagactagcttgaggatgatcagtattcaatttttgcaaagagtaggtacaataactcggccagcccaaatcttccatagtggtaattcttatatggagggcttgatggagagaaacagcttagaggaagattttaatttttattttcaaagttttggtaaatcagacaaaaatatgaaaacaaatgatctgagggatatatttattaatatagaattaagaggtgtgtagcctataagtgtttataaaatattcagaaaagaaaaacatcattatatgaagcaaatttctccagtctaatttaatctgataatggactaaatctatagttcaatagtcaaattataacttccaattctcaactacgtaaaacatctaaaaatctaaatcagggtgcaaattcacactcatattcaaatgcacataaaaacggttttgcttcttttccctaactggattcaatatgctcatcagcctctgttgcttctaatggtagaaaaatctaaccttgatgatgaataataattacttaatgattatttaaaaagtagtacattattgggtatatattgggttatgttgtgacgttctctctgtacttttttcctcttcccttggcagatcactaatggggtggtttgtgtatcgtgctgcgtcaagggagtcatgccattcacgagtcccacctgtttggaggcaaaagacttgcatcacagctttcattgctgttgtctgtaggacctgccttagtgtactaaccagggttctctagagggacagaactaataggatacatgtatatattaaaggggtttattaaggagaattgactcacacaatcacaaggtgaagccccatggtaggttgtctgaaagttgaagatcaaggaaggtagtggctcagtccaagtctcaaaacctcaaaatagggaagccaacagtgcagtcttcagcctgtggcagaaggcccaagagtccctggcaaaccactggtgtaagttcaagggtccaaagccaaagtcctcagagtctgatattcaagagcatgaagaatccaacacagcagaaagaagcaagtcagcttcttccatcttcttctgtctggtttttctagcagttccggcagttgactagatggggcccacccacactgtgggtggaccttcctgagggtgagtcctctcctagtccactgactcaaatgttaatctcttctggcaacagccagaaacacccagatacacccagaagcaatactttgcatccttctatcaagttggcacttaatactaaccatcgcacttggcctaagggagtgagatgtagtcacttggactctcccagacctccaaatccagctaccagcccttaacacatttactgataacttcagcccatttgtaccctcaacctgctcttctggtcctggggaccctcagttgcctgcctcacactgtgctagagtgaccaggtcactgtggaacccctctagcctttctgcgttgcctcttcctcagcctttgctaacctgtcttctcctccccagctgatttgctctgggatcatgctgaacttgagacagctctaacaggcttgcagccatcactgctatgggtacttctggaggcagtacctttctgtgttttccaagatctgtcttgtgacctctatccatatccacccaactcacatccagtttcaatccctcagggagaaccagagagcaggcctcaagctaccacctaactgtgctcttgtctcaaccaactgcctctgaaaatcttccacccagagtagaggagagattgctcccctcagtgtaataggaaactacaattttttagtatatggtaccctctatactacctgactggaaaaaactctccaccctgaatattttcaatagcactgtgttttgctatttaaaagacagcagctttttttcattctgtttttttactaacattttcctgcaaacaatattttcttaaaccataactgagcgaagtagagcattaatttttttgaaattgaggaaagtagccaacacaaaatacaaatgtcattaaatatttaaaataataaaaataagtaaaagtaacatatatccaaataacatatatttttacattataaatttgatgtatgtgaaaaatttgcaaatccaaaatagatcttttctttttttttacatttttaaattttatgttaagttcaggggtaaatgtgcaggatgtgcaggtttgtcacataggtaaacatgtgtcatagtgattagctgcacagagcatccaatttcctaggtattaagcccagcatccattagctattcttcctgatgctctccctcctcccaaccttccacaggccccactgtgagtggttcacctccctgtgcccatgtgttctcatcattcagctcccaattataagtgagaacatacagtgtttggttttctgttcctgcattagtttgatgaggataatggcctcctgctgcatccatgttcctgcaaaggacatgatctcatttctttttatggctgcatggtattccatggcgtatatgtaccacattttctttatccggtctatcattgatggacatttatgtagattccatgtgtttgctattgtgaatagtgctgcaatgaacatatatgtgcatgtatctttataatagaatgatttatattcctttgggtatatacccagtaattaaattgctgattcaaagacccatctgcctctaggtctttgaggaatcaccacactgtcttccacaatggttgcaataatttgctctcccatcaatagcgtaaaagtgtttctttttgtccacaaccatgtcagtatctgttgttgactttttaatgatagccattctgactggtgtgagatggtatctcattgtggttttcctttggatttctctaatgatcagtgatattgaactttttttcatatgcttgttagctgcatgtatgtcttcttttgagaactgcctgttcatgtcttttgccccactttttatggggttgtttttttctagtaaatttatttaagtttcttgtagatgctgcatattaggcctttgtcagatgaataggttgcaaaattattctcccattttgtaggctgtctgcttgctctgaaaatagtttcttttgctgtgcagatgctctttagtttaattaggtcccatttgccaatttttgctttagttgtaattgcttttggcatcttcgttatgaaatctttgcctgtgcctatgtcctgaatgctattgcctaggttttcttctggagtttttagagttttgggttttacatttaagtctttaatccatcttgagttgatttttgtatgtggtataaggagggggtccaatttcaattttctgcatatggctagcctgttatcccagcaccatttattaaatagggaatctttttcccattgcttatttttgtcagttttgtcgaagatcagatgattgtaggtgtgtggtcttacttctggactctctattctatggttccattggtctgtgtgtctgttcttatgccagtaccatgctgttttggttagtgtagccttgtagtatagtttgaagaagggtagcatgatgcctccagctttgttctttttgcttaggattgtcttggctattcaaactcttttttcgtttcatataaattttaaaagagtttcttctaatttcattaagaatgtcagtggtagtttaacaggaataacattgaatctatacattgctttgggcagtatggccattttcacaatattgattctccgtatccatgaacatggaatgtttttccatttgtgctctcttcgatctatttgagcaggggtttgtagttctccttgaagaggtccttcactttccttgttagctatatttctatgtattttattctttttgtagcaattgtgaaaggtagttcattatgatttggctcttggcttgcctgttgttggtgtataggaatgctagtgatttgtgtacataattttgtattatgagactttgctgaagttgcttatcagctaataagcttttgggctgagacaatggagttttctagatatcggattatgtcatctgcaaacaaagataatttgacttcctttcttcctacctgattaccttttatctttttctcttgcctaattgcctggccagaacttccaatactatgttgaataggagtggtgagagagggcatctgtgtcttgtgccagttttcaaggggaatgcttctggtttttgcccattcagtatgctattggctgtgggcttttcatatgtgggtcttattattttgaggtatgttccttccatatctagttttttgacagtttttaacatgaagggatgttgaattttaccaaaggcctttcctgcatctactgagataatcatatggtttttgtctttagttctgtttatccacatttatgtatttggaccttttcttaatgtaaatgactcaaatttaaaatgtttgaaaacagcaataaatcaacaaaggagattttgtaatacttttacaaaatatttgtggaatttacaagttcattggtaatttaaaattttccagaatgttttatgagatttaggagccattcatatgataaaatataaaactcagagacaaatttagacttgatctaaatgcttgacaaaagaaaactagagctcaaactaatttattacttaaaatatgagcacaaatggaacacaagagtggttcaataagagagaatttgttaactcacaatgtagtaatataattcagctcatcagtagatcaaacaaaatactctcttgtctgtcacatggatttttgaaataatcgtgaataaaactaagcattcattcttatttaaaataaataaataatttgtgtgtaaaagagcagaaggatattctcttcatgtggagtcagaactagtgttatgtatagctgagaaataaaatttttgttttgtttcgtgatggtattgttgttgatgttacaagtttgtataccattattattgttcaatattgcttcaaaaattttggctaggagttaggaagttttgatggagacagtaaaataggaaataaatgtataagaaattgatttcatattaattatattgaataaggtgttttatatatatatataaatacatatatatcatatgattaccatcataccttgcaggtattgtggattccgttccagacgaatgcaataaagtgaatattgaaataatcaagtcgcacaaagtttttggttttgtagtacatataaaagatatgtttatactatattatagtctattaagtgtgcaataatcacattatatttgaaatatatatgcctcaatttaaagatattttattgcaaaaaaaataaagctaacacagagacacaaagtgagcacccactgttggaaaaatagtgctgagagacctacttgccacagggctgacgcaaatcttccattcatgaaaaccacaaaatctgtgaagtacaacaaagcgaagtacaataaaacaaggtattgcctgtatctccctcacaaattaaaaggaaataactaaagagtatatgatttaatataaaagtatatacaagtatctggttaaagaaaatataccagcagcaataagatgagcacagcatttacatgataaaatgtttaatgaattaaaacaattcatatacaatggaatttttgaaatcatgaaattcatagaaattaatttaatgatgggtatgaaaactagagaaagaaaataataaccttagttggaggactttattagaaatattctgaaaatagaaaacaacggtgggttcttggaaagaaaaatcaaatatttaaaaaatatccattcttctctaactaaatgttttaatgtaaataataaattatcaataaaaattctaacaaactagttaaataaaattattctgtaattaaactttaaaatgaaatagataaaatatcaaaaaattctctttaaaaattaaagtagttgtaagtaaaagtgggcaacaggattaataatactcttcacctattacactgcattaagaaacacttttttactagtgtgaagcttgtaaaaaaatctaaaaatagccttaagtgtatcagtagttattcatataagaagacattctgattgggagaccacatcctcctgaaacattaagacagagacagctaaaaagagacagtgaactagagaaagatggagaagtatccaaatatagatatagttgaagtacatgctgacagtgatatttcaaagcagtggaaaaaactgcatttctcattaaatggtattgggataaacctgataatataaattatcttgattctttttcatagtagaaaaaatactcataacaggccgccttgcttttaaaataatatatctattaaaaaggcaatttgtgttaatactaattagaaataaaagttgtaaaagaagaaaaccgctagtatctcataacctttccaaagtgaaccactattaaattaggttggtgcaaatgtaattgcggtttttgccattacttttagtgacaaaaaccgcagttgcttttgcctcaacctaataataacaattcagtgtatttcctcccagactatgctttatgctcaacttcttattgttgacatcatactttatacccaattgtaactcttgcattttaaaatcaacattatatttacttcccattatattacaaatgtttaataagcaccattattgacaagtgaaatttcatcacattgattcttaattacttgctttacaaaactatatagaacatttggaatatttcctgtttttcatcattatagatgacaattgtggacaatcttatgcataaggctttttgcatacaatataggcttttaaactaggttcttctgtagctgaatagaggtatgttttgtttgtctcttggctttagtatggccatatcttttaagatgcttggataagagataattataaagacattgattttctttttctttttccctccttctgtaaattattgttttatttagtattaaaaaggttcagaaaggaagtgaaaatggttgtgtaaaatagtcccttaagaagcaagcaattacagttatttttacataggctaatcagtatccttttaaatgtgtaatcaagtagcatctataattatttgagccatttggctcaagcatacaattgaatctaccaaaaacgcacgtgtttactttcctttcctaatctttctgagcttaaaactaagagtttgtttctattttcaccccaaaagcttagttttggaggaattccagtaccaggaaaacctgggacctttttaaagaaaaacttccatggatgcatcgaaaacctttactacaatggagtaaacataattgacctggctaagagacgaaagcatcagatctatactgtggtaagtcagcccatctgttttgtcttgatggtttctaccactttggggtaagtcttgctttcaccagcccattcctgaacccattcgtaatgtgtttatcttatgctctgagttcccatcagcgtctgacgtgacactggagagaaagagaatggcagatattgaatctgtgttaattgcactagtggaagaaacaaagacattagggccatccagagaattcattttttttttttgactgtgggtcatatttcaactgtgggtagtatttgcagtctatattgggacaacatgaattttttattatctctggaatatgaaacaagaaaaccacatattccattaaattctatggcttgggagttacatatatgtctacttattgttaatattaaaaatagttccttttaaatgagggagattaaacttttagtgtgtttgagattctcatttatcatattgacaaattaaatgattttctaattaagtaacatttgtcttccctaataatgagtttcatgagggtcaggactgtgttttctttttactactgcattcacaatgcctaacagagtgccttaaacgttgtaggtgctcaataaacgtgttgatgtttccaacaataattttggatttgtctgtttctctctccagttctatccatttttggtttatatattttgtagctctgttgtttggtacatacacatttagtatgctatgtattctggtggattcactcttttatcattatataatattattatttgtctctgataactctctttgctctgaagtgtgtctgatgttaatatagccactcttgcttttcctctataaaggtctttgtcatgtaacttttcccatccttttgctcttaacctgcctatgtaatcatttttgaagtaagtttcttgtaaacaacaaatagttgggtcatgttttttaattcatgctttcaatttctgtcttttaattggtctatttagcaaatttacatttaatgtaatgaatgttctgggcttaagtgcctgtttattttgtttcctgggtttttaaaaattctctattttctctaacgtcctgtgtttcctggatagtttttaaaattctatttttcttatctagtgttagagtatatctgtgtatagcttttgttagtggtttctgtagacattatattatatatgcataacttattgtggtttactggtttaatcattttaccaatttagctgatatgtagaaacctaatttccattgacatccctttatcttcccttatttattttacaattgtcttaattaggcaattatatttttagaaccatttctatatatttagaaccatttcaagtggtattattttgctacaatgtcaaacatcatttaaagaattcaaaaggagaaggatagtttgttgcatttactcatatttttgcccaatattgacaaaatgtaaagaaaaactcttgaaaccacaagggatatgtttggcttggattagtattaaagactcatgactgctgcccatgtgatctgcagtgacatcacagtgtttgtgggtgggtgggagagggatgcccttcatatcactggaatgtgatgaaagtcctgactcaccactaaaccatctctgagactgctcctgcaggggatgaagggggttcctcatgatagctcagtagcggcagaagtctaggctttccttgtgatcgcagttgataccatagggagagacttggttctatctgacaatgattaaattcacagatcttcagaattggccttgtaagccagagagtcccagattgatcttcccatataccaccctggccagaaacttgggcacctcactacagcatggctcagtggaaatggggccatagtcttttctatggcatttggcttagggagagaagtcgttgtctaacagcatctctctttctatgctatcctttcctcatcctttggctatagacagcagtcttttaatggcaattttaaacaaaattttatctgcaccagttggtctctctgggttgtctttcagcagcatacttaaaacagatcaggttaagagaaaatccagagaattctccactgtgtttttcttttggtcccgagatttttatatatcctttatttcttttccccaccattcagagatattttaggtaagttttatacataattcctatagtcttttagttgtacttagcagaataaatagggaaaactatgttacttcatattcctggaattggaaatctcttcaactgacattttttctttaatccatggcaagagtaggtcaccctgtcattgacagcaaaaatatgattctctttgcaatcttattgtagaattatttgaacaaactatggcttaaatgactttgtgtttgttttattctttgataaatataatctataagaatttttttgtgttttgaggtatcatattaacacattttcttgaaaattgccattggattcaagggtatgaggcagaggatgctcatggggaatcacacttggattaaagattgtcagcattttaaaaggtttgtgtcaagtccctgactccttcggtttggaaaagttaggatgatgctagggagggattaattacctcactggctctagaaaagccatgacattacttgtccatctctggctaatgcccaaggctcctgacaattctgcaacttatccacatgagcttaggtcaaccatctcctaattaacataaacactggcttgctcatgacatttttttttttttttttttgattctaggtttggagtcttgggctatggaaagcacactcattcctatccctttcccaataatgtttcaagaaatatttcataatatatcagtttccttgagtccaatctgctgacacagattgtgattggagcaggggcactacattgaaatcatgcactaccagaagtttagattagcctaatgtcagaaatattaaagggcatcactacctaccattttgctaagatgtggcagagcaaagtgaaacaacagtaagcttataaaaacattgcacactcattgttcataaactggggcttaaaagtataaaagcctgagctttagatataaataactaagatccctatagtaatattaaaaaagaatatctttatacatattatgtgttaaaaaatatctttaacgataagatagattggagttactgaataagcagagcaaaaaaaaggaagataaaaaggaacaagagaaaaaaaaaacttcagtttctgaatatcagtagctttcaccgtttcgttttctgagagaatcattatctaaaactttgctaagtgttgtggtgacttttaaactactatagcacttatcaagttgcctacaactttgctagcatatgttactccttggggtttaattggcagtattgttaatatgaggcataaagaatccatttagcactaacgtatttggaaaaaaatcccaagaaaattgttttattgtgcaggtaggcaaccttagttttaaccttcacaatttagaagaaaaaatgtacattatttttcttccaaattgcttccaacaccctgcttaagtgagaattcgtatcactatacacttgcacatgtacacacacacccacacacatatttatatacctagtctatctcctttaggaatttcttacgagaagcaatggtttgcactgttaaataccgaagtacaaactctttcctttctgtagtcaagcttaaagtttcccccaaagacaccatatctgctacaaaatcagctttgctccatcactaagtcactgtggtactaagtaagggcttttggaaggaatgatatttttgtccttttctagtgttcgcagactctcttacagttattaggccttgggaagttcagattcaagggatcaacaaatcaggcagcaagagtacggtactactcataaattataaaatgtgtttcaaggcccacggaagctccagcctttgcctaacctaacgtatgcctctttagcaggctgcattcagcaggcatcctcattgcaatctgtcatctctttcttgtgggaccttcccactccctggagacttaacagctgttccatagggataattcaatttagtctttatagctcgatttgactacaagacaattctccacatcccgaaatgcagtaaaactaacagcttaaagtagacataaaaaatacctcactattcttcctcaaatcctttattatatgctaatacagcactatataataaacaatcagaaagcaaatggcccattgaagtgtgtgtacagtacctgtaatatggattattatatatgtagtataagaaatatattgctctgatagtttcctgaaaatgattaatttcataccttgcactccatcagaaatgatgctttttttgagctgtcctttctgagtcttctatctcttctcccagaggcaaggagcataacatgattccctgggagctggctgaagtttcactcccattattgtaggtctcaaaatattttcctttttatttaaaagatcatagtggaaatgcatgtgttactttactttgtcttcaatagaagggaagaaaatgcaaataactaataggaagactctacttacagagttggctttggagctaattgactatgtcaattcatttctgtacctttgtttccaaatgggaattggaatcagggaattggatgggcgatggccaatactaagccaatataataatactcccaaccccatggttgaaattgctaaataatcacaaaatgccttttcttttgtcctagagggaaacccaaaggtctcacttcagtgttcctggaagcatcctcaataaaatcataattgaaacattgacttcctaggttgttcatccccactccatggcttattcagctatgggatcttgagaaagttacgaaacttcagtaccctcatacataaaatgagggcaaatatagtatctacttcaaagtgttagtgtgaagattaaatctgcaatacccttagggcagtgcatggtacacactaagcacccagtagattggagctattaataaaaacatctataaatccattcaactgaagttgacatataagccaatatttatttgccattttagatagctaattaatgcagtcacatacagttccaaataataaaagttgattggagatagctcctgttctttcctgaatctgagtttctgtttactcccaaactatgagtcatgaagtgggtttgcagtaaatatattacaaacttaatcatctcatttatttgagaaaatttgatgaaaatcattacttcagatttgatcaaatggtagactcctttaaaataaggaacttaaaaaagtgttgcctgataggcttgggtataacagatgtattgaagagtaacaacagtgagttttcttgaagtatgttgcccttcgtttgcatctctgctgtcatgcaacttattggagcatggttgattatttcttatggctctaaagccaagcaaacactcactgtcagagttatgtgtaagagataagggtggacatgagagcacacacacatttacatctgcaggtgcacacatataacatacacacacacgtagtgacaggcacctttatcttacctccctgtgacccaaaacctcatgaaaattgctcagagaaaactccctactgtctagtaaagcctataatctctttagcttgtttccgggatcatgtttcatctctgtgagtatgctctgtgataaatgatactttctcttgatcgaaggaatcatttgaaaaagcaactaacatattgtgtcttttctcttctcattcctgctctcttctacttccatttgaccagtcggacatccacatcacctgcatctatgctgtatgctcctcatacccagcaaaaatcatttccaagttattcactcactgaacagttgcttccttcctttcttcaggaaaattggaattaaatagtttcaaggtcatatgaagaataatgtgccttaaagaaaaaaggaaaaactaacagtgtaatggttaatatcttagtccatcaaggcagctataacaaaatgtcataaactgggtagcttatgaataagggaaatttatttctcacagctctggaggctggaaagtctgagatcagagtgccaggacgatcgggttcgggtgagggctcccttccaggttttagacctcacagttctccctgtgtcttcctccttcctcacgtggtagaaaaacaaacaagtcccttggggctattttgcagccattaatcccaagacctcatgacctaatcacctcctgaaaggccttacctcctaataccaacatactggggatgaaatttcaatatatgaatttcaggaaggggaggataaaaacattcaaactatagcagtcagcctgtctgaaaattgttttacctgaaattagtgttatgacttttcctttctatcagataagcaaatgtaaccagtttcttttgctcatctgataaaattattatgtaaagtattaaagaaaatttctttagaatgttttaaaaatatttctatataaaatgaaaatttgcaaaatacagaatagggtatgcaaccagccagagaggaaaacactgttctcatctattataggtatttcattttcacactttaaatgtatatttatatatcatagaccacagtttattgacaattttatattttacctttttaaagtattttcaatgtttttaaaacttttattaaaagttgtttcttctctatttacaaatactatttcagcactaaatcaatttaccatagttcatttaagaatctactgtgttaaaatttgagttgtttgaatttttttctgccaaaaataatattgagattacaaccatggtgcaaaaataattttcttaaatttaaaacagataactagaaatgaatataattgggtcaaagattgtgaacttttgactcaacccacattgcataaagccacaccacattccacgcccactggccgtgtatacaggagacggcttatcctgctagtttcacctgatacttttcaagtcatttcaatcttcaagtgctttttaaaaaaacgggctatgtaaaagttgaaacgacctcagatgtgcttcctgatgcaaaacatccaactaatgagctgagcatattctttttatgctctcgcacctgcagtaataaacgcaatgaccactcccccattcgaagatcctgtatttcagagagcttatagacaaggccacagatcacggtgctagcactggaggggcggtcagtggagggttgactgatgacctgtggttctattagagatcctctgtctcctgtgtgtagcaggcaggaggcagacattattatccacgttttataccaaaaaatatactcaggattagggaaagtcaatgatatatattagtggctgtgcctttcacagtcttcttcctcctcttatggaaagcaatccaccatcaggttttattcatttttattaggcatttattttttttagggtcctgaatgactttcatgtcaaagtgaagaaaaaaataatacaaggctgggcagatccgtgaacagcactgatctctgagtattgaagaccaatgaggtgtttcagaaatggcccctgtgtgctttgttatttgccgaagaaatctctcctgggtgtctcttgcaatgtaagagcttgagggcggaatccttgtctttggtgtgaaaaaggaaggagggcagcgaagggcagagtgtggaatcccactgctccctggctcccagcggctcctgtctctgcatctggctggcaggctctccctctgggttgaaggagaaggaggcgaatgctgcaaagggtcaaagcgcttccccagaaactcagccctttgtttccagtgactcttgtactccttcaaggtgaatagaaacttttatgtgagtgtttcaaaactgttataatcagtttgtcctacatataaaagtttgcttcccagtttgtcactggtgtggcctcttttctaaccagacccggattactcgctgtttctggaattcactccttgcacatccttctctcagcctttgcatgttgtgtttctcccatgccagctgagctgtcttttttctcctttacctcttccctgacccagccccaaactaaccattcttcttcaaactcactggtagggttcacattctgaaccagagtaatgctcaaaatattcaccaggttctcagaggtaaagcagggtcctggagcccccaggctatgctaacccagaaacctggagttgctacattgtagggaggcctagagagcactggaagacaggcaggcaagcccaggtttcagggagccactaggagcttgggaccagtggctacatatcaagtaatatggaaggctgaaattgttaaaaatggaatcaccattagcgcaggccggtatgaacctgctgcataccctccatgccttatcaactccaggcattgtggagcacagtgctgagaaaaactgtagggctgtattcagagtgggtagagaaggctactgtaatctgtaagcagtgtctaccacagggtagggcagtggggagtgttgaatgtgctgtctgcccaccctgtccaggtgcactccttgtcccaccttctcctcagagcccctttcagactctcagtttcataatacctttcttgctgtgaatttcatatgtatacaacatggcataacttagcatttgagtcattattgtcattaaaatgcagttattgaacatctactgtgtttacagcaaatgatccttcttttcaaagagaagcatcctctctgctctcagaaattacacacctggcatggtcttatctttgtagaactcagagttcacagcagatgccctggccttggccatctcctccgaactttctgctctcctggccaccgtttgacagccacccttcccctttttatctcatttgcccttatggtttgacccttactttttgtttgtttctccatcttgatcactcatcacaattctggtttcccatttggcttttccacttcctttctttcaccacaactccagcctgtggatcccgacactacttccaactaccacagccacagccactgcaccaggtggcaagactcaaacacagcttataagagctagaaaggagaaatcacagggatagtaagttcaggaaagactttatgtaagtgcaggaacttggcttggatatggtagatgcaaaagctcaaggtgggactgtgggaaacaacaaactttattctagtctatttctttgcaagagttattcctgtttccctaagtatataaaagaaacacccttttatgtcactcatggtgttaaatatgtgatatacggtcaggaaatatatatggatgaaggcactaggtgttgaggaagagaataatctttgaaggaagtaagattaaatcccagccttaccacgtaatggatacaaaatttagataaagttttttaagctgtctctgcttcagtgtccttcatctacatggtagagataataatgcctactttacatatataaagtgactcctaggatattataggcattgaatcactaagagctgataatattatcataattatttttatagcctcactctgctcaccatttcttctcacatgttccccatgaagaccatagtcctgtgagtaatctctagcctgctcgacaaatggccttttagaagtacaacactaaaggttatagatcagtgattattagtattttatagggcacacacacccctttaagaatgtaatgaaaactatgaacacattttacttcacataacatttttgaggcttcattgatgcctgtgaagctcatccacagacagcagcccaagaactccaggttaaattttagacaaggaaacatttatatgtaaaataaaactgtgtttttataaattcctaataaccttctataagtgttccttgttgaatcaccaggacgcctagtaagtagggaccggacactggatttgttccatataagccagttgggcgggcttcttagaaacgcttcaccttttgtcacaagattcagaagacatctctatgtgtcaagttctgagttattagaaaatgcaaaaaaaaaattatataaaagtggctttctagtagaaggtgggtaactaataaaacaggtaaataggactccaagttgtccagaaatagcatgtgcaaaaaatcaggtactttctctagcttgagatagggtggactgtgaaggaataaggactagaaatgttctctctgcccacctcccaggctgagattcagacctcttcaagtaggtgcagttaccggccgggcacggtggctcacgcctgtaatcccagcactttgggaggcccaggcgggtggatcacgaggtcaggaaattgagaccatcctggctaacacggtgaaaccccgtatctactaaaaatacaaaaaattaaccaggcgtggtggcgggcacctgtagtcccagttactcaggaggctgaggcaggagaatagcatgaacccgggaggcggagcttgcagtgagccgagatcacgccactgcactccagcctgggcgacacagaaagactctgtctcaaaaaaaaaaaaaaaaaaaaaagaagaaggtgcatttaccggggaacacatagcatacagatagcaaagaagcttgccggaaaacttaggtcccagcttcctgcagaagctgacggctgtggggagactgaagctggggtcaaccatgcagattccctgggactcccactgaagaacagtaatggaggacaggaacctggaagcatcttccagcctctgtcaccctgcagcggccctctagtgccccttatggacaaagcataacattcagccagtagacaaaagagaaatgtttgcagggtccaactccgctaccgtttgattgagcaatttcactactaggtgtctacccagaggaaaataagtccctataagagaaagacacttggacttgcatgtttatagcagcacaatgcacaattgaaaaaatatagaaccagcctaaatgcccatccaccaaatggaaaaggaaaatgtggtatatatgaaccatggaatactactcagccataaaaaggaacaaaataatggcatgtggagaaacctggatggaattagagactattattctacgtgaagtaactcagtaatggaaaatcaaacatcagaagttctcacttataagtgggagctaagctatgaggatgcaaaggtataatcataataaaacggactttggggacttgtggggagggtggctggagggtgagggataaaagactacaaactgtgtgcagtgtacactgcttgggtgacaggtccatcaatatctcagaaatcaccactaaagaacttaccgatgtaaccaaacaccaccaatttacacaaaactattgaaataacacttttttaaatgtaaaaacaaaatgcagggcaaagaagagtggctttggaactgaacttcagaataaataattagcacaactgccaatctcttttcttcttttaaaaatttgggttaaaaactagagaccttggacatctggaaaagagagttgggaagaaacaaggagacatacacatattcacggtttcatatgtcacctgatcacagttttatgcaataccagcatgtctcacaaatgtatgaagtccaaaaccacaagtataggcctaggctcttgtaattagtaaaatgtcaatttatttaactttgtcattatgtatatgctccataaaaaaatagtgaaactactacttttattataggcccatgtaatttattacattaaaatgcatttctcagactcaaaaagtttagaacactgtataggtggacatgaattagaagtactctaataatttacctgtctacatgaagatttactgtaattctcacaaaaacttattcatatttaacctaaaaattgttttacatagcttattcttttccgctgaaattgttttatttccctgccacttctttctacgtttgtctaataccttagttcagctcatcactctaacagtacatccacccatggggttatccagtatcccccatggtggctagtgattacttcagtattttccctgatgctgtaacaaggtccaagatatgccctgtgtcagcctaggaagcaagctctctgaagcatattcaaattcatccccaaggcatcagggaaattcagtagctaaataaatatcttctctttaaaaatattaatgatcatttaagtataaaaaataacagattgactaggtcttcaagaatgtgactctgagatgaagaacaaagctaaatgaacatacgtagccttcataagccgcatttgatgtgtctgacagaaatttcgtatccaaacacattttagggtgaaggtatgctctgaaacccaccatttacttcatttatatgtgccacatggtggatgcctgtaaggacagtatgtttgtgcagctgaaaatctgatctttgttacagaaacttcaatgctagcttcccaaggtaaatggaagatccagcagccccagaagatgactttggtagaggattatatgtgcccatacacacggaatgagcttgcctagaagctcatttcatgtgcatgggcacatataatcctccatattgcaatcataatgaatgctttctctataggcttctagtaaactggagtgcattttatcaaacttttaattccttatgatgactggcaaagaccaagaaaatctaggcttttttttcccccatgtttttacccacaaaatcgaatgcttatactaggatttgacaatccacgacatttgggtaaaacttccagcttgtgacccaaagatttttgcaaccctcatgcacactacaggaagcagtcagtctccatgattcataagagtccagagatcattaggtctaagactgctctggaaaagtacaagaatcacagtcttctcaacaatgtaactcaacaaccaaactataagctaataaatatcttgtaaatcacattgcattaccattattcatgaaaaaataatacttatagattataggaaattgtgtaaacaccgaaaatcagaaagaaaagaagtcacccgcaattttatcaaagcaatcataaatactatacaggtatagattttttagtcttcatttcaaaaggactactttggtgtaattttgtgtaattccttttcttgttatcagtattctgccatgaaaataacgtgttgatcatttattacatgccaaatattgtgtcaattgatttttatatttatctattttaatcctcagaataaccttataaagtggatagctctttgtggtttcagtttgggaaaaatgaggttcggtaacattaaagtaacttccccaagatacgtaactagcatgtgatagaatctgctttccattagtggcctttctaatgccaaatctgtgcttagctgctgtgatgtgcttaacacacgttttatattttgctctaatcactgagtttctaaatgttaactaaaatgaaattacattataaaaatggtgatcgataaatgttgaataagtgaatgcatttttaataagaagagaaatgagtaattttaatttcctgtaaagaagtgagcacactacaaattggaggtgcatagtaaatattcattgaagcttatgttgtgatgattataccaagatgaacttgaaggatctgatgaaaggtgaagaagaatgtcttcctaagggagcatcttctcatagaaggctgagcctctctgtacctaaagatctccatatacacttaagagatctgttgcacagtctgactcttagctgcctggagatagagtgtttgaagattgtcttcacgtgtctccctccactaaatgttttctccttccctgattcagcagaggtggcaggacctaattaaaaagagccctgtgtgtggcagaagatgtggcttctccagtcaattgggccactacgtagctagtggaatccattgtttaaagttcacaatgaactcgttctttctggtgctttccatgattgagaattatgtcctctggataatgtctaaaatacttttcaactcagcggtttcattaagaaaaactattaaaactccttctatcactgtattagtctgctctcactgccaaaacaaaataccacagactgtttgactaacacaacagaaattattttcccacagttctggaagctggaagtccaacatgaaaatgtcagcagggttgattctgagggcatctcccttggtctgtagatggccctcttctccctgtcttcacatagtctcctcattgggcatgtctgtgtcctaatatcattttcttataaggacaccagtcctgttagattagagtctatcctaacagtctcattttaatttattcacttcatgaagtgtactgtttccaaatacagtcgcattctgaggtactgggggctgggccttcaacacatgaatttagaggaaacacagttcagtccacaacaattagactctgcaaaccatctaaagagcttgtgtgagcagtctttaagacctctcctccaactccacttcctaaaacaaaactaaaatataggattttcagctccatgaagtagtcaggtatccagatccttctgaccctctgcttggccattccaaccctccatcttccattctgagagtcccaataggctgctggagcttgaggtattctatctgcatgccaggctgcagaagaaaggaagaagtgaaggcaaaggggatattcctcccagctgagtcagctcccttcaaggagccttccagtaagtcccatccaatgctccttccatgccatgccttataggtctgacttagtcacctgaaaatacatgtctgcaagggaagtggggaaatgtagtcatccagttgagcacattcttgcctcaaacaaatcattatttcactaccaagaaatggaggaacaggcagagtgcagtggcttaattattattaattattacacctgtaatcccagcattttggaaggccaaggcaggcagatcacctgagatcaggagttcaaggacagcctggccaacatggtgaaaccccatctctactaaaaatccaaaaattagccaggcatggtggtgtacacctatagtcccagctacttgggaggctgaggcaggagaattgcttgaaccagggaggtggagtttgcaggggaccaagaaggcaccactgcactctagcctggacaacagagcattgttgtccatttcagaaaaaaaaaagaagaaagaaagagagagagagaaagaaagagagggagggagggagggagggagaaaggaaggaaggaaggaaagaaagaaagaaagaaagggaaagagaaagaaagagcaggaataataattaatttttgttatataactagggatctttccacaatctctttgaacaataaagatcagtatataagagttcttatgtaagaagtaaaacaatttctaccttagtgtcaaaattggcaaaactatcattactattataatgatgcactagatttgtgtcatccaatatggtagccactagtcatgtgtaactattgaacatttgaagtaagtatgtctggtgcaaactgtgatgtgttttaaggcatcccagatttttaagacttcatataaaagtaaaataattttatataattattatgtaatgtttttaataccgattgtatatttaaataatatttgcatctactgagttaaataaccctgtattaaaatataaattaagttactctgttttaaaaaaaattttttttaaatactgctactagaaaattttaaattacttatgtggtatgcattatatttctattagacagcattgacctgggatatcaccccaaatgtcagtatttcagtagcagatttccttttacttttttattttaaaacatttaattgaaaaataaagatagtatatatgttcaaggtgtacaatgtgataatttgatgtatgtatacattgtgtaataattaccacaatcaagttaatcaacacaaccatcatcgtctatgctgtaaattagatcccaggaacttgtttgaacatcttataattgaaagtttgtaccctttgattaacatctctccatttctcttaccctctaaccctgacaagtactgttctattctctgctcctgtgagcttgacctcttgagataccacatatttgcctttctatgtctggtttatttaactcagcataatgacctcctgatttattcatgttgccacaaatagcatggttttcctctttcttatatatgtatgtgtgtatatatatattcttatttatgtatgtgtgtttatatatatacacacacatatggagagagagagagagagatgtcacaatttctttattatctgttgagggacactaaggtagtctcatgttttggctattgtagataatgctgcaatgaacatgagagtgcgcatatctctttgagatactgatttcatttctttcagatgtatactcagaagtggaattgctaatatggcagatctaccttttggtttctagggaacctccatgttgttttgcataatgcctgtaccaatttacattactaccaattgtgtacaagccttccctttctctacattctcaccaatacttgtacctttttttttttcttttggatagcagccaccctaacaggtatgagatggtacctattgtggtttcaacttgcattgtggtttggatttgcatttccctaaacgattaacaatatgaatacctgttggccacttcaatgtcctctttggaaaaatctctagtgaaggtctttgctctttttattatattatttgggttttttgtttgtttgttttgttttttgctattgagttatattatgagtttcttgcatattttgtatagtaccctcttatcagatagctagcttgtaaatgttttctcccattctgtaggttgccttttcattctgttgcttcctttgctgtgcagaaatttgttagtttgatgtaatcccacatgtctatttttgcttttgttgcttgtatttttagtgtaatatccaaaatcattgcctagaccaatgtcaaggatatattcatctatattttcttctcagagtgttatggtttcaggtattatatttaagtctgtaatacatttcaagttaatttttgtgagtgttgtaagacaaggacttaatttcattcttttgcaggaggatatccacttttctcaacaccactggttgaagagactattctttcaccactgtgcaataagtttatttctgagttctgagttctttgttctgttgatctctgtgtctgtttgtatgccagcatcatactgttctgagtcctatggctttgtggtataccttgaaattaggaaatgtggtgctttcagctttattttttcctcaggattactttggctatttgaagtctttttcggtttcatacaaatgtaaggatttttttattctacttctatgaagactgccattggaaatttgatagggattatattaaatatacagatgactttgggtagtatgaacattgtaacaatatttattcttattactcgaacatgggatatctttccatttttgatgctattgtaaatgggattgtttattttattttcatatagtttgttgttagtgtatagaaattcaacttatttttgtatgttgattttgtatcttgcaactttaggaatttatttattagttctagcaaatttttggtggagtccttatgattttttaatatataatatcatgtcatctacaaacatagataatttacttctttctgatttggattttttaataattttactttttcttgcttaacttcttaggctaggacttccagtaccctgttgaatagaggcagcagaagtggtttgtcttgtttctgatgttagatgaaaagctgtcaacctttaatgttaagtatgatgttagctataggtttgtcttatatggtcttatatagcctttactatgttgagatacattccttctacacctaaatcgttaagagttttttcatgaagggatgttgacttttgtcaaatattcttttctgcgtctatcaagatgatcgtaagatttttatccttaattcctttaattgatttgcatatgttgagctatgcttgcattgcagcctctccttatttaatttttaattaaaaatatttaattattattatcattattattattattttgagacagaatctcgctttgtcacttagactgaggtacagtggtgtgatctcagctcactgcaacttcctccttccaggttcaagcgattctcctgcctcagcctccctagtagctgggactacaggcgtttgcctccatgtctggctaattttttatatttttagtagagacggggtttcaccatgttggccaggatggtctcaatctcctgacctcgtgatccgcctgcctctgcctcccaagttctgggattccaggggtgagccaccgcatcctgccttaattaattttttaacttaaaagtacttcattgaagataattacacacattccttcctatgttataaatattactgattaaattgagaagttgacttctataacatactcattatttgttgatggtactttcccttcacacacacttgctatttgttctatttttactcaagaacaaaggtactcatattttcagagctaagaatattttttcctgattaaagtgaatttagtctagaaaagcagcatatacttgtatgtgaagtggaaagttgttttgtttgtgggctaaaaaaagtagtttggagacaaaagaaaaccataaatacacacacacacacacacacacacacacacacacacactccacttccttcagccttatgtgttagtaagggttccctagagagaatcaataggagactgtgtgtgtgtgtgtgtgtctgtgtgtgtgtgtgcctgtgtgtgtgggtgggggggtaggggaaatgattcacatggctgttaaggctgagaggactcacaacatgccatttgcaaggtggagacactgggatgtttatagcgtgactaactccaagtttgaaggctggagaaccagggaagccaatagtgtaactctcaggctgaggccaaaggcctgagaacccaagggggtggggtgcaccagtgtaagacctagaggccaaaggctgaggcgcctggagttgttgttcaaggacaggagaggaagagtacatcccagctcctgcagatagatgaacatgttcattttttctgtttttgttctctctaggcccctagcaggttggatggtgcctgccaaacctgaggacagatcttcccctcctagtgcactcagactcacatgtctcctctggaaacaccttcagacacacccacaaataatgctttaccaggtttttaggtattccttaatttagtgaagttgacacctacatttaaccatcacaccttactgttataatgacttgttgcttttgccttatgtgagtagactggacgcatgactaaagattgcagtagaggagacaagcaattctgaaattatgcaaaagtagaaatcatttgaaaagtagtagtcattgggtttcaaacctagatgcttctattcctacctggattacctgctattatttctttcagcaatctacactaatttcctaatagcaattactgatcctgaatatttttgtcatgaaagccttcaaataaattcacatacagaaaactgtttaactgaaactcctagtataaagctatacctctttattttaaatacattggaaatacaaaagattttaagtatggaaataaaaattgccataattccaccacccagaaagagtcactatttagtatattagtcatggtcctatgcctacatatttatatgggtatatttcacctgattcatatgtgtaaatttgtattctatttgttcaatttaatgttataagcaattttcttgcttgccataaacatcgctactagtggtggcaaaatagtttttcatatacatataccataatttacttaaatatttatataatttcagacccagttttttattattataaataatggttctcagtgtgtaaatcttagtccaatttcaaattatttcctgaagacttctagaagtgaaagtagagtgtcaaaaggagtattaatatttttgagcttcttgattcatagttccaaatagctttgtgcaatatttgctaacggatattaaaaagtagatttgggagggcaaaaaaagaagcaaagacaagagaccatctctgaggccaaaggcagcatgtggctctagtagttccctgtttactggtgcctgtgcataggcagctgctgagaggccagaggagaggtcatgcagggcaccatcttctagcctgtccatgcaccatggccattagcagggccttccttccatttctaaaaatgtgtctctcgtggatgtctctcaaatgaaaccctaatgtgcacgatctttatccttgaaggcctcctttggcagaagcagaatgttgcctgtccatagtaatgccacttgtttagtttcacttaaattcctaacatgtattatggacttcttttcagtacttgtcctttccggttttctcttcctccacccaagtcctattcccagcttcactctcttccctgttttctcttcctccacccaagtcctattcccagcttcactccttcttacttgtcctacaaagctcaaatccaaaggcacctcataaagccctgtaacaatgctttgttacatgctctcccagcagaatacgtgtctccctcatggcacttggtcatagctgtgatgacatgttccatgacccttatcctactgccatgtaagctctaggtgggcgggtctgagtctgtctcactccttcactgtatccgtagtcatgagaatcaaggtggcccatatgaactgcttaatagagaactgctaaatagagaactgctaaataagtcaataaaaaaatgaaggagcctgtctttcccaaaaatgaaaaagagccttgatttgattcccgagtcaccctgagtttgtgaataggaaggtagcttgagctcacagggcagtcttttccctacatttgctgacagcgtgccagtcagtgctggtagttctcagacaaatcaaattagaaatggttgtactcatttggaaaatcaagaactggctttgaaatctttccccgcaaattagattggatgaagatcattttctccagcttataaatgcttgattggctttgtttgatgcctcatgactgaagctcagctttgcactgctagctttattttttactcaccagggtgttgtggcgtctagatgatgattaaaaacaaaacaaacacccacaatgaaaaagttttgtaaataacagctcagcacagtaatgtaacccttggaagcgtcacacataagaaacttgaaaaatagccaagctaagcagaacttcaagctgggcctgctgtattctcttcaggtcttaaaaattagtttcctggagtggcgggacagccacacctgacttactatttcctctcaggaataatgaaggacgtgccaggatctcactgtccctacggtagaggagtctcaatgggagcagactgtctgtcttccttccatcttcttcaccaacccatgcatcccctttctctggcttctgccttagtcacctgattggattcagatgcattctcctttcagtcgtagcctatccatagctacctggatgtataacctcaggtcttttttcaacaaagagtagtcccttattcttgttttattcttcccaggtgactcaaggtcagaccagagctttactgttgagctggtaagcagtgtttgaagcagtggtgacagcctggttgagaatccgctagagaccatggatcttgcatggtcctcacacgctttttatttatagctttttttattttcaggttttcatttaaagcagagcagccaacaactttctggagtcttccacaaaatagctaaatggcttgagtcactaatagtaaacagtaataggtgtctttgggtagtgaaaggagtccaaaaggaatgtgcttgaatatccaaaataactgaccaatgtttgactagaggtataatgcccactaatagaaacacctctgagccatttaacagtgatggttcactttagcataacctattgtctatgcagccaacatagggttggcaagtaattcagtaaaagtcttgaaagaggatggactcctagcagaaatataaggcaaagccagcatccaaatggaaaattcaagcagaattgtcttttcttgctaagttctaaagtttttcatgtacatcaatgacctcaagtgaaataaccaaaggattatgtttaatcataaagccaggaaatgagtacaaatgaagccatttgttaagaatgtctctcttctcatttctgataggtacttgttctagcttagtaaattatggtttctatgccacgtgctgagacctggcaaaaatacccagtgaccaatgaacatacgagagtccaggtttaggaatgtttgactaacatggaggcctgagctccctgttcaatacatttcagtctattctttctattatacaatcacattcagaccactgcagtggttccatccttgtgtctatcagcagagcagcatcttctgaagttcttcgtctgtgtaacagataagtgtaaattcattcgattggttctgtagtcacatgacaaagacttaactactactgtgttctctgtgtcaaaagtcttgaggaagtaaaccttctgccatgacactcctgtccatcagtcatgagatgatcatggtaattacactattactgcaatatctccttttggatgagtttctctgcgacagaggaaagcttttaggtggatgggttttattggatttccatcagcatatggcacacttctggtttagtggcagaatggcctgaatacgtcttcaaggaaggcgctgcttagaaacttcattctctctcacggtttgcttctggttttcattgcatagtccctgaactggcacctgtctaagtggctgcatataatttctcccattttatcttctgcaagaaagttgcaaccattgtagttcctcatacagctcagcattaatctagctttctctttgtaaaatattttaggctacagtttctggggagggggagggaaggggaaagcataatcagtcaattggttattatactcttgtaagtgtgttttaaaatatcaggcttcttatttactttttaaatagagattgggtctcatcatgttgccgaggcagatctcaaattcctggattgaagtgatcctcccacctcagccgttctaagtgctgggattacagatgtgagctaccacgcttggccttcttatttctttaacacgtaaaaatatatcatcttttgctcacttactttttattttaatatacttatcatggattgtgattcttggcctctttcctgcatcaagacaggaattattagggaagaggcctaagtttccctctttagagcctgcatcattcaaagaaaaagtcttctaaaatgtaaatacttggttacacttctcatgccaacaacagaatgattcagatgatccccaaatcctctccaaagacaagacagatgttaaagatgtgggtcttcagtctcagatacccaaggttagagaaacaagtgggaatattagggccctccagctcaatagcctcaggttacaaaaaagaaacctaagcctctagaattgacttacctctggccacccagaaaagcatcagatctgggaaaagggagaaacaataagccaggagcaatgctagatacattgcacgtggtctcatgtggtcttaaatcatcccactactattattccccagatcatgaaggaaacaatgaggaccagagaaaggcatgtttttttttccctaaatatttgtaacaagaatctagttctgcctaaatttaacaccctcacttccttcagaattcagagcaagatgatctataccaaattgtaaacctattgtgtaaggcatgggcagttatcaaaaagtagctaattattacaaggcagtataagaaacataatagatttccacaggtagcacacacgactgtaagcccatggagaaggcagccactgtgggatggatgtcaggaaaggtctgggcatgggcaagcccagaaggcttgctgggccctgcagggcaaaagtggggatggagggtgcagaggaatgaagaggtcatgcctggtggaggaaggaaggcacaacgtatgtctagaggacagctttgcttttagtgtgtctcttcactctagtgagggtagtgccgatgacgagggacacaatccaagggaggtgatggtctatcagtagtcagcaaccatctgtgctttcctgtttgaaatccattgtactctcagagaagaatgggaaccacacttgcccctccagcaccttcctcagtcaacactttctatcaattgtactggcaaatttctcatagatctgttttcttttctcactctcccacattgttattggtattaatcagtgttctccagaaaagtagggccaggatctctatatatgtggaatacatatatgaaagagaaatagatttgaaagagagattgagatttataatgaaaaattggctcactggactacagagtctgggaagtctcatgatctgcagacccaggaaagtcagtgctggtctgtatttgaaggcctgagtaccagaagttgtaaatcccagcctgaacgctggagaagacgagatgaaatttcttgatggagccaagaggaaggaaaaaaaaaagtacaaattcctccttcctgtgcattttactctatgccctcaacggagtggatgatacccacccacattggggagggcactgtactttgccaagtccaccaattttaatactaatctcatccggaaacacacagcgccacacccagaaataatgtttaatccgggcacctcatggcacagtcgagctgaccaaggaaagactgtagtgggtctctagagaagtgttgaaaaaacagtattctttacaattgttagagaagataacgggggctactaaatggggttttatagtagcaggaaagattgggctcagctctgaatgcaataaagaaaagtggggatttatagccaaggagtagggtgggggtcagggaatggaaaattacttagaggtagggtacttctttgctaaactagcccaacaggagctttgttgaaggcagacaagtgtgataatatatccaaggaggtcagaccaaggtgggaggttttggtatactgaactctgcagaattcttgctaaaactggaaaaaacgggacatggacagagcccaacatcacacctagtacaagggaggactcagaggagcctggctagagttagatcaaggaaagagtcttttgccagaaaaaacagacattgtctggggatccctaggggcaaatgtctactccatctttggcccagcacttctgaacatcttggctgttcgagaaggggcatgtatgacagtgaaaatatagggcactaagaactaccatcttaggaacaataggagacctacacttggcgggaccagtgacttgtggcagttgctgccctgggtggtctcattatcatctggaacagcagtcacagtcagacagaggagcccacggttcaactggagctttgggggtgtggtaaggaaaagcactcagaccccaaggatttccttccttccttgaagactgacttcctttttggacaatgaaagaccctggagttcttataagatatagggaggaaaaaaaggacccatggcagctcactgacttcctttcaatctcacttatgaggtcaaggccagtggttttaccttgaaggtttgatcaatgcatccttccttgccaggcatactttgtaccaattacagtaaattagagtaagtacataaagtgaatttaattactacagcatgcaaaggatcaggtcacatttatgtgtacaattaactaatccctgtgcttagcacaattttataatgcttgaaaaatcttgaatgaatgttgaaatcttgaatggaattaaacatacagagggacaaatgggctttggggaatgaaacttccttctcgggaataggaggaatgatatttgagaaagagattaaaagatatatagggtagaatataggccactgaccatttgccatgtctcctttgacacaattctaaagtaatgtcttctcacatggcttttctaaatggccggtgggaacttcctcaaatgccgtcttgagacagattctggagacacaaatggcactactgaaaatggtcagtccatgttgatttcaaaagtagcatttttacatgcagttcatttttcttttttctcctccctttggtgaataggggtgacactgatggccctcaacactgtacgtcatttctgtcagcagtaagcacagctgagacaggactgtcagaatagtggcacacagcagctatgtgacaggaaactgagctgccaacactcacgtgagcccagagagctgggtcagattctgtgtagaaggaatttcccatccacccacatattttctctcctacttgcctttggatttgcccttagagaatacagtagaggcatgcgctaaagacaaagaagttttagatagctggagtggcttcacaggggcaagaatgatagagggaagtgtgaagggaatcgggggaagggagagagaagctggcctaaggtgagcgagggagctgtccaaggaccgaaagcatatcccagtgcatttcaaagttttcctgctttctgttgagctaggtgtgcatccccactcacaaccttatcttaatagtgacaatctctgaaggcatttatttaaagcccttgctctggagaaccaatccaggaactccttagattctgagcaaccctgtattgtgctcaagaagttgggcccattaaacaatgaaatgaagggagactgaggaaagagagccaggcctctggtcagatgtgagcaaactgatcaaataaggaaagaatctcaggtcctctactcctccactgtcctgaagccgccttccatggctgtgatccagagaacactcagaagagggcttgggtgaagctaaactgggttttagataactcctggaaaggggatacttttgcaacctcctatgcctttgccttcttcatctttgtgaacattcccactctacacaacctcagactttgaatgcagctgtgttctggcagatttgtttttacaaaaatgatactgacctcaggaaaggaaaagataaataaaagttattactacttcctagcttctctgcagagcatttgtgatttggcttcttccaaaagacagccctaccacaatgagttggccatcattggtgatgtttttattcttgaaagggaatttaccagagatccaaaaatgcaaattaaaacaactgtgagataccaagagcaagttggtggatttttttttaaatggtagcactcagtgcagaggatggaggtatcagagatggtggctaaaagcaaaagcctccaagttagacaaacatgggtttgtctcccatgtttcctgctaactaggcacatggcttttgctaagttatttattctaagtctggcttgtgcaccctttaaatgaagaaaataatacattacggcattgttgtgcagaattcacaagatatgtatgtaagtgcctatcctattgcctagcacggtggggatgatatatactgtgggtgattgcttgacggatatcaaggtccttaccctttgacacattaattaacttgtgaggatctagcctgaagggaagaaaacatctaaacaactacaacaaatgattcatgcaataatatgctcatagcagtgtgactgatggatgaatcattagaaatgtgctactggtagaagtttggggactgctattcattttcaagaatacaagactgtcataaacaaacatggttggcacctacggatgttcttccaggtagaggcttttggaatcaaaccactacgctgctctggaactgagaactgtactgcgtatctaactctgccacctggccacttctgtggaaagttaaattcaggtagccattcaggttagggcattccccttgtgggatccttaccttttttttgctatgcaaagaataatcttcttactcttcttttgggttcgatgcacacttaatattccccatgaccagtcctttcatctactcctcatctatgttattgaaaatacttttactaagttaaatatatggcccatgtcactgcactgtttctaagtttgaatgaaaaccattcaggaagcatcagagggctttcaagctctgcctctcttcacctttccagacttacctcctttatgctacccggaccttcctgtcccacgaactacttagaaatggcagtttccctggaatttcatagggatgctgttttgctaatttcttcaagcctttgctgaaaatgctagtcaagttacccccactccacccctttcctaattccttcctttgttttgttttccttcgcataacctttgcttgtccagttatttctcctgtccggctcccgctggagctagtatctatcccttttttagcacgttccacattgtgagcttggcacatagttgacttgccataggtatttatataatgagtaaatgtaattatttttacgccccttagaaagtgtggatacttccatcccccttccttctgggactctcagatggccctctttgcagatagcattgtgatccttaacaaatgagcggaaaacgatcttgtgagtgtgtctgagcaaagccgacatttttttcttctttaagatcttgccgctgaatgtggaatgatcctgaaattaaggtcagctccaggtggttgtttatatcagctgtcagattgcggaataaaaaatggcttttatatgtttgacttttattgttttccagggcaatgtcactttttcctgctccgaaccacagattgtgcccatcacatttgtcaactccagcggcagctatttgctgctgcccggcaccccccaaattgatgggctctcagtgagtttccagtttcgaacatggaacaaggatggtctgcttctgtccacagagctgtctgagggctcgggaaccctgctgctgagcctggagggtggaatcctgagactcgtgattcagaaaatgacagaacgcgtagctgaaatcctcacaggtactgtctgctgacactctggatcagcttcttgtttatccaagtcgacaaaggttgaggtcctgacaaaaacatacagaatccaaatctcagggatatgggttagcccagtattcacaaatgtactccaagtctgaagaggcagcatttttttttttttttttttttttgaagatggagtcttgctgtccccaggctggagtgcagtggctcgatctcagctcactgcaacctccgactcctgggttcaagtgattctcctgcctcagcttcctgagtagctgggactacagatgcacaccaccacatccagctaattttttttatttttagtagagatggggtttcaccatgttggccaggatggtctgcatctcttgaccttgtgatctgcccgccttgggctctcacagtgctgggattacaggcctgagccactgtgcctggccagcatttttttttcttagtaggaagcaaaacaaaaagtgaatttataattagctatgtcaactttggttaagtgcttaaatttcttagtctcttagcagtctcattggaaagatgggaataagaattcttacctgggagtatttagcataatctagaccatttatagaactctctgctaggttctctataaacatggcatgtttcatatggaatcttcaccatgcttacggaaggaagttactattttacacttaataaatgaggaaatcagaagtcatggcaatcacttcaaaattccacgttcctaagtgatggagctgggaatttatcctgaatttgcctgacttccaagtctatattctcctcttaaaccacattaccatggaagtttgtataacccctaaattctatttcaagtaaaaatcagtaaatttaaaaccatttaaaaaatatatatgtatacatatatattttaaatgtattgagtaaatgctagtacatatgacaccagggaatgggaaaacttttaaatggtcctcaaatggccaaaatttgggaaacactgattcattgccatgtactacagatcttactgcctagcaatacacagcaggtcggtgaacaaattgtatttctggataccctggctcctccagctgctgtttcttcaacatgaaacagtggaagtctctctctcattctctgttatgttaccaatctctgatgtccttcaagcagcggtgtatttactaagttgacaaatactcattgaggtcaaatctcacatgccaaggattgggcagggattggtctgcagcatgctgatcgatgaagaagttctttcagaagtctccctgaataaacaatctgaataaaaacctccctctgcttttcaccgcaggtcaacatccatcatggattatactacaatttaatttagatgcctttttctcaactggactgcatggttcttttatccaagtagattagcaaaaattaagttaaattgtaaaggatatgacttaatagttgtcgacctaaaaggaagaagccaaggcaatattaatataagtagatagtttatttgggccaagcttgagtattgcaacctgggaatatagattcaggttgccctgaatgtatattctgctctgattagctgcagttagaagcagacttttaaagaaaaaaaaaaaaaaaaagaggcagtttctatgttgtttatcagaaatttacattaaaatcataccagctaaagattgcctgtgcattgttctttgtatcgcagattccaggagcaagaagataatgggtgaggcaggtagtcaggaaaaaaaaatgactttaaacaattgcctggagcatgggtgccttgagctcaggggaagggtgtgtgactgaagtttcatactcatgcctctctgggcccaatatactttgcatcactcacatagttcagactgctctgagctgtttttcttttctcatagttatggtcatgtcagaccgtgggagacattcaaatgtccatagtgaacaaaatggcccactgaacccctgagcatagcagaaaggcctgagtctggaagtcaggcagtcaagtttaaaagtattaatatgttttctccttcctttcctgtggccctggataaactttgtctcatatgcaaactgaattgtattagttatctatagttgcatatcaagtgacagcaatatttaatggttgaaaacattttttattatgtctcagtttctgtggatcagaaatccagggacaacttggctgggtgactggctcagagtctcccataaggtcacaattgaattgccaatggggactgaagccatggcaaggttcaatggaggaagatctgcttccgcactcactcatgtgctcaggaaggccttagaaaatccacttccacatgtagggaagtttacatttttaccctcaagttatttgagaataacttgagtctataaaagaaatgaattacagacaaattaacaggaaaaaatgcacacacattttattacatgcacacaggagtcacaacgacatacaaaatgtaaaagcccaaagaaatggcagatggttgatgcttttatatcaccttgagattatagaaagaactggcgtttagagcatggccaaaatcacgttatgggccaggcacggtggctcacacctgtaatcctaccactttgagaggccaaggagggcagatctcatgagcccagaagttcaaaatcagcctgagtaacatggcaaaaccccatctttacaaaaaactgaaaattagccgggcatgtgggtgcatgcctgtagtaccagctactcgtcaggctcaggtaggaggatcagctgagcccagggaggccgaggctgcagtgaggcataatcacgccgctgcactccagcttgggtggcaaaatgagatcccatctcaaaaaaacaaaacaacaacaacaacaaaacaggtatggtagtaaatcaggttatgatggcaagacaggtaattgaggggagagaaaaggaggttctgtttaccaaggtggtcttaaaatgtaggtgaagccatacaggtatcagcccttagagagaataaatgacaaatgtttttttcagacttttaaatgtttggactctcagtcctcgatccatacaagggagagccttacagaaagccttgttgtagcaatgcaggttttctctacagatgcaagtcccccacaaaagacagctttgcagggctacttcttttggaacagccctctcaaaatatgtcaaagaagtacattttgaggtgaaatattttagtttctttcacaagcttcctcatgagcctctccagaaggctgccaagggtgagtgagaaaaagcacccaaatagaagccgcagtctttttataatctaatattgaaaatggcatctcgtcacttctgtcatattctattccttagaagcaggtaaatatgcccagcttgtgtccaaatggaggggatgacatcaggacttggatattagcaggcacagattatccaggatcatcttagatattgcctatcacaagagataaaaaaaaaattatgttggtgctggcaattaaatgaggtagtatatctcaaatactgaacaaagtgttgagtagctatttaacacatttttcttccttccgtgctgactcaagagatacagctagaaggggcctctttctagagagtcataaaagttaagaatgaatttgtgcagtcagacgatttttataaaatttattagatttccagtaatggaggtgagttaatcacttagaattgtaatattttttcatgttccaaattataaaaattaagcctcaatcctccttatttgaaaaagaaaaacgtgagctggcattgagctgtttctctatcggtgagatgtttttgagtacagagacttgtaggcctcaggtcaaaaatgaagttttaatacaaggaaggccctggcagcacattgctcttaaaaatccaggtgctgtctgtattgttaagcgcacgtcagtccattaaaatgcatttatgactgaaagagagcctggtaagagctgccaccttacccagctgcagaaagggaacaaatcatcagttatttcagacccacctctcagaaactgaaataagcaaaaagaagtttttaaaatgtgcaaccagagttccaaaaactcttgtataattctctcctaaggagaatttctatgtttttggaaaatttgaacttaatgttttttagaaaaggatcaaggttttgtgtattcttcgattttcccatctgggaggaggaagaactaacaaataatcaaacaaaaacagttttctctttccttacatttctgaggaaacttgttttcaaagtacttgagcttatattggctttaaaagaagatgaaaatctcatatgaacaatgaaaaaataatgacaattgttccaataatttttgagagtcaacggggctatacttgatgcttggtatgtcccaaatgggtcagagaatgcagataatcaaaggtttatttgagactagttctaacatcctggatctaaaagagaaggtaattcctttggaaagggcagtacaatgatgcctcacaccttcaaccctgttccccgagctttgtacagtgtgcttggctttttaggaaggaagtagttcttatttagggatttttgcattgaagatcaaggagagacttgcaaagtaaatgcatcctcaaaatagaaggcatctgaatttagttattctagggatgaagtttcaggaagatgaaggacaacagtggaatctctttcttgtatttttctttgttttctatttttgtcatctcctttttttttgcaagccttatgtatgtatgtatgaggaaaggtagaagacctcatttcactgtaagggatgtgaaagtagaaccagcagccattgtagatcttctgccagttaggcattgtgctaggggcttgtcatacaaaactgtaaaaaaactcataaaactttatcaggcggttagtataccaacatacatagaaagaaactgagaatatgaatttaagttaaagtagccaaagtgatgttcaacctcagctttttccttagaattctcaagttcatggtctttacacagtatcctgctgctctccatattcattgtgcatactgtccattgcttaaataactcaaatgtaaagaacctctgcttttacatctatagataatctacagaagactcttaaggaaagtggctatttaggtctaaagctgtgtctttcaaaaacagtttcatggtggtcttatacaagaataagacttggataagaccttgggattcacactagattggaagtctgttgtctttataaacttctgtgtactttagctaaaattaactgtataatattattaagtaaataatacaggaggctgaggcgggtggattgcttgaggtcaggagttcaagaccagcctcaccaacatggtgaaacccatctgtactaaaaatacaaaagttagttgagtgtggtggcgcatgcctgtaatcccagctacttgctactcgggaggctgaggcaggagaatcacttgaacccaggaggcagagactgcagtgagccaagatcctgccactgcactccagcctaggtgacagagtgagactccatctaagaaacaaacaaaaaagtaaattatatatctatatatctatatctatatctatatatctatatatctatatctatatctatatatctatatatctatatatatatctatatatctatctatatatatatctccatatgtcaacacacacacacacacacacacacacacacacacacacacaaatattcattggccactgcactccagcctaggtgacagagcaagactccatcaaaaaaacaaacaaaaaagtaaattttatgtatgtgtatatatatatatatatatatatatatatatatatatatatacatatatctccatatatcaacacacacacaccaacattcattgagaaaataggtcatactttcttcagactctttttttggtgctcagtactgattccttaaaaggattatcatctaaggatgaaggctgccaagtgacatgaggtctacttcagtaagggcctgtctacttctaagaacattgccctgctttctgcaggctttcccattctaattttccccgtgccccatgaaacaagattagatctctcagaattcaaactgaaagatctgatccatgtggaaagccatgagtttcactagagcagagaacaccttctaggagtcttgctggactgtgaaccttatctgaaaatccatttaggcaattctccaatgaatgagcaactaccttgataacctaatttatatattttaagctcccagttctttcttacttttcataaggtaccaagtgccatggggacctctcacatggtcatgtggtcatgaggctctctcaaactccataccctttcattgagcaatagatatcatgttctatttttaatgatggatgtggttgccgttttaaaggcttttatggagatgcttagaatggagtttagtatttttcaaaacaacctgaattactaagaaaacaggacatttcataaaggtaaaggagaccacctggtttgttttcttaggaggaatagggcagactgttttgaatgtcatatgaaatcataagcaatcttaagagataaccggcaccactctaattatctgaaagggatctgacatttcaatgttatttttatttttccgatgggaaaatacaaggcaaggagaatcaaaagaaacaggcatggagttttagcttaagtttttgtttgtttgtttgtttttgttttttgtagtgcttctcaaaatgtcagccagtctggccaaagagcttgaactcaggcttcagtggttgtgcgtcagcctacctgtgctctaatcagatgtaggacatgagtaagtcttgttccgttagcctcactgtcctcatttgctgaaggagaggatcagtctagaatcatggatgctccctccagcactattcatgatttcttgagagaaaacaataggccaacccaccccttattatcttcaaagaaatcatcaacccaaggctcttcttttgaaactggcataaatggtcctgaatgattgggagtacccagggccaagccccttgccagaggtcatgctacccaactcccaaaactctggtgcactttgtggagtcagaaaagtaaacttagcctatttgataccatgaattttgtggatgagttgcttgcatggtcttaaaaaggttatgctatgactcttcacaacctgtagagaattaggagacaaatatctaaacctgaatagggttttttttttttttgcaaccttccttaaatgtgtatatgtgtgtgtgtgcgcacatctatgttggtaggagggttaacaaaatatattaggtcttcaacctatgttagtagaggaacaatattggttgtaggtactgaagctatttcctgcagagagaaatccaggcagagacacagcaagggtctttggctgtgggaccggctttcttatagctaacggttggtatatgtgaacatctctttagaaggcaaagcaagcagcagtgaggcaggcagagagcccactttggattccattaaagcatcttctccccagagcttcctagatgcacagtgtactgccctgatgtcaccagaggcatcaaactcagcctgggattttcagtattaaagagtaagtctacattttaaatacatggttttggcacaataaaatgaaatccagaagggtgggtggggggagaatccaaactaagagatctgaccctggcgctggcaccacttgctcattattagctgaaaaggcaaaaggtgaagctaatcacctgggacagacaaaatctctggacaaaaggtgacatggacagcaaagagccagaaaccaagaaaataccatgaaaaagtgtctatagtcaaggcaaatggcttatcggaggtgccatctcagcgcatcccatttaattcctaggagcaagcaatagtgtttatcatatttcctcaaccaccgtataacatttcactctttcgataattccttgaacagtattagttagagataaggtattccaaaacaaacaaacaaacaaaaatgtaaaaaacatttaagccatcctttttatcagttaattttctatagccagtagacttctgtgactggcttgttctttctctagcttgaaatatggtgagattctcagatcaacagccataatgaatgttttttctgatgattattgagcattgactacatttacattaaataaaatatgtcatcctgtagctatggtcaacatgacacccttagctttcagaatttaatctcaattgatattttctcaagaaacctttccaaggcaggccaggtgccttgtttctttggttttcttctttttaacgtttgttactaagtatgtatatgtatgtattcatctgctcaggctgctataagaaaatatcacagtctaagtgtcttaaacaacagacatattttctcagttttggaggctacaaatccaggatccagatgttggcaggattgatttcttctgagggcttctctctttgcttgcagatggttgtctttttctgtcttcacatggtcttttctctgtgcatgtctgtgttcaaatagcttctgctcataaggacaccaaacatatggaaacttattttaccataattacctttttaaagatcctgtctccaaatacaattgtgtttttaggtattaggtgttgggactttaacatacgcattttgcagggacacgattcagctcatgcaatgtatattaatatgtctatttcattgttgaccaatgcccttctcatcactagaatgtaagcaaccatggaaacaagtacattatttgcccaagccttggtccaacaccttgcttaccacacgtcttccataactatttgccacacgcatgaatacactagtggagttgacctctaaaacatttctgaaagatagaattttaacagggaaagaagagttagtagtgatttttaacaaacagtcctgttacaacaattatatgccgcataatgtgtcaaacccaggaatgagttatactcaggggggagtactaattaggtaaagggcaggggagctcccagaggtagggagatggcctggagagctgcatcgtgcaggatggaagtgctcactctgtggaatgctggcagccaggtggttataggctacggccctgcagttaacagagctgatccccaaatattgccctttctcatagaagccatttgtagctagccaccatctgcacatcaagtaaacatgacgaggccgcaagcttcatcctctgcttcaattaagttgtcattaatgcctcggtatttgagctaagataatgttaatgagaaaatcccattagcaagggcaaaaaagtggatagccacagggctgtgactgtcacaacaagctgtctggtttgagtttcagaagatagtaacatgatatcacaacaagcacagagttcgagtttcagaagatagtaacatgatgaagcatttcgtgttatggaaaactgagaaatgcaattgcctgaactttaagataccaagcaaaggttggaaatgtttaccaaagtagtgatttcttgggcgtcttcagctttttaagtttggataatgacaatggagacattgtatttcttaactcactgttattttctctgtctctcactcaaaagaggaattgcaggagatagaatttttttttatcatagattaatcttcttgtcaaacctgctatcacttccctttttcttttgtattttttactttgacaattttctcatgtaacttgaagttcctctcattggctttaggaaacttttggagtatctactctgcactgggtactgtggttgaacctgggaaggaggcactgccttccaggagctcataggcatggttggaagagacagtaaagaggcattaatgaataatagaacatgtgcctgggacactggggaagcactgggaagaggcagctggataggtgagaaagggaagactttctagaggtggggatatcacagcttggttcttaagaatgaatagaatttggccaaatatggagggaaggaaaggatgctctaataagagaagagaaatagaacgagaaccagaggtgtaagactatggaagcttagctgcctggggcccagatggcaaaagatgaagcagagttttggtcagggaccccagagtttgtgctgtatcttggagagaatagggaaataactctcttgagtttagcttaatggttagcgtgtggatgtttgatctcagcattcaagtctaccaaggaaaccacactttcaccatcaaccacaaatgcatcgtgagttcctaacagaccctagcggatggcaaagccagatgttttccctttatgcactgatcaaggcttttcaggatccaggttaccttgaaatatgagccaggcattaaacgactaggaaaggtttaacctgtgatttatggctaatgctcacatgagggcctgcttctgacacttggcagtggagattcagttggtctgatgctcaatccatcaatgaaccttggagagcgcagaatgctgccctgctgatactggggcagagcggggggtgtcccaaaacgtgactcaaactctgacccccaggtacctgttatcccactgggaagaggagactaacatggacggattgttaattaataccacaaggcagtaaatattatgagctaaacaaatagatcagacagtggatgctataggaatttagaaagagaaatcaccctgcactattctagtcaaggaaaacctgcttcattcgtttcctgatttattaacttactaatttattcaatcaatcaatcattcatcacgttttatatgccctgcactgtgctagctggctgtgatagaaagtaataaaacatatgttctctgtctgtacagtttaggaaagaatttgctgacacgaaaacttggccttggaagattgggggatggattttgatagcaggaaatggtaagggtagcgtataggtggagcagaggctgggtatggaagccccaattcactaagtatatttacttggagcataatgaacacatggtccagctggagcagggaattcttgtaaggattttggaaaatagcctgaaaagacagagggagacttgattagagaaagagtagattgtccaactaagcagtgtgattttcattctctgggctccatgacccagtggaggggtatttgctgtgaggtccatgataaccttgctctttaggtagttggatctagcaaggtgtcctctatcagaaagagacaggaggctgggaaaagagggggaccactaaagaaatttccagcttcagggataaggaatagaacaaaaataagagagggaatttgaaggcatatgtgaactcaatctaccataagtagggaaaagttaatcgaatttgatagctgatggataaacagtgtgccaggaaaacataactcaggctctaaattgtagcataatggtactagtaatcgtaatatactcttctactatgtaactgacattttcagacttccttattcaattattcatatattgcctactttattctcacaaaagttgactgtgagacagtcaacaaaagttgacagctaccttcgaattgttaaataagagcatgtatgagaggacatagaaaggccattgaattgagttttctggggaagataaagcctagaaactttcaagtcaagccaatctattttgtttccattttacagatgatgtaataggtttagagatattaagaaatctgtctaaatttccggaaatttttaagtgtcacgcacttgagcaaggaataacaggtgaataaagccatcaaggaaatctgtaacaagttatctccagggttggaaacagtctttagggactatgatctggtttgggctgtctttttgctcttgtgtgtggctgtcatggcctagggtagtcacagctgacacttaagggccctgaacagccacttggttacaaaggttcattgacaccttgcaacattgattatgatcttgctttttattttgtcttcaaaacataaaaaaagatgtcaaaatatggtgacaattgaagtgcaaagatctgttagaaattttatggaggaattggtggggttagagagaaagagagaaagaggtacaattgagagccagagtacaagagtgtgtcaaggctctgcaacctcaaaattatttctttaactcaatggttctgagccaagggaagatttccattcccaccaaactcaccttttagcccacccatcctccacatggtgaaaaaatgtgctgttggtgatggggatttgtagtgttggtgatagggttgtgctgttggtaatggaaggttgtggcattgatgatggaaggttgtggtattggtgatggagtgctgtggtgttggtgatggagcattgtggtattggtgatggagtgttgtggtgttggtggtggagggttgtggtgttggtggtggagggttgtggtattagtgatgggagattgtaatgttggtgatgaggtgtggtggtggtgatgagggttgtggtgttggtgatggagggttgtgatggtgatggagggttgtggtgttgatgatggagggttatagtgttggtgatggagggttatggtgttggtaaagaggggttgtgttgttggtgacggagggttgtggtgttggtgatgggagcttgtggtgttggtaatggaaggttgtgttgttgctcatgggaggttgtggtgttggtaatggagagttgtggttttgatgatcgttctttgtggtgttggtgatggagggttgtagtgttggtgatggagggttgtggtgttggtgatggaagattgtggtgttggtgatggagggttgtagtgttggtgaagaggggttgtggtgttgatgatggagggttgtagtgttggtgatggagggttgtggtgtttgtgatggagggttgtggtggtgatgggggttgtggtgttggtgatggagggttttggtgttggtgatgggggcttgtggtgttagtgatggaaggttgtgttgttgcttatggggggttgtggtgttggtaatggagtattgtggttttgatgattgttcctaatggtgttgatgatggagggttgtagtgttggtgatggagggttgtggtattggtgaagaggggttgtggtgttggtgatggagggtgatgatgtttataatggaaggttgtgttgtgatgatggagggttgtgatggtgatgggggattgttattaccatctagtgagcaggcgtgctgctacacatctgacacaggaggtataccacaagacacctactcctaacaaataataagccagtccagaatacccagggccagtgttgaggaaccccactttaagcccaaaccctactcttgtaaaacaaatttaggaccttagaatatctcttaactgttctgagtctcagtttcatcaagtgtgagctataaagggctgtggagatctcattatcaaaagcattttaaaagacatattatatgctctgtaactattttttgttttatctagaaagatatatcaaagtaataacaattgactagaattctaatttctgacataagtagacatcctgagaaacaaaagttgaattttcatttaattattttcagaagctaggtgattcacaaaataacagaactaaagtttgaagttggtattgttaaaagcgaagtcatttggtgggaatgtaaagtagtgtagccactttggaaaaattctggaagttcctcaaagggttaaatatggaattgccctatgactgagcaattccaattctatatgcacacctaagagtattgaaaacatgttcatacagaaatgtgtacacaaatgttcatagcagcattattcttaatggtgccccaagtggaaacaattcacatatccatcaaccataaaaacatacttaattgaccaggtgtggtagctcatgcctgtaatcctatcgctttgggaggctgaggtgggtggatcacttgaggtcaggagttcaagaccagcctggccaacgttatgaaaccccatctctactaaaaatacaaaaaaattaccctggcgtggtggcgggtgcctgtgatcccagctactcaggaggctgagccaggagaatcgcttgaacccaggaggcggaggttgcagtgagccaagatcatgccactgtactttagcctgggccgcaaagtgtactttagcctgggccgcaaaaaaaaaaaaaaaaaaaaaaaagtactgattcatgctacgtggatgaatcttaaaaacattatgctaaggaaaaaatgccagtcagaaaatagagcataatgtatgattttatttatataaagtgcccagaataggcaaatccatagaggcacaaaggtaggttagcggtggttggccagggctggaggtgcagggataaggggattgggagacagtatatcaaggttacagagtatatttaggggatgatgacatgttttaaaaattgattgtagtgattgtataactctgaatctattaaaaaccattgggtttcacactttagatgacatatatggtatgtgaattttatctcaataaatctgttaccaaaaaataataaaaataaaagcaaagtagaattcagtagcagaacataaaacttttcagagctttttggtcatcaaagagatggcaggagcagggcagggctggctggagttgccagcatgatgagcaaaaggagctcagctccagtacccacacttccctttgaacgctggctctgcctctgagcagccatggggccctgtgcagcctctccacttttctctgttacatctattacatgagggcaatcaacttgacctccaggactattgtaagaattaggaattacattatttaaagtgcctggcacattataggcatttgttactggtagtgtgatatattattagctatttttacaactggggtatttcaaaggttcatttgcaagttcagttggaaggatgaaaactgtcattctttttttctctatggagaaaattttccaagtctttatttgattcctaggaaagcgcagggcagcctatttaactctctctctgtaaggaaccctttatactgatgccctaggctgaattccagcacctgagagaagccatgagaacaaaagtgaaaaggacaaaaaagttttctgtcttttatttcagcttaaacagtttatcaggtttttttaagattataaaaaatgtacattaaaaaacactgaaaattccagtataatataaaagaatctgtgattctgtcattctacattattgcagtgttttttgtggtgttagtttttaacaagatgggaatcatgcagcacgtcctatttatttagagcttttctcttatcaagatatcagtagcattcttggacattatgatgtttaatgactacattatataccatattaggaataaaccatatttgctttagctagcctgctactatgggaaatatgggtagcagtgaatttttgctattgtaaataatggtgtcaagaactaccttcaccataaatcttggctacagctctgttactattttagaaataattcttcagaataaaattcacaggaaatgaggtatgacattcttgggatttttgatacttactggtgtattgccttccagaaagaatgtgcaaatttaggctgccacgaacaacatataaaattgactgtttccctctattctcattgagattgagcataatcagtttttatcctttattagtctgggagatggcaaataatacccaacatgtctttaaagttcagaaattgtatgtttgtcctcatctgtttctggaacccaaatcccatcttttaggcctcagcccctatatcatgggggtgcttagtgccccatattggccctcaatatcctgctcgtctctcctaagataatttttttcccccatcaagacattctcggcctaaaaggtgttgctttcctgttctcctcattggacacgtctattctttcaaagccatttatctcaaggaagtttgggaaaaaagcaatctcataaggtgatttctccctaacttgtgaataattaatagcacttccacttttacctttaagagagtatttttaataacaatacctcagagagtctctagggatgttattttggatctgttaacagaatgaagtgaaaacgaggaccaggtgaaagtggagatttttagctggggatgtaccacttcacttgccttgaaacccatgcctgggcagctctcctgggcgggtcccaatttcccagcttctttcctttctcttctgacacctccaatgacatggctcctgaccctggctgcaaacagaatccaagggacctttgaaccttccaagtcctgggataatccccagaaatctgacttaattaacctggagtgagccccaggttctgtattttcaaaagctccccaggcaatacctgcattgagaactattgttctaataattttcctccacagagctaaacttttcacccaggctcccactgcaggcattggggaacatgtaggaaaagaccaaattaaagaaagggcagaccaaaaaataaaaagaaaaaaagaaaaccaccaaccaagcaaaccctcattatgtgaaaacttgaaagagagacatagatggcgatgtggggagaggacaggacccacaatcacaacagatgatcctacagactcccattgagcagacctctcccctcaggccagtgccatctgtaacatgaatacatgatagatacctaattcgaggggacactcactgtggcctctataaatacattcttctctactgtatcactgatgcctagcagggtgcttggcctttagggagtatttagaacttttattctgaactagttactaactcccttccagtctagagtttacctgcaaatgcagtcccatatgttatgcagatgtattcaaatgagtatgcaagtgaaagtttttaaaaaggacttacaattgactgtgctccccaaatacccctgaaagaagtcaaatgttcaccaagacacacctgacagattctctgtctcattagcagaatccctgtggccaggacacaaaccctggtcttgtctgaggacaactgcctttgggaggaagtggggccaccaggctgagaagcctctgggttctcttcttcaccccaagcagatgttcaggattgcagtgatctggcttgagagatctggctgaaaacacatcaggtgtcctacatctgggatgctctgagcagatgggtcacagctgcccaggtgcaaatacagctgggctccaagcctggtgcttgtttctcccagggcagcctctccagccaactgggagctcaggggtaccggctcttcacttgccactctgacggtctggcacacctctgtggtgatcctcagtgttttcttcccagctggctgctttggggctgctctggtaggctctaccaaggcaggtctattttacctgcagaaatagctctgaatccatcacttactttgcattttcactgctgctacttttggtgagatcctctcattccgcctcctggggactctgcaagcagtaggacctgtgagttctgcctctagccttgaccccttccagctgctatcattggctcttgtgctggctgattctttgaataaacacctcccaccctgatattaccatcctagagagccctcatggagtcccatgttctaaagctgtaattttcatctctggctgcacattagaaccacccaaggagcttttgaaaaaatgcggatgcctggggcccatgcccagagatgctgatggaattggtttgggaaaagtgctcttcagaataatttgtcaaaggatattgtttaaagtcctcctggtatgtgagacctctgggtgattggatcctctttctagctgccttcatattgtcatctcctgcttctcagtccagacctttgtttctttatacaggctctctgtctcctggaacccttgctccaagaattacaaactcttgctcactttccacgactccccttaactgtcatccacttcaatgaaacattcttgggatcctcacatggagttagttaggctttctttcttctctgctcacatattgctgttccacccagaattgcaagaggtggtgttgtttgcttacttctctgtctaccccactagcctgaactcaaaagacgttattttaatcctccttgcatatgtctctgccttttaacaatggactaccctagggtagagatcatgtgatgttaatatccataccctctaatgacaaagaccatctcgtatttgcagctctgttcattttttaagctaatatgactgcccacatatgattgaaatgaactattctgcatacactgctggactaactggcgtaattctcacaatggcctgttaagtacaaacattgtcctctttgcaagcgaggaaactgacacaatgagaggaaagacaactcaacatgtaacagggcacaataaatgactatttacaatttagaattgtgtggctgtgtgctcttgccacagaaagtctttgtgaccaatcagttaatatgactttattttctcagcaagcactttacaccaccaggacacagtcttaatagatgataaactctttaaaggaaatagttgaaacctcatgactagttcccaaaacagttttttcagtaaggtaggtcagcagcacagggtacagcaaagacagctggagcaatggaataggagagaaaagaaccttacaaaagcacccacctttctcccagtgcctttagagagtgtcgtgcctcatttcatttgatccctttaacaataataaggaataggaatcataatatttacagatgataaaatcagagcttaatgaaagtgagtaactttgacaatgtctcctaattagtatgaaaaacgctgcaattggattatatgttacctctctccaacaggaggctgcctctgcctggcacatcattggaatctagctttcctcatctactttaaaaatagcttactttttcctaaaattgtaggaaagtatgagaaaaccaaaattgctcttaactctaccactcagttaaaattgctggtaatattttgagttcgtttatttttgttttttttttttcctctgcgtttatacaacaatagatcagaatacgtgacataactttggttgtggtgtgtacaacattttgtatttttcccttttgttttaaaacaaaacatatcagaagtagttcagccgtcttttttaaaaaagagattagaatgaagtggcaagaagaggaagaacaatgctttttatgaatcttccaagggcttgtatccagccgagtgaggagtgggtttgctctgagaatggcatggacggcagcaggctgggaaatgagccccctctctctaagtcttctggacccatcatctctatgcttactctcttgtttctcttgcaggcagcaacttgaatgatggcctgtggcactcggttagcatcaacgccaggaggaaccgcatcacgctcactctggatgatgaagcagcacccccggctccagacagcacttgggtgcagatttattctggaaatagctactattttggaggtaaattctccagtctttaagagggaaaattaagaagggagggaaatttaagtgggcaattatttcactatgatggttctggtttggtcaattagacaattctcccaacacacaaacacacacacacatgcacatacacacacaccctcaatctcaaaatagtgagaagcaaaatctctcacagctgtgtgcaaatataaattatctaggtcagtgctgaggaagaaaagaactttagctacaagagctggtgttatataacacatccaaaggagatttttgtagccatgccaagccctgtaatcacatgggaaaggagaaactcagctgaaaacttggagaaagtgtatcaagagtcagcagtacctgcaagaggcaaaattcaggtggaaaggcacaatcagcatgcttagcacccaggcccttcctctgccactttcctctcttagtctcctgtcccctccttccccacatccctagaggccatgctcgcagaaatccaggaatgaggaggaattaggaggcccatgaatttgtaactccaggtgtagaagccagttcagattattcacattctgccttctctgatgttaagtgagtcctgggaacctttccaatgacaaaaacacaagggcaagctgatggtgaagaaaaacataattaggcatctactgattttttataaatgcatatctatatatatgtatttagtctttcaaaagtatttttcattaaaaattaatatctaatttcatagttgtttgtattatagaaacagtctctgaaaaggatttaacctcaatagctgtctgaccttgagaaagatacttatagtccctaaacttcctaatctgaaacacggggaaataagctcacctccagaatttctggaaaagttaagtacgaccaaggtgtaagcatatggcagagtgtgccacatggcaggggatggggaaactggctccagctcctatagatataagtcagggtctggtctacagtttccttatttttttcctattagtaaattgaagagaagtattgtataaaattatgcatagtctcttaaatagaatttacagatcacttctctcataccaatggaatgtggttaaagctttaaaatgcaaaagggattttgcacatgtgcagtgtacatatcgaggtctcctaggagggaagcaatatctctgtggcttgattttagggtgaggaagggcctgtgacctttacctcaaatgtcctccacctgtgcatggataacaaattcctttagggagggaatacacgtccagtctctgcaaaagtttttatgacttaacctcatttaattcatgcagaaaccttgtgcagtaggtaatatccccacttaatagataataagactggtgtttgctgagatgaaagaatttgtgcaaggccatagagctcatgaattcaattccagatctgtgttcccacagcccaccagtgaaaacagagattggaacaaatgtattataatgatcgtagaacaagggtgttggggtccgaaaagataacctcacagaccgaataattttgcatcttatgcaatatttcagcatcagaggaaaaaacgctatcttgcatttattcttgagggaaatgtttgtaaataattctgatacaataagcatccaacatgcctcagagacaaaatggctctcctccctcagttgaagaagcgttcttagaggcaagttttaagggaccctgggtttagaaggtgaagatgtatcagtgatttgaacagtgtttaaacaaatgccccacgcgtagactgtaaacttaaggaaggtgaaaaatgagtttcagtaataatagtcaacttacataaattctctctacagcttcaattagaagttgtagcatctctcttcattttacagtgtgcctgtgagctgttaaccagctgctgggcttcagcccagcagtgactgtctattagagacggctgaaataattcccagttatttatgggttattaccatggtttcaagcttgcattcccatatgctctgaacctattaaagccattgggatggagttcgtatggagcacaagcactcatatacctgcaaggctctatacctgtcttaatgagaagtagatatgccctggttgcaagctacactaaatcagtgtaattttttaagaacactctttaaaaaggtatagtattaacctttcccatatgctattacagccctaaaatgacatgcatttaaacccttagttccttctaaaaccagcaaaacatctgattttgctttgcacatcacgtcaaaattccagttacgctcctgtgtgtacctttctcaggaactaagcctgttaatgctaacaattaaccagacaattactctgctgccatccttacccagagcgtaattttctttgaaagtgtaattcagaattgaatcgtgcatttagatatgtgtttcaagacagaaccaaaattctgaagcagctataatacatttcttccttgggatgagtgaaggatgccatataaaagaatagcaaatagtttaccaatggaaaaacaaagtaagaaggagacacatgttacagtattggtattccctttgccacgctttttattttctctacagtgatggagtataccctattttgtaccaattctgtcccctccctgagaatgctaggatttataatgaaaagggtgtgcactgctgtgaatgagaaagcaccaaactaattagacctcaaggtcttccatcaataggtcgccaaagcaatgacggatcatttcagcattcttcttcatcttttttctctgtcccacagggtgccccgacaatctcaccgattcccaatgtttaaatcccattaaggctttccaaggctgcatgaggctcatctttattgataaccagcccaaggacctcatttcagttcagcaaggttccctggggaattttagtgatttacacattgatctgtgtagcatcaaagacaggtaattattgtctcttctcctctgttctgccacccccttcccattcttactgttctaaatatgagtttctttaagcaaaattctaatccaccgacattagccacattagacataattgagttgcctaatggaaaatatttctgaaaggatttcaggcccagagaaaaaatggtttaaattagttgagtctctcttcatgttgacttgcagtaaatgggatatgcaaattaaatcaaaatacaaatttgtgaaaggattaaaattttatgcataaacaacatttgattactttgaagttaaagcaaaaaggaggaaggaattacttctctcctaaaccatttcatttttcactgctgtgggtgtcctttctaacacaggcagatgagcattggaccatctgggaagtctgcagcagaggttcccgaaatgcccaataacacacaactactcctgggtttggctggtttttgctcttactgcccctaccactgcttctctggcccagagatcagaaaaactcactttatctctcaatttcccctgggatctggctcttcttatattagaagtttctaaatgcaaagacacactgcagaaaaccaaagaggatggattctgaatttgcatcaaggtttaccatgttcttcttctttcctctccagagcctacctccttcattcttccagttctgctcacccttgtcaaaatatcgtttatagaatgggtgaataatatctgttcagtgcttgcctatgtgttgatgataaagggtctctgcttatgtttcatctgggaataaattagcaataaagttacaataaagttagataaatgaccaagaaatgcacccttatttgtcagacacatggcagcagcaacttagtctgaccctgagaatgagtcgaagaaggtttcagaaggtgatgctgagttgaatcttaaagcagaagacactggcaggctaggccaatgttgagaggggaagggagattggcatagaagcaggagaaagcatggattgcaagtatttcatcaattcaaaatacttttttggcatttgaaggcatttgaaatctctaatagttgaattggcaatatctatttttcatagtggcatataaaataattgtatatcttacaattaatggtgtcttagattcaataatatatagctcagtagggatggtaggccactgtggattgtgaacctggtgtgaataagtccagagatgtggggcaggaccagtcatgaaggactttgtgtaccagtgggatttggtttcatgctcttggtgagaaccacagaggaaggtggctagcttttcctgttagaaagagtactcaagaagaagtgagaaaggtggattggaagagagctggcccacaactaggcaggtgactgccccagttcaggagaggaataatgagtagtagcaggtgcctctactgaggggcacagaaatcagccatgcagtgcatagtctctgctaacgctagaatgagctgcgtaacttggtgaaaatttacacacatttctccattaatatcactatgcatgggatcatcaacaaatcatgcagattttctggctcttctgctttgttttttttttttttctatttgaccagctgaaaaagtagtaataaaatatgtgcttcattaaaatgtgctagtttagagctcggagaataaaagttattgcaggcgatggttggcaactattggctagaccaatagtctttagtaatggcgagggagaagcatcctacttcatcagccagtgcagcctcttccaaagtgttgatcaatacagggaacatttatcaacaggggtctcttatgctaccttaatttttaatcaagcaagctctcattatttttgattgcatgaaagtcattgccatgtactctgcatcattagttttgtgtaattgtagtcttgtataattgtattacatacaattgtgctttcattaattgtataataagggattgtgtttagtttcgtgagtaagtggtaagtttttcttgatttaccaggcactgtgtctaacagaagggaaagctggggcaagggactgtgtttgagtcactatttcttaaactcataattaatgttatctgaagagaggcaggagttagaagggcaggtgttttctgaatttggtgtttcatttttaatgtgttaatcaacgtgagctggatttcaggttaattgcaaactctttgccttcaaggagcttgctacttgctgggagaaaggaagggaataggctggcagtggttttccttacctggactgctgtctggaaagcccacagaggacaatctgagaatctcttcttactctgagaccccttgccagtccgttgttgcaggctgtagagaaccaggcctccatttgcctctttgtggttgtcctaccccttctttttctctctcaaagtgaagtgggatcccgccctgccagcttttgttttttgctggccccaaccgggcatcttacatacttaaacggtattagtgctagtcacgtgggaaaatcagatataagacatctaaagtagaattctggccgggcacggttgctcacgtctgcaattccagtactttaggaggccaaggaaggcagattaactgaagccagaagttcgagatcagcctggccaatatggtaatatcctgtctttactaaaaataaaaactagccaggtgtggtgacacatgtctgtaatctcagctacttgggaggctgagacagaagaatcccttgaacccaggagatggaggttgcaatgagccgagatggcacctctacactccagcctgggcgacagagcaagactccgtctaaaaataaataaatacataaataaataataaagtaataaagtagcattcctacctgaggcacaaatgttccaaaatctcaagagctccctccggtggaggtcctttaagcaacttccttttgaggtggtgcctaagaccctgacacctgcttcccagtttgcactatttacaaaccacctttgatacttcatcctgagcaaaagctaaaagggtctcttctcagggattaagaaactttaaccaatgtgcatctcagggatgggcaaattaccaaatcttctggctcctgggaggaaaggacttggaagaactggccttgcgcacggctctggaagcaggaaggtgttggtactgggcagctccagtgcctggcagtccatgggcaggatgggagaaggaagcagtaggaattagaataaggcattcctgacacacactgtgccctgttcacggtccttctaaacctctaggacacagtgtgcagctgctgcccctcttctgcaggccaaaccaccagcctcataatctctacaccctaagcccctgtccttcataataaccatctttccagcctctttgacttgaagtaggcaaaacacaatagtctaagccagcggtccccaacctttttggcattcagggactgggggcttggggagatggtttcaggatgattcaagcacacatttattgtgcacttgatttctattattattacattgtaatatataataattatgtgactcaccataatgcaaagtcagtgggagccgtgagcttgttttcctgcaactagatggtctcatctgagggtgatcgaagacagtgacagatcatcaggcattagattctcataaggagtgtgcaacctggatccctcacatgcacagttcacaatagggtttatatgcctgtgagaatctaatgctgaagttgatctgataagaggaggagcttaggcagtaatgtgagtgacgaggagtgtctgtaagtacagacgaagctttgcttgctcacctgacactcacctcctgctgttggtcccagttcctaagaagccacggaccagcactggttctggtttgtggcccagggtttgaggacccctggtctaagctatcacaaagaaaagtcactttcaataaggctttattcagtgaacagctgttgatacaccctctgtagttctgactcataggtaggcactgagagagtgagactgacttacatctatccctgagtaggatatgatgctgtaaaagctctagaagctctaggagtccagaggcactaatatccccaccttctaaaaggggaaagctaagacctggagacgtatgtcagtgttctcaaggtcccatagggctgaagttatgatcaagagtcaagcactgtgtgtattctctccttggtactatctagcaaggaggcactgatctggaaaaggcagtcactctgtgtcagtggctctaaatgtgtaaccccattttccaattgtcgacctaaaaggaaaaagctgatgcaaaattaatataagtagagagttcatttgggccgagcttgcttgaggcaatccaggagcacagattcaagttgccctgaacagacactcagtttagcagccattgcaactgggtttctaaaggcaaatgggaggacaaggagtgaactgatataaagttctgccaggaattctcaatggtttacagtttacagatttgattagtgattggctatgtattgttaagctgtagggtgtgggttctagtgtgtccagtgtagcattattaggttaataacaagcagttccaagaggtgagtacacagctcaaagtgggggagtagagtatgactggggtgtcattttaatgttttattggcctgataagtaaaaggacttgcattcctcacataaaagtttttttcttttctcatgctcaaccagattgaatttttaagaatatgcaatatgtcagattctttgtaacatttatgtgcctgatgtaattccatctatgaggggacattcagagtggcatgcaatgtctagcagggtctgagtggagtaaggtgagccaggttcaaagagtctctgccccgcatccatgtagatgattcccagtcaattccaggagccatgtccagtcctgtgaggttcaagatccaggacaggagagacagattagcaaatgctgtccaagagtatcaacaggagacaggctccaaggtgtgaagccaaaccaggagggaaaaacagggatgctgatgaggaaggtgtctgaggtggggagaagcagaggccatacctgggaaaaatccagaatcccagtgcaagtggcagcagctttcagaagcagcaggacacatttaaatccaccccgcccacagtctgagatgtgacacacattatttaaacttttgtccatgttttcccttttgcaaaatcaggatcacaaaacctacctttgtgctaagagttgaatgagagagtgcgagaaaaatgagagtgtgcgagaagtcaggtgttcaattgcatgactggaatgcggtagatgctcagtaaatgttcactgtgttaattcctctggccaaaggtttgccggttctctagtttccatggggagagaagaggcttaagtgccccgccaccctttccccaacccccactgttgcaagtgatccttagtagtttctggggtgattcccatgtgaatatttcacatttgtcccccctcccaaatcagtctgctttgtgaccccccttggactttggtcccactttttcagaagacctgccatggcccattaggaaagcactcataaatttaggtgccaaggttatggtcttcagattttcctaaagcattagtctcaagatcaggactagaatgagcctagagagtaaaatttaaggagacccctacttctagggccatgcatgcatggagatcctgcatttgcagaaacctgagagtgagggtctctttaaatcttataggcaaattggagcattttaacatcagaatcaccagaagtgcttgttaaaacacaaattactgggggtggagcctggaaatttgcatttctaagaaattcgtgtgtgatgctgctgctactgggctggcctggtggccgtactctgagaacaatgctgtaaagcttctgctcctggaggacgtggaattgtgtggaatctgcaaagctgatgtgggtgtggaggagagggatggttcctgcccccacctagggcctcaagcagctactcttctggccagagtctctctgaaaagtttttgcagctccctcaaagtcccaaagtccctttctccaaagaggtgttgaaatcagcccaaggggtgctgcaggaggccactgagtttcttctgcctctgagctttcctgatcttcctctctcagctcctcccctgcttcccactacaaacaaagccttcatgaataacaaggaaaatgatcagatcctctggcacgcctcagtgaggagtatttcggctggaggaaagtgtggttctagaacagctacagctgctgacaagcataactgtttgttgtgaggtacccctgaacgtcacagcttgatctttccttctaaaatacttcacagcctgcgggtggtggtggtgcctatataataggagtgactccacctctccccagtattgcttaaaaaactttataaagattgatggacacttttgcagcaacatgaatggtacttaagtgaaacaagtgagatacaaggagataaatattgaatgttttcacttataagtgggagctagataacatggacatacagacttagagagtgtggaatgataggccatggaaaagtgagggagttggactggggtggataatgagaaattacttaatgggtttgttttggataggggtcctgatccaaacctccagagagagttcttggatctcgcgcaataaaaaatttggagtgactccatggagtaaagtgaaagcaagtttattaagaaagtaaaggaatagaaaaatggctactccacaggcagagcagtgacatgggctgctttactgagtatgctcatagttatttcttgattatatgctaaacaagaggtagattattcatgagtttttcaggaaagggacagacaattccaagaactgagggttcttgccctttttagaccatataaggtaacttccagatgttgccatggcatttataaactgccatgtaaactctatcaccactgtattttctcccacacacattcatttaagaaattcgggtgtggtggctcacgcctgtagtcccagcattttgggaggccaaggcaggtggatcacgaggtcaggacatggagaccatcttggtcaacatggcgaaaccccgtctctactgaaatacaaaaaaaacaaaaaatgtaatgaacaatgaggatgagcagagatcactttcatcttgacttggtgggttttggtcggcttctttactggatcctgttttatcagcagggtctttatgacttgtatcttgtgacaccagtcctgttgacttcctatctcatcctgtgactaagaatgcctaatctcttgggaatgcagttcaatatgtctcagccttattttacctagcccctattcaagacagtcactctggttcaaaagcctctgacaggttcagtgtacgttgttctggtgatggatatcctaaaagacttaacttgaccactaagcaatctatgcatatagcaaaattacaattgaacctcacaatctatacatataaaaaaatgattagacagacactgatttcatatggccttctggtgaccaccgggcccattccttcatcatttcctcatacagtgatgctaccggggaagatccgaggagatcccccagctctggttgtgcacaggaggaaatggaggccacacagagggaggcaaagtcagatatggaagcagggtgctgttcctgcggtctttgcctttgcatcctatggagacttttcgctgtaatcctttctacaattaaaccatttactttttccaaagaggagatcccatgtggagcaccacattacatttcttgtggcaaacaagttatgaaatgtagcttctccctccatcaccactgtattttctcccacacacattcatttaagaaagccaggtgtggtggctcacgcctgtaatcccagcactttgggaggccaagaagggcggatcacaaggtcaggacatcgagaccatcctggccaacatggtgaaaccccgtctctactgaaatacaaaaaaaaaaaaaaaaaaaaattagctgggtgtggttctgcaggcctgtaatcccagctactctggaggctgaggcatgagaatcgcttgaacccaggaagcagaggttgcagtgagccgagatcgcgccactgcactccagagtgcagacagagcaagactccttctcaaaaacaaaaaaaataagaaagaaaagaaaaaagaaaaagaaagtgtctactgaactctctggtcaaaattcttaccttgttggttcagggtttggagtacagtaaacactgaaagttggcaagcattatgttggattacctcccataaacagactcttgctaaaaacccaccctgtgtgtgggagcttgttaaaaacagtgggtaatataaaaagattacattgcgcggtaatacatatgttttagttcttctctaaaattgaaagcctttacattgggcgccagaaaagccattggaagggcagtgcccacacaatctgagcttctaactctgaagtgagaaatgttacaatatgctgttctcccttaactcatgggatggggccaaaatcaaaacaagatcatttctgctttactatttatcatttgtggtctatttcacagaggggaaaaaaagttatattttatgtaacacttactgagcaaacattcctaaatgttatttcgttttattctctccatagtctgcaaggcctaccaagtgggttctcaaagtatggcccccaggactgcagcatcggtgtcacctggcaacttgttagaaatgcaagtctcagacagcaacccaattctactagatcagaaatgtgggttgggggccggggcatctgtgttttaatcatcctccaggtgactaggatgcacactcaaatttgagaaccaccacgttgttcggtgatcgccgttttctacataagacaaccaattcttagagaggttcagtgactgccaaggtcatatcttagtatttggaaaagccgggattcgaattcaggtttttctgattcctcagtatatataaataaggaaagcctgttaccaaaaggccagagaaagaggagacatgggcttgggtagccagagcgggccagggagggggctacagaggaagcagcacttcctgaggaacttgaagagcaggttggatttacgggggtcaaggaggggtgctccaagggctctcatgtggagagtgtaaagctggggttgggaagggctgcagtgctgaatgtttgcccatattggaagggctgtcttggcagcagtggatgcaagagaactgaaatcagaaccggagtaaacttgccagtgcacaaaacagtttaaaacttgagagaccagacacattaatagtgaatctttaaataatggttactgtgggccagggcagtgtgacaatgtgtggtgtgtgtgtgtgtgtgagagagagagagagaaagagagagagagacagagagactaatcttcaccacaatgttgtgaggttaatattattaactccattttacacacaataaattggaggcacagaggtactaagtaatttgcccaaggtcacacagcctatatgtggtagagcctggctgcaactcatggagtctattgggagagattaggcctgtcctggcactgtggtacttctaaccctgctgtgggaaggtgccccacattcttcggcaggattgtgaagtggaaaatgatgcatttttgtcttgcattaaaatcacaaaggtggttgtattaaagcaggaagagaagggctgtggaacacctcggtgcctcacgggttatcatccctatcctcgcagctcactgtcactatctcctaaagaacacactgagatagacgcagaacgagctcagggctcccatgagacactgggcttgatctaattctttgagctgactggggaatagaagaaactgggaacttgccaggaatgactgtcttgagaagacaggcttcaagctgactttgtaaaggtgttccatctggaactgcccagaaaaaggactgattcatttctctacttctttaatgagggtttccttcccccatctatctcacacctgcttgaatctcagaaaagaagaaggttttggagaaagggggaacctggatttgattagaaataagcgaccttgaacaagtgcatctgtgtcctcttacaaacctcatctctatcatcacttgtttttacaagaaaagtggatcattatcttgatgaaatggtccttctccacctgtgcatatggacgggcacaaaagagcctttattcatggaaaacacggagggctgagcaagccaggttggcacttcattttggcccaccagacggtggtgagaatccttccccaccaactggtaatctgacatattgatgctgaaaacgaagccagaaccatgagccaggtgaattatcacaagcacttccaaagacgaggagttcatttcaagtgctgtatttttgcgattgaggtacgacatgcatgtcaacgtatcaggaagaaaatgtctacaaagtccccagggctctggatcatatctgtcctgagatatactggcttagaaattcagatgttttaggccaggcgcagtggctcatgcctgtaatcccagcactttgggaaacccagtttggtggagaccaggagtttgagaccagcctgtccaacacagcaaaactccatctctactaaaatacaaaaattatccaggcatggtggcgcacgcctataatcccagctgatggggaggctgaggcatgagaatcgtttgaacccaggatgtagaggatgcagtgagcaaagatcatgccactgcactccagcctgggtgacacagtgtgtgagactctgtcagaaagaaagagagagagaaagagagactctgtcagaaaagaaagaaagaaggaaagaaagaaagaaagagagaaagaaagaaaagaaagaaagaaagaaggaaggaaagaaagaaaggaaggaagaaagaaaggaagaaaggaaaaatgaaagaataagaaagaaaggaaaaagaaggaaggaaagaaagaaaggaaggaagaaaggaagaaagaaagaaagaaatttagatgttttagatggcagagtagcagaggagactttttatctagatagaaatgtgagaaaaaggtttagattctcaagccacttatgtgaagcagagaacattcataaattaatgaaaagaataaagagattccttggtattgattcctttacatgatcgatatctcaataagccttcatccaacatcccgataagagccttccatctgtttctcatgttctctaaagagcactgccttctgcacagccaatgtcacattaattttttcctcatttacattgatgtccactcatggggcccttgaggcgaagcacctgaagcctttgaatgctgtttttccctggtccaaaagcattcatcgatggcccattataagcaccatttatagacacagttggaagagagaaggagtataatatgttttcagttgggaaaaaggcaggtctgacctgcagtaaaaggttctcacctgtgtctgcagtgaaatgtaaatttaaaattagctctatgctacttacattttgaattaagatatttcataggaagttcatagaattccaattaggccttgtgggtttgattgtgacatggatttctgaaggctgaactgatacttctgcatctgtatcataggcatgggcagcgtcatagatgccatccactttaacacttaaaatgcccaaaggaagcatcagtctccctggttgtcaactgagaaaatcgatattcacataaatttattaacttgcctcaaattggaatcagactcagaattttaaggtgggaaagcctgtgctgttcatattttagcccaatcttggacacaatgaatatgtcacttctttgtatcttagctcccctagttgtcaaatgtagataacatgttataactgcaaggtgttaaacaaaagcaaggcgatattattcccgcctgcctcttggaattttggcaaggattgactgagatcggaaagaaaagttcttaaagttaaaagcgagagagacagaaatggatggggttctgtgtatatcagcaggccaggttttagaaaacccatacataggcagaaaacgatgacatttctctgaataatttacctacatatataacctattttattttttagacaagtgattaatgttttcacttgattcaagttacaaatatgaaatcttccctctaggtttagcttcatcttaaaaatatctcttggacatgatttactaagcccactgcagggctcttctctcctaatcctgggagtactgtagacatagcagtagatatctcaacacctgagaaatgcaaagggaacacacagagctaaaacagagagttaattgggagaatgcagattaagttggattttatgtcttgccaaattttagtctctaaactcgtgtgaggtctagtacatccagaacaccgttaactttattatgacaaaatgttagaatcaccttgctacctgcttttacctatgctgaaaagtataactgtgactgtaataattaggtagggggctatccctgctttggatatggaaatcttctcagatgtggttcccaagtaactctaggtttataggtttgatcaaatcattgtattgagaattgtaaaaccctatactctgaaatgagaatcatttgtatcaacattagcatttgtgtatgtacatagctgtgtatgtgttcacatgcaatatgatattagcctgtgaattctgatgcacacttctaggtcctactaactgagagactgcctgtgctctgctaatattcctctgtgacctagtcattcatttatgaacatttccttgcatgcttactctgtaccaggcacatttctttgcctgaacatccaaaagtgagcaagacagagagtttttgatcttagagtcatgtcattgattttccctgctctgatcttccttggatcaggaatctgcttttttttagtattatgaatcattcattcattcattcattcattctttcatctcttgtgtttggaacctttctgctgtgccaggtgctgggtagaagctgaggatatacttgagtgccgaccacagtagacaatctctaacttcagaaagctccatggaaggacacacatttgaaccaaataatcatggaaataaacatatatgctcccaaataccatgagtgtcctcatgcacataaatagagcaccaggagagaacctgagaggaaggccactttatactgcagagggggcagtgtgccaggaaaggggatgtggacattgttatcttcaggctctacaaaagcatccgtacagaggtcgctgcaaacttttctcagtcagtttcttagagctttgtcctctccatggctttctaagaacctctggctgatgactgtgatctccatgttctgtgtgtgtcctctgctgaaatccctgtttggtgtggagacttagaggataagaagtacaaaattccgatttttttttttttttttggtgagaagaaattttttcactggtgttttagctgaaaacaaattccccacattttcccaaaacatgtatgtgctgggaattcctgtctgccattaataccactttcttactctcctcccaccacctcccatcccttccctggctgccatggttaaagggtcaggcttctagtaattcaattctaatagtatataggctacacccctacacttagaaaaatatgagaaaaagtcagcctactcaaaataaacaccagtgtaaaggtgggactgatatttcagctagcaatttggtaaatcccaagaatctgaaagtgacaaaaggaatatgcattttaaaggtcattccaattaccatgcttactcatgttgagctgaaactctggagtttatgtgagaagacccacgcactagggggataaatgagaacatgtggttgggagaaactcgaacaaataataaggaagggaatacaaatcactgttgttttctgtgatattaaataattcttcaacctcagaggcatctgagaagtagaggaaagccaactatcgataaatagctgggcaaatcctcacaactctaagagcccaggattccatgatggatttacttctgatctacattttgcacacttatatgaggatccagaagaagaggtctcaagggtgaactcttgtctgcattaaaatgtctatttgcaaccactgcattctccatgtcatagtggattcccaactcaatttttctcaatagaattatcctaaatgtagatatacctttcctgcttttgaaataggaaaacaaaatagccaagaattattcctttagacagggtttgcctcatatatctctcccacctccccaaatgcatacgttattgcaactgtagctattctaaccatcagattctgtatgtgcatttcacatgacctccagcacatgatggagcctgaggcattaaacacacgaatccaagtcctcctgcttgacttttgcagtcttctggcctcacctgttcctccctatctatttttacctcctactatatgatgaataattcatcattccatctgtgtgcatttactgagcatctagtatgttccaggacatatatacatagtttctgccttaaagaagctcaagagcaagagagctagataagaaacctgaaagcagacatcttacaaagggaagttaatggcactgagggccatgaagttatgtcccagctgcattttaacaggagagaagtaaggaaaatgggagtgtgatgggattccagaagtgcaccactgcctgccacaaagcagccagctgccttccagcctccaggcacttgctgctatttctcttgtctggagctcccttcccagtttcttttgcccaaatccagcccatctgtcaaagtctagttcaaatcctacctactctacgaagtcttcttgactgctcacactcttctttgcttatttgggtgtctctggcactttcttcttatattttgtttagctcccaaccatagtcatgactggttttctatttgtatcttgcccatccaaagttcatcacgtctactgatgcattcagctgagacacgtgccctgtgattatttacttaatgatttgaaccttttgagctttaacagcatctgctctcagtagctgggggataaactgcatatgaagctaacaaaactcaacacgactcttggttttgggcaagtattgcctcaagatatggaatgaacttgataatctttaatgtcattgtatacccaaaactctggaggttgctatccgagatttaggagttaaagcctttcacttcttttctcatcttgaaaacttcccaatgtggttcacgccaaatactgctctatttgaatagcaagagtgcctaataaaagcaacgccagagccagctgtcatcattcacgtggtgttaagtgctccttctgtaagcactagctagcaagagtatttttgtttagcaaggccatcacaaaattagacaagcaaaccatagcaatgtatttgagcaatgtagtctataaataacacagtggaaggaagcataggagcacattatccatattacaatcttgtgccttaaaaaaaaaaataggttagctctgtaatagaaggcagctccagagaaatagacaaaatgtctttggtgattgttaaaggatgtaagcagcctcctggtaataagatctgctgagtgtaccctgtggattctgtgcgcccctaagcaactcctacaggctgagtagtgaacgcttgtaaagttggcgttgtttacctagcaggaatggaacaaaaaattttcgtggaaggatgctgatgtgtctgtaaccatgtcggctgtttatctgaaagtgaagttattgaagaagaaaggtttcacattagcccagaaagcagcattcgaatcagatacggtccatacactgccactgttttttagatttatttatttttttctttctttttcagaagtgcctggcagaaacttaaacaacattgttattcatttggctttgtcaaactctgtagcatcgtcaaatgtagagagttgcttccaacttttgccaaatgccatctaaagcctcttcatttaataaaaaggaatatagaagatatatattttttctcctttgatgttttaccgtacttgtttctacagtggattctaactagaatcacctaggtttactaaaatgcaacaattggaccagatgctagctagtttttttttcctgctaattttcttgttcaaatccatagagaactataataaaatatcttaaaatgaactatgctcattttaccaagaaggacactgaggttcacaggtatgaaattactttcccaagattacagagttggcaagtatcttccacccccaaaaaacttagaagttaaaaaaaagtgccctttgaaagttaaactaaccatctaacaggtcttaagggatcatcttggagatacaagagagtatccatgcaaggctagttagtgcttggactaaggctaatgtttctaaagaaaaaaaatgtgtcaaataaaagtaggttggtaagaagatgagttataaataaggaaaatcaaatagataaagctaattttagctaaagaactaaattaagacttcctaacatcagatatgtaaagaaagaagcccattctgtgttgcaacatcaatggggaataatagaaataacaattgtacactcccatagttcttaatcctcttctcagactgagttggaatatccccccttataactgataaagcttacaggaatgtaatataattattgcttcagtgaatcaaatattacttgtctagaccagcactgtgcaatggaacactgtgtggtgatagaaatgatcttctctatgctgtcttaacatcttgttactattggtaatagagaactcaaaatgtgtgatacatttagatttaagtaccacatgtggctagtgactaccatattggatagggcagggttagacactctgctagggccagtacttgtggattttacatttttcttatccataagttcagcagcggactgcaccagaggttaagtataaagattgggtttgggccttcaaattcagatctggtgtggtagatttaatgtcagccttagcagcccaggctggatatggtcatggtcactatctgtcatggagccccttctcccaaagacaattacatcaggagacaagggcttatcactatttgacttaatttctcccaacatccttgcaaagaagtgatttaacgattactagatcaaaatgtcaaaaactttatattacttaagaagacaagtttactatatcaagtgttcttttgctatttctgttacccagttcaaagttcctttctaaattagaattcatgttaaaaaaacacacattgtaatctaaacataatccatttagtaaggtttggtttctaatttttttctaaaataagagagtcttcacttttaaaatctccaatagcatactatatgttgaagttattgacagaactcccaaaaccacctgctcaaatctgagtaattcagagtaagaggtactctgcttggtcaacaaaacatgtgagttcgttttctagggtgggtttagattaatgcctatcgcaaagtagaggcatgaaacccccaagttctgtgactattcttgtcctgatttcaagcttaattcacagccctcaaacatttggaaaacctaagaagctaacctaaaggaagaaaagatattgatcagtctggtggaaatattggtccctttgaaaatcataacatttaacatatatttattaattgggattctagtatcacatactagtctcttgtcagtttgcttgcatgagtcattatcgtggtgactgtggtcctgggaatctgtcaagagtgaatttcaggccttatcatgtggaaaacccagttggctttgatttcatctgagtctccgtactagcacaaatggcgtcacataaagacctataccagactacagatgttaacccaggacactcttcaaagctaaggatgggttacaaataattttaaaattcagcctcaagccaagtacagtagcacagccctccagtcctaattactgggcaggctgaggtggcaggatggcttcagctcaggagttcaagattaggctgggatacatagtaagatttcatctctaaaatataaataaataaaacattgaaagttagacctcagccctaccaactgatagcttcaaactttggaattcataaaaatccattaaaagctcttttaatgcagttgtttggaccctacaatcccagagattctgattaagtccatctggaatagaggttggaatctgcattttatccaacaccccagttggataaaagactgaccctgtggatcagtcctttagaagtactgtgtcagaagattaaataaagacatttctttattgaattcatcataatacaggctcatctaaattttttcctgcacagtggggagctatacttccagttctgcctaatgttaatggtagtctgtggaaaatgttttctttgttcaaattagcttgagaaatgctggagtaagaaaagtgtgtttctttactgcaggatttctcaatgtgtgtgtgtgtgtgtgtgcaagtgtgcatcctcatgcttataaactgtgcaaggggggaagtcactgaaagctatgcacaagtttacaaacgtatatgactatgaagcccttgtttccacaaaactactcattcacataaggagcttttggaaatgcggccctagagtgaataaatcacagtaaacaccaggaaccccttgggctgctcattgtgggcagtggggcagcaactctgggaggtagttggtagtgtagacaatgtggcttcaaaagctaccattaaagagaactcaggagtcataagcagacattagccttcactttctgcttttctctacaaaacaaacacccttaaaggtaacttcttctgcctctttttccttctagtatggaggacttgtgcttttgatttgtacaaacaaattttcagcctgcatttttagtgtctgtgattttaactgaccacttgacttgtgagcctccctttcctagagatagtgatacttgtcttacaagattgttttattgattcattgaagtaattattgtgataagctagcaccaagtccagcacgctgagtccagagtttgacacctggtagagaagttaactttattttatatgtgtaaatatttagggagaattaagcaagaaaagggagggagcagaatctctctgtctttcccctgtcaaacccactacctcccccacccccgaccaaaaccctagagatagcaaatagactgcaagttttataccagcctcaatgctagcaatggtggcatcagacagtatgcagattccctggcaggctttgggctcaatagagaaacggtgcattgaatgacagatgagtgaggtgacatcagccacaggagtagcaggagagagtaagccccgcaaggaaaaattaaaaacaaaatgaggagtgacctgagccatctaagaactgactatctgtatggcatttaattctaacttaataaaaatacagttgatgggcagttaaagactgaattttgtggtgtggattgttcattttgggaattctttcccgggatagaacttaaattgagcttagaataacaaagaggattttcatgcaaaagcgagagccagtaaaggcaggggacatgtgtattcctgtgtgaggccctttagaacccatctatgatttgatcaaggggctcctgttgtgtcagtatctggggtggctgctcgtattcatctcccatggtgtggtcctccaagagttctgtattcttgcgtaagtgcttgccttggccagggtggctggtccagccaggccaaagagagccccttgcaggggttctcatatttaagattaaagagtaaggttcttttctcatagcagaagccttaggctgcaggattcagcaattggccgccacaattcctgccacgggaggaagtggggatgagggagggtgagtgaaatcaactcacagagaaaagagatggccagggaggagccagcaacctggttgtattcaagccctgaggttcagcatttcctgaagctatgctgtgtctcttcctgctgtttagagacattcagctcttacttgcatcttcgagcccatgtctctttcatttcctaaaatggcttaaactgtgttttcaccatttccatctgaggttttcattagtataagtctttttagaccacatcttttacaatcttaagttagatgatgaagaatctaaacaagttgaaagagggggaaaaaacattaattgtggaaggaaggatttagtgttttcctctttgtttgtgttctccataatctccatgtgtaagggtcgtgacattttagctcaaattggatgcagaatctatttctagaacaggcacgatgtcaggggccaattaagttgttggccagctgtagtttgaatcattaacaacaacctgtggccaccagcagttttatggcgaggctgtgctataccactgagcgtggcttaggatctctctgccttaactgctcaagccccagatgcagatcagaactgaagtggagaggcagctgcccagttcactccatgaaaccaggtttgctgttcacaaggacaggacactgatgaaatttaaatgaacaaagatgaagtgtaacctttgttttcagctcctgtggttggcaacagagaatggaaatcccagatctgcataggcaggctgagtagtatactgagcttagcaatgtgcaaaccaaatctctctctccacgaactggaaaaaaaaacaaaacagttaaaaaaaggaaagagtgcaggaaagaaaaaaacacagtctatgactgtgtcacaaaaccatctgcaagtataagtgacaaaaataacaagagttcacagttacttacattttacaagaccttatttagcgcccacaaggattaagatattgtgctttgtcttgattttagaaacagggacactaaatctctgaaagggatcaataattgcaaatgtcacagagctagaaactggaggaactggaattaaaacttgggtctctaatctgacgcctgggctatatgactgaatcttgtcacctctgaaggaggtcacactatgcctcagctggggcacaaggggatggtctcagaccagcctttactccatcacaacagcctccatgctcagacatggtagcctctgggcacagtccctaatcctctgcttctcaaacaccagctcaattttaatttcattgcatgacctttaaagcaaaaattaaagaatcttgcaacatgtcaaaatcgatgagcatcctgggtaatccaggcactgctggtatctgttcacttcatccatgggttctagagaccacggcagccactatagcagtaagcgccaagcttggacagtggtagtctccattggaaaatgaaacctagaggagccgggataataagatccagagggagattagtggacccaattataacctgtgtcctttttggcttgcactatatgagtagttttcatttttactttaatgtggtgaaatctttttattccatcaaataaaattttagttctatccataacaaataaatacaatatttgaagattaaattagataattctagacctggtctatgaaaataattctttgatccagggggaggagtgtcaaaatttgcagtcatacattagcctcagtattcattttgtttggctgttctggtttggttgctaaatattaagaaaatcttgattcacacaaataagctgcccactgatagaagttctagataccctgttttgcaatagtagatgtttttcaataagactgatctagaagcgttcaaaagtaggtataattgctttttttcttcaaatttgagaatcgtttgcatttcttaaaaaagtaaaagccagataaatatatagtcagtgctaacacttgctatgatacgttattattttaatgtcatgttcatccattcacttgttcttgcttcattattatgcagtggaaagagcttgtagcatgcaggtgttcctgagcatggctgggtttaaggggatggggctgtggagcagcggtgccctctctgtatccacgctacctgcgtgggcctgagcagacctgataatacatgacagtgcagtgtaacatcattcccaattaaagttcacaggaatcccaggggaggtggggaaagatttccattaaagtccccagagttagcctggagctaaagactaacattgctagtgcagtgtgttaaaacctgattcatgacacatttgaaaacgataccattttaacataaaacttacaaaataattagaaatacttcacaagagagcccaaaacaaggaaaggaaagggaaaaaataaaaccccacaatttgcaacccctctgaaccatctctacagaatgactctctactgaagtgcagaactttgctattcagtgaggtctgggagccagcagttttctcattcccataagcttattataaatgcggaacctctgtatcagggtcttcattttaaccaaagtttgagaagcactgagtcaagtaatagaattatttctattcatagtggaatctgagtgatgtcctaaaattaagaagacccttacagtaatccagagagctctactgtctgtgcgtttcctgatagctccaatattccaaccgaggtatcataatcatgatgctgaacaaaagcctgtgagtgcagggaacacaaaacctgcttcctagtagatgtgaggtggactaacccaaccagatttctctcccattaaatctacagcccctctgtcaattgcgtggtggacttccattctgatggatcacttctaggtcactgagataaatgggttgattaaagaaatttaattatattctattttgtgaaaatgacccctaccaagctaatagggggttctcttcctttgtgaattttttgatatatattattttatagtttggtggtaggggacttgtttctaaagttcccaggtagcaatgtcttgctactattttcataggctcaggtggtttgtcatactaacaatattagtatgcatgatgctgatacattcttcttgattctgaatgtcctctgctttgaagaactggcctttgaagaactgagcacttcagggtcatacatttttcagtgtgcggtagagtagagagaggacctttcccttttctgttcagtggccttcactggcccgtgcagggagaggcatgtgtgccctttgtgcccggcttcttcttgaaccccagcattgttgctgggatcactgacgtgcattgcaaactcattcgatcatctttgcttgtccattatctggggatcatcgcaacaatctgcgattgactccctgctgtgaactagaccctggaaaatttaggaaactgacttttgacacttttctttttattcccttaatttcttaatgtctgcatctgctgtaattacaacaaatttaaattataatggagatccaactgtgggggtaaaatgggattatgataattgttagaatggaaagacatagaaataggtttcaaaagctttcagaaaagctatctgaccaaaacgagatcaatgcggttggctgctaattaaagcaaacagacaaaggaacgcaacctagctgatttttaatgtatgcgcttcataacacagcttacattagtcagcttgcattttgaggactattgaaatgttttgttcttttgtctccaaggaaagcatatagaaattgaaactgaccttcaattttataaagaaggaatgagaattctttaaaagggaggttactccatggagcataaatacattcagattcatgtatagagaatcatttatctgaacatttgggaatttcaaaggcctgtcatttggtgtcctattcatttcagtctgttatgggaaatggagaagagggaaatttaacagggaagaaaaattatttccgtaggtttttatttaagtacactgagtatattttttaatgctcttatcttttaagcgatgattttctcaagatgtgttcaggttgaagatttttttaagaggggtaggcatgtgtctaaacagttcatatgtctaaataactgcaataaaaaatgggcacttgggcacacacagttaactactgtgcttattttcttagacaaaggaccattttcttttaatttttacaagagacttagaatgtacatgaatcaatagggggcaataatgaatggtgatcatgaggagtgtgttatcagatgagcttaatccaaaggagcaaaggccctccccatttaatttgatttctagagtttgatgagggaagtagagggcagtcggctagacttgggtttaaatgttcactctgccctcactggaaatctggaactcgctgagtctcaggagcttcacatgaaaaggtgaccccactacacccctcgtgagtactatgacagctgcatccaggcagtgacaccaggacaggcctggcatctcatggggcccttgaacatattggcaatgatacatgtccagtgcccacctttccaggtggattgcccacgctcagatatctgaacatcttcttttgtccagctggtctcattcctgggcttataatgtgccttaggacagcttgactctctttttagagaccatttcctccatcagctgcatgaatgtccctttaccattgtctgatagcaagcatatacacacatgcacacacatgcacacatatatgtatgtgtgagtatatctataaatttgtgtgtgtatatatgtgtgtgtatttatgtatgcacacatgcatatatacaaactaaaataaaatatctctacatttctttccagactcattgcaaaagccatgagcagaaatatacaaaaagtgagatggtacttatattcccaccggtaaccactgttaacagttttccagtccattgaaggactttccaatctctttacgtacagacgtactattcgttttaatgtctcatggcattctacagtatgggtgtaccatcatttatttaaccattccctaaatggtagattatctattaattatgtttttaactgttatcaatgataataattttacattgtttttgtgcatgtaaaaatgcatttctgggacattatattctatttctgggaaagaaatagaattctaggtcaaagcagatatataagttaagtttttaaaatgccactgtgtccatggcattgtggcaatgttcttcatatgctgcatgagcagaaagtattataacacaaaacactggcaaaggctgtaaagggacaatgtgttccaagaagaaatagttgggcctggcagggtggctcacacctgcaatcccagtactttgggaggccgaggcaggcagatctcctgaggtcaggagttcaagaccagcctggccaacatggcaaaacacagtctctactaaaaatacaaatattagctgggcacactggcgcgtgcctgtaatcccagctacttgggaggctgaggcaggaaaatcgcttgaacctaagaggtggaggttgtagtgagccgaaatcatgccactgcactccagccttggtagcagaccaagactctgtctcaaaaaaaaaaaaaaaaagttagaatgcataaggaaaataaaaggattgattatgcagtctcaaaaaaaagaatgcaaataaaatgacgcaaaatgtttttctgtaatatttgcaaattaagaaaaataaaatccagagttttccaattttgagtaaacagatttatcaaaatactacttaaggagtttagggaatttgggtgaacaacttggccaatagattaaatctaaaacctgttattttcaccaaaaggcaaccattgtggagacaaagagacagacagaggaagggaaactagaggtagaattcagtgctccagactgaacaaatggaagtggctcccagggtcagctcccgggcatttgtgcagagcctgatggagaagctgaagttctcctcagggatatgagggccaaaggtgggatttaagaacagaattgtgagccaaggcaggtgccgatgggagtgttctggtgcctgcaaaggatgatttttgaatgtagaacagactttagcaagatttatttttggttttaaaaaagtgatgtcgaatttcttaaaattttaaaatccttgttctttaagtttttttttctttttttaaaattcaacttacaatgtctttttctatttataaatctagcaggtcttagctatcaagtctaagggacctttggaaatgtttaatcctggatttagttatttaagtaccttcaaatactttaaactacatatgtgatatattttattaactttccaagttcattgatttgttagtgaacaaacagaatgtgacaaacacttgtcaaacttgaacattcagaaaataaacatttaacttaaatgaacttctttcttaggttttttactaaggaagatttcaattaaggatctaaatcagttgtctcatacttttttcttttttttttttttttgagacagggtcttacattgtcacccagactggagtgtagtggtgaggtcatagcccactgcagccataaattcctgggctcaagcaatcctcccacttcagcttctcaagtagctaggactataggcgtgcacctccatacccagctaatatttgaatttttttgtagagacagggtttccatgtgttgtccagacttatcttgaacacctgacctcaagcaatcctcctgcctcggcctcctaaagggctgagatcacaagggtgagccactgagctcagccttacacattttaaagtgaagtttacaagaattatactcgaataggccaaattctcttaaaaactacaaacacaaaaggactattaaaatatcttcaaagttttattataatcttcctacaagagacacaaactagagctggccaattcaaaaattcactcttggcaggggatcttcataagagaaaagaaaaatgagatattcattgttagacttaatgtttttagaaaaatttaaaaattaaaaactcaatgaatgattattagacttcatgacttgatgtaagacattaagattctaagggtaaggttcttcctaagactgtcaactgatactgagtcttaaccctgttaaaattcatcataaatatgctctagtattttttttaacttgggaatgctatttttttctgagaaaagtgaaaattacaacacacagaagtttctgtccaggaccagttttgtgaccttttttctctttcagtaccatacttctttacccaaaaacattcataccatagttttgattattttaaacttttgatactgaatttggaaacttctgggcttaaaaattgcatgcctaaggaagacgtgtaatgtgctaagtgatgaagatttgaggctgtcagtgttggtgactgtggtggagcactttggcctctatgcgtggaagctcagacaaggtctccataacatccacagttggctgaccatgaaacccatatcactgtatcattggattcaaagaccaaatatgaatcctcaatgaattttccatttgcttaatacacattgatgaactcttacatttttctgtacttgtgggattatacaacttaagttttgcaataaaaagtttggtaggttaaatgattttatttggcttgcaatgataactaataaggtctttctactaaaagcaggcagagtctgaaattttctgacattagtagtaagaaagaggaagcaaccatgttaacttacacaggctcaggacacagaaaaactctgtcatgtgcaaaaaatgtaaactacaagagcagggcaggggcaaaggctgtcttctgggttaatctattttaaagatttcacaaactagaagcgaagagggattgaaaatagaattgacatctcctttcccattgggaatttgtagaataaatttgatatcattatgttaattgtgcaaacgtacatattttttctttagtgtaattttatttcaaattaatccatttgtcatattaagattccttttcctaccaaaaattatctttaaaaaaaatctaaactgacaactccacattgcataacagtgtctggaatcagtgcaaaatatgcaaagccccctaaccctcactttggcagaagtgatgcctcagatgtaggcttaggtatcacttttagggagatgatctggcatttgtttgaaggaggatgtgcagtgctctagagtacaggcttcagtgacaggtagtatgcttcaccttcctgactctgtcgctttgtacttggacaagttattcaccctcatctagtctcactttttaaatctgtaaaacaggggaaataataccattaaagcaacatcccagatgtgattgtgagcacatgtcaaagttttttcaagcttcttggccagggaaaagccttaaagaagccaagatcaaaatttcctcttggtggagatattttgtaggagaataggaaggaaaaaaaagtttggttaaaaattattaagatagtcttaaggctagtttaaggttattgtattttaaaatatgatctgccttaggtttttatgggatccccttgctcttgtgttgggaattaactgaaggggtcaagaacggaagctggaagaccagttagctgaaaattgtagttattctggtgagagatgcttgtggctcagactagaggagcatcggggtggggtgataagtggtgagagtcaggacagcttctgaaggcccagccagcaggaattgctcacatcttggatataggctatgagagaaggagagcatcttcaagtttcgggacctagatactggtaagaagggtattgccatcaactgtgatagcgaaaaacacaggtgaagcaggtggtgggggcagggtgagggaggagatcagaaagtcaggtttggttaaaggtaacaaggatcaaggtgagctggatgggtaaattgaatttttcagcagactttttatctcatgaaaatctatcaaaattgtacaaagattttatcaggaatgctagatattctcctgccttcccccccgctcaaaaaaaaaaaaagctctaagttgcatcatgcataagggttctgcttctgatccaattagaggacaattatctttctaagtacttaagcaataaagttgttagggcccaaaaatacagctcaatggacataagtaatcaaaaggaattgcattactgacttgcatccctaagtggccactaaagaacgtccaatttatggtctctatcttacttctccactcagagaaacctgagtttctcttccctctctcaattgctccttgcctgtggctgcacagaagaaggctctttttccactgttttctcacctcttaaaaaaaaaacacaaaagtgaggctcctttgcctgccctctttcctactgagctctgattgtgctgctcaagagcgtgcaggtaatagtaaatgggtgaaggccagcaaggctgtgacaaactgaagaggcttagctaacagagggctgcaccccagaaatgcctgtcattcattcactcaatctacaacaatttatagagtgcctaccttgcttcctactttgggtacgtcagtggaccaaacagacaacaagcagcgctcttatggagctaacgttcattttcagagaaacagacactgaatcataaactgatggataagcagagtatctagtgtgtcagaagataatacacactaaagacaaataaaatggcaggaaaagagattccagggaaacaatgaggaaggtttgcacattaaataacatgatggtggcaggcccctttgagaaggtgacacttgagcaggaacatgagctgagacatggggcatgtggacatctggggaaaaatgctttgggtagagagaattccagtgcaagaaccctgacaaggtagcattcttggtgtgctttaggaacaacaaagtcaacatggttggagcagatgtagaaaagggaaaagtgtaggggtgagttgagagtgttaaggggagcagatcaataagaactggaagatcattttaaggatgttgcttttaccctagataaaatagggagccagaggagacgcgtttaaaatgatctgccttaggtttttatagggtcccccttgctcttgtgttgggaattaactgaaggggtcaaggatggaagctgggagaccagttagttgataattgcagttattctggtgagtgatgcttgcatctcagactagaggaacatcaggggaggggtgataagtggtgagattcaggacagcttctgaaggcccagccggcaggaattgctcacatcttggatataagctatgagagaaggagaggaccttcaagtttaagaacctgggtactagtaaggagggtgttgacatcaactgtgatagtgaagaacacaggtaaagcaggtggtgggggcagggtgaaggaggagattggaaagtaatatctattagacacccacgtggagctgtccagcagacagctgcgtagaggagtctggagttcaggagcgaagactgaactcagatctaaacgttgaagtcactggtgtgtagccgtgagatttgctttgactttgctcagtaatcttatttttgctttaaaagaagccaaaaattcatatttcttctgtgaaactttacaaattaaaaacaaactgccagactgcatttccctgaactgtcttgattcctactgctttcatcacacttttcccaggcctcatccactccagctggaaacttcagcccggccccagttaaagctaagttacagagaaataaccactctgatcttcctgaaggaaagctgtgggggtccttttgttcttcttaaggctgacctagagagagcatgttctgctgaaagtgtgcttgccaggatgaaattggactccagtttacatactcagaaatgtctgtctctagtctacctagtggctcaatctcacaacatcctacaaaatcttatctctgctctgaagcagtttatttggctttctccattgctgtgcatttgcctttaaaaagaaatactttgtttcttcatatttcccatgaacagcaaaacacagtacaaaacaaccaccttgaggcccaaaccatgtacctctgtaggatggactgtgagcttaggtccatggaccactctagataaaccttttcactttatctattacctggattgtcaatagccccacctagcaatgatccttctcttttggaagaattttttatttggataaacattataaagacttttaaccctctgactttttttttctcctttcattcctatctcttttctttctttcaatcctttatctcatttcccttaagacaatgcacattctgcttttatacagaggctaacagcttccaatgtgtctgccacactatctaagtttttcctgggacacatcaccagggctttggggagtaagaggaaagccattgtgtccatgctgaaagctttctttgttaaacattgtgcaccaaaggaggtcacatccatccagatgcagttatagatgcaatatcgttaggattttagaagacagatgttcaatgtgtttatctcctagcaatttggattaagagccttacacctaaaagagtgagtgccctcacgcttaattcactctttccacttcccagttctatgatgggtctttttctgggttaatgtcttcgatgctcagtttatgccacgtagacagagaaagaaacaaaagcccagttaaaatgagctgattaaagaatgtggaaattatactcatgaaactgccccttttaaataagaaaattggtgtcatgtgtcttttatctcaagcgtcttctttacagatgagtttttctaatcacagtgtgcattgaaccaaaatgaaccaagcttgaaggcagctctactagtgctcatttattattattttttctttctcattctgggaaaactagatttttccttgctcaagtactcttttacccttccaggaatgcatcattggcttttctgagtgaccatagacaaatgagtttctagtaagttaataaagatgtagtttctacatttttatggtaaattgagtttatcattgtaaaacaaggtctgtgtgaggcatattaaatatgtgttctaagtgcccagatatttcttagagctttcccctaaacccttctcccaacatgccgaagtagattttgtaatcttttgttttaaaaacatttaaagtggggcaggtgccatgtggctcatgcctctaatcccagcactttgagaggccgaggcaggtggatcacctgaggtcaggagttccagaccagactggccaacccgtagtagagatggataaacctcatctctactaaaaatacaaaaattagctgggcatggtggcaggctcctgtaatcccagctactcgggaggctgaggcaggagaatcgctggaacccaggaggtggaggttgcagtgggctgagatcttgccactgcactccagcctgggtgacagagcaagactccatttcaaaaaaaaaaaaaaaaaactaaagtgcagaaaacgtttctttttctttttgtaattacaggattcttctttcttacccaaagttaaaattctgttagttgaatgtaagagaatcccagctcggactatcctaattgcattggggatttttctggaaaagggttaggctacttcacagcatctaatatatatgaaaatagccagctcttaggaagttcacgggtgcaatgaagtctcaaggacagcagggaccgaccacacagtgttggcatcccccttttttgctgcttgctgcatgtcagcatattttttgtttattctgtctctctttcactgcagacaaattttcttgtgtctcaaaacttgaccactgagaatgtctgggttttttattttatagtttcagccaccaaaaaaagtcaaccctgaactttcttggggcccaaaacaacaaaaaaaaaaactacagaataagcacctattgagtgtgctttgctcagtttttctttcttaaggcaatttcttgttttgttgggggagggcagcaataatactatcatttgctcatatggaaatctctgtttgtgtttacgtgtgtgctgtggggaggggatgggctggggcaaaaggaggtgtggaaaggtcatggaaaaactgggcagcttcagaagagaaaattatggcacaaggtaaactgcagaagaagcagtatttcagaagcagggagatgctgggatgtgaaaggaaacagcgtgtggggacagggggcattcaaaacagtgctagccccccaggatctcctgaggacatgcctggagaaagaaatccttactgggatgaggacatcaaggctctaagtttttggaacttccctcccagcacaggcatagagcaggacaggatctctgagttacccaagagaaaagcctgtggcctctgctgtccaccaagaccaggagagtgggtgggaataaaaaggaaaggtagaatttgaacagagagaggaccacttttttgtttgtttgtttgtttggttgttttgtgtgaatacatcccgtaacaaaactatgggtcctttatttaaatctttcctgtactttaggctatcgttgaataccataaagttatcaacaagcttttcccaaacataagccctgtcagcacaattgtatatttgctgtgctgagcagaaaatttctaatatgtctgaacatatgcaggaatattagtttctgggatttgaaacaatcattgctggaggctttcctacttatatagggcagtcagagtaaatcatcttacttttgcttgcctcagattcttagtggcttcacaatgaacccatttgttgtattatataccacttctgtaacttcattgcttgcaccctctctctttttaaattcgcggaatttattttcctgtactctctcaggccctataaagattgttttcaaaaattatggtatgtatcattgtttttactcttaatttcattcactgcatttactgagcaccaaccaggttatctcttaatggtggcagtataagaggtgcaaagaataacccaaaggcaccatgtagtaaaggggatttgaactcagatacatgtctccctaaagtctgtgatttctgtctggaagaaaaaaatgttacctccactcccattagcccaagtctaaagatttttcctttcaactatttttgaagtttataaagcctgtgttttattttgtggtgttcatgcttcgtatcttaaacttttacttaatctattataatcatgtttgtcctgttataatcatgtttgttataatcatgtttgttctgttataatcatgtttgtccacatcatttgttggagttttatgatagtccattaattttatgtactacagatttcctaagtaattttctaatgttggacacttatgttgattcaccattatgaatggcatcattgtgaataacactaattagcatatatatttttcatattttgaacaatagccttaagacaaggtcatctcagtgtgattgctgattctaattatataaatattttatggagtttttaatgtgtgtggtaaaaatatttttcagaatagccatgttattttgaccttaagtagtgaagcctttgttttaaggatagcatttacacttttacaaatgataaaatacccttgcattttagatgaacaaatatcatcttttctaacttcgtgttgtctttgtgcagtttaaaatagatacctggtcattccccaaaagagaagcatgaggacaatgacctcaattatctgcctctcctttaaaaatacaaaaccattaaaaaatgtaaaatgattatctttatacattttattttttagtaagtgaaaaaccttacaaattctgaccacttcaaattaactttaagtcaacatgaatttgcctcaatattaacatccttaacttaagtacttacatcagctttgcgactttcattgcgcagtaatgcaaggtgattctaccttttgtgctaaaactgtaatattcatactattttgatgtcattcaatctgccttaggtatgggagtatagcaaatcaatatctactattaattgaggcagttggatatgagacatttttgctttcccctttctgccaaatgatttggtttattttcttttcatttatgttttcttccattaggtgtttgccaaactactgtgaacatggaggaagctgctcccagtcctggactaccttctattgtaactgcagtgacacaagttacactggtgccacctgccacaactgtgagtagattgatcatttgcccctggtggcttggacaaaactccaggaacaccattgttaacttcaggatgtatttagcatggggcaggcatgttttattcactcattcagcatgtgtgttttaagaggttattatataccaaacactttgttgggctcagaggatgcatggatacaagccatattcttgtggagtttatggtctaccagcaagacaggcaggaaatgagatcatgacagtacagttgaataagtttaaggtggaagcaaaggaaggtgctgtaggcacacaagagggagctgttaagtcaattgcatagtcttgatgagttgttaggtggctataataaacaaactaacatctctgtggtctaagtaacaaggtccatgctatacctgtgtcacatacccatcatgcatgacaaaggcccttcttccaccttgtccttgttcttagatggtaacaaaattctattatctggaagattgctgtagtaagaggaaacacagggagggaagcacagggaaacatgggctagcttttcaaagcttctacttggaagtagcaaacattacttccactcacattccactggccaaataaagccacgtgggcacacccaacctcaataggggctgaagtgcaatcttgccgtggaatgggagaaaacagaacctgaatattggtgaaaagtgctaatgactgcctgtcaaccgcagtgttagggagacttcaaatagaagaactgagctgatcttgttgtagaaatatgggaggaaacaaaaacaagaaagaaacaaaaaggatactcagaagcaaagaaacaaatggagacataaagcacaggggtcctctgctctgtggaaaattggaattttcaaatagtttcagatggctggagggtgctgaaggtgaggaggagtgataagaggggagacagagataggctagggtgtacacaagataaggagtgagggatagaaaacaaataaagaatatgagccttgattttttatttgtttatttatttatttatttattttttgagagagagagttttgctcttgttgcccaggctggagtccagtggcacgatcttggctcactggaacctccgcctcctggtttcaagtgattctcctgcctcagcctcctgaatatctgggattacaggtgcacaccaccacaccgggctaaattttgtatttttggtggagatggggtttcaccgtgttggccaggctggcctcgaactcctgacctcgtgttccgcctgcctcagcctcccaaagcactgggattacaggcctgagccactgtgcccagcccagccctgatttttataattgtatagtcttattgagaccacgggtagggggaaacacatgaaaaagtatagaaagtttgccagtcagagaaatgtatgcccaactacggactataagtgtgattgagaaagataattctgaaatcactgtctggaattgcagagcatttcatgaaaaattagaaatttgaaattggcttagaaggtagaagggtaagataaacattttctagacgtaagagtgcagccaacgcctggagctcttctgaggactccagtgagaactatcgctcagggacagttctctccggtttttcttaagtgcctgctgtttttgggctggcacttggggatgcagaaagagcatggtagatgccaatagggctggaaccctgggattccagccaaggataagtaacgttgatattctcatctttaaagacctctcagccattccttagcctcttccattccttcaaagcaggattcactgatgatgtccatagggaagtctgatcaatttagagaagaactagtccactagtccactggtcatcagggagtgatgtggttattgctgttagttgcctgcagaaacaaaaaaaatattgtttggctttataaaaatatatctcattaaaacttttctactgataaatttagaaatcaaagtaactagaagagtatcattggattgttcataccacaaaggataaatgcttgaggggatgaatacccaattttctatgaagtgattattatgcattgtatgccggtaccaaaatatctcgtgtaccccataaacatatacacctactatgacccacaaaaattaaaaataaaaatacaattaaaaagaaatttagaacagtgaaaagaacaatagaataacagagattgaatttaaattttacctagatcctttttttttttttttttttttttttttttttttttttttttttgagatggagtcttgctctgtcacccaggctggagtgcagtggcgcgatctcggctcactgcaacctccgcctcccaggttcacgccattctcctgcctcagcctcccgagtagctgggactacaggtgcccaccaccacgcccagctaattttttatatttttagtagagacggggtttcaccgtgttagccagaatggtcttgatctcctgaactcgtgatcctcccgccttggcctcccaaagcgctgggattacaggcgtgagccaccacgcccggcctttacctagttcttctatgtgaatacgtataagattttatcaattgagggatcctttttttttttttgcagatcctaggaagaaaaactaatgaactcttgtgggtccatctaaggctaaaattatgtgtttttatctaagagtcccagtaaacaccaatctctaggttttaagtctggttccaaaaatattatcaccaaatagccaagaacaccatatacctatagagaaatgttgcaggacccccataaggctgtccagattgtaacgtcagtgctgctgtaagaagtcagagacaactgaaatggccatcaatttaatagcaagacaagggaaacatgaagatttaagtcaaaacaacccgaatttcagccaaatcacattacaacattcccgtgactgttaaagcttattccgctcactttctccaaaagtaatttaacaattttttgaggagttcatctctatggatactgttctcctttaatttacttcatccatcaggctaaaaatagaagatgtcgagctttaaaaaaaagtgtgaagttgaaaatcaatggaggtgaggtgctgatttttaaaggaacactgtcaagcctgatgagcaggagactcaacacacaaaaaccttaaaaatatcattttttaacaccttcctatttccttttctgtgaaattgctcaatgcctacactgtaggctgcaactttgtgaaactctatctttgcttctgggcactcagccaggacaaatcaaaatcccttgaatatttgtgacatttggcaagcacaccttggttccctgtgcaattcaaatatttgtcctccctctaactaatttccccctcccccagttgaatgaggaccattgtttttagtcattttgcaaaccaagtgatttcatcagcaagcttgtgcctcactctcagcaagcatgggtcccactcacaggccaggtgagagcttctgcagtgcagaagatggcacacagggcaccctttggcaaaaacaaaaacaaataggcctgaaattctgcacttgtggaaatgacagaatccttgctgtgtttgagggatgttttactgaaggaattgaccacagtcgaaacaagaaatacaaactctttggattaataaattatttataataatttcttgagtattctcttagttttgtcaagctcttcgaaaacagtcttttccccctcattgttggtgctttctagtaaatgtgaagcaagaggacagacttaggacagataggattaactttttttgtccagcctttgtggataagagaggtcctgggtgaggcgggcacaatggactctctaaaaaataacagaatggaaattcccaaagcgtgtagacacagcatgctgctgtcgaaagtagagatatcttcagtccgtcttaattttcttatccttacctgatgatacttaagggacttggatatgctaatttggtcacttttcaaacatacatcattcaaaactacctttttaagaaaaacatgatgaatgtgtgggcaatttctgtccaatctgtggcagctttcccatatgaagaggaaacctacctcataaagtgccattggagactattatatgatgtttgtaagttgttatggttagaaaatttctcccaaagtggtatcctattctccacaggagtaaccgaataaaaacagtgtttgcactccaccagatcaatccctggcaacccaaccaatgttcaatgccttccgactcccagagacagataccatggttattagtggaatataacgtgcaagttcagaagcctgtataatcaaaaccaagcttctaagtactcagggtatattttggtcatggtatgtcatatctactttattacaaatccaaattaagattaaaaggagcaggtttttgattgtgggatattagggcatagatgatagatagatagatagatagatagatagatagatagatagatagatatagatagatagataccattacaacatatcaataaagggatatgcatagtgttattatttccattttacagatgagaacattgaggcccagaaagcttatgtaaattccacaaggtctcatatctagtaaatggtagaagttgggctttaagccaagagaatctgcgtgttgatgccagatgctaaatcctgcatcttatttcttccttcaaacaagcaaggcatttgcaaacctctgtattacaaacttggtgatgggacattcatgacctcttttatattgcttaagacgcagtagaatagtgtgagatcataattgaaaatacagttctagaagactgagagatgagaaagtttttgtgttctagaataatcatgaaagcattatggaaggaagtagaatgacttggaggacatctaaaattgaagtagacaaaaggaaaagggaggtctgtcgaaaacagactgtcaagggctaagacatgatagtagacatacatgtgctgtattctgggacaatgcagaacttgcctggctcaaaaaaagaaaacatgaattgcactagtcattcattcctgaaggccaaatgagattcctataaagcactttcccctagagaatactgaagcacacttactattataaccagagcttttcacatgctactgcaacacctctaaatattattttaataactccaaattattttaataacaccaaaataagtagcccaagacgtttttgtttctatattcaaccatcttaatatttttctttgtctttcttattctggtgagagaggcagaggatctgttttgtttccaaatatttattattgtagccagcactatgttaagcatctttgtatttaagtattttctggccgggcgcggtggctcacgcctgtaatcccagccctttgggaggccgaggcgggcagatcatgaggtcaggagatcgagactatcctggctaacacggtgaaaccccgtctctactaaaaaaaatacaaaaaattaccctggcgtggcggcggacgcctgtagtcccagctaatcgggaggctgaggcagaagaatggcatgagcctgggaggcggagcttgcagtgagccaagatcgcgccactgcactccagcctgggcgacagagcgagactctgtctcaaaagaaaaaaatatatatatatatcttttttctaataccacaagttctatggtttacttaaacaaacctcagaaactgctttattgagtaaaaagttctgaatggttttaagaatcttgattcatatttccaacttgttttcctaaactcttattacggtttacactctgatcactactttctgagatcttgttttaccttctctgacattattgtttactacaacttgtaaaacgtttttacatgtatttttactaacacagtggcatattaaaatagagattattattgaccctcattgtgaattccagattaaaaaaagagatttttttcagatgacttgtattataggaataagattgcttccacaatcttttttcagatgacttgtattataggaataagattgcttccacagaattttcttttttcattcaacaagtactttttgaaagtacatctgattcattaaactgtgaatttagtgattactgtcacattgaacagatccagtaagtgatacaagcacttgtccttgatcttctcgatgtttatgtctgatgacactcacatgtgccctgttcaggatcttttcaccatttctcagcctttgccaatcccttttcaacagtgtaggctctctgacatcctaacaatgccctttagctcatttttcagctttgcagaaggatgtcagctttcttcctcttccaagcctgatgtagtgcttcttctatggagaagtcaatagccatgtattaatttgaagcatatcaagtcatctggctatcagatgttatagtaatcattgcagagggacaacacttgctttaacagtaggtaaatggtcctttgactgcatgtagttatgttaactaactactgagactataaacctatttaggtgagaaaacatgccttactcacacttgtaccagtcacattcaaggctttggtggcatataggctattatagaaatggtgagacagaagattaagcagaaaaagataatacagtgtgctcttagtggaaattccataagaacgggatgatatctgaatcttcccagggtctccagcctctgatctaatccctgacacatagtagatatccactctttgatgtataccaaaaacaaataaatgaatttatgaggcatgtgcacataacaatgtcaagttactgtagcaagagcattgttactttcttgagaaagtgagaaagtgctcaaaataattgaccttttagcagagatttgagggatgagaaagaggaagagcaccgacaacggccttgcaggaagagtgagctccatgagcaaaggcaaagtgacacgaatgtcaaacaacaaagtgggggctatgggacacctggcatagctagaattgaagatgaaatgggggaggcaggaaggagatgcaggaaatgcagccagggtagaaaaggcagacaatgaattgagaaggaacttacttctctgctggccaactaagagccagccacagtttgttggggatcgggttgctaatatttgtttgttgtttgctttgttcatcagtttcttttttttaatgtaatggtgatggtgctttggagcatatactgaagatggaaggtgtgggtactagggacagatactggatgcaatttgcaattttgtgggcagcaaataatgagaaccagcacaagctagaaagcagggacctgatatgaaaggcatatctaaaattggatcaagtatacttaaagaaaaattgaacacagtagagagaaggatgacttttagctttttaacttggaagacctcatggatggagaatggagtgactaagtcctgaggtctgtctcactctgacagcctagtgtcaaatgcaggctctacaagttacaagatatatgacctagggaaagaagccatgtgagctccatgtgctttaacttcctcacctgtcatatggggctaatgatagcaatcatttcaaagaagtattatgaggactgagtaaaacaatcttatttagcatggttcctgacaaatacaaatttcctgttccatgttagctgctgtttaaatagacagaggatgtgtagaaagaggaggagatttagtagttggacttcagtctagtttggggcacagtatttgcctggaaagtttcccactgtgcagaattagctggaaaactctggagggaggtccatagggaatatcagaatcagtgggtgtatagttgctgaagccttttgagtagatgaagtcaatcaggtgtggtaggccaagtgtgggaccttgaaagtaaaatattttaagagactcaagaagagatacaatcaagaaggaatgatagccaaaacatataaataaagtactacggaaagtgtaacctaggagtcagaagagggatgtttcaggaatagactattcacagagatgtctaggtacatggtatcccactgagtacttttttttcttttttctttttttttttttttttttttgagacagagtctcactctgtcacccacaggctagagtgcagtggtgcgatcttggctcactgcaacctccgcttcccaggttcaagcgattctcctacctcagcctcccgagtagctaggattacaggcacaggccaccacacaagctaatttttgtatttttagtagaaatggggtttcaccatgtagatcaggctggtctcgaactcctgacttcaggtgatccacccatctcagcctcccaaagtgctgggattacaggccgaatactctttcatcataatgattggtaattgttaaacgactggatagatgtttagggagaagatggaaaaaaagcacaataagggggaaaaatgaaataagcaaaccaataaaattcaacctgaggaagctaattcaaaaaaagaaagaaagaaatcagtaattttctgtcggcagcctaagactgtggcagtattggaatgcactggaatttgctgatccaagagaatttgtttgttgatgagtatcccagattttgtcaggatctaggtgattcaaaagcattcactgctgttgagaggatttcattctccttcaggagaaaaaactccaacctccttgaatccgttaatgaacagtgaatgcactgtgcaattgagtgcacaggactgcctgtaagggggaatgcttcttctgggagggagagatctgagcaggctgaactggatgtgagaaagtcttcttaaaaggaaacagcagatactggggtctacctgagggtggtggggtgggaggagtgagagaagcagaaaagatgagtattggttactgggcttaatacctgagtgatgaaataatctatacaacaaacccccatgacacgtgtttacctatggaacaaacctgcatgtgtacccccaaaccgaaaataaaatttaaaaaggaagaaagtcttcttaaagaagagattggacctgggcataaaggctggacttggggagtcagataggtgtcaggaggatgtttttcaagggtggatattaaaataagaaccaaaaataaggatgagcacaggggatgtttggggttcacccagtgctctagcctaaggggaaaggaatggacatttgttgagccctatgtaagtgccgtatgctttactcagtggtgaatacatgtcatctcacattctcagctctagccctgttagactccggcggctcttcaaacaactagaccttcagatttgcacatctcttggccacaaagacttcttaccactgtcttttcctgaagaaaatctgtcaactgatgcaagaaatctgagcggaccttttgcagctattacttctttttgctcctttagcattctctcacatagcacttattctaccgtataaaaattgtctgcttcttgtttttccttgcaaactgccacttttctatgcatttctccttgcatatttggcacctagttacacatagtagacaatcactgaatgtaaacattcttttatggccaaaatgcttaaagccacagaaccggtggagtttgaccttagttctagatggcttgaaaacactttctcttcacattacaacatcttaagtgcattgaagagcactcttaaatattttatggaacacagaaggatttaaaagcaaaactaatccaaagacttcttatcagagaaaggaaggaatgcagggtgtatattcaccttggattgattttcttccttttgaatacatctcagtgatttgagagtttccctcagtcatatcctacatgtcaattggttccatttcttctttccttcctctttatctatgtctttctctccatcttcctccaaccccttgttaattgaggatacagtaaagccaacttcaaatatttacactgggttgataaagagcaagaaatgtaatcacaagttttagctttgttccaaacccctacaagcaacaaaagattccaaaatgtaagtgaagataattaactgaatataatttaattgctgatgttgcttccattggagaatcattgatatttactttgaataccaagcaagaaaaattagcacctatttttaatgtatttcaatcaacagaagattaattgccagaaaaatacaaagctctagtatgtcccatgagtaagaagttatctggaatatacatacataaaaaattcaatatatgaagacacagttttcatttgtgcctccactttgaatccagacagatggaggttatcaatagctctctggtatcagacaaattatttaacttctttcagccttggttgtttttggtctctaaaataacagtaactcctttacacaattgttatgtggattaaaggcaagaaacagacaacatctagcacaatatttgaaatttggcatttccaggttaaatggtatctattacatatatataaagttattgccataaaagtttagaaatactttttcatataagagacatcctttctatgctgctaggtcatatggctgttttctactatggatttctactatacattttttatactatagactaccaaatagaggttaggttttggcataggtgttgccatcagtagaaaaaccaagaggcaaaacgtcaccagtagaaccccggtggcaggttgcgggggggacgggggatactcctgcatgagtcagatcctctctgccacaaatgaccttaggcaagtcacttactttttgtgatccatgattcctcatgaatactgtgtggattatacgtggattatacatggtcactaaggaaaactgttttgatttgctctagcagcatgactcagaataagaatgtgatataatctcactcaatagtttctatttcttatcttagccattttataatattctagcctaaaataacaattacataaaccacatagtccacatcttgtctatagaaagcactaagtattaatttacactgttacctcaaataggcttttaaaataaaacaggttaaaacatgaggaatgttctgcaagcatcacagctctttcagcttccccttgaagtatttggtatagtttaattacttgggttttcatttggaatgagtcaactcaaacagtaataagagtagtgagcaataataaaacgaaggcatcatgtgattgttcagtataatttatcagtattttttaaaactatgactgacttgactaagttgtcatgaaatgaaggaatttccagtgtgttcattccgattcatgcaaatatattttgactatgtaattcagagacaaaagtcagaatacatttccctagtcattaaaattctataacacaataacactgtgacttatgtatagcaagttatttcagcaatgtgagcctcatttgtgccatattcaagggaaaataatagaatctgcccctcagtgctgttgggataaattcatgaatcaatgggcgtgaaatctctctgacaagtatgatcataaccctttcttatagatttcttctcatgtatttacatcatttttttcccactgcaaccttgatgagggacgaggcaagtacgctttaatgtacagaggaaagtcatgagatgtacaatggtttaatatggagagcccaaggacattcaggtacaacagcccagcaggacacaagcctgaatattgtgactctttccaagattcttcagatatatcatgctctagacaaggtcagttgttagggaaaatccagggttcttttaaaatatagtttctgttgtttcctaaaagtgactttgattatatcattgcccaacttcaaattctttagtggctctctataatcttattgaagaaaaccctttactatttgatctcagtaagtgaggcctttcattatttggaacgctcttgggtcacaaaccattttcagtcatggccctgtatgtgtccactttatagcagttgtgatccactattcattccctgagcatgttccgtttttcttatctttccagtattttggccttgaagttatttctcctggaatgttcttcctgacttgttttccaaataattgtctattctctattctactctatgctctgctctagtatcacctccacgtatacaggtggctgcaataattgacttttgatctttctctggcattaggttgagctccttgaggtcatgcactttggcttttcttgttttttgaatgtgttcccaactcctaaaccaggtctggaatattactcttgcaaaataggtattgagagaatggagttctaattttcaaattgttggcactaccttgaaatatacttatatccattccttattgagggaaggtgaaagatagcaaatcagataacaggccacaacctccgttaggctttcccttttagcaatcaggtaggaaaacttcccatttttaatttgatggaagaattgaggatcctgctttttatttaaagagtatttcttaaagatcctcacactacgtccccatttgctctcaaactagcttgtaaatgattcttcacttggcatagctgtagttccagattttaagatattagcataaataggatttttggatggctgtatatatctatatctatatctatatctatatctatatatatgtgcagaaaacatgaaaaggagataaaattttccattgtcatagcgggacatgcaactgagtttattagtctgttaacggaggagttgtcaaagtcagttttcagtggcacagatttcctgctggcagctaatgtgatgatgaagaccctggcaatcattcccttgttcctgtctgcttgattttgctgtcgtgatgcctggaagagggagctaatatttctgtctgctaacattttatttcattactgcatgtttactaaatgggcattcaatggaataactgttacataacatatgcagattagggatacctgcagctcacaggccatcagaggagaagctgggctctctggcttctactttaacagaagtcttccatctaatgacatcactgggggaatagtcaaaactacagaaaacaaacccgttctgtatttggttttgtgtttaatggcaatgcagtatgaaaaaggaattgtttttgaagattaggctgccctgggttaaattccaggctctaacaattactaattgagtgacctgtgggaaattattcaccttctcagaacgttagttctctcatctctaaatatagggatagtgatatctatgtcttaaaattttttaataaataagagattatgcttagagtggtggatgcagtgcctatataggaagtgcctgattaagtttacttattttacttcgtcagtcctctacacttctacattttctggccatctgtgcgtagcttttggactagtagcaagttctgatttctatgtttggaagggacttttaagtgcaagtatgttttcttgcagacttcttcaaatcgatgctctagaaacggactgataaatacctcctgttatcactgtagttctccagtagctataagatttatttcttttaggtagtaaaatgtaccttctaactttccttagttagttttattttggctctcaatgatcctactatggacttgccattttttccgcagcactatcatcacgtctcagtcgcttgacatgaagtacactggtgggctccatagctcctgaaatcactggattcagaacatacctaggaacaatcagagtgagaaattgcctttacttattttaattagcatgtagtttacttatcattacattataatacatccctaaatcagtgaaagtagctgattccacagtttattttggctgttgttatgacataatttcattgagatatttatttttattcaacaccaattcttgtacatctctcctattttggggtcacccattcatgcaacacacatttgtatcaggcatgtataaatatctattcagggttcaacagtcaaccaaatattgtgggtgacacttgtgcaattgaaggtctgcttcctgttctcaaggactttaaaattagcaggaatgtgggcagaagggagatgggttatatactaagaaaataatgcaagattgtacatggtcagaagctaaattgaatataggaaatggccaaaatataggcaccaaacaaggagaaggagatgagccgtaaagggaagggatgctggataatgctggacttgagccaaaccctgtggcatacatgggatctgcacagacagagaatatgacagagggtcaagaatcaagactgacattaacttggttggagttggggtcagagggatatggacttgaatagttcggggattcttattaatggagagaaataatgatgatagacaaaactggtatcagccagagttcagagaacagaaccagtggaaaaatacatgacaacaatggtcacattgttatcctgaattgaccaagatgctgaacatggccgggcacggtggctcatgcctgtaatcccagcactttgggaggccgaggtgggtggatcacctgaggtcaggagttcgagaccagcctggccaacatggtgaaacctccgtctccactaaaaatacaaaaaaaaaaaaaaaaaaaaaaaattagccgggcatggtggcaggcacctgtaatcccagctacctgggaggctgagacaggagaatggcttgaactcgggaggcataggctgcagtgagctgagatggaaccactgcactccagtctgggggacaagagcgagactttgtctcaaaaaaaaaaaaaaaaaagatgctgaacatgtgaaaaaaaactgcccttgctttctacattgcaacaaaacttggggattcataatcttacagctcaaaagggtctccccacagtcttggaactgtacacccactggaaaccacaggataaagctcaccagggaattttctccccagagggagacagcatccctacttcagaaggccgaggcggtggatcacttgagctcaggagtttgagaccagcttgggcaatacagtgaaactttatctctaccgaaaactaaaaaaattagccaagcacggtggtgcacgcctatagtcccagctccttgtggggactgaggtgggaggatcatttgagcccaggatgttgagtctgcagtgagctaagatcacaccactgcattccagcctgtgtaacagagtgagaccctgtctcaaaaataaataagtaaataaataaataaataaataaataaatgagacaacagcatctttgatgtggacagctttttcccaggatcatagatcaagacttctctattatcatgacactctttgtttttcaatttttttttctttgcttatgcctctatgaaagatagaagtgacaagggagtctgttgtgcacactcaagggatacacttttatttgtgaaagatttttcagctagctttaaacatgcataaccttataccttgatagatgggagatgaagggccagtgtgggtgagaaaattttatggtacatatgttgcctcataatcagtcagaaacagacattgttttactcctcttaacatatgtaatggatcaaaaataatgctgccaggaggtcttcgctcttctagaatggcatcatttgttaggtcctttttaccatgatttggagtaaatgaggcaatgattagaaattcattcctcatgataggctctatagtagattctattgtaaaggatatggttacacaaaatattttatattctcccataaaagttatgctaaataatagaattgctctaaattacttacttactggataaacagaaaagtatctgtgcagctgctggaacttcttgttgtccatggagaaatacatcacatcaggtattatagagattcagttgtaggagattaacgtagagactgcttagctaaaacaagtagactcttcatctagctcattctttgatctattttatcttagttggtttggtttatggggaccctccaaactcttggtattatcccccgatagtcataatagtagtctccctggtgcactgtattttttcaaaagttttaaatgtttgcatgcagccttctctagaatgtgaaatgatctgtcttcaactgggatgacaagagctgaaaaaaatgagtgatcgtgagggcaccataacctgtgaataacatgctgagaccagaaaccctaaatgatggtcactgagagtggtgctaaggccctaagttttggtcacactctcacctaagtgagaaaatgaccaaaaggagggagtttttaagcaaaataatgggaagcaattgttttggactgagttcatgcactaggttccaacagaccagaccaaaccaaagtgtagtcacttatgctaaatgtgacataatcaaactaagactttaaggaaatacatagatcctagaacaggccaggttttgttctttgtttgtttgtttgttccatcataaggaggcaccctctactctaactttcacagaaaataacctgaaatcctgtccccaccttacaaaactcactattctgctatttcccagtgggtttcaagactaaataagtacattgacaatggtgacaatgacatcaatgactaaagttctggtcagtctctcaaaattgagaggataaccaaaagcggggaattgttaaatcaagtttagcctaaagctgcctctttacatattttaagttcagcctaaaggcttctctgtaagttgtcaactataacctaaacagagttgtaaacagactgtagccactcactgagttttggccaatcaaaggtggtcaactgttcaaaccatgttcaaataaggcagatgccaagctgtaaccaatttggttgtttctgtacctcacttccactttctgtccacatattttcttctaccacgtggctgcactggtgtctctgagacaagtctgactcaggaagctgcaaaattcacgaatcgttctttgctcaattaaacacttaaatgtaatttggctacagtttttcttttaacaagtgcttggccccctcctccttacagcctccacaatgcataacagttacgtttggtcatgatgcccagaagggtgcagtctccgtctctctctctcagctgtccatccccatctctcaatatctgtttatatagacctatgcatgtgtgtatctgttcgccttaacaaggtgagaggacaaaacctatgcatatggagtgatttgcatgacagtacttgattctttgctgaatgataaaatagatataaaggagaagttcagaacaatatgggatgtcctaagtttggggaatctttatacagggagtgaggagaagcgaggccttacaggatgcaggtatttgcataatgtgtggagcacagggggaacgggagtcattggaagtagagggaatgcctggctcctcaaaggctctcactgaaggattatagaatgtgatggatatgatagggaagagcacagatcgtgggcttggggccaatgaggaaaccaggggaataggtggatcacaatgaagtatctgctggagaggcggtaggaaacaaggctggaagtcactaacccttggagagagaatatcctgttttatgctttcaaattcttcaaaattcttctccgaacatgagtctttattagcaaagatcatttcaggtttcttaattttaaattaaaatcatgccaaggtgggaataaaagtgaaacagggaaaaaagtaaaagttgaaataatgcctttgtaatagtctctagtctcctcatttttctttctttaaaaagtccaatcctctaattagaagacaaagaataaaagtgagtgcatagattcccttatgtgattcttctactaagaaatcaaagctctttcattttcaattttctagcacgacaacataaaacaatctcattaaggactttgtcgaatattggtaaaggttagacagagttcaggcggcagggactgagaaaaagtgtttgagagtttgagcaaaaattggaaaacttcagatttaagttttcaggaagctgaaatggaacaaaaagagaaagcccacaggtaatgatcagtcaagagaccctcccttatacccaaagacctagccagcacagagatgaaccagtgtcctgaaatgcaaacttaataggaagaaatgtgaggtgaagcccgttgagatcccagcctgctgaggaaagaaatcctattgtatatgcacatgacgcatccccaggaagagaaagactacctgcattacaccattctccaaaagcggccgtcatattgcagtgtcgatggtacctcagggaacctattctcaagtcaaagacagaggaacattcttaagctggtgctgtttcacaaacacggaggcaggggcttagagtaggagtttaaattacttattaaaacagatggtgaaatctctctctactttaaatctgcgttaaaatgaatcttgaaagactgaaatccaagtgatctggaaagactacaaatggaagttgctgtgtaaatctggtgaacttttcagtgtaaagcgattccatgccatttagcaggagcttgatttctttggatcggaaggcctcggtggctgtgtctcgtgtctgtcattttgcaggcatgtggttgggaattggatggcacaggcaggcacaaagcagcctcatcggacagtattcaagtggcagtagttgttgctcacctggctttactcactccagaaaccaggatttgactcaaagaggcagctgatttcccctgtcaattgtctgtttataatagtttctcaaaagagattgaactcaagatttctgataaggacaaaaataaaaataaaaaagcaaactcagagcctagaagtcaaaaggcaggataaagatccctggacactaagcaaactctaaatcaagagtccagggctcttgcctacctgggctagcagctgggacacatccctgcaaaagggggctgccagcttgtctggatgaccttggaaatgatccagttctgatggcctgctcaggctctgtgcactgagctggggcagaccaagtttcaaagggctcaaaatttatataatccatgaaagtttttttttcctaaattatttttggaatgagaaaagaagtcactacaaattactaacattttaggaaaaagacaataccacagatatttgcaaattttagaacaacataatgttttaattaacttcttgacacaattttataacacttttatttccttacaacttttgcctagtgtttgattgcttccttatatgatgattttgtttaaaaaattgcagaaaataaataagtaattcagtttttcctctagtatggttgataaaatcatttcttaaaaaattatattcataatttaaaaaaggcttttttttccagcttgacacctcattattggtgatgccacataaacttttataactgtgattgaattggggatatccatgtgaagttccatagattagatagtaagatttattagaatttccacagaccagcttctgcttctgtacatttcacaccttgcttccctacacgacctacactcttccattgctggtgctacaggagacatctctagggagacatgacctctggccctgcaccatttttctctgatgctggatgactttgcatagcaaggagcaggaatactcagggaagcaactcctcaaatgcaatggctaacaatccatgtacatagccgggaacgatatggttatatgctaccaatgtaaactaaatatgtatccacagcatcatttcccctcactggatcttaaaagtttctgtggcctctccaatgccacctggcttgagaagtgtaacagtgggaagggcaggggaaagagacagtagtattaacccattgcagttcaatattttgtttttactgattgccattaaaataacttttgtgaagtttaatagctttataatgtgtcaacacaatttgactgaactaaattccaaagcatttcctttcctgtatatttcgacttaggggaaaaccacaggaaagatacttttgggaggtttggaagggggaagggaggctgcagtccttatgtgtttcacatccactacatccactgttgctggctttttgactcatctcaccggtgaggcagtgtctgggcctggaactgctccaccttcctctggatcctgcttcagcatctctaccttctgggtcaggtgtgtgtgtttagctctgtgacaaagccccccagcttttccagaatactcacatcaccaaggtcaatgacaacaggaagttccatgggttgcagtctgtcttcctggccccagcatgtcctcatgggtttcaatttaacctagctcccgcacctcctcacatccaccttctcctctccactgtggtcttcaaactccagcatctgatgagaagacaacagctttccagagatcacttcacctgctcccacaatagcatcaggtcaaatccttataataaatacaggtatacctccaaacagcctacttctctgacagcctacacacaccagcccttactgacacacatagtttacaaaatgcataatgttgtaaacacattgctcgggttttgcaagaagatcttgaagctgcagcttccggagctttaaaataaattcatctctagcccagagctttctgcctcggttttcctgctggtggtcatgaagtttcatgacaattagtattctctcatcactgtggtgataaggaacttaactataagcatgatctagtaggaagaattacaacgtgatttgtatttaatctggaaatgggtatctcatattgcattaacataaaatgtcctgggtaacagaagtaaatatcctctaagtgtagctcatggcatatttgttcatcttttcctcaaacctcatgtgaactgcacaagctaaaggacacagatttttcatcgtaaaatatccttctcacagcttgaaaaatagacattcaccaattcacacagaaagaccactctttaatggtatgcaaatgcaaaaatgtttattatattaccaccatggcctctgcacaaagaattctggactcgttaaaacaatgacagtgaaatatagacaaataaatactgtataattatttccaaggatgccttcaaataacttccactaggatagcccttattactctgtctagttgaaaccagttttgaacacttatgaccacaatataactgttttatgagttttttgttttccgcatttagaggcgaaagcatggagcgtagagtcaagaacaaacatcagatttacagatagagcccttactaatgggggtggctttggggaaagctctcacattgtatgagctcatttgcattattcataaataggaatacttgttagcaggctctttccccagaaggcttcaggaaccgtgcttaagtttagggagcaagcatgtaggctaaggtggtaaatgaccctaacctgtcagtggcttagcaaaggaaaagtttctgtttttctcactcacactgcaggatggctggtacatgaagctgtacaggggctcaatcagcttctatgttatcactccatttcctttcaggtcctggggaggctcttttcagctgatagagagagaagaaaatgagaatcacatgggaagttctaagggttatgcctgaaagtggggcacgtgtctcactcagtttttacttgagcaacactaaactacccttagttcagaagcttgcatactatcctggcaaaacagggatgggagtggagagaggaattctgttgaggggcatcaaagtctaacaggaagaatggatggatccaggaacagagatcaacttgtaaatagttctctttggaatttgaatgagcctaggagacaggatctgttcaaagtgtggttacattcttggtcttacagggaggggaagaaaaaacaattgttctttattgtgggtccagacattaggcatataaaggaacttcagagaacaacttcattctggcttagggacagtgagtcagggagagcttgaagcttttttttttttttttttttttttgagttagcatgtggaagagtagtacttggggtattggtttctgagccccaaccttacaaatcttctgaagcagatcttttagtacccttcaaagaaaacagaaccttggaacagtaatgaggccaggtttataaaactcataaatagcaaagccaggattttaattaaaacctccttggctaaaacacttctctcttttttactgcacaccacgaactcaactctcaacaacagtatcacttggttgtgaggtcaaggcttacaaatatgaaacaaagtgtgaacctcctcacacaggatatggatctgcttctcaatatatggtcctgaccaggagctataaagaaagaggactggagaaggtgggtctggaataagcctcaggcaacttcctatagtaggacttctcatatatactatttaatacctggagaaaagaggcaggacttcctcacttagactccctgctcactagatggcgatttcaataccaaagccaaggatcaacgaatgagctgtgctatcttatctttagagattattttctagttgtatgactcaactggcaatttgtactgatgatttgatctgttcaagtccccaaattttctgagttattgaggttttgttccatgtaatataacaacaatggcatgagtcagggtcgctgagcccctgtaagcatgaggacagcttagctactatccagcggagccaggagcgggtgctggcctgcctgcaggacacatgattttacctctctgagcttcaggttgagttgctttcctgtttttgtttttagcttttttatgtataaaatgaagaatacaataatatcctcatcttcaaattcttaaaagtcatttcttatttaaactttcacctctttacctttttagcttagagataggttagatgatgtgatcaagtcagaggcctcagagaaataaaagaacaaataatgttatccatggggagggtgtgtcaagagtgaagtatcacagcaatctaaaggctttctttgctatgcatcaagctagaaagttgcaattgggtggatagatccttccagggcaacctccaactgtgtttggaagctaactacagggaacatttgaaagtttgtaaagatttcctggagactctgatactgaaataagtctctgaatatcatatccgattttttatattaaatgtacctgggtaagatgcatgagctcctacctctgtgaaggggaaaatacgcagagcaaagcctggcctgggttcagataccagcttcctgctgaatggtgagtggacttggacaagtcagagtcctgttctgagcctccttttacttccctgtaaaaatgaagctcaaccctgttgtatgagattcctgactgtatgtgagtcaggcactataggatcaaatggtaaccactaactcaagttgtaactatagtatcaaatgctaactattgttatcagatggtagctactatgattttgtctttagttccatgtgctataatcatctgttccatgaccatctccctgtgctgaatacatttctccccctcattatatactgtattgtgtagcatcctcaatttattctgagtctttggataatttgaaatggattacaatgacagatgcatttaaggcttaaatcttaccatagtattgaatcaacttgtaaacaattttttgccccagaaggaagaaatatttatatttttctttgatgtctgattgtttccatatgttatacccagatatatggagtccaagataaggtatagaatagttgtctccaaattctagtgtgcataaatatgtccctctgccaaacttaggtctcttttttaaaagatctcttattgcctctttctggctcagatctttattcttcctcagggggattgttgcaatagtctcctcgtcttttggggcctttgtatagctagttccactctggcttccagaaaggtctctcagaaggccacgtctttataaatcatcagtgatgcttgaattcagagtaatcagcctccaaaaattatttctggaaagacctcaggtggtaagatgataaaatcactagtcggagcagaattattgaataagtgagttgggaaacattcttaacttacatagttacatgatgactatttcccctaaaaaaaagtaagattactaggaaaaacaaaagaggagagaagaaatatatatagagacttagggttctgggaaaaggtaaatttattgttttgactagtggtatgttgatacatattggaaacttgagttttcagcaatgggtttaaaagtgtaaaaatctcaggcctgtcacgatttaataagagttaattttcaaagtttcctttcccttccctttctctttctttctttcttttcttccttccttccctccttttccttccttccttttccttccttccttccttccttccttttccttccttccttccttccttctttctttctttctttctttctttctttctttctttctttctttctttctttctttcttctttctttatttcctctttcttcttcttttctttctacaatgcttctgaaattttaacttgcaaaagaattacctgacactattatgaaatgcaacttccagatccctatccccagagattctggtttaataggtcaggatggggcccaataatttgcatgcctatcttgaaagctcagagtatgccaattgtcgtcggtctgaggaacatactcagggaaccaatactttagaaggtgtgtgtgcccactgagaaggttcaagccttgccgtatctttacataccaacgactttacttccaggcatctgatggcctagactcaattcagctttgaattactgggacagtttatattgagcttgcttatgtatttatattttaaatataaaccttattattatgtaaatctcatagattaatgtatcagatcatggagggtcagggtgacgtcaatgtaataagaatgttagtcacaacaacattctctacttatatttagcaactgttgctacgttttatcttaactaaaatgtgtggtggtttttaagaagaaaatgaagtacagatgccggcttgggtggtggtgaagctctaggcaggcacagtgctttctttgcctttctcacagagccagaggtcatctggctcctgtgttgccctaatcagacaccacaggccaaatcaagcagacaccaggctctggtgcagtgtgtcccgggagcctgaaacatcttttgggacctgacctacaacataacatcccatcctttaactttttttcaggtttattgaagcatatttcatagaccatacatttctcctatttaaagtgtacaggttagtggtttgtagcatactcacctggctgtgcaagccttcttcactatcttaattgtagaacatttcgatgccccaaaaagtgaccccatacatggtaagtcattcctcatctcccctccaccacccccagcccctgcagtcactaatgtactttctgtctctataggcttgtctaatttggacatttaacataaatggaatcatacaatatatgctctcctatgactggcttctttcatttagcacgttttcacgatttatctgtgttgtagcatgtctcattccttttcactgcctagtaatatttcatggtatggaaataccacatttgtttatccattcattggttggtaggcttttgggttgtttccactttttgactattatgaataatggacatgcatatgtcagcttttatttgggcacatgtgttcatttctcttaaatatatacctgcaagtgagattgctgacttaacctcctgcctcctttttcgactttgtaccttgacataatttatagtaaactttgaacaaaaaaaagcactgtgaggttctgtgtaccccagtttcccctgtgctaatatcttacgtatttatggcacgatatttaaaaggaaattgatgtcggtatactatatggagcttactcagattgtatcctttttacgtgaactcagttgtgtgtgtgtttagttccatggaattttaaccacatgtagacttgcacaatcactgccataatcaagaagcagaatagtttcatcatgaggattcctcctgctatccttgctgtggtttgaatgtgttccccaaagttcacatgttgaaaacttaatgcttaatgcagcagtgttgggaggtgggacctttaagaggtgattaggccatgagtgctctgacttcctgaatgggttaatgctgttattatgggagtgggttagttactatgtttctcatcaaaggatgagttttcccctccctctctctctctgtctccctgccattccaccttctaccaacggatgatataggaagaaggtcctcactagatgcagtcccctggaccttggacttgcaagcttctagaaccataaaaaaataaaactttgtactttataaattactaggtctcacataccctattatagcagacagcgaactaagacaatcctgttatggccgcacctgcactctcctatctccatttgtaacctgtagcaaccactaatctggttccatctctaccaatctccttttaggtaatgaaaatgttacagaacctatgtctattttcagcctgtaccagctatgtgcagactgggacaccaaaagatctattttctaatttaatccccagacacattgtttgaactaatttcagcactcccattagttttaacatatttatttttcttttcttcactgaaataaggccaaggcaaagtccctcaaacctaccgcacaaggggtttgataaacttaattaaataaatggctgctaaatgcaaaatgcttcacaagcatttacttaattactagaattaatttgatcctattgatgtccgtaggctgtgcatggagatctgtaactaaatatgcagtcatgtggtaaatattatattgctggggacataggaacaaaggaagaaacaggactgatacatttttaaggccttaaaaatatgtactcagcttcttgtctatttctatagttttacaataggaatataaatggcagtgcagaaacaccacatctctgaccttgatacttgaaaaggtgaggtctaaataaaactatttcgctgtctgaatactatcattatctttaatgagagtgggcatcacaaggacatttcaaattgtaccttaggcaataaattagctgccagaactatattcagactattttcctcaaaaatgaaaacactgatccatctgctctgtccagctacattatacatctgttcacattaatataaaaatctattctgaagagacttaatatgtctatcgttgtccttttcattgaagagcacatatctttctgagtacccctaataccagaccttcaaatgcaacaataggtttactagttactgttttttctaatggagacaaatcttgttactgataatgtttattttgcttttccttcacactcccatcttcttcccaacagaaaatgtgatgatttcctcaaagatgaccttcaatgctaatttagagcttgtgtaagatgtagcaagtcatttcatatacagtggatggtaatctctgtcttgagctttactaggtattgcagagaacaaagatattgccatacaatttttaagtttagctcaatttaacctttaccaaaggttaaacaagagagatcaaaatgctaatccaaggatttccatacatagcagtggagaaagagaaaggaagtctacctaactcagactgatgatatggaaaggctttctggaggaaggaagccttggatttagtcttgatgaacatacatattacaccgatatgtcaccatgttgcacccttgttgcactgttgctgttctatactgagaaggagccaccctgcactcatatagtgaacacctactcatattttaaagcttaccttaatggtgggaacatttatggtgtcttctctacctctgcagaaaagattactttataattacaagcagttcaaaaaatgcttgtttatggaacaatgtaaaaccaacaaaataagtcttcatcaaacaagtcttgcttttattcttattccttcttcctcttcctttccattctctatacataacctttataaaaatgctgttttcttaaaaaagataagcaaatacaaataagttcatacccccatttattagataaacattagcatagtatacatgcattgtctgtgcttttctctcatagctatatattcagaagctcagcttgtagtgttacgtgtggggatgcttcattcctgttcaaagctgaactatattccatgagtgcaacatagtttattcaactagtcctcaattgatgaacaccgaggatgatttctgtctttttgcaagcacaaatggtgtttttaaaaaaatatggaaacatcttttttcccccattttttaccagtgtttcttggagcagatcactagacatggtgtttctgggtcaaagtttaaatgtatctgtaattttgctagatattgctaaattccacatttaggatttgtatgatttttgcattccctctcagccacatatatatatgtatacgtgtgtatatatatatgtgtgtgtgtgtgtgtgtatcaaaataaaaggttaaatggacaaatatttatatataattagcaatgatccaatatctatgctcatgatatgagtgaccactcatagaaaaataaatgcaaataaatctacaacacataaaaacatgtctgaccttgcttataggaaaaaaaaatgctaaagaaaatgacattgaaatccaatttttcacatatcaaattagcaatgatccaaaagattgacaacactccactgctaagcctgctagggaaaaggcctttcccctataatataactaatattctcattttcattagcacttatttttctataagtaacgtcagacatcttttatgtgttttagatttatttgcatttatttttctatgagtctccactcatatcatcagcatatattcctataggttgctacctattgtgtctttatttttaacttgtaaaagtatattagaaatgttagtgctttgtgatgcaaattgtaatttttcccagtttgtccatttgccctttttttgtttattgtatcttttgccattcaaaaatgtttgtttatttttttaatttattttgaatattaggaaatttatctatatttttgttcattgcttctggattttgaatcattgttagtaatacttttgctgcttctaatttacatagaaattcagccttgtttttctctagtacatgtatgtattctatttttcaatatttatttatttatttatttattattattattatttttttaattatactttaagttttagggtacatgtgcacatagtgcaggttagttacatatgtatacatgtgccatgctggtgcgctgcacccactaactcgtcatctagcattaggtatatctcccaatgctatccctcccccctcccacctccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttatagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtttctgttcatgtccttcgcccactttttgatggggttgtttgtttttttcttgtaaatttgtttgagttcattgtagattctggatattagccctttgtcagatgagtaggttgcgaaaattttctcccatgttgcaggttgcctgttcactctgatggtagtttcttttgctgtgcagaagctctttagtttaattagatcccatttgtcaattttggctttggttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcatcgtttattaaatagggaatcctttccccattgcttgtttttctcaggtttgtcaaagatcagatagttgtaggtaagtggtgttatttctgaggactctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggcaatggcattgaatctgtaaattaccttgggcagtatggccattttcacgatattgattcttcctacccatgagcatggaatgttcttccatttgtttgtatcctcttttatttccttgagcagtggtttgtaattctccttgaagaggtccttcacatcccttgtaagttggattcctaggtattttattctctttgaagcaattgtgaatgggagttcactcatgatttggctctctgtttgtctgttgttggtgtataggaatgcttgtgatttttgtacattgattttgtatcctgagactttgctgaagttgcttatcagcttaaggagattttgggctgagatgatggggttttctagataaacaatcatgtcgtctgcaaacaaggacaatttgacttcctcttttcctaattgaataccctttatttccttctcctgcctgattgccctggccagaacttccagcactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttgtagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgctacaatttcagctcctgttattggtctattcagagattcaacttcttcctggtttagtcttgggagagtgtatgtgtccaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagagttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtatccagtagtcattcaggagcaggttgttcagtttccatgtagttgagcggctttgagtgagattcttaatcctgagttctagtttgattgcactgtggtctgagacatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttctgatctttgttggtttaaagtctgttttattagagactaggattgcaacccctgcctttttttgttttccatttgcttggtagatcttcctccatccttttattttgagcctatgtgtgtctctgtacgtgagatgggtttcctgaatacagcacactgaatacagctcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttattcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctgggttgaaaattcttttctttaagaatgttgaatattggcccccactctcttctggcttgtagggtttctgccaagagatccgctgttagtctgatgggcttccctttgagggtaacccgaactttttctctggctgcccttaacatttttttccttcatttcaactttggtgaatctgacaattatgtgtcttggagttgctcttctcgaggagtatctttgtggcgttctctgtatttcctgaatctgaacgttggcctgccttgctagattggagaagttctcctggataatatcctgcagagtgttttccaacttggttccattctccgcatcactttcaggcacaccaatcagacgtagatttggtcttttcacatagtcccatatttcttggaggctttgctcatttctttttattcttttttctctaaacttcccttcttgcttcatttcattcatttcatcttccattgctgataccctttcttccagttgatcgcatcggctcctgaggcttctgcattcttcacttagttctcgagccttgggtttcagctccatcagctcctttaagcacttctctgtattggttattctagttatacattcttctaaatttttttcaaagttttcagcttctttgcctttggtttgaatgtcctcccgtagctcagagtaatttgatcgtctgaagccttcttctctcagctcatcaaaatcattctccatccagctttgttccgttgctggtgaggaactgcgttcctttggaggaggagaggcgctctgcattttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccattctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagtttgagcttcccggctgctttgtttacctaatcaagcctgggcaatggcgggcgcccctcccccagcctcgctgccgccttgcagtttgatctcagactgctgtcctagcaatcagcgagattccgtgggcataggaccctccgagccaggtgtgggatatagtcttgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcacgcacggtgcgcacacccactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccaccttcaatatttaaatctctgattcaattaaaatttgatcgtggtctgcagtatgaggagtggatttaatttcatctttttccatatagtttcccaattatctcaataccacatgtaattttttttgtttttctactgatttgagttgcctttatcaacaaatatctatagttgtgaattatttatttaaatatttagataaattattaaatattgaacctctcttgattttttggattaaacattcccttggccattatgtaattttaaaatacgttatttagttctgtttgctgacactatatttaaaattttgtgattgatattcatgagtgattctataattttggttttctttctttatgatgtttgtcaggttaaggatcagctttgcatttactttacataacaaatgtggaagatgggaagatatctttcttcttctgttctttggagaaatagaagtaccagtgagatgatttgttctttaaaaggttcatttgagaaaccatttactctcacaatattacaatcttactctattatctcagggagtttttttgtttttgtttttgtttttggagatggagtattacttactcagtgacccaggctggaatgcaatggcaaaaatgtggcttattgcagcctcaaactcatgggttggggggagctccttaaatacttttcctattttttataggaacaggtcgatttaaattttgtgtcagattgaggttaatgttggtaagtttaagacgctgaataacttgagatttagaaccatgtcttttttttttgcatgtgattttctcagagcttaccttagattagtgaaaaacaagtgcattctcaataaacgtgtgtggagtatttgttccataatgtgttaggcaagcaatgtaggccgaataatttagtaaacaaaagtgtatgcttgtacttcctgaaacagttggtgaattgcacatgtgtgtttaactttgtttccttacactcctcatgaagaatagtaaatggttttttttttatttttattttttaatggctctgtaagccagcagcaaatcagaggaactctttgtcgtttaccatctccaaaacagcaacttcagtgatggggtgctcataggagactgaaaattcacctggctagaaattaggctagaaatgagggaagctgaaggagaaggtagcccatctggagtaacgcactagtaacatgtatcagtagatgagcccatctggctgccacacactagtaacatgtatcagtagatgagcaatgatgtgtgtaaatctacagtagcacatcctgcccttcattgaccttacacacatggaatcaatgtctgtgctatgctcttgcacctgccgcatctcatgtaaaatgtctgttgtgggatatgctgaccagagctatgcaaggaaaggaattctggtaaatgtagttccagtttggcttaaattgacacaactcgaatccaccacaatggcatgacaaaaggagacaaatacaggggcacacacacaaaaacccccaaaatacaacaacaatactcagagagagagagagagagagagagagagagagagagaaagagagagaaagagagaagcaaaaaccacaggggaaaagggcaagaaaatgttgaaagcagaaagtgagtagacgaataggaacaggtaacagattaacataattataatgctgaatcttaatttacatgcagtgaaatccaagaaacaaacaaatccacattacaaaatcccccaaaggcacagaagtaggaatcatcagtcacctttgcaagtgaaggtgaaggtaagataaatacaggaagagtaaatctacatctgtgtaagaagtagttagattatcaatcctctttccagttgtggacacttggtgattgctccttcaccactgagagagaagactggaagtttttcttttggagaaaacacaattcctaaaactgagagaaaacatgtatggttgaagaaggttgtaccatattgaaaatggggtaaggtatgaaaacatttatatagaaagaatgctaagacctggccttcttctcttcagctccgagatattccacagccaagcatacatcctctaaatcatagactctaacaagagcaagagaaagacaaaagacactaacgtgagcatttctcacaaaattcttcagccagataagcctacattaaagtccttggaaggcaaaccacagacatttgtttacaaataccaagtagtatttcagggaccactatcaaatacgagagaacatcccagaaagcactattacatgaaatgtaagatagagaccaaaacaaaacacacaacaattaaagcaattaaccaaacaagcacagcttaaagggaacagcctatacggagcaaagaaaggatcaaaggtactgtaatatgattaatattcttagagacatgaatgaagtattgcgtcaatgagtcaagcatcacgtgctattagagaaaataatattcaaaggaaaaaaaccaatcttctataattttaaaaatactacaactgaaatagcttaaaacggaaacaacccaaatgttcttcagtggattaattattaaactgtagtatgtccatgttatgaaatactactcagcagtgaaactggaattgacaactgatacatcacaaagcttgaatggatctcaagggaattatttttagtgaaaaaggccagttttaaaaggaatatccagcttgagggtgaggagatgctttggggagacaactgtaaccagacgggtagctcaatatcccgtattacagcaagtcagaagaatccagaagatacttttgattttcaaacacattttcaaacatatgaaaaagataaaatcggccaggcgcggtggctcacacctgtaatcccagcactttgggaggccgaggcgggtggatcacgacgtcaggagttcgagaccagcctggccaacaggtgaaacctcatctctatgaaaaatacaaaaagtagctgggcatagtggcatgtgcctgtaatcccagctactcgggaggctgaggcaggagaatagcttgaaccaggaagtcggaggttgtagtgagccaagatcatgccactgcactccagcctggcgacagagcaagacttcaccaaaaaaaaaaaaaaaaaaaaaagaataaaggcaatatcatgtaattgtcccacatgtatccttcattcaggctcaacagttatcaatattctctcatttttatttcgactatcccctcctcacttgtttgatgcaacatcttatttatttgtttgtttgtgtttttttaaactgagacagggtcttgctctgtcacccaggctggagtgcagtggcttaatcatagctcactgcaggctcaaactcttggactcaagctactcttctgcttcagcctcctgggtagctgagactataggcacaagctacgcacccagctaattttaaattttttgtaaaaacggggatctaactatgttgctcaggctggtctcgagctctcagcctcaagtgattgtgccacctcagcctcccaaaatgttggaattacaggtgtgaaccactgtgcccagctgatggagaattttagaaacaaattgtggacatataattttactacaactacagtattcatagtgaacaactctctaacacaggacaactcatcttttaaaacataatcacactgccataattgtaactatcaaaattaaaaatacttaatataatctgttataaaatctgatctataatttttgtggttatcttaaaacatcttccctctctccctccctccctccctccctcccttctttccttcctaccttccttccttccttcttcttttcttcctttctttctttctcatcttttctttaatgtgtttgaattagggtctaaacaagatctaagcatagtgtttgactgactgatatatcttttgcatttcaactccatttttgccatttttgttgaagaaactaagtgaaacattccagtattgtagatttaactaattgcattcttacagtgtggctgggcatgtgggcctctttctgtaaattggtgtttagatcttggggctcgaatacatttatcttcaatttttgtggcaagaatgtgttttagatggtgttacatatgtcttattgtgccacattagaggcaccctgataatcacttttcatgatgttaagattgacccatgagttcaggtgttaattgaatccactgactaaaatatcccattaatgtttcaactaatggtttggcagtccttgatgatcattgtttaatcctttatctcactgggcattactaaaggatgattttcaaattctattattcttttgcagattctggtttggttattctctaaagacttttttcatggactgttaagttgcattcaaatacatttatacaagaaagacaggatatgatctctgttctttctaatattcaggacatgacttcattctctattaaacttcagaggggaccaatggacttgagtagagagacaagatagatgctacgtaggtagatagatagataaataaatacatacatacatatatacatacatacctacatacatacatgcatacatatataaattgattgatggatagatagaaactaataaattgtatatatttaacaatcaaagtgactattattttttatgcccaaattgtcccatcaaactaactcctgggctgttttgagataattccagtctttaataaaagtcttgtttttaggcaaagcaagacattccactttcattctgtacttttcatggtcccaaaattgactcagtaaaatcttttttccttttatgtgttaacttttatttagagacaactctctgtgcattaatttgcttcttgcactttcagtggtccaaatgtgaaaatgcatcattttttgaaagcattaaattataagcttaagcttattaccaattctaagatatattgcagaattttatctgtttgcattttatattttatcttttatgataagtaatttagtttctgttgataagacaattattagctttttcttgctatgtttaatagtttcataatataatagcaatatcgtttaaaatgaggttattaaatgtatttttatattttaaatttttttggtaggatacatcctactagtcaaactactgtttcaatatcaaatatgtttaaatctatacattcataataatactaaaaatattttcatccgttactttggggcaccctagggaaacatttcagcatttcgaaactgatgaattaaagtgaaagcatcaaccatgtaactcgcttttcccaaataatcttgtagtttagggaaatcaaacgatgaaggttgtttcagttttgtaaaacattcccattaataaatcaggaagggatgatagcattagattaaccacctacaagctggtttgtctttgggcaaagtacttatattttatgaactcatttacagtgtccataaatggcaatgctgttaccaggctttgccctcagagatctcccagttactgagccagcatttaaggaacaagtatatcaataacagtaggttaactaagatggtaaatcaccccaagatctcaatgacttagtgaaataaacatttattttatgttcacatcccatgctgtgtgacctgttcaatgaagtcaaacaatgataaaatccatgtctaccctattgatccatttcatttagcttcttgggatttttttctgagaattttggatgcctcactgatttgccttgggcaatggggcatcagcaaacatcatgcaagcagaggcctgacaagtactttgtttcttgctgttctgggaggctgtaccatgtaaactcccctgctacagtgtgagaggccacgtgggccgaagcaaagaactacagcttaccaccacccagcctggctgacccagcagctgactgcagatgcatgaactgcccagccaatcccagactaaatggctggcctgcagaatcatggcttagtcatgacttaaagtcaaatttggagttttatgtgtgtttgtttttatacagcaaaagaactgatgcactgaggatatagatgatggaagattagcaatatactgggagttgctgaagctggttgtgatgctagcaggatcctctctgtgctctttgtatttgaaagtttctgcaatgagaaagttaaaaagaaaatattaaatttcaatattgctttaaataattcctggttaaattatcttgttttcattttctttcaatgtttaagaactattattctaggctgagtgtggtggctcacacctgtaatccctgcactttgggaggctgaggcaggtggatcacacggtcaggaatttgagaccagcttgactaacatggtgaaaccctgtctctactaaaaacagaaaaaattagccagatgcggtggtgtgtgcctgtagtcccagctactcgggaggctgaggcaggagaattgcttggacctggcggaggttgcagtgaggcaagagcatgccactgcattccagcctgggtgaccgagcaagactctgtcaaaaaaaaaaaaaaaaaaaaaaaagaaggaaagaaagaaagaaagaatagaaagaattattatatttaacttttaaaaattattgaaaatagttttatggtttcaaaattaaaaatataagacattcagaaatgtctcactttcatctttgtcccctcccacatttttctctctctccatagttatcctcttatgttaattcttacctgaacattttggtagatattttagatagttgttagtaaatttggagttaaattagcaatttatatgtagaaaactaggcaaatgagaaaatatgacaattttaaatttcaagaaaaactaaattttgttcagaaaagaaaaagtaatcacattataatatgtagttaatctatgaatagcatttacaatgtcatatcaccaaaatagtaatcattgatgtagctaaaattattatacaactagactggatggatgggggaatggaaagttgtttttattttggggatggggggataaaaagggctaaattcccattttccaactgttaaataaatagataacttgtaaaagtaaaaaaaaaataagaagtaacaatatagacatgctatttagtcattccagtcaataacagaaaaatgaactaagaatgaaaagttatttctgtgcagaagggaagttggagctactgatcttttataccaaggcttgtggtttatgatgaaaattgaaaaaaaaaatcaggtatacaaaaactgtattagtccgttttcacgctgctgataaaaacatacctgagactgcgcaatttacaaaagaaagaggtttaattggactcacagttccccatggctgggaaaacctcacaatcatggcagagggcaaggaggaacaattcacatcttaagtggatggcggcaggcaaagaaaaaagagctggtgcagggaaactctcccttttaaaaatgatcagatctcttgagactcgttaactatcatgagagcagctcaggaaagacccgccccctaattcaattacctcgcaccaggttcctcccacaacacatgggaattgtgggagttacaattcaagacgagatttggatgaggacacagcgaaaccatattaaaaactcataaaaaaaggagaggcaacaagtcatgaaacaacactactactattaataatataggctcatattaatcaagcactttctatgtgccatatgtggattgtgtctttgaatccttactacaacagtatgagggaggctctttttgagttactgtagtctaatgagacaatttatacttcgagagttgattagctacctattgtaatgaaggattctaaaacaacacctggaaacaacagacattatcatctcagagtgtctctgggaccgtaagcaacttagctaggtggttctgtcttggtctctcatgcagctgcaaaaaagatgtccacagggctgctttcgttttaaggcttgatatggggatcttgctttggtgcccattctcagggcatgctaccaaaacttccaggctcactcctgtgggcctcttgcaagggctgccttgttacattggagttggcttctaccaccgtgagtgacctagaacacccaagatggaagtcactgttgttttataatctaatcttggaaatggtatctaccacactatcatattctatttgttagagcaagccagtaagtccagcccacttggagggaggatgtgattttgtcagcagaacatgaatcccaggaagtatctgtccatcacgggaattaccttagaggttgcctagcacaggtggggtagcttgtccacgcttccacagggagaaaggggtagccctgccaggaaaaaccacccattctgattccaaggtttatgttcttaactactatgcaactgctcacatgctgtggggtggtgtttcccttttgtgggacaacagcaactccttccacatagctgtcatcccgggaatgtgggagtggttgggaggtcaacatagacaacagctgattttcacctttgtgacaaacacccaagggcattatcaggtttaggcaaacaaaaataatctgtacattatgctcacaatgtggggcacagattgtggcactcccacatacctcctgctgcggaaagtttgctggaatgcaagagagaatgccatgagaacaaggataaccttgagttcactctaatttataaaaagtcaaaccctctcaggcttcataactttcctggtaataaattatttgagccacccctcacatttgatcatgacaaactgcagcttcctcttcctgggatgggacattagtcacaaggggcaggagttggctaggagaggagttggtactatatcttgaaagctgttgggagccactgaaatgtttaaagcatcatagggtgacatgattggagatgtagctgctgctctgagcaacagcattttgtctgaagcatcagacaacattctatattctcatatatgagacagtagatgtctcctttatacccccaacagatttattcatgttagcctaataaaatttatatatttcccaaacttgcagatttatcaaagctccctatctcaggacacctgaacctgcctctatctgagcatgcagacttttgtggctgccaatcaagctgtgagctttctggggtagagatttattgcctcctccatggttccatcctctggtggcaacctcatctgttgacacgtattaggaactcagtaaatgcttattaagtcaaaataaactgaacttcgttgtgcacttactacatgttatgtactatacttagtactaggtacataaaaataagacagtctgggccaggcgcagtggttcacacatgtaatcccagcactttgggaggctgaggtgggtggatcacgaggtcaggagttcgagaccagcctgatcaatatggtgaaaccccgtctctactaaaaatataaaaattagctgggcgtggtggcatgtgcctgtaatctcagctactcaggagtccgaggcaggagaatctcttgaacccgggaggcgagtttgtagtgagccaagatcaagccacggcactccagcctgggcaacagagcagactctacctcaagaaaaaaaaaaaaagaaaaagtctttaattagtaaaaagccatactgtatgtaagcagtaatttttttaattcatgagtcaaacattggctcaggccctgctgtgattgttgcactctgctagatgctggggcacaacatcaaatgacacgtgaccactactcttacaggttctgtaacccattgaaagagacacaatggtatttggatgatccaagctcagtatacagtgggagcaaggaggaaggtcatagagataagcaaagaggagggccatgtaagaggtgaggggccacattttgagaggcattacctctgcactgattttaaaagaatgaatgaatttaaataaatggaaaataaggctgggcctggcggatcatgcctataatcccagcagcttgagagactgaggcaggagaatcagttgaggctaggagttcaagaccaacctggataacagagtgagaccccatctctataaacatttttttaaaaaaattagtcagggtggtggctcacacctatactcccagctactcgggagactgaagtgggagatcacttgagcctgggagtttgaggctgcaatgtgccgtgagccgtgatcgtgctactgcagtctaaaacaaataataataaaaagagagagagagagagatgaatggaaaatctgaatgtcaaacatcagtatcaagccactggtactggtgtgttaaggcttggggaaaaagtcaaggatatagaaggagggaaatgaatacacatagagcaaatctaagtaggagttactgattcctgcaaagggatatgcagagccaagcaaagttttatctctgctgcctttgtctttccagccatctacgagcaatcctgcgaggtgtacaggcaccaggggaatacagccggcttcttctacatcgactcagatggcagcggcccactgggacctctccaggtgtactgcaatatcactggtaagggtgcagtagccctactcacacttaaccaccccacttcatggaaggaagcaaaaataaattcactggagggggatacctacgtgaataaaaatttgaaagaccaactggtctcctttggggaggaaatggtattctggtgagtaatgcaaatttgcagctaggttaattttcatgagacagaaaaaagaaaacttgttaatggtcttgataatgtttcactgaagcaagaattaattatcagtggttttctttagggcctccaagggcattttctctcctgaaactcaaaaacagaaagaaaaggtaaataagcaaacaaacaaacaaaactccaaatcagtgggaagccctgactcaggaagctggaaagcttgattccactctggccccaagggatgcatgacccttaggtgaatactatagtttctctgagctttatcagtgaaatgagaataatagtggctacccccagagctgtgagaattagatacaatcatgtgtattggagcagctagccaggctggttgttcttagatgcctaaccaaaacaaaacaaaatgaaaaggtgagttttttcatttttctctggaaatttcttgatagcttaaacttatttctcaaatgcagaaggacatggtaagaggcaatcattacatgggcttagaaatgacatatgatccttaatttaccatgaaatacatttccacaaaaccaaatcttgaggtaatcattatttaaaaatccagctatgcagccaggtgcgatggctcacgcctgtaatcccagcactttgggaggcctaggcaggcagaccacgaggtcaggagatccagaccatcctggccaacacggtgaaaccctgtctctactaaaaatacaaaaattagctgggtgcggtggcatgtgactaatcccaactactcccgaggctgaggcacgagactcgcttgaacccgggagacggaggttgcagtcagccgagatcgtgccactgcactccagcctgcgacagggcgagacaccgtctcaaaaaaaaaaaaaaaaatccagctatgcaagcactcctattatgagcatcattaattggcacacgcacattttttgtttgtttgtttgtttcaagcactggtcttcagagatgccagctgcatcatgtaatgaagcaggaacgtaggggcctctttaggctcattgagccttcaggcctcaggattttctgcaacaaagcaaccacatttatggagtgctttctgtaggcagacactgttttagatacagagggtatgaaaagtaagacacagtggctgttgttcatgaggcagtaaagtcaggaacactaccgtgaggtatctccagctaaatgcaagaaaactattggaaagaaatggtgagtaaggaagcacagtaatttgcccatctggatacaaagtcctatgctgtctgcgtagaaaatgctggtgacctggcattgggtgccacgtccttgcatttccgtaataactttctttatctctccaaaatggttgtatgatagctgcttttcaaaagccctgtaacataattagaaattgtgctcctgttgtcttttcatggttgtggtaacctatagtgttcaacaacctggtcaaaaactaggcttctcagtggatctcggttattttaaaaatgtaattaacatatggactcttgctaaaaaggcagatttcccagccccagaaattccaattcagtaaatgcacttttactgagcttttcaagtgattctgatgcaaattgtccctgttccacttttccaaaaaacagggaaagtaatttggctgcaaataaggcaaaagagataaatgcccactgctgagtggccaggtgtgacttgtaataataagagtggtataatggacagcaattactgagcttcgactctctctgggaattgagctgggagtttacaaataccatctcttttcatcctcacaacaaaaatcagaggcagacattttttttatctccatctaacgtagaagggaagagaatatgagcatttcatgactggctcaaggtaaattctgtgactaacagtcaagacttaggaagcgggcatagccttctggttcagtaataattcatatcactaaaatgttaattggatatgttctattacatacattttgtttttaaagtgttgttttattgttagaaaattttgtaacaataattgaagaaattttgagggaaaaaagtatgaaggaaatattaaagccaactgtaatccgcaatccagagattgccattgttattaaattattagaatttcctcaagacattttaaaatgaatgtttatgtgtgtttttgctatgaatgtgtatgttatatatatacatacagacacagaaatatacatatacatttaaattataaattttaattttaatgtgttgtgtagattttccctattaaaatatatattgaaattaagataaatatagcttagaaatgttaaactcttcaaaataatgcaaggacaaggacttagagagtctgactgatacataggtttcatgtacatgaaactctctgcctcaccatccaacagccttctcccagggtttatgtttgatcatttgtccaagaatggctaaaggtgagtgtgtacttgtatttaaaggttactgttttgctgatatgatcctgaagaaatcagagcctctgaattgtgtcccgagttgatcagcttgatgcgtatggtggggtatttattttgaatatgatttttttgggtcatattcagctgcacgatgtctaactttctgtttttgttttttaaaatacctgcaaaaataaaagcagaccaggcatagtgattcatgcctgtaatcccaacactttgggagaccaaggcaggaggatcatttgaggtcaggagttcgagaccagcctgaccaacatggtgaaaacccatctctactaaaaatacaaaaattagccaggtattgtggtgcatgcatgtagtcccagctacttggaggctgaggcaggagaatcacatgaacctgggaggcagagattgcagtgagccgagattgtgccactgcactccagcctgggtgacagagtaagactctgtctcaaataaataaataaacaaataaaaataaaataaaagcaaagctctgtgtaggctgaactacacaactctcatatttaaatggaaaacaattttctgatacatacatgtaatgatgatcaaatatgcatctttctatttgaaaattttataagttgaatgttgttaaaacatgagtgacttatcacagtatgaaaagtgtgacacagtggtccagggaagagagtcaggaagaagggagagaagaaacagaaggaaacttgtgctatctttaacactgggataatcccagaatgggtgtccagagcaccagaaggcaggaaaaccaagctctctttctgcaccttgtgcctgtcagctcagttaagtgcctggggcccaagcccacatctgtaaaattaagatctgggtcctctggcttccacagcctttcctcgttgagaattctctgagcttttctttgaggttccagagaaaagagacttttcttctaagaagtctacagatacttgcaaatggatgtcatgggactgaagatggacaggtttccattgtagaaagcaatagtacatttgagtcccagctgtctcctcttacagtgcaccctggggaacgttagctcccccttcctatatgcaaagtagtccctaacctgtcctgggagatgtaagtctgtgcatctcacctgcacacagggcagtcttcaggaggggagttccccaaatgctcaaccagcaaccaccctatgtaatgtaaaaagccataatctctgtgaaaggaaattaacttaagggagatgattaagcttactgataaagtggactgaatctggacctccgcacacttttgacggggtgccatccttggaactatgttctaagttgcttcaccacagggctatcagatgggagacggggagagcacaatttttggttggagaattgagtgaagtgatggataaggaagttaaagagtaagcttccagaggaacacacacttgtcagacttttaacaatttttttaagtgatttacaataaggttcagccaatataattttactcaatataaatttgggcattgtgggcactgtgaaagtgctgtagttttaatagtgtgtctatattagtttcctagggctctataacaaactacataacactggttttatttcacaccactgcaataaaatgagtatcacaataaagcaagtcacatgaattttctggtttccaagtattaccgcaaaggggtcctgatccagaccccaagagaaagttcttggacttcactcaagaaagaatttggggagagtctatacagtaaagttaaagcaagtttattaagaaagtaaaagaataaagaatagctattccataggcagagcagccccatcggttgctggttggccatttttatggttatttctggattatatgctaaacaaggggggatttatcatgagttttccaggaaagtggtgggcagttcccaggactgagggtttctcccctttttagaccatgtatgataacttcctgatgttgccatgacatttgtagactgtcatggctctggcgggagtgtctcttagcatgctgaggctattattattagtgtataatgagcagtgaggatgaccagaggtcagttttgtcaccatctcggttttggtggtatttggccagcttctttgcagcatcctgttttatcagcaaggtctttgtgaccagtatcttgtgccaccctcctatcacatcctgtgactaagaatgccttaacctcctgaggatgcagcccagtaggtctcagccttattttacccagtccctattcaagacggagtcactctggtttaaatgtctctgacacaagttcatataaaagttatgtttacactacatggtaaactattaattgtgcaatagcattatatcaaaaaaaaaaaaaaccaaagtctatgtcttaattaaaaaaatactttactgctaaaaaatgctaacaaccttctgagccttcagtgagtcttaagagaccccatcatttttgctggtggaggaaaaagatgttagtggctgctaactgattaggatggtggttgctgaaggttggggtggctgcggcaatttcttaaaataagactacaataaagaatgtcacataattgactatttcttttatgaaggatttctgtgtagtgtgtaattttgtttgatagcatttcacccacagtagaacttctttcaaaattgaagtcaatcattccaaattctgccactgctttagcaactaagcttgtggaatattctaaaccttttgttgtcattttaacaatgtttacagcctcttcaccaagagtagattccatctcaagaagccactttatttgttcatccataagaagcaactcctcatccgttaaaattttatcatgagaatatagcagttcagtcacattttcaggttccacttctaattctagttctgttgctatttccaccaaatctgcagttactccctccactgaagtaatgaacttctcaaaatcatccatgaggactggaatcaacttcttccagtctcctgtttgatattttggcctctcccataaatcatgaatgttcttaatgagatctacaatggcaaatgctttccagaaggtcttcaatttactttgcccagacacatgggaggaattactatctatggcatttgtagacttataaactgtatttcttaagtaataagactgaaaagtcaaaattactccttgatccatgagctgcagagtaaatgtgatagcaggcaggaaaacaacattaacctctttgtagatctccatcagagctcttgagtgacctggttcattgtccataagcagtaatattttgaaagaaatcctttttttgttgtttatggacaggagttctcaatggtgggcttaaaatattcagtaaaccatgctgtcaacaaatgtggtcccatccaggctttattattccatttagagagtacaggcagagtagatttagcataattcttatggatcctaggattttgagaatggcaaatgagcattagcacttgcattagtccctaccaagagatacagcctatccttggaagctttaaagataggcattgtctttcttctcttctctacctctgataatcttagatggcacctattgcttagtgtagccactttcatcaatgatctttgttataccttatgggtaacttacatcagcacttgctgcttcaccttaaacttttatgttacgaagatggcttctttaattaaacctcatgatccggcctctgctagcttcaaacttttcttctgcagcttcctcacctctctcagcctttatagaattgaagagggttagggccttgctctgggttaggctttggtttaacggaatgtcgtgcctggcttgatcttctattcagcagctaaaattttctccacatcacccagaaggctgttttgctttcttatcattcacatgttcactgaagtagcattttaattttcttcaagaacttttcctttgcattcacaacttggctaacttgcacaagaggcctagcttttggtctatctccactttcaacacaccttcctcattaaggttaatcatttccagcttttgatttaaaatgagagatgtgccactcttcctttcacttgaattcttagaggttattgtggggttactatttggcctaattttgatattgttccatctcagggagtagggaggcctaaggagaaggaaagagacagaaatcattggccagtagagcagtcagaacacacaatattggtcaattaagttcattgccttatatgggtgcagttcatgatgccccaaaacaattagaataataacattagtgaccactgatcgcagatcaccatagcaaatgtaataataataaacaatttgaaatattgcagtggtggattcgtggctcttgccaatgttcaggctctaaggatataacaatgataataatataatataataacgataattataataataatatacataaattaccaaaatgtaacacagagacatgaagtgagcacacaatattggaaaaatggtaccgacagacttgctcaacatagggttgccacaaatcttcactttttttttaatgaactatctgtgaagcacagtaaagtgaagttcaataaaacaagctatgcttgaaccagagactgggtgacttataaaacagaggtatattttctcacagttctagagcccagaaatccaaaagtacctgcagtgccacacttcctgttaaacctgtagggtgaatctcttcttgccacttcctagcttttgatggtttgctcaatccttggcactccttcacttgcagcctcagcactttaatctctgccttctagagattgctaccctgccttcatgtgatgttgtcacgtggccttctcctcccatgtgcctgtgtgtccatttcttttcttcttacaaggatacccttcatactggattaagcccaccctaatggagtgtgacttcatcttaacttgtttacgcctgtaaagaatctctttccaaatagattacattcacaggtacggagggttaggacttcaatatattatctttctggtgacaaaattcaacccttaatagtattatttcagtcttcttcacagactaatcaaggagatgacacagcagcaattaacgtataaggacaatgacaaggtgtgcatagtgcttgttgggagctcacaggagagaccctaacctagcctggtgtgcagtgggaaggctactgggcagcagataatgcctctgaaacctgaataggagtagaagctggtcaagagctgcaggaaagcatttccaggaagacagaatgaagggcaggaacaaaggaccagcatccctagaacctgcatgtttttaggagtcaccaacccactgagctgacttgataggttggaacccagaaaatctcataaagctgtgactgaacagaagagaaaggatcaaattgacttgagcagcagcaagcaaaggctgttgaagctctgtaatctgaactagagtttcccagcacaaacatctgctgtctcagattcaacagaatagaaaaggaggaatggctttatcatagatagctcttcagcatgtgagactatttagctggccctgaaaaaaattaaaaaaaaagatgagcaacagactaagaggtagcaacaagatgtcctcacagcatgcatggaccttagcactgaccccatatcttgaggacagtggatctctcgtatggcttgttcaaattagggactattcataaaggtgtgaatatataaaaggaatttatagtgtagggactatagcacagagatactaacagagtgggaaaaaggcacatgttcagaagctgtgcctctggagatctgtggccccctgtgtgggaagcagccagctcaatccagtgaccactttgacctcagtctctcgttgctccttctaggctcctttctatgctcccctctgatgaaacccaactagaatcgagaatgcaggagtgcgtattgatagaatgcttttagtcagccttcctgcgcacagagaaggctggagatgtgcagaaagtggaactggtggggcaagtggaagatttccatattgacctgcttaaaggactgaccaaaaacgtctggggaaaatgattaaaattcataagaattaaggatggtggtgagggtaggggctgtaagtggaattcacaaaccatccaaataaatgaagcgtagacttgttaaatcaattttaacctgaacaagaaaagaccactctttatgggttaaatggcactaaggttagaatgaatgtaagaaacacacactgaataagatatttagaaaatgacctactccaagatttaatacaggtactcaatttataaacaacctagaaacaagtaaataagtaagaaaaactgtgacatgcttaaacgtaatattttgtcaaaaggtagttctcggcttcatacctccatcggatgataaaaatctggaatggatgcagagcatttcagccaatgatgtaggagtttgtgatcatcctttgctgcaccaatctaattgggtcggtagggaaagatgcatttgagacaaccaggagtccactggggactaagaattgggtttctggatgaaaatgcacataaggagaccttgcaggatgggtgagatgtcaccaggaagaaaaggagttcttggaactgggtcccatataaaagaaatggagaaagagcaggtcacagtaactaattgaaatccgtgaacacctgaggtggctgtataggaagcttgggttgataaaacagaagaatcggcttctgaggtggggcgatctgcccttggggtgatggttaattttatgtatcaacttggctggaacatggtacctaatatgtgaacatactgtcctgaatgtttcctgtaaaagtgtttttggatgagataaacatttaaatcagtggactttgagcaaagcagattgacctccataatggggatggacctcatccaatcagttgaaggccttaatagaacaaacactaacctctcccaaatgaggaggaattctgaaagcagatgtctctggtctggaactgcagctacttcctgggtctcttgtctgccagcttcccctgcagattttgggcatactaaaccttcataatccaatttcctgaaaatcaatctccttctctcactgtctcattcatatatatatatatatatatatatatatatatatatatatatactccttctctcactgtctcattcatatatatatatatatatatatatatatgtagtgcacacacacacagtttagtttattcaggtagttctgtctctggacaaccctgactcatccatttgggtgtctcaagatgggtttaatgcccctactctgtgttctgctcatgacattaatcacactgcattataatgcagtgtttacctatgtgtccccacagggctgtgagctccttgttggaaaataaggaacagggtgtgatgaatctttggatctacttttatacacacttgaatgagtctagtgtaaattgaactctgagaaatcactgccaaattgaagactaatttctatctttcccgtttttttctttcctgtttccataatctatctttgactcaagccctgttccattaaatcaataacagtttgggatgttggaaacagcctcagtatttaatcttgactgagcttgagtcattcctactctttgcaatgccttctataagtccaagagtacagagtgcccatctgttcctcactgccttcatgactgtttgttgctgctcaacctctctccaagttgctgtttccttcaaacatagaaatgactaatgggtagaaatatgatttggagtcacactggagtttaaattctagcacattctagctgtatgaccttggataaatcatctaatatttctagatcttggtttttctagctggatggccttggataaatcatctaacatttctagatcttggtttttttatcagtagtgtggagacaataaaaaattggtgacatgtaagattgtgagaattagcatatatatatatgctacacacacacacacatgcacacacacacacacacacacacacacacatatatatgcaaactttctagccttaaaaagtagatggtcatttaatatgctaatgtaatgtcatggtgtgattattaattgtgtctacaaccactcttacagttgacatagtatgaatgatattacatagtcattctagtcatgaaagatagctatcacctttgccagcgatagaaatagaatctttacttgtataggcaccatgagatttcagaggctcttggagcctggagagagcatttctgctgggactccttcaatattgataaaacagaattataagggtgaggcaccctgacaagattttccttgaaacttgacattaaactgattctactcagtttacattgtgccttttttaatgttaacaggacacactgtcaatgtgttaaaagatatttcttagctgtatactgtttttcctttgtacagtacaattgtacattgatatgcaaaattgtttgtctagaatcactagcaaaaacacatttatttcttatcttgatggattcaatgccaatttcatgcatgtggatctgtaaggcaatcatcaggcattacaaggaatttgcaaggaacatttagtcaaatctctaaagcgaaacttattttccattctcaaacagctcataatccatttgcaaaccaacttacaagtctccatatcttgtcactctggctattatgatgctctgtttctcactcctttggcagcagcctctgttttcattaaaactcatcaaagcatgcataatggagtaggtagaaagctgcaattgaggtctctccaatatttctgcacataattgtgcagtgtgattgcagtaatagattatcatcccaggtattgacataaagaaagaaatgtatccatgtggtttggcctaaattggtagccttgcttcctgaagttagagcgatgtcagtgaatttacctgtgggctgcacccaggtctgccagtgtaggggaaatgagaatgatccatgacataaaatgggaccactggttatgaaacatttatttctccccagccttcttaggatgttgttaattttgccagctgtatcatatagcaaagtaagtagaatttagttgattacgtgatttgtatctgtaatacaatttggtactggtatctccttgcagattcctgtttgaaaacactctactttctttttttttcttcaacttttattttaagttcagtgctacatatgcacgatgtggaggttttttacataggtaaacgtgtgccgtgatggtttgctgcacagatcaccccatcacctagatattaagcccagcatccattagctattcttcctgatgctctcccacccccgaacccccaccctttgacaagctccagtgtgtgttgttccccctccatgtgtccatgtgttctcatcattcagttcccacttgtagatgagaacatgtggtgtttggttttcctgttcctatgttagtttgctgaggataatggcttccacctccatccatgtccctgcaaagacatgatctcatttctttttattgctgcatagtattccatggtgcatatgaactatattttctttatccagtctatcattggtgggcatttaggttgattccatgtctttactaatgtgaataatgttgcaatgaacatacacatgcatgtatttttataaaaggatgatttagattcctttgggtatataaccggtaacaggattgctgggtcaaatggtatatctgcctctaggtctttggggaattgccacactgtattccacaatgggcgaactaatttatactcccaccgacagtgtaaaagcattcctttttctccacagtgtcatcagcgtctgttgtttttactttttaattgtagccatcctgattggtgtgacacgatatctcattggaaaacactctactttcaaaacccacacacactcacacacacactcacacatgcacaagtgtcaacttccattgccctacttcaggcttatacaaaagcaagctgagttcaagttctgaagtttgcttttttatcacaagttgggtaatcatcattgcaaaagtattgttaccacaaagttgtcatttgattacagactgtaaaatattgcacagaatatctacagggtaccaagctagtacaacatgcattatgatgaagtagctggaataatttttattttataagtgcacgaatgaggctagtaagtactagaaacaggataccaattatagctgtctagagatgaagcttctgccctgtatgctgtgctttttatcaaagggtagtaaggcatgggtggcaacacttcctctactatgttgaatcaatattcattggttatctgttctggccaggcactgacaagccactgggaatatagaaatgattaagatatggtcctgcaagttcacagactttataatctcatgtccttgtgggaaaaaatgcccatgtcttcagctttccccatcgtgattcataattcacacaacagctaggctgatctttaaaaaacacagggatggccatgtctccccatcccttccacctctacctgaataaattcccatctcctacccatggcttacaatgtttgaagggcatggttgtgaatctttataagtttatatgcatcaatgaaaactcttagaacagtgcccataatcactacaccttctgaattactatattattgtctaattactttgtggggacatgagtaaaaccctccatctttatactttagtttctctgtctgtaaaaggagggtgatgatgacagctttttatggttgccacatagtcaattgaatgagttaacatgtaaacaatgtcagaaagtgacagtcacagagaaggtgggaaagaaagcctagatccttctccttatcttcttttgcctttccttggaaacacatccactgtctttagggacagcaggtttagttcatcctagggaggagctcacaagctgagtcccctggtggcacaagcattgtttcctggttgagactcactcatgggtgacatatgtgctgtggctcactggtagtttaatcagttggaataatacttgtattgttgcttatatttcagagggacaatttgctttctgtaaatgaagcttttccagaggactattttaggctgaagaatagtaatttaacagcttagaggtgggaatttttatttaagtgtctctcttttctctctaatgggtttatgatgttgaccaaagtgtggtgaccacatagggcttccagaaggctggtctcttaggcgaagctctggagctgctctgcgtgtgttgaagggctgagctttaaagtggtctctctggactagtggcagaaggcataatctcctgctaaattgggccattaaataaaactactaagtcataaagctgtagtattaccctgaaattaaagcattgtcacctttgagttgccaagaattttaacaggcacttagagaaattcctttcacatacccgttttagcacggccagttgactccaacccacatggatggtagcaggaggctcaggtgattgcagtgtgattttaattcatttacttgatcattcattcatccatccctccctttactaacttatttgctgctttcttgaattcctttattatcttctcatttatgtattcatttgttaattctctcatttatttacttcctcatttattttttcaggtttttaattacttacacattattcattaattcagtcactctgtcaattattcagttggtaattcagaaattaagtaattcaaataaacttttgaatattgactgaacttgacatcaagtttacaaaataaataaatctgttcttgtcctcaaggaattcacagtttggagaagatggacattgtaaatggatattttgcacagtgtggaaaatagaatagaagctggtagatggtacagaaatagtacaaaggaaacaggggttgaaagtacacaaggaggctgggggtggtgggcagagaagatgcccttgaagagctgccctctgagctgaattttgtagtagaagcagctaacatttatccagcagctgctggtattaggcaccatgctaggtattttatattcaagatgttatttgattttcttagcaatccatgttacagagataggcaccatctggagagactaagcaactagcccaaggtctcacaaggagcaaacggtaaagccaggaatggaagctatgggtgaggttgtgaggctgggttattaaggccaggtgacacagtctctgaaacagagaaagcctcctgtgtccaaacagaattcccctctggcctgcattgccctgtctcttgttcacagtcccttaactcaatgccatggtggaaaactcctccaggaagtagccttgaagggtgagggctccattatacccactttacctccgtgtccgtcactttcctcatctgtaatgtgggggaaatcatacccacttttccaggttttcctgagtatcatatggaaattatataaagcagaggttcacaaagcttagttttctaaagcatgagctgggatgaacatttaagacgctattttctaggcctattcccagcaatgtttattcagtaggtatagcatagtatacttactacagtatacatagtatagtatacatagtatagtagtgatcagaaatagcatgtttagcaagcacctgaagatactggactttgggatatatctatataaggtgattagcacagtgctcagtgcttaataagtccccatccttatgtatctccccacttccgaggggctcaggccagggcctagaatcgctgctcttctaagcactgaacacagggcttatcctgactccttccggatgggtcttttcatcttttactgcagataactggtgagtctcatttttggcatcaggggattgggagacagtccagtcaacaaagatttattgaggcactgcttgcgtaatgtaagctgctggtccacacacaaaggacctcacactgtaacaagaaaataaagccatccatctcttacagcaattttagctaggccattttatttattcgtacaactatcctgtagcaacttgacaatggaatcctggtcaagttgcctaacttttatgaggcttaatttcctcatctgtataatagaaatgatcacttattcttacctcaatgagttgtacaaaattagatagaattaaataagcaaatgtacccaacacacccagtacaatatctgacatgccctaagacctcctaaaataaaagtaatcacttttatttcagagccaacatcatagaatgatctagatgctaaaggaatttagagacaggaatagtcaaggaagcattatgggagacactaggcttgggtttgaccttggaagacaggtatcctggggtgtgttagtccactctcacattgctataaaagttatacctggtaagaaaggggccgagatggcagaaaagaaacagctctagcctgcagctcccagtgagacgaatgcagaacgtgggtgattactgcatttccaactgaggtacccagttcatctaattgggactgactaggtggtgggcttgacctacagagaatgagaagaagcagagtgggtcatcatttcacctgggagctgcactgagtgggtgtacctccccgctgagccaagggaaatggtgagggactgtgctacctgccaagggtactatgcttttcccatggatttttgccatctgtggatcaggagattccctcgtgagcctacaccaccagggctctcagtctcaagcacaaaactgggtggctgttcgagcaggcactgagctgcaagagtttttacatacatcgggggtgccttgagctccagtaagacaggagaacagtccactcccctggaaagggggctgtagccagggagccaagcaatctcgctcagcaggtcccacttccatgggcccagcaagctaagaaccactagcttgaaatccccgctgccagcacagcagtctggagttggcctgggaccactgagttcccggtgggaggagtgaccatcattactgtggctttagttttcccctgacagtgctaaggagactgggagatttggactgagcagaattcaccacagtgcagcaaaggagctgtggcagatcatggctagatggcttctttagatccctcctcactggagagggcctccctgtaggaaatctagcagctatagtcaaagacttacagaaagagctctcacctccctgagacccagcatctgcggggaggggaagccgtcatctcaggttcagcagacttaatctttcctgcctgccggctctgaaaaaatcagctgatccaaatgaggaggattccccccagcacagcacaccagctcccctaaggggcagactgtcttctcaagcggatccctgaccctgtgcctcctgactgggtgagacctcccaacaggggtcaccagaaaccacagacaggaaaatcccagcggacatcaggtcagtgtccctctaggatgaagcttccagaggaaggagcaggcagcaacctttgctgttctgcagcttgtactggtgatatccaggagaaaagggtctggagtggacccccagcaaaccacagcagacctgcagaagaaaggcctgttagaagaaaaacaaacagaaagcaacaacaacatcaaaaaaaaaaaaaaaagaccccacaaaaaccccatccaaagttatcaccctcaagatcaaaggtagataaatccatgaagatgaggaaaaaccaatgcagaaacactgaaaaatcccaaaagtcaaaatgcctcttctcctccaaatgattgcaacgtctccagcaaggtcacagaacggagctgaagctgagatggatgaactgacagaaatagacttcagaaagtgggtaataataaacatcactgagctaaaggattatgttttaacccaatgcaaaggagctaagaaccatgataaaagattacagcagctgttaactagaataaccagtttagagaggaacataaatgacctgatggagctgaaaaacacagcacaagacaatcataatgcaaacacaagtatcaatagccgaactgaccaagtggaagagaaatggcagagcttaaggactatcttgctaaaataaggcaggccaacaagattagagaaaacaaatgaaaaggaacaaacaaagcctccaagaattatggtgctatgtaaaaagactgagcctactactgattggagtatctttaagagatggggagaatggaaccaagttgtaaaacacacttcagtgtatcatccgggaggacttccccaacctagaaagacaagccaatattcaaattcagaaaacccagggaaccccaataagataatctatgaaaagatctaccccaggacataatcatcagattctccaaggttgaaatgaagcaaaaaaatgttaagagcagccagagagaaaggccaaatcacatacaaaaggaagcccatcagactgacagtggacctctcagtagaaactgtacaaaccagaagagcttgggggccaatattcaccattcttaacaaaaataaattccaacccagaatttcatatctggccaaactaaggtttatgagcaaagaaaaaagtaaaatctttttcagacacgcaaatgctgaggcattttttcaccagcaggcctgccttgcaagagctcctgaaggaagcactaaacatagataggaaaaaccattagcagccactacaaaaacacactgaagtacacagaccaacaacactactaaacaactacattaacaagtctgcaaaattaaccagttagcatcatgacagggtcaaattcacatataacaatatcaacattacattaaatgggctaaatgccccaaataaaagacacagaatggaaacctgggtactaagaccagacccatcagtgtgccatattaaagagacacatctcatgtccaaagatgcacatagaatcataataaagggatggaggaaaatttatcaagcaaacggaaagcagaaaaaagcaggagtagcaatcctagtttctgacaaaatagactttaagccaacaaaggtaaaaaaagacaaagaagggcattacatcatgctgaagcgttcaattcaacaaaaggagctatttaaaatatatatgcacccaatacaggaacacctagatttataaaacaagttcttagagacccacaaagagactcagacccccacacaatgatagtgggagactttaaaaccctactgtcagtattagatagatcacggagacagaaaattaacaaagatattcaaggcttgaatgcagctctaggccaagtggacctgatagatatctacagaactctctaccccaaagcaacagaatatacattttttcctggcaccacagggcacttactctaaaattgatcacataactgaaagtaaaacactcctcagcaaatgaagaacaactgaaattataacaaacaatctctcagatcactgtgcaattaaattagaactcaagattgaaaggtccactcaaaaccacacagctacttggaaattgaacaacctgctcctgaatgactcctgggtaaataatgaaatgaaggcagaaatcaagaagttctttgaaaccaatgagaacaaagagacaatttatcagaatctctgggacacagctaaagcagtattaagagagaaatttataggattaaatgctcacatcggaaagtgggaaagatctaaaattgataccctaccatcacaactaatagaactagagaaccaggagcaaacaaaccccagagctagcagaagacaaggaataaccaaactcagagtggaactggagatagatatatgaaaaacccttcaaataatcaatggatccaggagctgtttttttttttttttgaaaaaaccaataaaatagatagactgctagcaagactaacaagaagagagaagattcaaataaacacaatcagaaactataagggggataccaccattggccccacagaaatataaccatcagagaatactataaacacctctatgcaaaaaaaaaaaaaaaaaaactggaaaacctggaagaaatggataaattcctggacacatacaacctcccattctgaaccaggaataagttaaattcctgaatagaccaatatcaagttctgaaattgaggcagcaataaatagcctaccaaccaaaaaaaaaagaatcccaagtccagatagatttatagctgaactctaccagaggtacaaagaggagccggtaccatttcttctgaaacaattccaaacaattgaaaaggaatgactcctccctaactcattttatgacaccagcataatcctgattccaaaacctggcagagataaaacaaaaaagaaaacttcaggccaatatccctgatgaacattgatacaaaaatctccaacaaaatactggcaaaccaaacccagcagcacatcaaatagcttatccaccacgatcaagttggtttcatccctggcatgcaaggcttgttcaacatacacaaatcaataaatgtaattcatcacataaacagaactaaagataaaaaccacatgattatctcaatagacacagaaaaggccttcaataaaatttaacatctattcatgttaaaaactctcaataatctaggtattgaaggaacatacctcaaaataataagaaccatttatgaaaaacccacagccaacatcatactgaatggacaaaaactggaagcattccccttaaaaactggcacaagacaaggatgttcttcctcatcactcttattcaacatagtagtgttgggagttctggccagggcaatcaggcaagagaaagaaataaagggtattcaaataggaacagaggaaatcaatgtctttgttttagatgacataatcctgtatctagaaaaccccatcaactcaacccaaaagcttcttaagctgataagcaacttcagcaaagtcttgggacacaaaataagtgtgcagaaatcacaagcattcctatacaccaacaaaagacaagcagagagtcaaatcatgaatgagctcccattcacaattgccacaaagaacataaaatacttaggaatacagctaacaggagaagtgaaggacctcttcaaggaaaactaaaaaccactgatcaaggaaatcagacaggacacaagcagatggaaaaacactacatgctcatggataacaagaatcaatatcatgaaaatggccatacttcccaaagcaatgtatagattcagtgctatttccattaaactaccattgacgttcttcacaaaattacaaataactattttaaattcatatggaaccaaaaaaaaagctcgcatagccaagacaatcctaagcaaaaagaacaaagctggaggtatcatgctatataacttcaaactatactacaaggctgtagtaaacaaagcaatatggtattgctacaaaaacaggcatatagaccaatggaacagaatagagaattcagaaatgaaaccatacgtctacaaccatctcatctttgacaaacctcacaaaaacaagcaatggggaaaagattccctatttaataaggtgctgggagaactggctagccatatgcagaaaatcgaaactagatcccttccttacaccttatacaaaaatcaactcaagatggattaaagacttaagggcataacccaaagctaacaaaccctagaagagaatctaggcaataccattcaggacataggcaaggggaaagactttatgatgaaattgccaaaagcaattacaacaaaaccaaaaattgacaaatgggatctaattaaactaaagagtttctgcacagcaaatgaaactatcatcagagcaaacagacaacctacagaatgggagaacatttctgcaatttatccatcgacaaaggtctaatatccagaatctacaaggaacttaagcaaactcacaagaaaataaaaccattaaaaagtgggcaaaggatattaacagacacttctcagaaaaggcacacatgcggccaataaacatgaaaataaagctcaacatcactgatcattagagaaatacaaatcaaaaccacaatgagatactatctcacactcatcagaatggcattattaaaaagtcagatgctggcgaggttgcagagaaataggaatggttttatactcttggtgggaatctaaattagttcaaccattgtgcaagacagtgtggcaattcctcaaagacttagaactggaaataccatttgacccagcaatcccattactgggtatatgcccagtggaatgtaaattattctattataaagttacatgcgtgcatatgttcaatgcagcactattcacaatagcaaagacattggaatcaacccaaatgcccatcaataatagactggataaagaaaatgtggtacataaacagcacagaatactatgcagcaataaaaagaaacgagatcatgtcctttgcagggacacgaatgaagctgaaagctgttatcctcagcaaactaattcaggaacagaaaaccaaacactacatgttctcacttataagcaggagctgagcaatgagaatacgtgggcacagggaggggaacagcacttattggggcctgttaggggaggtgggggaggggagtgcattaggggaaaaatctaattcgtgctgggcttaatacctatgtgatgggttgataggtgcagcaaaccaccatgacacatgtttatgtatgttacaaacctgcacatcctgcacatgtaccctgtaacttgaaaaaaaaaacaataaaatgtttgtttaaaaatatacctgagactgggtaatttatttttaaaaagaggtttcattggctcatagttccacaggctgtacagggagcatgatgcttctggggaggcctcagaaaagtttcagtcatggcagaaagggaagcagaagcaggcatgtcttacatgtccaaagctgggggaagagaggcaggcagggaagtgctatacacttttaaacaatgagatctcatgagaactctatcatgagaacagcactaggagaatggtgctatttaaaaacccaccccatgatccagtcacttcccaccagaccccacttccaacattggggattacaattgaacaggagatttgggcagggacacagctccaaatcaaataattctgcctctagcccctccaaatctcatgtccttctcatatttcaaaatacaatcatgcctacccaacagtccccctaaattttaactcatgttaacattaactcaaaagtcctcaatccagtgtctcacttgagacaaggcaagtccctttcacctatgagcctgtaaaatgaaaaacaaatttgttactcccaagatacaatggggttataggcatttggtaaatagccttattccaaaacagagaaattggccaaaagaaagggggtacaggcaccatgaaactcagcagggcagtcattaccttaaagctccaaaataatctcttttgacttcatgtctcacctccagagcacattggtgcaaggggctagctcccaaggctttgggaagctctgcccctccggctttgcaaggtacagcctctgtggctgctttcacagactcacagtgcaagctgttagtggatctactatttgggggtctggaggatggtggccctcttctcatagctctactaggcagtgctccagtaaggactttgtgtgggggctccaactccacatttcccctccacactgccctagtagagcttcttcttgagggctctatccctggagcaggtttttgcctggacatacaggctttccaaataatttttgaaatctagctggagtctcccaagcctcaattcttgtactctgtgaaccctcagacttaacaccacctggaaaccaccaaggcttatggctcgcaccctttgaagcagcagctcaagctatatctgggtccctttaagccacactgaagctgaataggctaagatgcagggagcaatgtctccaggctacacagggcagtggggccctggtcccgacccatgaaaccattctgtcctcccaggcctccaggcttgtgatgggagaggctgccatggaggtctctgaaatgtctttgaggctttcccattgtcatggatattaatattctgctcctctttacttatgcaaatttctgcagccagcttgaatgctttccctgaaagtgggcttttcttttctaccacatggccaggctgcaaatttttcaaacctttacactctgctttccttttaaatataagttctagtttcaggtcatttctttgctcatgaatatgagcacatgctgttaaaagcaagcaggccacatcgtgaaagctctgctgcttagaaatgtctttctccagatactctaaatcatcactctcaaattcaaaattccacagatcccaagagcaggggcacaatgctaccatgttctttactaaagcatagtaaaagtgacctttgctccagttcctaataagtttctttttatatatgatgcacacacaggcacacacgtgtgtgtgtgtgtgtatacatatattttttaaatgaggcacggtatcactttgtcacctaggctggagtgcagtggcatgatcttggttcacagtagtgttgacatctgggttcaagtgattcttctgcctcagccccccaagtagctgggattacaggcatgcactaccatgcctggctaatttttttttgatagagatggagtttcaccatgttgctcaggctggtctcaaactcgtgagctcaagtgattcatccacctatgcttcccaaagtgttaggattacagatgtgagccactgtacctcacgtaataaatttcatatctccatctgaaatctcatcagcctggatattattgcccatatgactcagaattttggtcaaaacaatttaacaagtctctaggaagttccaaactttcctgcaccttcctgtagtcttctgagcccttcaaactgttgcaatatctgctgattacccaattccaaagttgcttccacatttccaggcatccttagagaaattccccattaccagtaccaattttctacagtagtccattcttgcactgctgtaaggaaatacttgagactgagtaatttatcaggaaaagaggtttaattagctaacagttccacaggctgtacaggaagtatgatggcttctggggaggcctcgggaaactttcaatcgtaatggaaagtgaatgaaaagcaggcatgacttacatggtgggagcaggagaaagagaggttgtagggagaggctacacacttttaaacaaccagatcccatgaaaactctatgatgagaacagtattcgggaggatagtgctaaaccattagaaattgccaccatgttccagtcacctcccaccaggattcatctctaacattggagatgacaattgaacatgagatttgggtaggaacacagatcaaaccatatcatggggctaggcaaagaagggaaaccggaggaaagacaagccttgttgagctcagcaggatcatgaatgcagagatgcaatgagaaggtccatcaagtcctcctgacttccctgggtgttctgatggtctgatgttggctgaatgaatacttttcctgtttggaagtggaaaataacaaatgggtgtcaaaggtgtctcccagaaagcctgcttgctcttgttcacttttgttctgagccccagtttccaaggagagatgatgaatcaaagtaagtctagacattccaaagaataaaagggccaagattgactgtggtccttgttctgggaagtaggcaggccaagcaccccttgcttgagagctttttcttactattcctcctgagcaggctcacgtcacaggaacaccaatcagcctgcattctcagtgtgcatgtgtttgagttctcatatttatgtctatttgtaaagagaagcaagtaggagacattgactgattgctgtccatagggacaatttcaacatgggttttccagtgctagctgtgagtagtctaacttttatgtcttacaggaagttttgctctccctctttagagtatgctgtcattttgttctcatgtaaagctcctttgaaagtcacaatttttatgcttgtaattgaaaaacatctaccaagttagttatttagagtgtgggcttggtaggaatcccagcactcacatttcctacttttggcaaattatttgacttagttgagttacccagcctccttatacctcagtttcttcctttataattaatcatagaatctatttataagtttgttgtgaagcttctatgaggtaatcgatgtaaactgcaagaaaaaagacttgacattacatatctaatgcatggtagatactgttagttattattttcattattctgtccccagaaatatagactctggtttcttggtgtttctggggacatggtgataaaaataatgactagtaactttttttgtgtgcataacacctgacacaatgaaagcactcatgaaaattaattcaacagagtgaataactacttatacttgaacatgaatgatctaccataatgtaaatggttaaatttaataatgattgtaatttagtttaaatttagtaatagctttctggtcattattttgccaattactccttaactctgtgtgtgtgtgtctgtgtgtgtctgtgtgtgtatgtgttggtgctgttataaaagcatgtgcatgtgaattttttggagcttagaataattttcagcacttactacatgtgaaactttctggcaaactatcttgttttcccagagttttattcctaaatgtccaaacctacagaaaagttgaaaaaataatgagtagccagatacccttcacgtttacgattctgccacatttgcaaatttgtgccctcctcatctctttctctttttctcctctcctcattttctcagacattttaaaaaaatttttacggaaccatttgaaagtaagttgtagacacagcgataatttaaatcgaaagactttaggttttatcttctaagaacaaatatattcttctatgtaaccagacataagaaaccattcataagaaaataagcattaattaaattaattatccaatatatagtccatgcaccaagaatccaaagtcctacaatgtgttttatagcagtgtctattttcatatttttattcataattcaagcagtgtctacaatttggaattgattgccacgacccttcaacctcctttaatctggaaggcccaactccctgaccccttctttttgcttttgttgttgttgttggttggttggttttcatgacattgatcttttctggagattaaaagacagttgttaaataaaatatcccatactttggatatttctgattatttaatcagtgtagaacattttggccagaaagtctcatgaacaatgcttgcctttttagtgcagcccgtgagcagacacatgacatcagtttgtcccgatactggggatgcttctcgctatcatttggctaacacagctctgccagatcgttgcattgtgaaggcagtttacaaccagtgagtgagttatctgtagtattacgtgagcacactatgtgaatgccctgttcctcaacatttcctcccaatatggtagggatcctgactcttttaagttattacactggaatctgtgacgtgttgcttttctaattctacaatttcctttcatatttattgctgccattctgaagtcttacctacagaagagatttttttccctttccctgactccatctccccttgtgtcgttatggactctaattcatggtccctttaattctgctccagtttcttttttacatgtgtctattaatattggagcattttcttgtgttcttgcatggaaagatattctcaatgtcaactagaactttccctaccctagaaccagactcagctcttttcctaaagaagcctacctcttttttgtagcaaatggtatttggaaaccaagacctagatgtttgtttgctcattgtttctgggccctttcagtgggcagaactaaaattgtgtgtgtgcatgtgtgtgtgtgcgtgtatgtgtgtgtgtgtgtttatgagttcataaggttatttacaaaacaaacctagttccattagattcttttctcatcattctgtcttctatatatatatgatatatatgagatatatataatacatatatatgatacatatatatgatacatatatatgtaacttctctcacagtgagaccttgtttcagcaatgtcagtatatttacccatttgctccattctgcagtatgcacacaatcatttcagaattacttcagcaatatcacatcaataacaatgtaaagttaaagatttccttgaattttaatttttatccttagaatttattctgccaagggtatatagtgagacagaatactatttgaaagttgcttaaattaacttttttcttttttatagttattttatcaatttaatgtacagctaggctttttagtttctgattaatattcaacttttggacttgccttttctttatccttttgattttaacagtgtaaagcattttcatgttacaaaagtcaaatacagacaaatatgcacacactggctgatcagagacattttgctctcattcctattgccttcatcttgttcttatccaacttttttagataactatttatatcagtttgtcctttctgtgtgtattcatttttctcttttgtaccttcacaaaatgtatcatactcttttgtgcatcaataccttgattttgtcactttacaatatacagtggaaatcattctggatcagtttacagagatcttatgtattatttattatggctgcattgtactttactgtgtcagttaacaatgctttattcgatcagacacctatggatgtgtatttaatttttttccaatattccgctatttgcaatatataacctcggctgcacagcggaatttcaagtatgtatctaaacatcctttcccaccatgtgtcactttcatgctgatttcaaaagctgtcactgaagtggataaaaattctggtagtccgttaagtgtttagtagtaagtgaatacctactttaggccatatgttagagacacggagatttctgagacaggttttcatatgtagtacttgcagtatagcatgggatactgaggaaacaggttgttgtaataccatgtaaatgcgacgagcacgggatgttggcaggactggaaaagaccacccgttggagaggccaccagcatcacacaatctcattcatcttgtgatgagctccagagtagagatgtcagctgaaagaaagatgagtaattctgctcttgtctctgagttttctttttgtcaatcccctccagaatcagaatataagctccatgagagcagagtaagtagatgctctcacccttagagaaggcgtctcttcttttctgacccggtacaaggagatataaatgctgcctttggatatctcttcaaaagacaaaggctagccctttgcaatcagctcactagctcatgacgtcctctgagttcaatactggctactttagatcttataaacagagggacaacaagtactattatacttatactattacagcacaacaaacacaagaactgtttattatgaacttgtgttccagtacattatgtacttatgtgggtccccagtcttatcctcagtgtgcaccaaaatagtttctatgaccatgatactcctaatgacctcataaagctttctaatggcaatcaaaacacttatcaacagcctcacagtcctctttccatcaggtgacttagacttagggcttcttttctccttttcctttgccccaaatgccaatacactgagtatggggggaatggtatcttgttcccacccactcccccctttgctgctgcagatactcttcccaacaggaatgcaacacaaggcagtctgccttcctagaaccagctgtgaactccctgagctcagggtccagcctgttagcgaaacttgcacccctcatccgacccctttccagtccctaacatagtgctctgcatacactaggtgtctaaattaaataataataataaactagtgaacaacaaataaacaaatatgatacagtgcacatagaatccgttccacaccactaccccctaagaccataaaacaaatttcccaggtctctttgatcatacctattttaaagcaagaaaaaagagaaaaattacccccctgaaaagatacataaaaagtaaaggctaaagtgaagtgtgaatataaatcagccaagtatgttgtctggaagtcgtaaagtgtggcccacgcaggcaggtggaaggcagtaatggacggagcccgccacgctgcggtgtctgcatggcactaatgcagagcgcatggtagccctaccagccaccctgaaccggtaatgcgcacacctccaaacagctgaaacccagacactaaaagcagccacgtctgccgtggttttagtgaggcacggatggattctcgcacagacagctgggctggtacacatgggagggaaaacagctcctgggggatttctgaagccttttaaaggaattggaaatcactttacaccaattgtctcccttccttttaaaggtcgggcggggggaaggtgcaatgtaccccctcagtaaaggttcccagaagtgtttctaataatgaaataatctcttcacatcctcccggcttcgcttcaacagaacggttcatagcagatcagctttgacttggagtcaggtaccaggtgaagggttaggaaggaggagcaggctgggcccggtggctcacgcttgtaatcccagcactttgggagaccgaggcaggaggattacctgaggttggagttcaagaccagcctaaccaacctggaaaaaccctgtctgtactaaaaaatacaaaattagctgggcgtggtggcgcatgactgtaatcccagctacttggaaggctgaggcaagagaattgcttgaacccgggaggcagaggttgcagtgagccgagattacgccattacactccagactgggcaacaagagcgaaactccatctcaaaaaaaaaaaaaaaaaaaaaagacaaaaaaaaggacggaggagcaccactcagagccagcaccacgctcagttcaaccctatgctttctattcagtgtttatgacaacactgcacaatgagttatgccgtttacagaggaggagactgaggctgggggaggtgataggtctcttgcatgtccaggaatccagtgggtggcagagctggcattggaagccagccctaatgatgacaaagctcaagcttcccctcatcacatctgcctccatgaaccatgaagccctttccaagcctatatttactagcagtcattacctatgatttaaatggagagataagggagaaacatatgaaaaattaaataactatcaatgcaaaatgacaagagatatcacaagattgccaatgagtagatggaaaatgagaggtagagacagtactttgaggattatttaaactgtctttacccttggcatagaaaattcactttgtcaacatagataactacagcagaagtgaccctggggaccttaatatagacttgctctattacaataggagtataagtgaattggcacactgttcaaaggatgagaagcagctccccacagatatttcagttcaattaagctgggtattgacaatctgtaggcttcccttccttccaagcacattgatataaaaattgcagtttttttctggctctgcaaagagacagatatgtgtgtagaatgaggtcttattaatcagagttatttcttgtgtctccttttttactttccttttgtttgctatttcttctgagttgtgatccccatggtaacagatggaattgcttacagcgtctgtaattactattattaataataatgatcatcataatcagaccaatctgatatgatgagagaaaaaatatgaaagaaaattaaattgtggctctgtatgtaaactgtttacggcttccaaaatgagagccagaggaacaaggtaggtcacacagagatgcactagtgaaggctgtctgggagcttttctggggtaatgaccagggaagattttaccacactgatgcgaatacaaaatgtttcagaatattccaccattactactctgctggctctttgtacagcctctttttcttttctctttttgttattgttgagtgtgcgtgtgtgtgtatgtgtgtgttttgatcttttaacttgagacttcttttcagtttggactattacataatacaggcttaaaagagcagcttcagaaatgccgaaactaagaacctgacagtatacaaaggactaattagtttcttcacttgacgaagccatccagaagtgctaactcaggtgctcagtcctagcttaggttctggtagcctgaggatgaaagaccactcttgaccttggaagttctcaaggaaaagagtgcacagacttcactgcgcagggctctctaataacctctacccatgaactttgccccagacagatctctggaaagcccctcttcctttacttgtagtctacagagtatttataacagcctcagacatttgtcattcttgtgtacacaactttctccccagatgatggtaggcttttggagaagttaacatattttcctccagtgtatgtactctggtggatagcagagcactaactgggcacatatttaaacacaaaaatgaattatgcatttcatgtcctaaaagatctcatagctttatgaagaaatgaacttgaaagctcaaaatcacaatgcaacttgggaaatactttactggtttatatatcaatacacagtctgcctttggaagccatggggcacagtatttgatggcccataactcatagttcctttctacatgaagaaggcatgatagctgctctggatctgaatcatgagatcattgacactcatgccaacccactgtgctgaatgcaactttaaaaaagccaatatttcacttagataactattactttcagggaaccagaatgcttagtgaagtggccctatttcctttcccagctaatgatgaacaggttcctgcctattcaaaaatctccaaatgcagtcctctcctaagtaaaagaattgatctgggttagtcaatacatgtatgcctttgagcagtgaaagagaagaggctatgtgtctaattgtgggattgggtagtggtgtgcagtagaagtaatgaaagagaaaaacaaactgggtagcaaaaagtagtatcagagggcaatatttttccaggtttctggctccatgagtactaaagagcaaattatcttgaaggaatttcaggaaatgcaaaggacacaaataaagacagagatacatagggcaattctatagtggaaaaaaaaaacttaacaaggtggtaataatttagtatatacaggagcagctatattacaagaaatcacagtccatcgcacttgttaacctcatttgcagagtatgttccccatcgcagtcctctaaggaatgaagtccaagccctcactctaatgttgtagaaaacttctaatgcttagagtctttactcatttgagtgccagacagtctatgtgcaccaaatcattatgatacttctatggatgcaaagattggtgtaaatatgaccattttccaatgaggaaacctcagaaatgttatgaaacttgccaaaagctttactgctgacatggagcagaacatagattccaatccgaataggattgtttctaaagccaacctgtttcatggtcttattggtgccattgctgcttttcaaatatgaccaataagaaaactgggcattgaagaagtaataatttcatcagggttgctcccacagttagtgttgtgctggcacacaaacccagatttgctgactccagagcccatactttgttcactaacctccactgtccaactaacttgaccatcttgaacatttaagtttgtgggtccaattttcattgaagtcatgtgtgagtccacttaaaagagaatctccacctcctcacccatctaaaggatggtcaaaatgaattttgcttgttaaaaaatcattcaaagatgactgtcacataaacctctccagctcaaaccacccttccctagcctagagcaggcatcaggagtatctgtcaccacagctgactttctttcagtggcattaacacctgacctttcaatatttagtcaggatgcagggctaaatctacacaaccaccaatgcagctgaggaagaaaagataggaagcgaggaaaaatattatggcaataatattagtggctttaagatgaaagattgactctctaatacaactttattttctttattgccaaaaacaatatgatattggtaaagcaattcaatgagtaaatgaataaggaaatcaataaatgaatgtatgaacaatcagatgaattaatatatggatatgaaaatctatgtttacttagaaggaaatataaatctatatgaattagtaaatatggagaccaattttggaatcagattggatgcactgagactggggacaagtctaagagacagatacagatgatacaggtggaaaaaatgatatacatttacttccttgtttcagtctttatcctgctgtctcccaggagaacagtaatcagaggacatagggcagattcaaaataaaagccaactcaggggctctaggtttcaagcaatcatttctcctgtccctcgtacagtgtttgaagctaagggttgtgatgtcagttatatatatcatatgatcacacacacatacacacacacacacacacacactgtgtgtggtggattattgtgagtactggagataatatatgctaaatgtgctggaataaaccagtagcacaacatttagtattatagattagacagggttttccttgtcttctttgtataaacatcatggacatttcaaaactgtccatctttatttctccctctacaatgtttcattattgatggataagatttttggttattttatcagcatttgtctatactggtatgaataacattttaaaagttctgggttaattgtttttataatattattatctttaccaacatgaattatgtcttatttttgtttttaaagtcaaaagcaaataacatcaacttgtttagactttatggaaaatataatcttaggttggatgcagtggctcatgtctataatcccagcactttggcaggttgtttgaggccaggagtttaagaccagcctgggcaatataatgagagcccatctctaaaaaactttttaaagattatctgagtgtgatagtacatacctgtggttctagctacttgggagtctgaggcaggaggatcgcttgagcccaggtggccaaggctgcagtgagccacgatcgtgccactgtcctccagcctgggcaacatagcaagcccctgtatctaaacaataaaatataaccttgcctcagtgaaacactggggacatgtgggttatcaatgggctggttttaggaaatagtcttaagacaagtcagaatgtttgagcacagtttaattttttgctgtgtattaggccatttttgcattgctaaatgggaatacctgaaactgggtaatttagaaagaaaaggagtttgattaattggctcatggttttgcaggatgtacaggaagcatggtgatggcatctatcatcagcttctggggaggtctcagggagcttagaatcatggtggaaggtgaagagggagcaggcagttcagacggcaagagcaggagcaagagagagagtgaatggaaggtgccatgcactttaaacaaccagatgtcactgtcgcaaagacagcaccaagccatgagggatccactcccaagacccaaacacctccctccaggtcccatctccaacactggggattacaattcaacttgagatttgggcagggacaaatatccaaaccatatcatgctggaagaagtattttcttttatagaattggaaaatcctttagaggtaattaaaatcatactctctttttctcctgcttctaatatgttgaaactaaggtttggaaagatgaaacgacatgtcccaagttgtgtacagagctagtgagggagaaaggattaaccaagggcacccaagtggcctattcttttctcttttcagctcagtcatgccaactgctgtgcttctgccttgtagctgtgctaattaatcgtggtgactttcagtgtatgtgctcatcattactgtttcatggatgtgcctcgggtcatttctttactttctggaccttagtttctccatttgtaaggctaagaggatggggagggaagaaaccacatgatttctatgctagattccttttcagctctcagaatttatgaagagtaatgatgtaattatgcgggcaagattctcagatgacaaaagcttttcaagtcttcctatttcctcttttgctgtatttgagaggatgttcagaattaaattgcatgtccaattgcagtaaatgttttagcctaggttattactacagagtgtctgatacatcccagatagagccttgcaactttgtatttgtggttgcttttccatattaccagtgctaccagggtattgctctcttgtttttgttgcaattgttgttgttttcttaactgactataaaactaagcttcagaaaagagaagggggctgggcacgctggctcatgcctgtggtaccagctacttgggaggctgaggtgggagaattgcttgagcccaggaatttgaagctacaatgagttatgatcaccctactgcactctagccagggcaacagagagagaccctgtctctttaaaaataaaaatttttttaataaaaggaagtgatttatccaagcttgttcttggcagatacaggcttcaaatacagatctcccatgttctaatgcccaaatatctcccctctctcactgccttaccttctttcgcctattaggcaaaatatgtccttccgtcatgatttaaaggtcctcatctttcattgtaaatcttcccaaatatttttggcaaagagaggtaatacggggaataaatactaaacaaaacaaaaccctacaattaacttcattgcatgcagagtgtggatcacacaatctcaaccttgttctctgagaaaatggttctctgaaaacatgctagtgtttctcttgtgaggaagtgtgtcagtagctttggagtcagacatcctaggctcaagtccttgcttagtcacttattaactgtgggatattgggtgagttgcctaattttctttcacattttcctcatttttgacatagcggtattgcttcacttccaacttaggcattgtcaattttaactgagatcatgggattaaatgcttactgtagagcctgtgggaaaagggctccgcaaattgagctcttaagattactgacccccatcctaactctggtggagctccatggggaaacacaatttctctgtcctactctccatacggtaccggagtgttgattaatgttgcacgctgagtggcccatcacactgctcacatgctccatttttgacattgcttctaacgtctcttgctttgtgttgtgttgtctgggcagaggacaagatctggacatcagtgcagcacaacaatacagagctgacccgagtgcggggcgctaaccctgagaagccctatgccatggccttggactacgggggcagcatggaacagctggaggccgtgatcgacggctctgagcactgtgagcaggaggtggcctaccactgcaggaggtcccgcctgctcaacacgccgggtaaggcctctgcatgcatgaccacagtgggatagatgggaccctcagacctggagtattaggcaaaggaaaatttgccaagaagggggctatagttacagttagtcactgtgcactcgagagaaacacaacaagaggggtctggttatgtagtaatcctggctctgaaattcagcatggaagctagagtgagttctgtcacctttcaaagttttctcctcatcataaagaaaacgattccaacacccaccctgcaacagttgtgagaatgaagaacatctgaagaggaatgggcctcaaagagggcatttgagcttgacatagaaagtgtggccatgggaaatgctagtttggggagagagaatagagcttgataaggcaccaggatctcagcacacccacccgagagggatgagttatgtctggggtggaggatgcctggatgcctaagggggcagtgttaggcagggaggccagcaagataggcagggcaaacctgtgggttcatggcatgaacggagcctgagaaataggggctttaggggaaatgactctttttataagtaaagtgtgcttctagaaaaaattaaactaacactgcatatgaatttatttattttcccatggttattttttacagtaaatggatgatttagttattaacatgctttgaaaaggaaaaaaaacaaaacaaaacacaacaacaaaaacaacttctagaactgcttactaagactcaagagtttctgtaaaatgtaagatagggttcatcaaaatttacatgtttcctgggagtcagtcatttttttgtgaatgtcagttcatcatttgtttcatgggagaaaaaaggacaaaagatctgaagtatctaagaaagggtgttataatctctagcctcaagaaacttacattccagcacttagaagttaagaactttgaaaggctggggaaaaaatggagaataaaatatcaacaaaggggaaatcatagaaacctaactaaattcaacagaatgcctccttgatctaggatcttcagggaagacgttgttccacgtaattgaattttccaggtaactgtcacttatccttttaagcaccaaaaatctttccaaagaatttttaactatttgaaatgaaaatctttctcaaatggattacacgcttccatgccttcttaaccagagaattctgaacataaaatgtaacctttcttggtgactcagcatcagcattgtgaaaatcaattattgtactctccttagattcagccaggcttgcagggctgattagatcagacgtactggttcgtgtccctttacccagcatcctcagagggtgctgccctgccagagtcaatgtttatatttatgtgtgtttctctctccatgtctgtcaagcctgcacgtgctacctcagcacagttctcagggtgcctgtctccagaaatgcccttccctcttctcattgcgttgtttctagtttttgaaggtttcggtttggccgaattgtaggactaatggcggggcatgttcattctgactatgggacttcttttaggatacgcactccgtgatatcaatttggctacaccattgactttgcaaatgtgttcttttcctaactcagctgcctcactgtccctggccttatttgagtgggagggcacgggtttggcagcaagtcatattgggagtaagggcttgatgctgtcatttaccagttatgtgactttgtgcaagttgctcaatttctatagtttcgatttcaccacctgaaaagtttgcatgaaaatcctgaacccatgcagttgatctgaggatggaagaaaaaatttagtctgaactccttgtgctatgcctggtacataataggtattcaacaaatactggtgtccttattcgtagcttccattgcagcagggaacatccaaaattgttccataatgggaaacaagcacaaagggaaattttatttctattttaacaatgtaaatagaataattgtcataattatgtagtaacagaattgattagaaaactcaacgtagataatctcatcccctgaagatggcaactttaacattcagatgtgaatccttccagacattcttccatgtgtatattctcaaaggcacaaggaagacacaccatatttttgtgcatgagggtcttcattaatcgtctttccccatgtgctctgaatcaaaaggagggagataaaggagaacaatgggtatgtaggctcagtgtctactttcttcttgtgagctggcttggagaatgtagcatgaaccacttcatcctcttggcttccacctccagactagacactgcttgtggggcaagagagtcctcatttacccagacagtcccgtagaggtgtgatttagcttcacactttcactgccaggacagaagccacctcgtcccccatgcatgtgagctcaccgtctggaaaagcaggaatgggaaaaacaatatataacatttgtagccacatggattcaacagccagcatccagggcatacacctacatgaatgttttcctggtccttattattattaagccactcattcccttcccaagaggaagcccaaggacagaagcagaggaggatagaggccatctcctccttacctatctaagattctggaagaagtttgtgcaagtttttcctttatcagatgaatctgtggtctatgctgggaagagattcccgaccctgtgatactcttttacagcctgtatttgtcacacacaggaaatgtacaaatacctttctttatcaataaatacaacttcatatcatcattttcattaactatagagtattttattatatggagctactccaatgaacaaatctcctatttggacctgtagattgtttccatttttttctctgttacacgtaatgctgcagaacagttttgcatttagatctttgtgaacataactgattatatcctcaggacaaattccttgaggtgccatttgcagggcagcgagtatgcatatttttaagactcttgccacattgaattctgcaatgcatcaaggttgtaccaattcatactcccaacgacactatgagactgagtgcccgtttcccagcgatagatactattatcttccttcaactttggtaatgtgataagtgcaaaggtggggagtcaaagatgattataaatagttttgttattaatttttaaaagcgtgcaggctgattaccatagcctactggctattgctaactagtagccagggtgagtagacgttatgaaaaattataaattatggctgcaggtgcatttaaatcaataagagaatgtgggggttgccttgtgggcatagattctcctatatactatgcacaatggttaataaatggatacaatataagaaggcaaaatgaaagacaaagaaatatttaaatggccaataatgactgagatttcttatgtttgaggatatgtgtggggtgagctactggaattatctctaacccagacaacagatctgcaccataagagtcattgtccccatctgatatttcaggaaacagaaactcagagagaataagatgcttgtttaatgccacacagaaaggggcagatctaactcttgcaaccaaaatctcctgaagtcagagcaaaagtgctatttctgatacatcacaaaagcggccaagagccaagagttacaagtaaatgaaggagtcagaaaaaacatgattttgtataaatttccttattgtgtaggaaaatggaaggagagagaagcgcaccaagcactgtctctgtgaaggccacggagttgtcagggttgcctgaactgggcacattcctgggcggcatcagagggtttgcatcatcctggcctagactcatcaccttccatggctcacgcaccccttcatgggaaggcctgtgtatccctacacagcatccccagagcctccttctgcctgctctcggctccagcaagggctctggttccattcatttagcagcggcagagggagaaggaagagacaggcaggataaggtcgtgcatgggtcaccactgggcctttttcattcagttggtgactgaaccatgacactgtcattttatgacagtctccttggatatttttttcccagaactactgataagtgccaaccaatggaatgcatcctccatctctgtagctgaaggtttatactagaaactctccaatgtctcaccaggacatccgtatcccagggaaagtgtctttgtgattctcatggatctttgtctttcccctcactctgcttgctgctttctactctgagctttctgcagggctggaggccctttgctacagtgcagcttccagtacagagcccagggggggagaatcaccacagcctgccagtactcacagtaccttgtcacagggaaggagacaacacttatccccactgaaaaaggctaccttggttgagcccagaccttttctctcttgtcagcaccttcataggcattttgcctgaggctagagtcctgaaggcgacatgtgatgagcatacgaaatgaaacaggaggacagaaaaataaatatcaaagccatagtctggaagattcttgaatcacatggccaattagctctataacccataactttcccctggaaggaggacaagatggagaggggtatagcaagtgaccgcatggggaaactgagtgcccagatctctgctgggaatgggcattggaaggcctccctatcccacaattctcttgcaatagtctccatggtgccttgaaagtcccccgccactggattccgtcattagggtgtcagtatccggtgtaggcatcctcttgcactcaccactccaagtaatggaaatctgtttgtggaaaccctcttcagtaaagctgtgacctcttgcaggcagagggaagaagtcaatattgaaacacgtgaaagcactggaaattcagactccattactttgaaatctaatggctgtaggacagcctgagctggaatttactttgatttttctgaacagaaagcatttgcggagcaaatcagtcatggaagcaagattgccgtgaggattgtgtaagttcttcaggagccctaagaatccagagccctacagcatcacagaacctctgtttacctaccagtaacatgctggttaaaagccattcctattaattcattcatgcagctgagagtggtttctacctgcagtcaattgctttacctagtcatgttacaatggaatttaaagggacagcatgctatttattttaaagtattttaaaattctgaattttttctttaattactgatactttagtgagcatacagctaactgactatatataccatacataataatctagactatataatacatagtatatagtatggataaatatatatgtgtctgtatgatagtatatagtatatagtatatagtatggataaatatacatatatacaatatatgatgtatatactatatagtatatgctatgtcatatttgtccataatgctatatacattcatcacgtactctttatgtgtccaaacagctctgtaaatacacttgtgcatattaattctgtttatttgcaatattccccttcacatgtgaaaaattaatgatttagtttagaaatctgagtaaggaattgtgatgtagaaaagtcaaattacaggtagaaaagaaacagtatgtcaagatactctggggttcacaaaactaaaaatgctttcttctcaatacttgtaccacccaagatcaattagcagaattaacatttttctttcatacactaggcatttttgagtatctgttttgtgccaggcactggggagtgaaaataaaacactgaaaaaacagagttcttgcctgcatacttgtagtagggaagacagaaacatgcccccactgcccccaaccccccccccccgccacacacacacaatcagtgcatgttgaaagtgatgctgaaaggtccagaaggacaaatgactagagtatcagtggatgtggggagctgcatctcacatgaggtggtgggaaagtcctcccagtgtgcaggagctatccagcaggaccctgagtgaagggacaggatgaggcaggtgcctttttggggcagaagattccaggctgaagaatagccaaaaggccagtgtggctagaggaggagcaagggtgggaggaaaatgatggaaagtggtatccagaggccagattttacaaagcctgggactgcaaattttattctaagagtaaagggaagtcactggaagattttaagcagaggattctctttctgtttcaaatccaaagggtaatgtcagtttatgtaagtcaggctaaaccaggtatgaatattttcatatgaataatttgctaagcacatagacattttaagtcatctcctatgcctagtgaactggaaaaaggtatgagctccctgaaggaagaaacatgtcttatatcactctgtaacctcacattctaattcggggctgtgtgtggaaggctgtgaccaccttggatcccctctgattcatggtggtgattctgttctttctcacccaattaactgagctgcgattgctttggctacttcacccgctatgttcttgctgcggcccactttcaccatgctcacaaagcttggaggtccgcgtcagagagctgcaatctttgcagtctatggcaccacctctgctcccatatttctttcctttcttaattccctctttctttcatctttttctttgtccttccttctttcttaaccaccccccgcctccacagacacacgcctaaacatacacaaatatgtgggtagaactgatccccagtgtctaccgttcttccacaccagaattaaaaccacaaacttacatcatgacatctggaagacaaaatatcagggtagtatttgactttttttttttacttatttcttaaattatgctccctatcatctttttattattattattgttattattattattatactttaggttctgggatacatgtgcagaatgtgcatgtttgttacacaggcatacatgtgccatggtgtttttctgcacctatcaacccgccatctaggttttaagtccagcatgcattaggtatttgtcctaatgctctctgtcccctttcccctaaccctctgatgagccccagtgtgtgatgtttccctccctgtgtccatgtgttctcattgttcaattcccacttatgagtgggaacatgtggtgtttggttttctgttcttgtgttactttgctgagaatgttggttttcagcttcatccatgtccctgcaaaggacatgaactcattcttttttatggctgcatagtattccatggtgtatatgtgccacattttcttaatccagtctatcactgatggacatttaggttggtcccaagtctttgttactgtaaatagtgctgcaataaacgtacgtgtgcatgtgtctttatagcagaatgatttataatcctttgggttatatacccagtaatgggatttctgcatcaaatgattatatatatatatatatatatatttaccaaaaagctatttctactttatgtacaacaagaatataataaacccaggtggactgggtgccatggcttacacctttaatcccagagttttgagacgccgaggtgggaggatggcttgagaacaggagttggagatcagcttgggcaacaaagcaagaccttgaccctacaaaagatatttaaaaagttatccaggtgtggtggggcacacttgtagtcctatctcctctagaggctgaagtggaaggattgcttgatcccaggagttctaggctgcagtgagctataattgtgctactgcactccagcctcaacaacacgtgagacctcaactggaaagaaaagaaagaaagacagaaagagagagagagagagagagagagaaagaaagaaagaaagaaagaaagaaagaaagaaagaaagaaagaaagaaaaaaggaaggaaggaaggaaggaagggagggcacaccttggtgacagaataagactttatctcaaaaaaaaaaaaaaaagaaaaagtcactgccactagcccacattccaggggagggaaatctgcttctatcttctaatggaacaggtatacagacatgttttaaatgacaatgtcatcttcaaaattttacatgaatagtcaactaccctaagaaatgcagtgaatacagggcagagtcgagagtcaaaccaagctctttctaactcaaagtctaggcccttagactctggtgtctaagtcagttataattcatgttggaaatgggtttggccctccattttttcccgtgagggacttttgttacccttaaagtgatacagctaaaatgtgtttttaagcgtttgccacagctttcaaaaataaagagatcatcacatgaatcaagccagtgcaatttacagtgcatgaaagccaaagccatctttcctaatgtcctagtaatttactcttggtatttcactggggacttgaagtcaaaattagaagtgggtgggtcttaccaacaaggtggataacttaatcaagctaaagatgttgatatgaatctgaggaaaaataaaaactatcctatgtaaagtcaacagatggtatatatctgaccacaattgagttgctgttcagaccatgaattatttaaataatcaaagttgattgcccaagaatcaacactcagacactacataaaataaaatatgcatttttcccatcactttatgaaagcccatgtccacttcctttatctcaaggataaaggaatgcacatgtaggaagaagaatacaatgttctaatattaagatacggtacagtggcagcacaatggaaagaacatggattttcttcactgttttctcttcctttattaattgtgagaccttaagtaagttaaatgggccttctgagcctcagttttcttatgtgtgacatttaatgagacagatgccatgtctggcacagagtaggccctctggacactgctgttattttagccagtattttatcacattatccagcggcaaggagaacattaggtcccttaggtactgatagagggtctcccaatctcatagtgtggccattcaaagagttcagttgtggagcttgcctcttcatagcttgggggcacacctactttctaaattgcacttcatttatttgtaacttatggcatttacctactcctggtagcactgttgaaagtgtagagttaggtctatgttcctctccccatttctgccaaatacccaaatccactcatctgcttatctttctcatttcagtaaatgctaccttcatctactgagttttttaagaccaaaacctacgattccttcctcttcaccatctccattccccattcagtatattctccagtctcttctctctaattccacatcaaccacctccattcacaccctcatcatctcctcaccatactagacaagtgcagtagattcctgcttcctgtcttccaccatcccatgccccatttccccacagcggatatcccagcctgcagccagagtgataatcttttcaaaattagattatataaccatggctccaaacctttccctctggcctggaagcaaaacccagactcctaactgtagcctgcagagctctgccagccacaggcctctgccagcccctgttctcccattaatacagtgaacttggccccactttgctttttgttgcttcttgcccagcttgccccacctctcagacctgatacactgactgctctctctacccagaagccttgttcctctctccatgcttagctgtctctgattttacgtacaactaaagtattcacttcattactgttaactgcttcatccttcctgaatagtctgcattgaagttgtttctatcagataccttcttcttgcttatttgttcactatctgcctctgtcaatagaatgtgagcttcttgtaagaggggccttctttgtctcattctttattcccaaaatgcttagaatagtacctggcacctagggacaattgagtgaatagttgttgaatgaataaagggtctcttctcagtagtaagtatcaccagtagtcatatgatgtcaaaggacagatgacaacacacgtgcacttggccaagcctgtcacacagaccctggtgggaggagagcaacttcacagagcaagaggctaggcttgtggggagctgccctctgactcccagctttgccattgattctctgtaaccttgagatgttactgatgttttatgggccacaggtttctcctctttgatactagaggcttatatttaatgttctctgagtgtccttttcactctggcactccatgtctctatattcaccacacaaagttagttaaaacacatgtcagagtttattacttttttgtcacagtaaggaacttgtcggggttagtaaaacaaacaaaccaaaaaaaaaaaaaagacttttgtcagcctctcaagcttatgaaatgtgctaatatagttatgtaataggtgatattttttgacaccttcatacacctactctcctcagaacatactttccttaccgtggcatagattgtgcaaagaaggtatgaaacttccctagggtcatacataacaagtcaagaatagcaagaaaaacaatttattactgtagcatatgtttgtgtgtattaccgtagaatatgtatgcatgtattttctttataaacaaacatatttggtggcttacggggtagatatggaaacgaaattataccaactacacagatgaggttaatgggtctgcataggtgttaggctataatggcacctctgagcttgcttttcagggggccatggctagatactagactttcttcacacctgagtcctcactggaaccttcccaaagagaaggctccagagttctggtgatgagctcacttacatgttgcatcagttgctttggttcaagcacttgctccactcctaccgccatgtgaccttagatgaggtactcaccatctctaagcctcagtttcctcaactctaagaatgaagatgagaaaaataacattaatgatacccacatcattggaagaataaaaagtgtttgaaaatttcactcttcataactttttagtttacctaagttgttttgaaattacaggggtgcctttctgaacataattttcattgtcttattatttgctgagaagagggagtgggttttctgtgtgtgtgtttacgtgtgtgtgtcagatcagatgaggaaataccaaatgtgctttctatatggtagcggtgatttcacagcgaagatatgaagcttcctaaaactggtaaatcattatcttggaaagagacagtggaaatgttttagcctctgaataaaaaaataaaaaaataaacacaacataattcccccactctgccacttatttttggagtagccatcatcaggaaaggtaatctgaatctgcatttcattttcttctctgcgaaatagctaacatattgacctcacttgcatctcattttcttctctgcgaaatagctaacatattgacctcacttgcatctcattttcttctctgcaaaatagttaacatgttgacctaacactatgcatgcgtagtatggggctggactagtggctattattatttaaggagcctatccccctacaggcagaactagagactatatgtacatgtgagcaaggtatacagggctctgaaaaggagaaactacttctagttaggtgaacacctttccagaggttttctatggaaaagcacctcttctttgtggacacaacatgggtagaagtcattctgagttgagggaagtgatggggaaaggcatgaagggaagactgaccctcagagaatgggggagacattgtaggaataaaacagttaaaagttcttgctgcttatttcagataaggagtcacagaggatggaaagaaaaaaggaagaaaggaggaaggaaggaaggaagaaaggaaggaaggaaggaaggaaggaaggaaggaaggaagggagggagataggaaggaagatggagatctttctatgtttcagatacttcccagcatgctcctatagattaactcaccttctttcactgaatgaagacatttgaactggagaaggttaaccatgtggatggaggtagagagaacgcactgagtctgaaggagagcacagagagaggctaggtaggcatctatcttagcggtctagggaagagttaaaaagcatggaggtgatgcgtcataggaatagaaagataaagaaagacactaacacttagatgaaagcactagtacaggctggtgagttactggtttcaatgaaccaagtagtatctaaaacagtgctgtccaatgaaaatatagcacaagccacatgggcaatttaaaattttctaatagccccatgttaaatataaaaagaaataggtgaaattaattttaataatatgttatttttatgccaagatatccaaagcaataccattttaacatgtaattagtaaagaaaaaccctaatacactgttttacattattttttataccaaatcttcaaaattgggtgcgttttttgcatttacagcacattttaattcacagcctgttgctgtactgaatactgtaggcaactataatacaatggtaaatatttttacatctaaacatacctaaatatgaaacaggaatagtaaaaatacaagacaaaagatacaaaaatgagctgggcactgtggctcaaacctgtaatcccagctactaaggaggctgaggcacaagaatcacttgaacccggaaggcagaggttgcagtgagccaagattttgccactgcactccagtctgggcaacagagtgagactgggtctcaaaaaaaaaaaaaaaaaaagaaaaagaaaaaaaaatttacgctgtgtagggcacttaccatgaacagagctttcaggactaaaagttgaaagttgctctgggtgaggcagagagggaatgatgtgtgaatgtgaaggtctaggaaattacaaggtgccactgtacactttataaacactgcacacttaggctacactacatttaaaaaaatattttttcttcaataacaaattaacattaatttactgaaacttttttactctataaacatttgcatttttaacatttttactcttttataataacacaactgaaaacacacattgcacatctgtacaaaaatattttctctcttctaccttcattctataagcttttttctatttttaatcttttaatcttatttttactttgaaactttttttgttaaaaataaagacaaatacacatactaaactgggcccgcaaagaatcaggattatcatcatcactgtcttctatctccacatcttgtcccattggtaggttttcagaggcaataacatacatgaagctgttgtctcttattataacaatgcctttttctggaattcccccgaagggcctgcctgaggctgtttcacttttttttttaataagtagaaatggtacactctaaaatactgataaaaatagtataataaatgcataaaccaggaacatagtcatttattattattataaagtattatgtactgtacataattaaatgtgccatactttcataaaactggcaacaaagtagatttgtttacaccagtatgtacacattagtaattcattgcacaataacttgaaaaggactactacatcactgggcaatacaaattttttagctccattataatcttttataaattttatagctccattataatctttttttaatatatatattatactttaagttctaggttacatgtgcagaacatgcaggtatacatgtgccatggtggtttgctgcaccagtcagtccatcatctacattaggtatttctcctaatgctatccctccccttgtctcccaccccccgataggcctcggtgtgtgatcttcccctccctgtgtccatgtgttctcattgttcaactcccacttatgagtgagaacatgcagtgttttgctgagaatgatggtttccagcttcatccatgtccctgaaaaggacatgaactcatccttttttatggctgcatagaattatatggtatatatgtgccacattttctttatccagtctattattgatgggcatgtgggtttgttccaagtctttgctattgtgaacagtgctgtgataaacatacgtgtgcatgtgtctttatagtagaatgatttataatcctttgggtatatacccaataatagggttgttgggtcaaatgatatttctggttctagatccttgaggaatcagctccattataatcttatggggccacccttgtacatgagatctgttgttgacccaaatgccattctgcagcacatgactgtatacatgtatttatataaatgtgtgtgtattacaacagccgttaaatatgatcttgttagtccagttatataaatgaggaaatggacacttagaggtgaagtaaattgcctgaagtcttacacaaaggatgggattctaggcagatctaatttcaaagcccatacaaagtcacagacacatgtcaagagagaatgaaggtaaagcaggatcaggagaccttgagtccaaatacttttgctctatgtgatggttctgccaaatgaggagggagatgtttgccaactagaacatactatacgtagttgattacaaatgtcatatgtatccacatgtcaaataaactcttacctatatattattgcatatgatacaaatatatgtacatatatgcactttacatgttttttctggttcctaaataatctttatggaggaaacacttaaaatatggaaatagaaaaaggaaagctgttaacattagcccagcttttgattgtaacagctgaaatgggccaggctttgtggtaagtattttcagttcctagtacacacaaattacaaaaccatctgagttaatccttcgaatcccgtgaggtgtaggttattaccaaggaacaaacgcatgttcaaagaggttaagtaaagtaagaaccatgtgaccctatctgtaactgtaggattacacaccaatctagtaaaacctgttacggttaaatcccgctgcatggaaagacaaaaacaatccttgcttaaatcagccatgtcgccagctgcccagacgccagttagacattcgcttgaactgtgccaaacctagactggattttagctagtaaactagtattatatagacataatctgaagtcactcaaaagctatctgagtaatcattccataagttgccccccaaaaataaaaagctaaatatttctgtgaatgcatcattgacaaggaaaaggaataagataagaagaaaatcagaaacaaagttgccgacactgtaaaaatttatctgtatattcagcacaatttttgcattagaatttagaaaggataaaacattaggatattggagtagttgcagaatccattttgggagtatggaggttgggggctagggagaaagagagagaggaaaggagggaaaatcctttggggaattgcctctgagttagaaacctgtactctgcttcattttttatcttgagtaaatgaagagagattctcaacatggagacatgatcttaggtacataaccctttgtgatcttcccaagggccatacattatgatgctgaaaaacaagagtccatgataatgacccacagctatttaaaatagcaacattccacaatgaattcctcccttcttaaaggaagacagggatatggtggcaatgggagctcagagttggcaatttcttggcagctaagaagctcaacagggatgaattctttggtggtaaaattgaaatacaaattcctttttcaagtggaacttttctaactctctgagttttcaaaaacagtaactgggtcatatttatttctgaatacctctagagccattttagtgactggcacaaagtaggtctccctcccaaattttcttggatatgaaaatcctgtgagaatatgatccaaaaaagtactttgaagacaataattggaattctcatatgagacacaaaaaggtgacagggcttggtggctcacacatttaatcccagcacttcgggaggctgaggtgggatgactgcttgagcccaagtggtcaaggctccagtgagctatgattgtgccactgcactccagtctgggcgacagagtgagaccctgtctcaagaaaaaaaaaaaaaaaaaaggaaagaaaaagcttaagtgtggtgcaataacaacaaggtaaaaacaaacaaaacccagaaacagaacatcttaatggcttaaaacagcatcctttcatttctcaagtaggccagatatgtttcatgaattggcttggggctctgtgttaagttttctcctcccagcacccggagtgatagagtagcacttctctcaagtgttactggtcaccttggcagatgcaaagagggctctggagtacgtcaaacctgctgcagtctgggaatgacacatgtcacttctgcttacagcacattgccctgaatgaaatacatgcaatccgcaggggacaaagaagttttgtttgtttgtttcttttgagacggagttttgctcttatcacccaggctggaggacaatggcgcaatcttgtctcactgcaacttctgcctcccaggttcaagcgattcttctgcttcagcctcccgagtagctgggattacaggcatgtgccaccatgcccacctcatttttgtatttttagtagagatggggtttcaccatgttggccaggctggtctcgatctcctgacgtcaggtgatccacccgccttggcctcccaaagtgctgggattataggcgtgagccactgcacctggccaggaagtttaatcctaccgtgtgctcagaaggtgacgagacagaagtaattggtgcatagccttaacgtctatcagccagtgagaacacaatgaacaaaccaacaaacaaaaggcaaaaacaggaaaaaaagaaaaaaagaaaaatatcatacccaatagaagaattgaaatcaaagggtatatttacaatattgtctttccctttttatcttctatctactataaagtgaatcgttccttaatgcatggcacaccaaagaaaaatccatcagacctctgaagtactatgaactatttttaaatttgtaactctatttatagatcctcatgtaatcatgaatatgaatatcctgaattttagtttcagctaacatcaaatatttggttaacgtcaaaattagctttactatttagttaatattatagtttcagtgttagttcaagctaatgtcaacatcaactgacgagcaaatatttggaaagcattattttattcccttttttagaaaaagcaaagcaaattttcaaaattaactttgtgattagtcacaaagccctcacatacgtgtggataaaactgtctccatatatatgttgatgtgtagctaaaaaatattggccaggcgtggtggcttatgcctgtaatcccagcactttgggaggccgagaccggcagatcacaaggtcaggagatcgagaccatcctggctaacacggtgaaaccccgtctctactaaaaatacaaaaaattagccgggcgtggtggcgggcacctgtagtcccagctgcttaggaggctgaggcaggagaatggcgggaacccgggaggaagagcttgcagtgagccgagatcaagccactgcactccggcctgggcgacagagcaagactccgtctcaaaaaaaaaaaaaattatacatatttattgatacagcatcccatttaatgctgcttttataaatctgtggcctctgaaatagtgttcatacatgtgtttttgtgtacatgtatttttaaaggaaaaaacaaactgtaaaatactttaaagagatttattctgagctaatatgagtgaccgtgacctgggtaaaatataacccaaagaagccctgagtaagtagtcctgaagcggttgggttacagtttggttttatacattttagggagacagaagttacaggcaaacacacatatcaatccatggaaagtatacattgatttggcccagaaagttggggcatcttgagtcaggggcttagaggttataggtggattaaaagattctttaatttgccatgggttaaaggagtaaagctttgtctaaaaatttggagtcagcagaaaaaaatatttaagataaggaggtctgttaaccagtacactgggtgagagtgacttgtagaggtgtgtgacttaacccttgtctggcagagccttaggtcttatttattagtatcttattgtcacaaagagtttgttttgttagtctttgtaatattaatgctggtcagctgtgcctaaactccaacagagaggtgtcatcacaaggcatgtctgatctcccttcccatcatgacagggaattcgctttttcagatttctctagagtccccttggccaaggggcgaggggtctcttcagagatgaggggatcttagggttttatttttgtttacagtataaaatggtacaccactatgcactgttgacatatttttcctcatcccctaaatactgtcctattctctggcagctggccagtgagggccatcacctcactctgcaagtgcccatggctgcaagtattcttttgagccatcctgcagggagcgcatcccagcagcttgcgtttctttcccatactgacctcttctgctgctgcatattttgtgcttgaaattgctgtttggattcctcaagactttcaaagatgttcaggatggtgcataactacagcaaagaactaaagggagactattactctggacattaaatacacattttatgatagcttgatgtgctttaagaagaacgatgggggaaacatgagcaatgattgggcagttagagatgggtagaagtccattgatattataaaggactttaaacatcttggtagctgggaaagattaaccaaggaatgagctagaagaacagattgccccagggcagtttatgactgcatgcaatttgaatgcacctcagtagggtgtgctaagaccattatagtcctgattgattagcaccagaaaagtatttctacttcctgctaaatggaggatggctgctctgtgcaatctcagaggattgtttaatgtacacgtgtgtactccaggtgccacagaattctacagccttgatttgacaactcaggtctgtgctatcttcctgatattactcatttcacagtctgaatatgagagtatctttgtcactgaacaacagtgttcatgtatgtaaacctgctcattgcacctgctccttgccattttggtcaaggtaagtataatgcctcttgcagtcattcatcagtaccgttgggttttggtgggtgtgttcttccctgcctcagggcaatgctaatttcatttctcatcctccaccatgcctgaatacacagtttacctaaaggttaagaattgagtccaattaagaggatggagcaattccactacattaacattaatagtgcatggaaaacactccctatgtcttcattttttaagcagtagccattttcctgtctattctctctctcttattttttcttcctgcaccacttaatgaaaatctaatggtagcaatggcacctttgttgatgaaagagaaaaagtgataatcgttcctgcttgtctctttctcatttctcccgtaagggaagctaagagtggcatccttgagacaggtttgctttactgatcaaagacagtccttgggagaaacgacccagaggatgaggaattgtcaagaaagctttgccacagacgaatatgatggaactagttcatcaaatgataaaatgtgaactttcctttcatcctggaatggaaaagtcattacaggaaagagtgaatgttataaaggttaaacgtgagtgactgatgatgatgtatcagggaattccctggccctgtaaggctgtctggtatcaggctctcttggcctgtttcaatttatacacaaccatgagggccttacatccatctgttaaagcatgctgtagtcatacatttagctaggaaaaacctttggcatccggggcttctgcagggagcaggccaagagattccactaggttatggatctccttctccctgagggaggcataagtggcagagaagctgagagatcttaagcagctaacggaaaggtttgggaccagctgtttagcatgacaagcattccagaggcattgaggggcaaggaggaaattgagcatgtgttgaatcattactgtaaagaaataaattgccctggaaactgtgtatcagggagaggccttcataattactttatttaccaagccttgccaagctccatcctatcttcacacttgtttccctccacaggccctccctgctactctgtgcttgagtgcaggaattctcaaggtatgaaacacaggaaaggtttatgtgatgcatggatggaatttttgaaaacatcatttttttctattttaatgtgttataaaaaggtataccattagcacttaaaatttataatttcaaatctcttattactaagagagtagtgtaagttaaaaagaaattagtaattcacgtcaattaacttaaagagatttgaagtaagtggtcatttgggtagaaatggcaacaaactggaagatgcttctggaatgagggaaggaatgagggaaggttaggaagtgctagggcacttttccttcctcagacacatcctttaaggatgtggtgctatacctttaagccttactcactcactcctcttcccacttccagaggtgccttcttcctgcagtcctattggtaacattacattttgctttaccagctctgcctcctctgtgaagcccaccctgatttattcagaataattcagcatgtgttctttctgctccctttttatgtggttcatattttaattgcattattcactcactttcatttcagtcagttgcacacctaaagatgttatgcaaatggtattcatttttatatcctcagggacaggacctgcatttgggagatattaaatgattagttttgagcaaacaagttattcatatcctttcttatcaaagtttcatcaagctctacagccgccaaatcccatggcaatactaggagatcatttcttgattagtggcatttgacacagttgaccatgtcctattttgaaatacttgctttacttaacttctagaatgtgataccctccagtgtggtcttgcctctgactgtacttctgctaccttgtttgttggctccttccacgttaaacaagaagaaggtcttagggctcagcccagggctctcttcatcatctatgcattcttcttggattgccattcagtcacatgctggagaatctcaaatttagatctccagccaagattccttttctgaatacaagatgcatatatccacctgcctactggtcttatgatgtcccaaaataatttcctgatcttcttcctccaaatatgctcttccagcattctttcccaaactttgtaaatagcaagtcattcttccggacactcagaccaaaaaacctatgagttatccttggttcctctctttttcccatactttctgataaaaacgttcctaatccaactggctatcattgaaacagatgcaaaacttaagcactgtgttcgctaccttggccattcccaggcccaagatgcatcacctgtctttttgattactacgattgcttcttctcaaacacctctcagttatagagggacaaactgctcacaatatctatgtgtttcctcctgacttcagtgatccagtgtccatccccatccccatttcactactcacagcgagaccaggggccctcttagaccttccatgttctggaggcactggatctctctatattgtgctgacacttgcctgcctgccttcctttccttttccttccttctttccttccttccttccttccttccttccttccttccttccttcctccctctctttctctttctctctctttccttctttccctctttctttctttctttctttcttttctttctttctttcttaagagttatgttggtgaatatgaagcatatgtcattgtggttttgattttcattctctaataattaatgatgtcaggtatcttttcatgtacttgctggccatctgtgtgtcttctgtggaaaaatgtctactcagctcctttgaccttgtataattgagttgtttgtctttttgttgttgcactgtaaaagttctttatctcagatactagactgttatcaaacatatgactgcaaatatttttcccattctatcttttcactttattgacattgtcctttgatgtaaagtttctaattttgatgaagcccaattgaactattttcttgttgttgttgtttgtacttttgatgtcaaagctaaaatccaccttagaggtgttgcacttgttgttgttgtttgtacttttgatgtcaaagctaaaatccaccttagaggtgttgcacttgttgttcccctgattgcaaatctcttttccaatttaccacatgccttgctcgttcacctctttcaaaattccgtataaatagaaccttcttagcaagctttatttctgttcactctatttaaaattgcaatcttttctggacacagcaaacctgggccccttttttccactttatttttcctcagtatttattttcatatgatataatttactaacttatgtaagcatgtttttagacttaagcttcctaagtcagaggttagtgtctgttcatgtgtgattgtattttccatgcccagagcacagcttgctacagaggaggtgcccaatatacccaactggcaggggagttcagcctgtcgccacgggcctcattcttcctgtgtaaaagcagttttatctgcctttcctcacccatccttgacctcaactgttactttatcattggtataattattagcataatcatcactaccaagaaatgtttagaaagtttccacctcttcatggtgttaagctaagcataggcatagaagcacgtatctgggatttcccaagacaatcctgatttaaaaataagtttattagagaatgtaatctaatttttgttttcaaaaaacaaaggcataagaaacagcaattctacatttttgctcctgagctgagtgacattatagcaatggcatggtctttctgaaccacagttttctcacctgtaaaatggggttgttgtgaggattaaagaaaattatttttttaaagacaaaggaggaaaaaatgtaataatgtaatactcatggccctataatttaatttaagtgatctttcaagactttacaaaaagcagaattttctgaattctttgcttatctcttttgtttcaggaatgtgctatgaatgctaactttaatcttagagactcttatttttatttttagttatttatatttttgagatggggtctcactctgttgcccaggctggagtacaatggtgcaatcttggctcactgcaacttctgcctcccaggttcaagtgattctcttgattcagcctcccaagtacctgtgattacaggtgtgcaccaccatgcctggctagtttttgtatttttagtagagacagagtttcattatgttggccaggctggtctcaaattcctgacctcaggtgatcctcccgctttggcctcccaaagtgctgtaattacaggcatgagccaccatacctcgccaagactcttttaaagaaagcccaaaggccaccactttagatatacccagtgagacttgtgttcatgtgttaacgatgccatcacagggttccacaaactggtagcttacacaagagaaatttgttttacctcctcacatttctgaaggctggaaaccaagaccaaggtgtgagcaggattggtttattccaagacctctctttttggcttggaggtggccaccctcttctggtgtcttcacatgacctaccctctgtgtgtgtcactgtcctaatcttacaaggacaccagccatattaaataagggcccacccatttgccctcattttactttaattatgtctttgaaggctctttctccaaagacagttgcattctgaggcattgggtattagaaattcaatatatgaatttaggaagacacaggttagctcataacagtgaaaaaatatgcaggaggaaatttttgtaaaattttttactttattaatgcactgaaaagaaagaaatactgaaagtcaaaaaaagtgtaggagaatctaaatccatcattgaggttggcttctaccttgacagcatgtgcctaatacaggtgatcttgacctttggtcctcaaggcctttagggccccaaaagaagaggacatttcttagggcacagctaaggcaaggagtttaatgagagatgttaacttctcatactttataaaactgaaatttaaaggagaaacttgaaatcaattcccaagggaacacacggaaaatttcctgtaccaatcaggatggaataaaaatctctcctataaatatgttcaataagttggtgtacatgttaaaaagactaaaatatgagtaggaaactatttcaagtgaccaagaagatttaaagaaatataaataatttctcaaaattaaaaatgtaataattaaaactaaaagcacaagggataaacttaagagataattagaagtgactaaaaagagaattacagaactagaaaatatttctgaaaaaaattacccagaatgcatcacagagcaaagaaatagaaaacagaaaaaatatttaagtgatggagaataaaattgtaattgctaacatatatcaaattggcattttggtaagaaaatcattcctgagatgctgtgcaaaatgtaaattgtgtgcttaattttatttgctagtaaacctggcaaataatactttaaatggtagctattattagcagtattgagcttactactaacaataacagttctgtcttaagagtcgagtacacaatcttaaaacactacattctcttaaaaaaaacacatttaaaagcactaacatgttctcagaatgtgctttcctaatgaatttaatctggtgattgcagttgcagtgatggcactgatgacgatgactaaaatgagcaataatgaatgaggaatttgcaatttttgatagggcggtagtaacaccatgtcataaaaaatgttaaggtacttgagagttacagtttctttttttttttccctagctctcatcttgatttcctaggtattttagataacttacgtttcttgaaggcctcacacatgagggtatatgttaatatttccaacaggctttgtttttgggactcacttttgtacataataaattatctaccaggacaataaaagtggcatccttttattaaataactactctgtgtcagaaagccaggcctctaactatgggcattacgtaatttaataatcacgtattatttttctgattttatagagaagcatctaaggcatagagagaataagtaatttctgcagagtcctacagcattaaaaaaaaaaaaagagatcctctagacaatttttctgactccaatgccctcaaatattttcacgatgataaggtactcatttttaagttttattaagatatatttaataagacattaaatgtactcacaaaaatgtataatttactgtttttagtatattcagagttgcaaatatcaccacaatttaattttagaatactttaacactcccaaataatatcttctacatattttcagtcattccccattcctgctcccaccttgccgcattcaccacaatgtcccaaacccagcagtgatatatcctctttcatccctgttttagtgattttagtcttctctcttttttcttgctcaatcaagctaaaggtttatcaaatgttttgatcttctcaaataatctacttttagtcttattgatttttctctatagttttactattatctgtttcatttatttgtgtgtaatctttaatattccttctccttgattttggcttagtttgcgcttcttactctaagtttttaaggctaaaggtaaggttgttgatttgagaaccatccttccctccttccctccctccctcccttcttccctccctccctccttccctccctcctttgttctttctttccttccttccttccctccctccctcctcctctcctctccttcctttcctttcccttccttcctttccctccctccctccctctctccctctctacttcctttctttctttctctttctttctttctttctttctttctttctttctttctttcttcctttcttcctttctttctttcttttcatctcctcctactccttcttcttcttaaatacaggcatttacaacaatagattttcctctaggcctgttttcttgcatcccaaaaagtttgggtatgttctgcttttgttctcttttgtttcaaagtttttcttatttccattgtgatttctttttgaccaattggttatttggaagtgtactgttaaatttccacttatttgtaaccttttcaagtttaaattgttgatttttaatttaaatttaagaattttgggtaacatacttttaatgattttaatcgttataaattcattaaatcttgttttatttttaagcatatggtctatcttggataatttttattgtgtacttacaagattatgcattctgttgctatttggagttttctattgatgtatactgttttttaaatgttctatgttcttgatcttctgcctacttctatttatttttaacacaagagtgttggattctcaaccattattgctaaattgcccatttcttcaactttttttgtgcatatgtctcattactttagggctctgttgttagtcgtataaatgtttataatcgttttattttcctgatgattttctcttattattataaaatgtccttctttgtcattagtaacaattgatttcttaaaatttattttctccaacattattttgtggctaaaataatgttagctctcttttatagttatgcttgcatggtgtatcttttaccatccatttatttccaacatatttgtgtgtttgaatatgatgtatatctcatatagacaacatattccaatcatcatttaaatattctccattttttgtatcaatctctaccttatgattaatttaattcacttatatttaatgtaattatagatctgacaggattcccacttgccatttttctacttctttattggagtctatttttcaatttggttatcctgggaattacaattggcaccttatttttaaacaatcaagtttgcattaatcctaactcaatttcaatcgtatacaaaagcttttgtgcaacatattttatttcttctttcctccattctatattcattacaatgcaatttacatctgtatataagcccactaatacagtttagtatgtactgctttgtgcagttagttgtcttatttgtcgagatattgttgtcatattttcctttaattctttagagatatttttatttatttatttgaacatatttatgacagctgatttaaagtctttgtctaattagttcaacatttggtcttctttaggaacagtttttgttgacttttgttctgtgtatgggccataatttcctgtttatatctagtaatgtgtttcttgaaaataggacatttcagataatataatgtggaaattctgaaatacagatacaggtttgttttctgttgtttttattgtttctgatgatgtttaattgtttactggactaatgataaaatatctgtattcatttttgtgtgtggccactgaagattctgcttaattagcattgttttcagctaactattagattacatttcttaaatgccctgaaccaataagtctttcaggctttgctgagtgtctctgacttgtgttgtaacattacttaaatgcaagcagtttacaactcctccttagctttcacatcctgcttctgcaagtccttaagattagtgggatgtaagaaactaaggtttttttggttattttctgagcatgtgcacagccctgcacatgtgcatagcccttcaggtttaccagaaatatgctgaagcttatcaaaacccttattgtcataccattccccaatttttcctttaacagttttagtcaacttcttattcccaattggcatcactgcctcaggcagatgtgatattaaacaattgtcactgaaagatttcaacaaatgctatgggaatagggctgctcccatggactgatatctgagtgagactctggaaatggagcttcttagtgagatttgagaaaggtcaaatagtaaacattctctgtagctggggcatttgaggaggctaccaaactcattctgctcccttgcatagctgttaggctactgtacttgtgagggtgttggttttcgaggctgccatggagctaagtgaagaaggaagggagcagagcaagttaaagcaccataataagccttgccattcttactgagattcagctatttttattaaagactccttggatggttaaaagcctctattattttccagacatttgaaaaagttaatttttgacaattttgaatagtgctctcattgcttttatgaaggtgtagatttttggaggcccttcctccaccatctggaagtgcttctgttactgggaagtgtggagcatctcagttcttgacattttggaagacataatatgtccggaattgattccttctggtgggttcttggtctcactgacttcaagaataaagctgcagaccctcgtggtgagtgttatagttcttaaagatggtgtgtcctgagttcgttccttcagatgttcagatgtgtccagagtttcttccttccggtgggttcacggtctcactgacttcaggagtgaagctgcagaccttcacagtgagtgttacagctcttaaaggtggcgcgtctggggtagctttttcctcccagtgggttcatggtcttgctgacttcaggaatgaagccagagaaccctgtggtgagtgttacagctcataaaggtagtgtggacctaaagagtaagcagcagcaagatttagtgtgaagagtgaaagaacaaacattccacagcatggaaggggacctgagcaggttgctgctgctggctggggtggccagcttttattcccttatttggccccgcccacatcctgctgattggtccattttacagagtgctgattggtctgtttttatagagtactgattggtgtgtttacaaacctttagctagacacagagcactgattggtgcatttttacagagtgctgactggtgcatttacaatccttcagctagacacagagtgctgattggtgcgtttttagagtgctgattggtgtgtttacaatcctttagctagacacagagtgctgattggtgtggttttacagagcgctgattggtgcatttacaatcctttagctagacacagagtgctgattggtgcgtttacaatcctctagctagacagaaaagttctccaagtccccacccaacccagaagcccacctggcttcacctctcaataattcagccgagagaccaattagtaaagtaagcagaaaggtttattaagggaataaaagtacactccaagagaggagtgggctgacctggctaaaaacacccccaagaattctgcgttgcagtttttatcatgttgggcgtttctttaagttcccacatgtcttaagtctctgcctttttgtttgtctagttttccactgttgtcttacatccccatctttgttcccatctagttcccacccaggtttgtgggatcctcccttactgtcatttggtgcacatgcctggggtccagtgatcaataggaatccaacctaatgatgacattgttcatgactgcctccccaggaaggttgcatagcagttaaaactgtactgattgtgcctgagtatgtcaggaatttcccctttatcctttctcctttcttgtcagcatgtagctggctacattctgacaatttaaccacagaatgagcaattactgggtgtcttaagcggcatttcaggacgttcctgtctacataggtatcaccccttctctctgctaatacctaactacatgtttcaggtggtctctgaggcacaagattttccagagcttcctcaccgagagcattccttttctgctcttgtctgcctgcctgctctaaaaattccagaatgtgagggtttggacctagtgtaggacttgatgctcagctttattaaatgttatgtcctatgatgggagctgactggcccaaaaaggattcccgaggtgagggtagaaaagtgggaactacagcaaatggaaccccctgttatgaaaaggagaggccaggaaaggaatgcaccatttttgtcatggcctccttctccaactctccttgggctagatatttggcttctctgtgctcttccatgctcatacttatctttattccagatccaattgcctggtagcttaactgttgcttctgcttcttcaccagaagataaattctctcaagggcaagacaaatgtctgattgcctctttgcatccttgtggcttagcacaatgcttggcatgctataggcactcaataaatgtttatgaagtaaagtcaaccacaaacacctttcatttcagaatctcaaacataggataggcagggcatagtaaactctgcaacaaacctgtttcaggcaggaaagcagaaagggaactgtcagctccacccatatcttctttattagagggatgaatggccagagtcaaagtcacagaagacaggcaggcattgacaaggcagagaggtatgcagcaacttctggtttgagaggtgcctctgtggtaagcgagataaataaaactggtaaatgatggatctcctcaaggagatgaattgagccaagagctagccttggctgctggtgcacacatcaggaaagcagtatttgagatccgggagtcttgttctttattaataggaggatctggctatgcctcctcattttcattgcattgaaagtaatcactaacatcattatcatctcatcccttctgattctgaaggactttgacatttataaaacaatcacatatggtgaccctcatagaggacagacaccctttaatctctattttacaggtgaggaaactgaggcgctttttccaaatcactaattatgataagtgacagagttgatcctagaacccaaaatgctggctaattgtcccatatcttttttttttttggagcggggagtgggggacagggtctctgtcattcaggttggagtgcagtgatgcaatcactgcagcctccggctccctggctcaagttatcctcccacctcagcctcctgagcagctgggactgcaggcaccaccatgcctggctaatttttgtaatttttgtagaaacagggtctcgacatgttgcccaggctagtctcagactcctgggctcaagtgatctgcccacctcggcctccctaagtgctgggattacaggcatgagccacctcattggcctcatatcttattacggtttgtcttgagttcaaagcaaaatgcatttctttgctaatttctttgggtacatggctgtttgtcttctcaagaagttcgagacccccgcccccacaactctgcagcagtctctgtatttccatcgattttttatcctatggataccctgttttccacctttgtttgaaggaatagaaattataacctgaccctcaaatgagtatccagaaaaaagtgtaccacttctagtcagattccctcaaaagttctttgtcagattttaatttgtttgaaggtcaaccagattcctctttatccctcaaggttcagcataaatgtcatgtactctggaaggtcttcttgaattccccaggccaggttaggttcctcctttggaagtttccatggtattcagtacttttctttacagagacattagcataaccctctgcaaccacttctcaaaacagtgcatgtactgcccctctactggtctaagtcacctaagtgagtaccatgtcaaggaaagcgaagaacaattgtccccaactgcattcctgtggcttgcccaaattctgacacacagtgggctcccagcattttccaaatcacagactctgattatttcagttctcagacctgggtcccagaagggctgccttcactttggtttctctaggccagcagcttcttgtataccaagtccaaaatctggatctcctcaggggcatattctgttggctatatttccccccacccactatgtatagggcagaatttcttctttcactgcatgtctcataaatttttgttggaaattggtcattcaatttgcaatatactatatattattgtcattcaatgtcagtttgagataatgacttcttggtctgtacatataaacattgttgtaaggatgatgctaatgatgaaagcgcatgcaatatatatttttacataatttgggtatgaaccttttttgtgggggttggctaacgtagtaatagttggtaagattaaggggatgagggctattatagtagtggaagaatacatgtttgtaacttttatttggagttgcaccaatatttttgcttcctaagaccagtggatgactctaatcctttaaaagttgagaaagctgaccgggtgcggggctcatgcctgtaatcccagcactttgggaggtcgaggtgtgtggatcacctgaggtcaggagtttgagaccagcctggccaacatagtgaaacctcatctctactaaaaaaaataaataaataaaaatacaaaaattagccgggcatggtggtgggcgcctctaatcccagccactcaggatgctaaggcaggagaatcgcttgcacctggaaggcggaggttgtagtgagctgagatcgagccactgtactccagccctagcaacagtgtgagactccatctcaaaaaaaaaaaaaaaaaaaagttgagacagccatgttgtgggcatgggggcatatattatacagataatatcttgtaacaactcttttatcagatttctccacagcccagtgttcatggctgttgctggtttgttgctgtttttcttgttgttgcgtgttcatgtagtgaccttcctgaattaattctgtctattctgttttcctgggagtttgcagcttctaagttctcttctagctcttatttgtttttatttttgtttgtttgttttcttctgttttgagacggagtttcacactgtcgctcaggccggagtgcagtgctacgatctctgctcactgcaacttccacctccctggttcaagctattcgcctgcctcagcctcctgagtagctgggactacaggtgcatgccaccatggcaggctaattttttgtatttttattagagacgggtttcaccattttagccaggatggtctcgatctcctgacctcgtgatctgcccgcctcggccttcctaattgctgggattgcaggcatgaaccaccatgccaggcccttgtttttgttttttagttcttgtttttatttttcaatcctgattcctagtgattatgtctctgtcagtataatttagtggccagccaatgagtggtcagattttaaaaaatgctttgctatgtgtcttcctccctttgccaaagggacctatgtggataccttgaacttcaagcatcttacaagacagccttagcttttacttcctgcttgtgcagggcctcaaggtcagtcataggtgagtgattggtgctctcttctttccgaggtctttttcggcatgtacacatccatgcacatgaatgcaaccttgaagattcccaggagcatgtaggagattttcagagtctctctgatcttctccaaaatttgccattaaattccacaccaagctcttctttgctccagctaaaatcgcaaccttatgcagctgagaggtcatcaacaatgtgctgtcgttttggtcatgcgctggagttagccctgcttctccccaaaccagctgaggtctgacttcaattaaataaccaccacactgtgagaacagagatttgtcagggcaacatgactttaaacaaagtgttgactgtgctctaataatggtgcttttttaatggaacgtcaaaagttctcagatctttcaattgtctgcaagactgcaggcttctggccactggaccactggaccactggactgggaagaaggggaaaaatggaaacatcaaataccccacatcttcccgaggctcagtagtttctctcgggtagacaattttcagttcttcaatggcttaggttaattgctagaactctgaaatggttgattttatttattttgcctgtatttatgttgttttagagagagagagaatctaccaggttcctcaatctgcaattctggaagaggtagtgaatgtgtagttttgaacttgtgagtgttggtgggattttgaatgaatcgtgccaccttaccagctatggaaaaggatgttggctaattagtggcacaaaaataggatacaagcaatctaggaacttaaccaaaaaaattgttttaattactctgcaaatatttacttacacgtaaacaactgcagtgatcatcacacatttttcttatctatctaaagtgaatttttaggtttgtgttgttgcagttggtggccatggtaatgagttgtgtatgtcttgtgaacacttttttggggtaaagtcaactatttttagaaactgaaagcaataattttggtgtttactcctgttaatctcaattattgaggagtacacagagtgtggctgatgtatgaatctcagctgttgggggagccgtgtgccccactctcccatatactatgtagattcttttcagactgctttgttggcccattgctggattttattttttaatgttttattctgaagtaatttcatgacttatttggcattacaggaaacaagccagtggtaagaatatttaagtggttaggtaagcaaagctgaactgtaaaacttttttttattaaaacagtttttatttcagttttttttggggagaaaaggtggtatttggtttcatggataagttttttggtggttatttatgagattttatggcacccatcacccaagcagtgtacgctgtacccaatgtgtagtcttttgtctcttacctgcctcccacccttccccttgagtccacaaagtccattgtatcattcttatgcctttgcatccttatcattgctggctttttaaataagggaatctatgaggcatttcttactaattccattgatgtttatttttctgttccgttaatcactagaaacaagggaatatttgtggctttgctcatgttaacttttatctctcactgaattctggacacgctaagttatatatgtgctgcacttcacttttctaccctcttcaagacaaaaacagaaaaaaaagttttctagtcacaaaatgttaggcaactaacgtttattgcctgactaatcattttactttattgactgagtaatcattttatctacatgatgccactgggaggtagtaatttgtgaaataccaccttggacaattcattttctttctccgcacaaggcctggggatgcttcgagccagattgtgctaaagaatgtcatgtttccaaaggataaggtttatcttccatgaaacagaccatttgcaaaattaataggtaaattagcaaagtgcaacagcccattagacccactgtcagagtttagaatctgagttggggaaaggaagtaaaagctaaatgtgtaaacagaagtaccctgaaatgacagcagctgtcattctgtggtggagggttgcagctgcttaaacaaagccagcggagtgctgttaacatgcagtcctgtcaatatctgaatatacactcacagggcaaatgcatgggctataagaccagagctaggaatcatgcttactcagtgtatgttaaaaacattatactgcagggaaagagtcagagcttatatctaccaaccatttcttcatttatttgaaaagtttctattgaacactagctgtgctgaaattttaataatccttactctataccaaagctctgggtatggccatccttttctccctggagagctgactttctcttgtaaactggaaacagctgccttgatagccaaaaggttattgactattttggcttaagcatggactttacaatcaaatggactgtttgaaagctgtgtgaccttggaaggtttttgaggctttcattgtaaagtgaggaggatcccaccttgcggagtagtcttgtgatgattaagcgagaaaaatctatgcaatactcatcatagatagctcttatttaattattagtatgtgccaggcagtgtgctaggagatctacatatagcatgccatttaattctcacaacaaactgtaaggtggcaattattatgatccacagcttacatttggggaaactgatatttaagaggtcacacaagttgtccaaggtcactgagctagtgagtggtgaaagtggacttgagatccatgacatcaggccccaaagccttgacttttaatcaccaggccttcctatgcttacagatggtagccctcaacagatgctgggttccttctttgtccttattacccacttccacccctcatgcctgccataggaattaaaactcttcaaagtacttttctagatagcctctgaggtacacaatcttcacattggttaataaaggttgttgatcttcaaaatgtaaattgcttgtgagccgagacacccctggatgaaaatcccctcggatacttcttgtaattctgactgcaaaagtgcagggggttcatttcccttttccttctcatataaattaaagaagacacattatttccattttcctgtctcagatcttgccttctccactattttggaggctgtgcagaataaatactgtaaaatggctcatttctgcttacactttatttcttagtacccacatagatcatctcaatcacctatagaaatatttgtgtcaaaggctaaggcagctgataaaatattttccttgtaggttatgcatctgagtatcccagcatctcttcattgaaagaaaaatagttacatttggtgattgtgatgacttaaggtagtgaaaatatttttactgccaacaaaagcagttttatggtgctcaatcctgaatcactaaaatctggattttcagtagagcaaattgtactgcttataactgaggttttttaaaacgaatgcaatttattatctaggcagtcttctgtggcagatttgtctatgtggttaatgcctctaaagagtctgtagacacccaatatctaaagtaagtgtgtgtgtgtgtgtgtgtgtgcgcgcgcgtgttattgagcattcctgtgatagcgagggaatgaatggcacataagctaaaatgctgagctcctaatttatgtaagattcagaagcctcatgttataattctcttgagtcctcattttttttgctgttttttccctccgctttctaagtttcttattctataattaacttttcataaatttaggtcatcttcacaattttattatgaagacctcacagttgttttgaagcaattgaggtaatagaatgttggacatagaatttaacccttggcccatctaattccagaatttcttgtcatactaccttctgtagaaattggtgaacagtctcctactcttaaatagagacagtagtgtctggggtgagtgggagaattcaattcaatcttttatttattagtggcttactttttgctcagcactcagctgtgagctggcaactggggagaggtacacagacactagatagttcagacccaattcctttccttaagaaaattatcatatattttggaggagtggagtaaagaaggcagcatgatctcaagaaagatttaaaggacaacatgacacttatttgaacagcagaattctggaagcaaattagtcttgtggaaatttagaaaactgaactgaaggggtaggaggatactttgtggtagactgtgatttaatggatgtgctaaatactccccaaagatggctcacctatagaagaaaaggacctggtaccggagagagggaaagatccagcttcccctttgttccagatgagcccagccttgtcaacagtcctttcccacatgacagacatgggagtgaagttatcttggacattccaatcccagctgccatctgactgcagaagtttgggaagctccaagaaaaactagaaaaagaacatagtcaacctgcggagttgtgaaaaataataaaatagtgctttaaagccacagcatatttggggtggtttgttatgcagcaatagatatgtggagctttgaagatttgatataatctagacaagtcgaccagaattataagcaccagaagttgtgagaaataatatgaaatttattgacttccgatacaagttttaaatacatttttaaaaatcccaagtaaattctataaagcagcactgcccaatagaacttcctgaaacggtagaaatgttcttagctacactgtccaatatggcagccactagccctgtgggtgtagagcacttgaaatgcagtcattgcgaatgatctttttgcaatccacaagttgagttgataggagagaaattaccagagtttgtggctatgttccttctaggtttggcgtgtgattagttgggtacctggggctagagttgcaacggagagaagggccatagtgccactaattctctccatgccagtgtctctcaaatcatggtatgtaagattgggatacctgttaaaaatctcccacacaagttcttctgcttgaagagcctgagcactgcattataagagggagtctggattaggtagtgcaggtgcagtctctatactcaggtcttcacttaacaaccacccaatttatctagatgactgtgggtggtgttaacagctaggccttcctgaacagttattaagcatttcattagatatgtttaacattctttaagaccttttaaatattacctgttttttctttaatctgaaatgtgctactctgcaagtttcattatggttcatgggtttccttttcacacggaattacatttttcttaacttcctctcttgagtgcttggagaatattgatgtgaaaggtggttggtaatcacaggaagcaacttctatattcagaaaggatggtacttcctgatcatggaaactatggagaaacttgtacgtggcaagtagagagatctgattgaactacaaaaagtctgtaatgaaaaatagctattttcctttagaacatactttctctcaggcaaaaaccctgattttaatgaatatagaataatcatttgtaatattagttaccatgtacataaaattagggtaataaaatgtggaggtatgttatgtgtttttaatagattaaatttgccctgttttgttatactgaggtagacatttacttatcaaattatgtattcaaaaattgaagaatttattcaagtacattttactagtactaattctgaattgatagtgttcaaatttatgaaactcctgtagtcatcaaaagcaggtgagaatcctagggtcacaccccctccagaccttgctttatttccttgtagacattgaaggaagcattgctagctataagatagtctttcctgggatttttccataaattctctactgcaaatttcatactataacttaactctgtatcaattgccaacaacaaagacggcaagattctctaattggactttgttttgttgaaatacagctatgatagattcttttggcaataatatctttggaaatgctggaataaagtttttttaaaaaaacgaatagaatcctgagggcatatggggagtctagaccttattttttccttgaagatattggaggaaacattgctatctatgagatattatttgctgggatgtttccataaatcgctaccacttgaggtattattttcataaatttgctaaagggggcaaaattcagggaaaacatcagttagtctggatgactattttagaaaaaggaaaatgcagaggagtgagtcagatagaatgacgtagaattttaggataagtcatagaatgttgggttcatgaggaagcacatgataattcaattaatacaaaaaggaagaatccattgtacgattggaaatactatgaggctgagttcactcggggacatgcagttagctagcaagtgtctggggaaggggaggaattacaaagcagagctgtgaaatatctaatcagatggaccttttaagcaataatgtattgccaaactgatgaaaagtcattacctttgaataatagcccacatctgagagttaattattacagggtgagactatgggtgcctcatgcggacaaggtcaattatcttatacctattaaaatgtattatgaataattcacaggtaaaagttagctgtaaaacacgataaaaataaaaggtgaggaaaacattgaattcagtggtaatgtattttgataatagcaggcagataattatacaaggataatgttcacacataggatatgaagaattactagtcagattggtcttcttaaatgaacacaacaacccctgccattctcctgcttcagagaactgtcatgttattgcttttaatgtcactactgtttctactttgcatgccaccacgcccagctcagtagacatttatcaaatatttactctttccttgggtttatgtcaattcctggggattcagtggtaagaccagagcactgctccttggaaactcacagtctgatgcaggagataaatcagtaaacaaataattttaaacaaattaaccattatcgggatgaagatatttgtagaggcctagccctgggaatggattcttgagagagattaggactgagcaattcttggatcttggaaggtgaatgggaattgaccaagctaagatgaggtcggaggaggcatgtggctagaaggtgaagttgggtcatcagcaaaggctctgtaacataaaatagtatctggtatttgcatgtgtgtctctgcatgtatacatgtgtatgcacacatgtgtttgcctgtccacatatatgtatatgtgtgcacgtgtgtggatatgtgtgtttatatctgtgtatatgcatgtgtgcatttatgtgcacatatgtgtatgttcagatgtgtgaatgtgcatgtgtgtttatggtgcgtgtgtgtgtttgattgggtggggcaatggaatcagaggtgagtcagtatctctgcagcataggtcaaaaaacacttcaatctctatttataatcttcataatatttttattcttagttcagttggtcttgctgtgagcagaagtacagacttctgtaagaagtaaaattagcattacttcttttctctcccattttgcctgtgtgcccaatataggacaatgagtctttatacttttgtagaacaaagggaaagggggtgttcagaaggaaattgtaagagatgccaaaaggggaagttctgttctccctcacactctttctgttttacaactctttcatcttcacttacgggaaatttttttttgtaatgaatatacattacttttataacttgagaagaaacaagggatgctttaaaaaccttatgttaagcaccagtatgaattctcacttggagtgaaaagtaaaaaaaataaaatcatctatatctattaaaaacacattaagtatcagcacaaggtctattatagaaatgtgaaactattcagttcttgaatattaaattaattatttagattcattcagagtgcattttgattcaagtggtcttactacaagtcaacatgctttgtattagttatttatttgaggactcttcctcatgcatagtttttcctctaaaccagtctccagaagcagtgtttcccctcactgagcaacatgaatatacagacaatattcaaacgaattttttccccaaatcaccaccaattcttgtctgcaatacttaatagtcttctatcagatgtccctgtttccagttctttgtttcaccaatatctgttatgcaatgttgcttaaattcttacctaccaggtaaatgatagacatctgcccaagtcactcaaggccctctgtgaccctgctccctgctggctgggatctccagcctctctcctgctattcctctacacttcccctaaccatccaagctctttctagcctcttcacattttcacactgctccctctgcctagaatacccccatgtctggtacatcacttcaacccctccttaggcattaagatttcattctaatatggtctcctcctcaaagccttccttaatgtctccaagctaaattctcctgaatatattcccatggctctttgcttattcaaaaatttatcatgtcttagtgtaaaatttatcatgttgctatacgggcaaagggaaaacttcccctttaccctcaaggtttgcagaaaatcaatgacaaaaggcagattaataggagaaaaggcaaacaaatttacttgatcatacttttacacaatacagaagccttcagcgtgaaggcccaaaggtacaggggaaactccatttttatatttaggctcaacacaatatgaacaactgtgcagaaagatgattggacgagaaggctatgatctaatgcaaacagactgagttggaaaactcagaaaagcctgtctgttggcttttcagaagggtaagaatttaagcaacatttttcttggcttctctgcgtagcattcttccttctgggtgtaggggttttatgacctataatcatacaaggtaggtcagatcatttctttatggccagtttttatacaaaaagttggtgggtaaagttagagtaatgcttttaggttttatggctggctttggagaaaagggattctgatttctattgtctgccttgaggaagagggattctagtttctatgcctagccttaggggagaataagaggccagaaacagcagggcaggagatggtcacaggacaatgttggctttctgaggacttcatttcatttagggatatcgttttctgatcctcagtattgttgaaattattttgtttcaggctcatttatctcatattgtcttgtaaattcaaagaggaagatgcttctgtgtttgtaaccctggcaccatagcacagtcgctggcacctattgaaaactcagtcagcgtttcatgggtgaattaatcattccatgcgctcagtggtcccagttttcttcaattagaccatgaacttctgtgatctggaacttctgcacacactattgtactagataaaacatgtgatgtgataaatgcaatgaggggttgtctgtgaggatgtccaccagcaattccttccatccctgtctgtgcactctgctcttcttattaagagacaaaatcgttttccttccccatgagcctaggctgccttgccactatgatttgctttgaacacgtagctctgggccagtcctctgtcttggcattaggagatatatcggcttttacttttgtgctcttggtatctaacagccatgtaaagaagcacgaattagattattggatgataagagaccacatgggcaaagaaaggatgaaaaagttctcagttcttccaactaccctagttgaggtgccagacacatgagtgaagccctttggggatgttccagcaccagatgagtgtggtcacagtgaatatcacattagaaagcaacagcccaggaaattctgagaaatagttaactattttcaaccagaggtcagcaaacaatagctcatgtggcccactgtttgtttttgtaaataaaggtttattggaatacagctaagtgtattcagttacatattgactatagctacttttgcactactgaggggagttgagtagttgtgtctgagaccatatggcttgcaaagcttaaaatatatacaatctggccttttacagaaaaatgtatggactctgttttaaggcactaagtttgatcaagtttgttaaacagcaaaagatcactgaaacaactgctctcagatttcagcttatccatggaggttggaagggggaaggaaagatgtcacaagtgatatgaggtcaggccttaatgtgcatgcactgatgagagtccaggacatgaaggttggtacaaacagaaatcgatctctttttagctccagattttttctccccctttcttactaattttgagaaagaaaatactagcacagactaagcaaagttaagtaaaacatattccccaattatatgcagatgatgggattagagttgctgaaggtattatcttccctcattaccaaaagaaactgcacagtgaactgttgaaaggccaggagaatgagcgccaatggtctctgggggaaggtcctggctgatgagttggcctcttcttgttcagcttctttaactccctcccagcttgtgattccccaaagggcacatccatctgttcttcagaaatcaaagaattctttgtgttttttttcctgtgacatatgaatcttttctggtaaattctgaaatttttttacccacaaatttcagttaatagaaaggtggcagcatggcttggtagcaagagtgtgagtttcagagacacacagatacgggttcaaatcttggcttcactatttttttttccccgtttgggcctggaccaagtgctttaaccttcctgtgcaccactttccacaaagtgtggacaaaaatggaaacatagttggcacagaataaatgcctttttgttatttttataatcaaaatgtattctttgactatgctctgagatgatctcattcaatgttcaaaataaaaatcccaggaatatcactgcttacccagaagagtttaacagtaatcaccatttgtttgggaacataatgtgtccaagacattgtgcaaagttctgaaataacaaagatgaatatcataagtcatagaaacctctttagtatgaggattcagaggtgttaacagtcagacctactgggatagagggctaggctgagttttattcgtttttctgaaattagaatggtaaccattgatatccattaagtgcttaccatgtgcctaattttaagtactttacacgtgttagttactctgttcctgacgcccctgtggaggccgtggctgagacacagatgtaccataatgagctgtcctttccctactgggctccactgccctactttaacatcgcaggcatgggccagtttatttttcaatagagtggaaatgtgaagatgtttaagcctatatcatattaaatggtgtcataaggcaaaataaaacaaaagaaaaaacaaaagaaagcaaaaaaaaaaggcaaaaaaaaaaaaaaccaaccaaccagcttgactgttgtgtttcttcacagctggctctaaccagcacaagctgacaaggggcagtgagctttgaatgtccattatctgacctagctgaagacacttgcctgacccatgaacaatgggatttcgtataaacaacaatgggatttcgtataaacaactgtgtacacacttatgggctcattctgttttgtctgagtgctggtgttcattgctgagttggcacagctccatgacctcccacttctaactttaaaactcctgagcttccccctctttagtgacctactcagtaagtttcttcaaatgaatgctttcaggcctaggtagtaaacaaacttgacattttaattatttaaaaaaatagttttgtcttatttttaaactctagtcatttttatttagttctttgatgaggcatagagtgaataagtaatttgctgactccagcttgtagttggcaaagctgacatttgaacccaagcaggctgtccctagaacctgcattcctgccatcttatgctgctcgcctgcatagagtcaaatactgagcaccaggctcttttctatagtgaaatatcaggtgcttaaacatagtctgaaatgatcttcatagctgtgtggtttggcagaatattggtaaagaccttaatgatataaaaaataaaaatcactgattataatacatgtaaacacataggcacaggtttttagtgtccctagtgttttaatggtaatgtttaataacaaggtctccaaaaaaatgtgaatgtgtctagatacaagcttattataaatttactggcatagaggatgcagagcaatttacaaataatagtaaaaatgcatgctattcttactgtacattccacatgggcattttattctcacagaatgtattcattgattttttttccaaatcctggcattcatagtcaacctacagttaacaattgttgaaagcatataaacacaagtaccagtcagtattttcatttacatcagtgagtaagacaaaagtgaaacaatgaaggcatatgctaaagctttgcttgtttgtcaatgatggaagctgcttctttggcgagtcaaataatagctttagaatactagtagaatatttcctaaattgtgtgtgtgtgtgtgtgtgtgtgtgtgttacaatgtaatggaagcaacatgacacacttttaagtttaaatctatattactagtattttctccatcgctttcttcagtccagagaatcgataaaacaatacatcaggccatgatttgtataataacagtgtatagtttctgtggtgtgaataatcgcaccatggccaatcttaccgtaccaccatgcagttcctgaaggtggacctgagcagaagtgtgcagtagcacagcacttgcagttacaatagatataaacaatctcaagatcacagacatttgtgaaatgcagtcaaaggacagaaaatcatgagttgagtattgtctttgtttttaatatgattcatcagttgtaagtttgtgtaatttatcttttaataacaactatgtttcacagccaattcacaaaatttctgaatatttagcaagcagctcccctgaactagtataagctgtctgcagaacaccaatgggtgtacatgaagaatttgtgtacagggaaaatacaatcactgttttgagttagacttcaaaatatgcacctaaactctcagacattttcatatcatttataatagaggaaatgtcttccaaacttaagtgggatgcaaagggtatgttaacatatctcaagaaagtctgtgttaatcgaaaggaatctggtcagctgaagcagcagcaatctacattgggtccagatggagggagctaggactgatagacagctcataccgatgtccccattgcccaggctgtcctcatacagcaggtggagagaagcatcactctgttgtcttctgggtgatcattgcagagtgaagagtgctcggcacctgtcccaggttccttgtgcatatttttgcttgtaattgttaaaacaaatttcccctaggtagtagcattgcttctagttttaaaaccatgaaactgaggttgaagacttgtgaagtaattttctcaaaatcacttgtctgttaagaggtggagtcagaatgtcaacctggagaagaaccccaaagctttccctcttttatcctgaagattcaaataaataaaaaatacttagagctgagaatcacctcggatgttggtaaaggtcatgatgctgctggaggttgttcagaggatccagacaatgatggctggaatgattcctattaaaagtgaagaaatgttactggagtgaagtttggaatatttcagagcatatgttttcccccagtagcaagaattcttttgctggtaagttaaagaggcaggaaacaatgcagtgatattttctgctttcccttatgccttctgcacttttatcccagaacttcaagtgcaaattaaataaaaaggcttgtgatcttttctatcctagagaaataactccttaaacatccattctcttagttttacttatcttttcttaccttctgcctctcagtgagaagtagtctttaaatgaccagtgaaaggctgattcctgtctagtggccatagtcagccctgccttctctccctggagctactcggtgcctgtctaagtcactgagtcatatgtccctgaaaaggaacaaggaagttatgttcatttaataatctcttaaaatatggccttcgtcaaataaatcaatgaacttaagaaaacccagaactcagggcgacttgccttctgactgtgtgacttttgaagcatctaaggtgagcgtgtcaaataatacatgacgatcttcaattctcaaacgtatgcccagtcctgacaccatcaccactaaacacacattcacacacacacatacgtatccataagtacatttttcttgtaacttccaggttaagatttggttcaataaagcagatctggtatagctagtgtatcacttatggattggggcttttatttctctttttaaattcatggaattttataactttgtgggaaagtaagttttgtttctttcagccttttcattgcatgagaatacagtgtctcaggaaggttaattgacttcatttgagtcatacaaacatggatccacttaataataaatctgcttatacaactcagatgccttgatttttttaaaaaaaatctttatttgttttagaattttttaaatttacggaaatactgagacaatactatggagttcccatatacactgtacccagtttcttcattattcacattgtacatttgtgtggtgcacttattgcaattaatgggcccatattgataaatggtcattaactgaagtccagagttacttggattaccttagttcctacccaatgtcttttttctcttctgagattccatccaggatgccatgttacagttacatgtcatgcctccttaggctcctcttggctctgacagtttcttagacattcctcgttgaaaaccttgacagctttgaggagcactggtcacatgttttgtagaatgatcccctcatttttaatccagtgttatctctctgtttattcaatacttgactttttttctctaggaacttcaacaaggccttatcttaccttaagtgagcaatgtgaatgagtaatttgatgaaaagatctgaaaggacatcccttagtttgaaaaaaaaaaaaaaaaagctgtacccttccagaagcctggcataaggccagcacatccttcactagagacttcttcatgcaggagtgccctccggagtgcagacgctgcctgagcagaagcaacacaccaatgcttcatcatctgttaatatccttgcacaattactttatatatatatttgcaaacatctacctgctatatactaggcactgttctatgaacttgcattaattaattattacattatttcagcacccttatcagatagattctattattatcctcattttgtataagaaaaccaaggtacacaattaggatgtaatgtgcaccaagacccagaggggagacagaggatggactcatagaaaagtagaagacattttagcatgaagaggtgtgagtggtatatgatggggccacatcctggaagccctttttggccatgctaagaccatagattttttccccaaataatgatataatacagaaagattataaaaaggggtatgatctgctcagattcatattttaagggaattcctttcctgcagcatgcaaaatgggtttgaggtggactagactggatcagagaggctgttagatcttatgggtgagagagataatctgcataaaggctgaggaaaggggaatatttcttggtctctgaaattttgcttcaaacaggcctcattctctgcagatactcagagatgcaactgcaaaactcaagattttaatatgcccaagtagacgagaggatacacacacacacacacacacacacacacacacgtttgcttatttatatgtatatatttagttatttatcataaattgattggtagcaggtactaaatcttttttcttaaacttttgtaagcaagaaatagaacatttttgtattttgttcctatcaaattgaatctgaatctgagctgagatgcaatcttggtgatgattgggtcattctacctgggcatgaggactctggaaggctcacatagtaccctgaactgggggaggtcttctatgcttctgctcatcatggtcgacactggcattcccattgtccaggcaggtgctttccactgctgactcctgagagatgtaggccaaagcccttgtctctgccccaagtgccaaggtgtgtggttggccatcctagcccctggggagcctcccactctgaggatttcccaccccctaggccattagaaaacctgcatgagagactcactctgccctctttccacagagggacacttcctctcttttcctcagtgtctctgcctctgatccttcgaagagtggcagcccagtgtgaggaatggaattctgtatgatgatggacatgttctattctgcattttccagaattgtagccactaaccatcatttgaaatatggctagtgcaaatgagcgatttaatatttaattttatgtaatttaaattgaagtttaaatagcctctatggctgacagctacaatactgtatagtgagagagagggagaagccaggaaggaagttgatttaagcagctgtgctttctgccttgcaatgcaaatcacccctaagaagattacgtgcacaggggctttgtggtctgcttagaatggggagggaaatatacagaaattcttatctcaatacatcatcctgacacagatacattcactttcatgcttatatgctttggatgcgttgcctgtttgtaggttgcagggaggggctcagattggtaattgaagcaatactggaaaactcccccagaatattttctgctttcctttctcaccctacagtctacccattggaagcatggccaaagtcagggaggttcaggacattcaatgctgagcgaggtcagcttcagccttgcttcactcagcagagtcaagtgaacaggctgtgctgggaaatgggatttctcagactctcaaggttgtgcggatgtgccaccacccaccaacctctcccttggctgtccctcactgcttcagtaacccatacttagaaagcacattcaccatgaatgctcttagcaatcctgggaggttaattgatggaggtggtcaagacaaagaggcatttggtcatgcctagaagtcactgccaggctctcccacaattctcagtttcagagtcctataatttgttctttctcctttctttcttttctttctttctttctctttctttctttctttccttctctttctttcttctcttcttagatataattcatatatcataaaattcatcgttttaaagtgtttgtttcagtggttcttagtatattcacaaggttgtacaactatcaccactatgtgatcttaaatacgttcatcaacccaaaatgaaaccctgtacttgttagcaacttctctccattctcttctcctctaagcctttggcaaccattaacactaatctattaactttctgtctttatggatttgcctattctggatcatttatatgaataaaaccactcaataaatggtcatttgtttctggcttcttccacttaatagaatgttttcatgatttgtccatgttgtagtatatttcagtacttccttcctttttaaggctgagtaatattccattgtgtatacatatcacattttgtttacccgttcctcaattaacaaacatttggattatttatactatttggatcttatgaataatgctgctatgaatatcactacaagtttttgtaaatatgtttttaattttcttgagtgcatacctaggagtggaatggctggatcatatggtaattctatgtttacatttttaagaatcaccaaacttttttccatagaagctgcaccattttacatttttattaggagtacttgaagagtctaatttctccacaaccttgccaacacttgtcattgtctttttattatagttatcctagtgggtgtgaaatggcatctcattactgtttgatttgcattttcctcctcaccaatggcattgaacatcctttcatggtaaaggatttgtcattttatttaaattgcattacttttctttgtgttgttgatttgcaagaggtttttttatgtaatctatatactaggcccttgtctgatatatcatttgaaaatatgttcttcaattctatgagttttcttttttgtatttttacaatatatttaatagtatatatttaaggtatacaaaacatgatattatgagatacatatagatattaggttggtgcaaatgcaattgcgttttttgccactatttttaatggcaaaaaccacaaatacatttgcaccaacctaatagtaaaaaggttattatactgaggcaaattaacgtatctatcatctcacatagttacgcattttttttgtttgtttttgtggcaagagcagccaaatctactagtttagcatgaatcccatacacagtacgctcttattacctgtatggtcctcataatgtaccttagatctctagacttggtcctcctgcatggctgctgctttgtgtcctctgacctatatattcccatttcctatgcattttctaccctcctctgtcaaccctggtaaccaatgtgttgttctcgatctctgtatatttgaattattattttttaggatctacctataagtgagatcatgcaatagtttcttttctgtgtctggctcatttcacttaccctcgtgtcctccatgctcatctatgttgtgacaaatggcaagatctcactcagttttagggctgaataatattccattgtatatatgtacctcagtttctttattcatgccttcaatgatggatgcttacgttgttttcatatattgggtattgtgaataatgctgctgtaagcatgggagatcagacatctttatgagatggtgattccatttcttttgggggtatgcattgaatagggatcactaggttgtatggtagttttatttttaatttcttcataattccccatactgctttctagaacaatctacattcctgtgaacaaggtacaagagttcccttctatccacacccttgccaacatttgttattttttgacttcttgataatagtcatcttaaatatgaagtgatatctcatagtggttttgatttgcatttccttgatgatgaatgatgctgagcacctttacatatgcctgctggcctttttatgtcttctttggtgaagaaatgtctatttacatgtttttgcccatattttaattgagttatttgttttttcttttactttctcttatgattgacctaagggggattttttgtcttatttttttcccaacattttactggaaaattttcaaatatatataaaatttaaaaattgtgtagtgaacgtcaatatactcattacctaattctacaattaatattttctctttatgacttatcagatatctatttttattttccttcaacttttctgagtatttctggtgcaacctccttctccttaaacttcaaaaattctttttctcatcacctaccaaggctttgatccattcagggctagcggaaaaagaataacacaacaaaaccaaattcttctgcccaaaatgaggatctttatatggaacatctgtatttgagtggtcaaatttgttgtcatccgatttacattaagcataagtacttctgttctgcaaatcatttaaaatgaagaattatgatgtccttctgtgaaactatgaacacttttttttttttttttttttttttttttttttttttttttttttttttttgctagtgaagaacttcaaggaggacaaatgcctttaatgccactctcaacttggtgtgtcctcaatagatatagtaatcctttagggatgtggacattgctttccccctaagacttagtgagtgagaggttatcttctctattgccttattttatgtccctgagtttaatagtgccaattccatggctgttgagtttacctgctttatttgctctaaagagaaagttcagcagaatttcagaaggggctggagaattgcatgccaagcagtgtctgccctatatcaattttgtacagcacgaggaaaagagaattgaaaccaaatttcccattatgtaaaagtagctattaaaaagatacaactgaatttaagatgattgtcaacagagtgggatacagcattaaagggaggtagggacacagttaaaggatttatttgcccttttctctcattttctgttcctcattttgtcatttacttcagaggacatcaaaaagtactattttaagaccaatctgaatttctggaacataaccatctgatatgcttatttcaacacatgaacatgaacagatgtttactttataatgttaaatgtgccagctgttctcatgtcagaataagcatctaggcattttgtttaaaagtgaaacaaagattttaaacctctgttcataaacctccatatgaattcagctttccttccttccttcctccctccctccctccctgtctccctccctcccttctttcctccctttcttcctttagccctttcttcctcctctccttctttccttccttccttctccctctctttcttcttccttccttcctcctccctttctttcttcttccttcctgccttcctgtctgccttccttccttattttgaaagaatcattggtttttagaacaatatttgctatttctggatgtatcatagcatgaatatcatatatattttattggctaatatcttcatgtcatatattacaggtctatacttgctcagcttgcatatcttctactttttaacctctgatccaatagtgatactttaacaatgaagaaagtacgagtatcataaaagaagtagcataaaaatctaggcaaagttttttatgttcaaacacctagatgctgcctagctttgtaattaattaagtcaacccttagcacatcgcacttaactacctggtcaccttgtgcgatggctagtttgaatataccataggcatttggtatattcaaaccatttggcttcttccctctaactactgatcttcccaggcaaagggaggctttaagacatcattctgcccaggtctcatctcttctacctgcattgcagctgctgagccccaaagacgataatcatagaaggtcaatgcctgatgacatcagagaagtcagtgaatgaagatcataatcatagaaggtcaatgcctgatgacatcagccaagtcagtgaatgacacactcttatcattgagcacaggactaaatggggtttaaagaaagtgtcctagatttagatatgagtttttaaatttccatccacagatgtaagaggctggctacattccttttggcaaacatccatgaattttggtagctgtcaccattcgaacagcattgcctattaggctttttattttttcctgttgtggcacaaaaacacagaaggtcaaggatttcccacattaaattgctttagttctgtattctttatgaagataacataccggatttaaatctgtactccaaagattgcactgggagtggggcgacctaacccacaaagatagaactggtggcctcagcttagacttttctctattgttgcaagcacaggtgctccccagggggcccgcagaggggctttgccatctggacaagtagatcagccttgaaaaaatcattaacacctaagtgaagtgttcttttttttctttcttctgattttttaaaagagattaaacaaacataataaaagagtgtttggacataaggtgtgaaactcgttatatcactattccaggaacatgccaggaactatatctgtttacttattcctgtccattggaaggaaaaatagaatagtatgcagtccttaaatatgtttatgcagaatgtgttatatcatagggaagtgattttaaaatatcattaattgatgagacagagtacttcttatatgtttaatgttatatcaactctttaaaaatgtttgcctatgtataaaaagaaaaaataattctggaggaaaaatgccagaatgtttacagctatttcctggttacagtggtctttgcaggagcctgtaaatcctgacatcatccggctgccagtctccctacccccaacttctaccacctcacctccccctacaccccagttaaaccatgtgctttctattccccatctctcagcttagcatctttgtgccagctgatgccactgcctttccctgtattcaactgcttagttaattcccttaccccttcaagtttgactaaaataccactttttctaggaggcctgtgctcatggagacactcctatgtagtcttgctgctgcctattcctttccccatgcccaatctccctcagtgtctcctatttttgctttttttcttagtactttccacttaattgtgtactttataatcatattatgcaacatatatatagttaaatgtatacatatagttatgtattacacacacactttttttaatagagtgtagcgtatgtacaagcacatgtgtctgtgtaactctcctttccataatgtaaattccatgagggcaaattacatttgctgtatttaaatccaatgcttggccaggtgaggtggctcacacctgtaatcccagcactttgggaggccgaggcagggggatcacctgaggtcaggagttcgagaccagcctggccaacctgatgagacctcgtctctactaaaaataaaataattaggcgggtgtggtggcatgtgcctgtaatcccagctactagggagactgaggcaggagaattgcttgaacccgggaggcggaggttgcagtgaaccaagattataccactgcactacagcctgagtgacagagagagactccatctcaaaaaaataaaaataataaataaataaacaaatccaatgcttacaatagtatcttgcatatagtaggcactttaaataaatgttgaattaatgggggttgacattatggatgatttataataagaagaacataatacaattccataaaacaaatgattttttaatagcaaagagagtatgaatagcataaaaatgagtagcgtaaaaatctgagcaaagtattttagcaccataggaaaagtaaaaaaaaaaaaaaatctgaataaagttttaagatgttcaaatacctagacactgaatggtcttgaaattaataaagcaaactgttaaatttcaggttaacccttggttcatcatgctttaccacctggtcaccttgtgtgatgtttagtttgaaaataactgtggacatccactgtttctccttcactctaggcctctgatcatcacaggcaaagggaaaacctaacagctcattctgcccaggtctcatctctcctacctgaattgctgttgttgggtccagaagaaactaatgaatctatgcagatttgaccttggcactagagaattatgaagtagcagctctgattctaggttactgctccacaccatctccagcaaagggacttacccaaaagacgagtgttccctttccaaatgttagaaataattagttttgtaaggcttggggtcaatgtccattggtttgaaaagaaaaaaaaagacagaatttaaagatttctgcagtgtcaactcttttgtgtcttgcagccacagctaaagcatgatgcaaaatattaattcagggaaattttattttggaaaattttacattgatgtgaatttctgataatatgtgtattttctcccaaaacatttcttattagttcattgcttatttgtcatgatttctgtgtccctcagtgtatcctgaggctgggcatggtggctcgtgcctctaatcccagaactttgggaggccgaggcaggtgaatcacttgaggtcaggagttcaagaccagcttggccaaagtggtgaaaccccatctctataaaatatacaaaaattagcggctcatggtggtacatgcctgtagtcccagctactcaggaggctgaggcaggagaatgacttgaacctgggaggtggaggttgcagtgagctgagattataccactacattccaccctgagtgacagagtgagactctgtttcaagaagaagaagaagaagaagaagaagaagaagaagaagaagaagaagaaggaggaggaggaggaggaggaggaggaggaagaggaggagggggaggaaggaggaggaggagaaggagaaggggaaagggaagaagaagaggaagaggaagaagaaggaggaggaggaggagaagaagaagaagaagaagaagaaggaggaggaggaggaggaggaggagaagaggaagagtaagaaggagaaggagaagaggaagaagaaggaggaggaggagaagaagaagaagaagaagaaggaggaggaggaggaggaggagaggaagaggaagaagaagaagaggaagaagaagaagaggaagaagaagaggaagaagaagaaagaagaagaagaagaggaagaagaagaagaagaagaagaagaagaagaagaagaagaagaagaagaagaagaagaagaagaataaacaacttgggatcattcactgacactgaggagagggcgagagtccctgctcagaggtaatgcccagggtcacctggaggtctggcaagagagaaaagatgaggcatggactttgattccttcaaaaatttccattagaacttgaaattgagttttttgtttgtttatttgtgcaactggcattttcccaagtaagtgggaataaaaatacctctagaaagtgtggtacattttttgaactacatcacattatttcattatctaaataaatccagagtgcaataaatgttaataaagttttaaggaaaaaaaatccttcacatactccacccatcgcatcattgtcatgtcttagccatttaagagatcaatatcccaaacaaaataatcacattcctcgatggccagaaattgctagattaggagggatttgaaggtgggagcctgaattctaagtccagttctgcagtggctcaacccatgacatctaacaaacctaacacctctctacctcactttctatttctgtaaaatgggcatctcttcctttatttttctggattcaaaaagaattggttgttaaaggaaaatttttgtcatcagcctcaagtatcgtaaatttcctttcagtgcaagctgaattacatacaattattattccaatttggacatcttacagtaaaagtgacgacaaataacttcatatatacaagcaatgcttccaggataaaacttttaaaaaaaatcactatcaatgatgtaacagaaactgctgaagtgaatacagggaattaatatgtcaagtaactagttggacctacatgatggtgttttgttcactgttgctttctaaatcatttgagtatttacaactaggcttatgatgttctttgagttttaattaataggctaaaaactcaagtgaactttttttcacatttattactgcataaaccagactttaactcaaatagtcaaaatggagaggctttactgatgaactgcttacgaaggtgtcagtaggaatggaggtatccacaggcaaaatgaaggcacctggatgctagcaaaagtgggaagtcatcactaagcctggtactgaggaggaaatagagctggagcagtggaagagaagtgcccagtggaagctagagtcaatgaaggagctcaatcattggtagttctcaaaagcagagaggaatccagaaggaaatgtcatgatctcgctgtcatctccatttcctgctggtgcttctattggcgggcggacatgggaacctggcagtgcaatctgcagggacaaagaagccaaacaaaggcggaaaatgtatctcgggattggaggtacaaggaaaacactgagcacagagggatggaaattacaatgccgtttagtgttgtgacagacattggcatttatgtgtctttgctggagctgcagttctggaattccagagtaaggatgctacaaagagtttccttgctactacctttatcctaagaatgagtctgactatgtttttggtggcggtggattcccccatcatcacttagtggtcattaattgtgggcactaattgctgagttctctaagccagaattgctcagcagttgataactgtggtgaatcagcaattgtttatgtccatgctatctttggtgaaatcttacctgactacagagaagcttgagaaatgtgttttttctcctctgcaacctgggcagagggcccagcttacagcacccttctgtgaacactaaatcacagtgcaaactcactcaccgtgcgctgtgcttcattccacagaatatggagcagagcctctctgggcaaaactgtgcagtgggcagtatctagcaccatttgtattccatattttttcctgcctcgggcccataaaagtagcaagtttctttggacaatctctgctgcaatcagaactctcattcaaactgaaatgtgagataacagttgaagaggaactgcaagcttcctgggggagggagggtgtgtgtgtgtgtgcgtgtgtgtgtgtgtgtgtgtgtgtgtgctctttttaatagacttataaataaaaatgtctatgagggccaagcagtcacataaatgaagacattatttctacaaagacccatcttgtctaagcaataaatattaaggaaaactgccttcctgaaagatgttaaattacaaattttataaagttgaaaaaatgagtcttacataaatatagaatgaatacaagtagaaaatttgtataaccaattgaagagggaaccattaatgagttatataagtaaagttggttcaaatgggaagtaaagttggttcaaagaatgcttgaggaacagagatttgtgtagtcagtcaggacagcaatctgctcagagacaaaatagttaatatcttataagactatgaatcataatttttggagttaaaattatttttatccccactggacaaaatctacaagttaatacgtggtcctaatcaatagtaaagtgcacatcaaacaaagataaatcctctaaagggataattaatccaccagataattaaataatcttctagaaaattaaattaaatattgaatagatctgttcaacaatgcttcatatgacattgaaagggtatcagtcattcctttgtcctattcccaatcttcagctaacttttcttaagaaaataatatagtagcttctatttttctcagagtacaccatggttttcttaggtttctcaatgttgatagatttaaatgtaaaaaagtaattactttaaaaaatttcctacaaaattacaaaaaaagtggtcccgggtcttactttttgccatctgtagtgactgagtagatggtcatcgaagctggaattcagagtttgacaatgttgtgtttatgccgagatgatggtgagcagtgaagagaaaacccaagggaccccttacaggagcagctggttagtgggaatgtgggacccagtgttgccaagacttctgactttctagaaagccccaagaaactctttataataaatctcttgatttttaaatattgacaaattaattcagaagattaaaagcactgtatgggcaacaatttcaggctacctctggtcagagagtttccatcttgcaaatttcttcataagcaaaataaaacaagctttggtagggaaattctagtttctcagatgcttttgtacgcaacctgtaatagaaaaccaatagattttctctatataaatttggatcctagagcctagaatgtttaagtcttctcagttcaacaagagaacctatcatccattgtcggtgaacccatcagtcaatccaccactccatccagcaaatgtctgcagagtgtagacaatacaccatgtgtggtgctgaagatatggcaatttgcttccatctttcctggacattttgcagccaaatttcccagtctccagcttttgatcccaggctgactccttaattcactgcagactgactcctcccttcaaaacttttctgaaattactgttttcagagcaatccaggatcacttcattgtttaattcagcaaacatgtcttaatcgttatccagcctgacttttctgtgacagtgaaatctgttctgattttcctgaaaacctctctttgggtgttctggaaagttttccactgcttctctccttgccattactgtgcattcatgttgtagtagattcttctttcttcacttcttgattttttgaatttatcatcccttcattttacaatctttctcctataagctgggcacggtggctcacgcctgtaatccccgcactttgggaggcagaggcgggtggattacgaggtcaggagttgaagaccagcctggccaacatggtgaaaccccatctctactcaaaatacacaaattagccaggtgtggtggcacgcacctgtaatcccagctattcgggaggctgagacaggagaacagcttgaacctgggaggcggaggttgtggtgaacagagttcacaccactgcactccaggctgggcgatagagtgagatcccatctcaaaaataaaaaataataataataaaattaaaaaaatatatatttctcctataaaactcatcagagggaatggcacccacacacactgttccatctctccatgcccccaacatccaactagtcactgactcctttatatgctacttccataatagacttcaaatgatttccttctccctgtctctatctgctttagttcaggctcttcttattttgtactaaatgtaacagtgaagatgctttcgaccataagtaacagcaaacaggcaacatggcttaagcgatatggatatttattaacaaaaataatttgtatttgaggctgaagcaggtggatcatgaggtcaggagattgaggccatcttggctaacacggtgaaaccccgtctctactaaaaacaaacaaacaaacaaacaaaaaattagccaggcagggtggcacgtgcctgtagtcccagctacttgggaggctgagacaggagaatcccttgaaccagggaggtggaggttgcagtgagccaagatagtgtcactgcgctccagcatggacagcagagcaatactctgtctcaaaaaaaacaataacaataatttatatttggacagttctagtattgtttaattcagcacctcatcacagataagtaatttctattttttactattttccttaagcctgaccctagacacgtgcagaagatccagcatctcaacagaaagaattacatccattagcagaaggaagccttctttacaactcactttaagttcttggcctgatatccttttatgtcttattggccaggagtgtgtgatatgtctgtctaaaacaatcactgcaagagaaatttaagcacgttcattaatttagaccagttatgatttacttttcttctgggacttacctcccttcagactcatgttgggtggatacatgaatcaattagtagcagtagtgtaatcataataataactacaaataaggctaaatctgagcaggccagatgctgttctaagcatttacttgtattgcctcatttaatcctcacaacaaccatatttgctagacagcataattattctcattttacagcaatgaaaatgaaaggttagaatggttcaggattttgacaaaggtaacacagctgccaggactcatatccaagctgcctgatttggagctctgctcttgcccactgatgttctacctaacatgggttttattagcatgacagaagtatgtggagaaggagctgctgctggtgtgtcagacaattcaggctgctacaataaaatatcatagattggatggcttaaaaataacggaaattaatttctcacagttttagaggctgggaagtccaagatcaagttgtcagaaggttcaatgtacagtgagggctctctttctggttcactaacagtgccttcttgctgcgtcctcacatggtggaagaggccagagcactctcagccttttttttttttctttttaagagacagggtcttgctctgtcacccaggctggagtgcaataatgcaattgtagctcactgaagcctcgaattcctgactcaaaggatcttcctgcctcagcctcccaaagctctgggattaaaggtgtgagctgttgagtctgtccttcaggcctcttttataaagggcactgatcccattatgaagcctctgttctcaggacctaatcacctcccaaagggaaacctcctaataccatcatcttggaggtaaggatttcaacatatgaatttagagaagtggaggtcacacacatttagaccacagcatttggctaccaagcatctgctgaatttctactactatgggactgtaacaatgtcttcctttcttccttccttccttccttcctccctccctccctctctcttttcctccttccttccttcctccctcccttcctttctttctctgtttctttctttctttctttctttctctttctttctttctttctttctttctttctttctttctttctttctttctttctttcttctttctctttctttcctttctttctttctttctttctttctttctttctttctttctttctttctttctttctttcttctccctctttttttgagatagagtcttgctctgtcacccaggctacagtgcagtgatgccatctcggctcactgaaacctccacctctccggttcaagtgattctcctgcctcagcctccctagtagttgggattacaagtgcatcaccaggcttttctaatttttgtatttttagtagagacagggtttcactatgtcggctagggtggtcttgaactcctgacctcaagtgatccacccgcattggtttcctaaagtgctgggattacaggcgtgagccaccacgctgggccataacgtgtttcttatttccatccttgctccttttctcacctccctctcaaaccagcttccatactgctaccagaaggtccattccaaaacagaaacctgatcttctcttgtgctaatcgcccaatgcctcacagttacctttaggagcaatcccaacttctttatcaaggagcatgaggctcatcaacacctgactccccatctctcctccctagttcagcaaacatctttccttgttctctgtacttcaacgttgcctaatgaattacagcctccagataataccatattcccccatactctcttgactttgcacatgtggttattattattatttggccaagaatgtctttaggctctttttttccccccaaacatagtatgacatttcctctaggttttcttcactgacatcattctgagtttgctgagcttcatttttgctcccatggtgttccatgcattatgaaatacttgtttgccttctcaagagtcgcttgagtgtaagggccttgtaagctgcttgagaacagtcattgtgatttttttcacctctatctgctcaatgaatcttggtataaacactgaaaaaatacgcagaatgaccctcaaggagctcagaaattagtgatgtaaaacaaatatttgaaattaggtatttgtagttcagaaaatgttataatagataattggctcaaagagagaccctcatcacagctaaatacaacctcttaatttatgatgagttttatttgctatgaaaactagcccttcagttttgagtattgtagtggtttttaggtgaggttccatgtgtctcatagtgttacttcaaaggcaaaggcattaccttcaagttgttatccattatccaccattccctaatatttatggaaagcctttgtctgttcagagtaagcccagagtagctcctagttagggaattctaaatgcaacactgctagtgagttcaataaatatatattttataataatacataacacgtgaattatatattgtactttatactatatattgtataataatatttatggatatatttatatggagctacctacatattaaatatataatctatattttactggggccacatacatatacattttttacttgctaaacacaactaggaatccagagtccagagataatctggaaaaacctctggtctatcaagacagatttgcaaagtcatgtttttgacttgtagaaaatactctattgatcttttcagcagaactccagcaattttgttaattacctctaagacaaattagaaagtacaatttcacataagggatgagggaagacaggactaccatgaataagaaaacaagacagtaggacattgcaataagaggcaaaagtaatgctattgcttggatcccagtaatgcggagtgtgtttaatccttggttagttacacaaggcagctgaactgagtgggcatttcactgaagagaatgccatctgggcaccaagccttctgcttcaactattcaagcacttactatgtgtcaagcattgggctaaccattgaggatatagaaataagtaagatattagacatggctttcctgacatttagatcttgttacttagaaaacccatttgacggcttagagtcaaaatagcaacatcttgaacaccatatatttatgcctctcacatgatgtttttgggttattttggttcagactcctcactcattgctctctgtcatccccccaaagctaaatttattatgatcctgaatgtcttaccaccatgttcccactgaggctggaataccaaagaaaaaaggagggtggaatttttatttttttctttatactttaagttctagggtacatgtgcacaatgtgcaggtttgttacatatgtatacatgtgccatgttggtatgctgcacccattaactcgtcatttaagaagggtggtatttttctttaaggaacatgtatcatttccatttatataccattgatgagaacttagtcacacggctttaacttgctacaaagaagccttggaaatgcaatcttcatctgggtgacaatactctcccgaaaatgccgttgctatagaaagaaggagattggatatgggggaacagctactagtctgccacctcgtctaatagaagatggatgcttgaataaataagcagacaaataaaatgactaccaagtccccttctcaaaatagagattttataagcttaattcttctcaaggtgaccctcccattgaaatataccaaaaagcgagtgtacaactcctctaaaactaattctactgaggtatatgtttacataagtcagaatacaggtgaagcttcaagcccaggtgcaccttgattaagttacttttttatttcttaactttttaaagcctggattgcatttttttccaaatggacaattatcttaaaattatttttatatttttgccaagccccctacaaggccactatcaatatgaaaaaatgattcgtgcaaagtaaaacaaaaagttgaaataactccaaatatttaaataaacactggcacatacaatttttctcatggtaataaccctaaatgtgtggcaccatcatccatttaaggaagctgaggactgtttaaaaattgccatcaacatatatcgttatccttatttttctcaaaatgcatgatgaaaaatccacatgtactatttggaagatttatttatagaacacctgcttctgtgaaactgctggataaataaagcatagcagtagtaatagtacaagctataacttatataatactttttatataattatattaaaaattctaaatatctttaatagaatattatcaatgtttattgtttttaaacattttgcattacactgtaaacaatataagggcattgaaaaactttatatttctctatactccttccatacttaacaacaaccaaacacctaccatgagtaaagattcatgcttgatatcgaggatgcctaagagaatagaagacaaaaacacatatttttagaataggcaactgctagatgaagagtaaatagaaattgattaggtgatagatttttctggcatggtacctgcttaggatgagagaaaataaaattaggctgttgttccctttgcagtttccaacaacctgtggaaatacccatctcttgggaaatcatcctgccataacatcgggctggtctggcaaaacttctgtggtattcaatgcaagtgattctttgcctaatttcttcccattactcataatttccctctgcctaaatatcccgggtgcttatcctcttgaatatcattcttaatctctggatgatcatcccccgcactttattttcatttggccatgctcccactatataattattttaatcaggagcaccatcttttttaactgtgatagcaaatgatgccatttccagagtagggtggaaaattaaaattgttagaattgaatttgatttgctttgtgatggtgattcagaggtgacggaggagcaggggagtgtaggctgtgttgggccatgatgaagatcagaggctgcgtgctgccagattggcatcctttccaccctatgaacggttttcatttcagaatggaattgtggaatttgtatcagtttaatgttcagggaatacttgagaattgaatgttgcactttagtgcatataaccatagcactttagtgcatataaccatagcacctgcctagaggcattcaataaatattggtttaaatagattgaaacacagacaattttaaaagcattgacttgacatcagtgttcccccaaaccctggtgtgcctacaagtcatttgaagagtttgctgaaatgttgatttctaagccctatttctagaaactccgatttagtccatgtgacataaggacctggaatccacaatttaaagaattgaacgatgcatcacacatgattctgttgctgctggtatgtggatgtcaactaggcagaatattgggaaatctgacataaatggtgtaagctatattggcctgaacgatgtttgaaagttaagggaattgaggatggaatttttatggattgctctaccttcaatagaggtagtctattcatttctcattaaattcatatttgtttaactgacagatacaaacacaaatatattaataaaatgttcaaaggagtcaataaagatgaacttttccacaataaaaactagatacctattatgggcaaggacacctgaagtccaaattgcttgctcactcctgaaaacaatattaaggttttattgtaagtttattcatgtctatgttacattaattacaagatgctattatactctacccacaccagttcttacatttctttctagaaaataaatgagaagactaacaaatgtaaagaggatgactgtttgattgattttgcctacatgtccaactttctactccattcttaccaaatgagatgtgggacataaaagctttgaattataaaaaatataaaaatacaaagataaagtattattattcattaattacctcctctttgcttaagaaagctgttctatctgggtagagggcaatgaagaaagataaaggttcctatttctgtttcattagtccacttttccacctcgtaaacagtgtaaaaactcaatccaacaaactccatttttcagtaaagcctatcatcagttaatgtccctgacctttatttttcctatttctcttctgtggcattttgtaagtgtttcgtgttgtgtcaggttataaaccatggaaggaaaaaatggaagagcccaaactgcccatttattggaaaacaatcaaataaacccactattgcctttaaatatgctactgctgttgctgcaacagtgttggtgattatgtatgtggaactgtttctcttaggtgtgatgggttttaaaatcctgtctctttagtgaccagatacttagtgaccactggccacattaagaatgggaagtaaggccgggccaaagcgagcagatcacgaggtcaggagatcaagatcatcctggccaatatgtcgaaaccccgtctctactaaaaaaacacaaaaaattagtcagatgtggtggcgcatgcctgtagtcccagctactcgggatgctgaggcaggggaatctcttgaacctgggaggcagtggttgcagtgagccgggattatgccactgcactccagcctgggcaacagagcaagactccatctaaaaaaaaaaaaaagaacgggaaataagaccagtgcctaagtgaatgccatagactcatttaaggtcaagccaagccagtgactttactaaatgcagaacactgagtgcctcttcaatggaagaggcagtgccttgtcatggatcaaagtataagtagtctgtcaaggccaggtttaaatttaacttattttccttatactttgtattaattgtgcaaccctcttgggtttcactctctccagctataaaatggcataataaaactctcttcatgggatattgaaaggactaaataaaagtgcatatctacatcacctcctacaacgaccagcaaataattcatgtttaagaaatgtttaattcctcattgtctcttgtagtatgcacacaaagatttttaattctgtggctgacatactgtttggaaaatgaatgaaatcaaagttcccgtctctggctgcttacaatctaaaaataaataaaaggcacacaaataaagaacagctgaaccgagtagtaagtttatcacaggatcgggaaggaagagattattcattctgagatctggtgtataaaaaaaggggttttaaaatgatgcctacttttaattttctttctgattttcaacttcaccatataaatttgaaaacctccttgcacagagatttccactggctacgtaatagtttctcttgtggtcctgtgactattttatactttctctgttgaaggcacttaaactatatccccattttttttaactctcaataatactgtaattaatcttttttattatgaaatcttaagaaacatctttataagaggaattttaagacttttaataaggccaaatgcctctcgagaaactttgccttaacatttgtatcaagagtgtagcagagtgcatggctaatattttaatgtgatgtaatgagattggtctttgaagcaagggctcagtggtcctagtcttggtagtagatgatttattttgcctaaaacagatgatttccgtggggaaagccatggagaaagaaaaaagtgtggataatctggctaccaagattctctcagaattgaactaagaattagggacagccaagccagccagtatgaatgagacagaagcgagactctgagctccaggacagttttgaatgaccttttagcttaatattgccttggtccctccatcatcccagcatctgaattctcacggtgaccccacactgtgagaccattcccataaactgggcttcaattccttcatctataagaaagggttttgtatagcctgtatttttgctgttgactaattttattagttgttttcggtatgtaactgaagtatttgagctgccaaatattgtcattaaaactgttgaaaaatctagtggcttccccctttgactattttctgaaaacatgtgttccctttttcccagttgaagctgtagacacgtctggttgcttctctcacttcccattctgctctgatgagtttaaagtgtacaattgatttaaccagaaataacttagcagctgatcatatttccaaaaagaaccttctttgcatcccaagaaaaaaaaatgactcagaaaatcactttttaaatttgattttaaattttcaggtgactctactgcgttaaaagctattttagtagagttaggcatggagtgagaaaaggtagagccaggaatttcatttcctctgaatgagccttgctgagatcctgagaataaaaaccacaacactcagaaattaaaatgtcaactttgaatcaatttgctatagcaaagacagttgtacttttgaaaatttaaaatgacaaattgattattagtgtacctataaccctttagctatgaaatggagtgctacatttctttaaaggctgataattagtttatatttcattggatcagacggagaatataatttatggccccttaatttttttcttctttagtatactttaagatggtaaaattgttttctttactatgaacctaaataatgctggtccatgctctttggcacattcctctgcttctgtttccatctttcccgtacctcctgaagtgtggaaagggcaaatcccattaatcagacagaggaagatagtgtaaaccaacactcacctttgcctctgtccagctccctcactacactagatacagggcagatcttacagtactcagaactgaccagcagatttgcaccttgtttatttacaagaattaaatgcggctgggcactgaggcttatgcctgtaatccctacagtttgggaggccgaggcacgtggatcacttgagttcaggagtttgtaaccagcctgaccaacatggtgaaaccccatctctccaaaaatacaaaaactagccaggcgtggtggcactcacatgtaatcccagctacttgggaggctgaggcaggagaatcaattgcttgaacccggacggcggaggttgcagtgagccaagatcatgccactgcactccagcctgggtgacagagtgagactccatctcaaaataaataaataaataaataaataaatacataaataaatattaaaaaaacaaaaaagaaaaaaaattaaatatagggtgtcagaagcagacaaatagacatacaaaaatctcaggagacattaaggtcagcaggttctgaaaacaaaccagcaaatgtattaccctatttattttcacaaatactacttttccccttaataattaagggaaagtatggttttccttcaaagtgttggggattttaaaattcaaaattctgatatatcaggaggaatcctaaacagtactgatttagtttgctagggttgccataacaaaatgccacagattgagtggcttaaagaacaaaattttattctctcacaggtctccaggctagcagtgcacaagcaaggtgctggcagaaatgttttttttccaacacctgtcccctgagtgtgcagatgcctgccttcctgctgagccctcacacagcctttcttctctgcttgcacacccctagtttatcttctgaagatgaggccttataaggacaccagtctcattggatttgggccccacataaacagtcctgttttaccttcattttttaaaagaccttatatcttaatagagacacattctgaggtcttcagggttagacagcaacataagaatttgggaagaacacaattcagttcataacattctgctctttggacccctcaaattgctacacttcttacatgcaaaatacaatcactccatcccaacagctcaaaagtcttaacccatttcagcaccaactctaaggcccaaatctcattaaaatatcatttaaactaagtgtgagatccaaagtatgattcatcctgctgcagaatttttctccagctgtaaacctgggggagcagacaagctatctgcttccaaaatataatggcagacaatcaccagatagacattctcctgccaaaaaggagaaattgagaagaagatggtgtcataggtcccaagcaagaccaaatcctagtatggcaaattttattagattttaaggctccagactaattctttttggcttcatgctcatcctccaggcctgctggtaggtatggtggccttatattcaaggcccactgaagtggcagcattacctcctgagttcctgggtggtagccccatccataggagttgggtaatggcagctgggctgctgagattaagggggtagcctcaacctcagaaaatgaattggaggcagccttgacccctgagcctgtgtcctccaggacagtggccgcagtgacagcccttgcaatctttgagtcacctttgagtccttcttccctttccttgaatgaaaacatgtgcttgcagctagatagctctattttcccatcctgccacatcccagaagtctgacagtcttccttcctattgtcttctctctgtcaccttcagtcaaggatggcagtgtgtctcccatttctctctattcatagcttcctgggaggtggctgattagatccaggagccacatctataatctctttaccaaataattttccagccatacttactgtgttctctccagaacccactttctactttttggcaatatggacaggctgatacttttacaaatcatgaagttcttgtttctttttgcttgacagttgctttaatgtatctcttccaatgacatttttctataaacagtcaaaaaatctaggccatagctttgacagtttgtgtagaattttctttgctaaatattcaagttcatcacatacaatatgcactttccacaaaacactagaatacaattcagcctcttttttttacttttataacaaagatcatgttccttcaatttccagtaacatgctcctcatctctgtctgagacctcaaaaatcgcatttaacattcattgtattcctaccaaaagtctcttcaagacagtgtaagatctttctaacatgtatttcaaaacttgtctagcctttgcatattacccaattccaaagctgctccacatttttaggtatttgttacagctgcaccacacttccctgtatcaaatctggtttcctttgctaggactgccttaacaaaataccatagactgagtgacttgatcagcagtttattctctcacagttcttaaagttagaggtccaggatcaaggtgtcagcagggttggttttactctgaggcttcaattttgacttgcagatggccaccttcttgatatgtccccacagagtgcttcttctgtgtgttcccatgcccagttcatcttccattcttacaaggacacgagccaaattggatttgaacccgcccaaacagcgtcattttagcttaatcacctcttttaagatcttatctttaggccgggtgcagtgtctcatgcctgtaatcccagcactttgggaggctgaggtgggtggatcacaagggcaggagattgaggccatcctggcaaaacatggtgaaatcccatctctgttaaaaatataaaaattagctgagtgtgatggcacgtgcctgtaatcccagctactcgggaggctgagccatgagaatcccttgaacctgggaggtggaggttgcagtgagctgagattgcaccactgccctccagcctggtgacagagggagactccatctcaaataataataataataataataataataataatgatgatacagatcttatctctaattcagaggcattctgaggtgctgcatgttggcacttcaacattttttttgttgttttgttgttttgtttaaccatgtggttgattataaagaatactgcaaaggatacagattaagagatgtgtagggtgaagtacaggtgaaggaccatggaggttccacaccctcgccaggggcatcaccctccaggaacctccacgtattcaggtgtctggaaactggcacttcaacataattgtggtggcaaggcgcacaagtcagcccatagaagataccaagttaaagataaatatacatgtgatcaattaattcaccaatattttctgatagcctatgctcaaatcaccataatagtaatgtgtgtggagatctaaaagtctgaagacacagttgagtccagctttctccctctctccctggccctgcttgaatacattggatggacagctgcatccttatctcttctgtaaagcatttgaccataattccaagcagcatcccacatcacatgcccttaatgtgctctctatcaagaactcacccaaagcccagctcaaaaaagtagtattagtgggagggagggtcatgggaagacaatgctactcatctgttctgaattttagtctttacattaagccagcaattcgaaggcaactcctttactgtggtacattaatccctcagcttcaatccctcagcttttttcaagggaaattcccttagctttttttttttttttttttttaaaggagattccactatatgaatttctctaagaaattcttccccatgaaattcaacgtactgactttttggagggtagtctattgaggacattttccggcaaactgctctgtgttcttctgtacagggtctcacatacacataaatttattttccaactcaatgtttaaaaaatcatttacttctcactgatttgtaaaatctatttctgtgtgtaagaaatgtgtgatgatgatttttttcttttattgccaaaattgaattaaaaatatttccataattttattttttgtttttactaggacagtcttcatttatactttataacagatgcagggattgttatttttttccagctttattgaagaataattgacaaaaattgtatatatatggtatacatgatgttttgatacagttatacattatgagatgattaccacaatgaagttaactaacatatccatgacctcacatagtttccctccctttactccccttccccttccccttcctcttccccttccccttcctccttcccccttcctttcctctcctctcctctcctttcctcttctctcctcttgtttccttcctctctctctcactctttctttttctgtgtgtggtgagaacacttaagatttactcttttggcacatttaaagtatgcagtacagtagtatcaactatagttatcatgccacatattaggtctccagaccttattctgcataactgaaactttgtactcttcgaacgacatgtctctactttccctactccccagcccctggaaactaccattctactctctgcttctgtgaattcaaatttttaggttcctcatgtaagtgagatcataaggtatttgtctttctgtgtttggcttttttcactagcataatgtcctccagattcattcatgtcattggaaatggcaagaattactttttaaaagctgaataacatttcattatgtattgtgtatgtgtgtgggtgcatggtatatatgcgtgtgtgtatatatatatgatatatgatatatatgtatgtgtatatatatgatagttccatttaaattattttgtggaacctccatactgttttctgtaatgacaataccaatttacattcccaccaagagtgtacaagtgttccattttctccatgtcttcaccaatgcttgttaaattttcccttttaattacagccattcagacaggtctgaggtgatagctcatgtagttatggtttgcatttttctgattattagtgatatggtttggctctgtgtccccacccaaattgcatctcaagttgtaatccccgtgtgtcaagagaaggacctggtaagaggtgattggatcatggagggagtttcccctatgctgttgtcaagatagtgagttagttctcacaatatctaatggtttaaaagtgtttggcagttccccccttttgttttctctcccctgtcaccatgtaagatgtgccttgcttcccatttgctttcccctaagattgttagtttcctaagttctccccagccatgaggaactgtgagtcaattaaatctttctttataaattatccagtctcaagtagttttcttatagcagtgtgaaaacagactaatacaattagtgattttgaatagcttttcatatacttgttagccatttgtacgtcttcttcaaaaaaaagtctattcatttcttttaaaatattatttatttatttattgctattgagttgtttcagtttcttatggattttgatgattaaccccttatcagatgtatagtttgcaaacatttcctcccctgtattccataggatattttttcactctcgattgttgattttttttaatttaagcatatttttattttgatacagtccctctggtttatttttacttttgttgtctgtgcttttggggtcatgctaaaaaaatgttgttcagactaacatcatgaagattttatccagtgttttcttctgttatttttacaggtacaggtcttttgtttaaatttttaatcaatttttagttgatttttacatattgcatgagataagggtccagttttatttttctgcatgtggatacacagttttctcaaacatctttattgaaaagactgacctttcaccatgttttgtcctttgtactcttgccaaaggtagttgactctaagtgcctggattcattttgaggttatttattctgtcctgttggcctatatgtctgcttttatgatagtaccatattattatgactactgtagctttatatttgaaataaggaagtgtgatgtctccagttttattcttgttgaggattgatttgactattcagggtcttttgtggttccttataaattgtagaatcattttttccttttttgtgtgaaaaataccattaaaattatgataatgattgcattgaactttgggtagtatggtcattttagcaatattaactcattgaatccatgaaatggcctatttctctatttatttgtgtctttcaccatttcgtttatcaatgttttatagtattcagtgtacaggtcttacgcttccatggttacatttatttctaagtaaattcattcatttttgttgctattgtaatgagattgtcttatttatttttcagacaattcattgttcgtatatagaagcactactaaattgtaaatgttgatttcattttctgcaactttaccgaattcatctattctaacagtttttggcatcatctttagggttttctatgtataagattatgtcatctgcagagacaattttacttattttttccattttggatgtttttatttctttctttattttatataattgctctggccaggactttaagtactatgttgaatagaagtggtcagaatgggcatcctttccttgttcctaatcttagaggaaaatctttcaactttaaagattgagtatgacgttagctgtaggttagtcatatatgacctttattgtattgaggtacattccttctacttaatttgtggagagtctttatcatgaagcaatgttgaattttgcaaatatttttttctgcatatatttagatgataaaaaggttttcattcttattctgctaatgtggtgtatcacatttattgatttgtatatgttgaacaatccttttatctcacttgatcatggtgtgtaattctcttgatgtgcttttgaatttcatttactagtattctatcgaggattcttttacatctgtgttcatcagcgatgttggctgcaattttctttgcccttgtctggctttgatattagggcaatgctggccttttaaaatgagttaagaaatgctccttgctcttcaatttacggaagtaagagtttgagaaggattgacactagttctttaaatattgcttagaattcaccagtgaagccacatgatgctaggcttttctttattgggtggtttttgattactgatgcaatattcatactcattattgatctgttcagatttattgatcatgttctcattgaaaaccccctgaaatcaaagaaatgaacagacacaagtaatgttgttctttatttcaatgaatgtaaaatatctttaaatattttaatacatatgcattattttaatgtaatacatatacattattttcaaaaaagcctgaagtaatagttattcatagctgatttgatcaaaaatgcttcatgggagaggtaatatttgtaataaatatggaatgaggcatggaaaaattggcttaaaacctttaataaaattctgaggattttttgcctttttctgaatgacactattctaaaatctggcaactccacaaataagatttgaatgagtcttcataatccaatttgtaaactaaactcaattctaatttataatcaaatatataagctagactattttctattatctgatgtgaatttccaaatgtgaatttccaaatatgcttaaagtcttataaaggccctctcactttgttggctggtatgcagagagagacagtattttaggctctcaggatgtaatcaacaagggcctttcatggaattataatccaagaactactggaccttaccaggccttttagtatcccacctgagaagtcatgtaatgtcacatcaatcctgatctactggctgcaggagtcagcccactcagattcaagaggagacacaaaccttatctcccaatgagaggaatatcagagaatttcaggacctcctttgaaatgattccatgtatatgcatttcttagttgagaactctaatcttcaaatatttttattaatgtaatacaatgaaatacttgtaataatgtctaatttttgcaaaaaagtagttattgttcataagaaaatattaatagaataataatgaattttttattattgttttctttgttaggcatcattctttatccttgtcatatgttcaataaacaattctgagcaatttttctgactaggtaaaaagcattaatttcagatgcaatgaattataagaagtttatatgtgtaaatacagtcaaacgctaattttgttttacatttttgatatctctgaaattgaaatgaatcttagaatcaatggggtaagattgttgaactggcagcagttttccttcttagcaatacaaaaataatggtacgaccaattatcaatgatgacctattttatcatctttgatgaaatatgatagttgttactcaaagttctggagtaaccagatactcaagataaaataaccacaccctctattttgagatattttctctataaccagaaatgagtcctaaatcttagatactgcttgaattacactatccaaaaaacctgttcacattcatttttttataatgtgcttatttttctaatttgattctagacttctaagagagcagccaacaatgcattaactatttctgtcagctgaaaggccctttaattgacttgttcgtattgactgagatcctagaaggcagcctctgttaatggtgtatcctgatgagagacaaggaataggtttgctagcatcagacttgagtgctaatgtagtatatcatgttatttccaatcacttagctttttctcgtgatagcaacaaaatgacttcttgaaaaatgaagacttgcaccatgttatctgaaaaaatgcatagctgtctttgaccaatatagctacaagtttttcaataaaaatcctgtcttaaatcttaggtaaaaaatgtgtctttagggaaactgtattgcagttattattaagagtgtttgtatcagtacatcttttaatgagaatggtgtttcgtgtagtatacaggtgtgcgcgtgtgtgtgtggacatgtgtacagatatatatatatatatatctgcaaacagatatgtatttattcattcaattattatttaaagaattactgaacttataaaatatgctggcatgtaatgactaccaatcatccctgcccttaagtagattacagtcaacctctcataaattcaattcttcttctctaccttttatgatgtggaaacatagcaactagtatgttgtaagtcttgtgtaaacactagccaatgttttcagtatttttatttagaaaataactttattttgatttcatctgttttttgttttgattttatctagttttataagacacaaagtatatttttaaatggtacatttttgcccagaaaccaaaattgccaatttcatatattttatgattgtagaatatctttcagaataattaaatgacctttgtggggtattatggaatagaaaatcctcaaaggcaagaaatccatagccttattttattttttgttatataccctgtaaataatcataaacaggagagtggttaatattcttcagatatggggctgtgaaataggagatacaggcatgaaatcctatttttattactatcgttatgctgatgatcctctggccacttctttctagtctgtgtaattgcaaagttcttcatattttattcattagaagagctgctctgtgcccattcttcttatgttgctgcctcgtgccgtttccagcacttcctaatgggtgtgatcgctgggctccatcaactttctgtctatgccttgctcagacctctaatgaatattagacttgcagccatcagtcatgtttcaagtgcagacatacatgaatagagaatttttgtttgttcattagcattgtgaaaagcaaactcattttgtctccttcctgttctctttgatgtatttgcccacctactataatgaatttgaagggaaacttgatgcatgtaggtatttatttaaaaggttcttgctggctcttttctcaccttttttcacttcttttttttttcttttaccgtaagcagataatgcttattaaccatcaacaataaaatactgtagataggattgtgataaattcttgtcgaatcgattgtgctaaggcgtttaaaaaggttgcctttcaggaggggatcaaaggaaggaatatggggagatcagagggaacaagaaaggtaaaaataatttggggagaggaggaggagaaagggagcaagaaagaaagaaaggaaggagggagagagagacaaatgcagagacagagagaaaaaggagaaccaggaaagaaagaaaaaagaaataagaaagagcaaagggcaatcttgggtaagaaaaatcatataggtgtttatgtgtaagaatgtgtgtatgggtgtgcatgtatttgtgtgtgtatgtgtatatgagtgtgtgtttctgggtgtatgagtgtgagtgtgtttatgagtgtatgtgtgagtgtgcatgtatgagggtgtatatgagtgtaagtgtgtgtatgagtgtgagtgtatgtgtgtgtgtgtacatgtgtgttgaaaggaatgcaatacttaattgggtaagacaattcaagagtttattatataaacacagcataccctccttccatttaggtctctttgttcatcatttgggtgaaaatttattcttttactcggagcaagtttagtttttcatcttagtatattttacttagacaaagaaatttttaaaaatgtattacaatgcaaaatagcagcttgtcagggatcagtgttatagcttttttgagtgcactgctggaaatctgattcttttttgttttataatgagtgagctcaagataaaatgttgatagagactagataattttgaagagaaaatacataattgagtctcagttgctcaacttattttattccatacttcttgtttcttttcagcaaccaggttctcttagaaaattttaatggatcaataaaattctgtcatattcctatggtatgaatatttttattcctccaaaattcatacattgaaacgtaatcaccagtgtgatggcataagaaggtggagcctttggtgagggatcagaccatgaggataaagttctcacgcataggattaatgcccttagaaaacaggcccaagggagaccctaagcccttctacctcgcaaggacacatcaacaaggcagtttccctgatccagaaagtgagctcccggtagacatgggaattgccttcattttggacttcccagcatccagaattgtaagacatcaatttctgttgtttataagctatccagtttatggaattttgttatagccggccaaatagaccaaaatgcataccaaatttatttttcataagaaaaatgcactgaatttcacattttcaactaaagagtacttatttcaaactttaatttatagtaaatgtgtattaattagttgatgaagctatagaaaataccgagttccttacataagagttctcaccctttgtgacatgttttcaaacacaaaaattccataaaatatgccatcaccatgagggatttccactttgattaaaagactcagaatataaacaacagtggattagttgttgtcttgataaatgaaacagtgacttggaggtgggtctattcacatgaataattgcaatggcattttgattagcaatgcaacatttactccctgttcactttatttaacacaaaattattgatttattgaacaccttatttaagaaaagattaggagcttttgggggaaatgttaatacctccatgtgtatattctaaacacacacacacacacatagcacagtaggtaataaatattcttcaaactttgtaaagaagtatctggaaaatggaatattatacatataattagtcttgatattgtataaagaaattgcaatttgttaaggaatttaagagaaatagcccgatataagatagtatgcagtcagtcaataattttcattttttttcaaagtgctatacaattgagaagaggaaatgctttcaaataaaattgttagagaagacttcttatgggaaaaagcatttaaaaagggctttgaaaaagaagggaagtagaatttacatatgtcaaaatgtggaagggtggaagtcaactattcctgcaggaaagaattatgttagcagaaattcaaactaaacgaacaagattttttttttaataaaaaagagtaacaacccaatttgattgaggaagaacatctgtctaggaaagtagaccaatatgaaaagtagcttgggggctagggagtagaggtattgaagagcagattgctagttttttgtttctttaaattcatttgcaaatgagatactattgaatgttttgctggcagaaagcattgtaatcgaatagttagtttaagaaaactagttgagtgcatgtgtgcagagtagattgcagtgatgtgcaggcaggacacagtgagcccacactgcagatttggaaagaaatctgcaaagaaagctttgatgggggagagtgttaatacgacatgcacaggctttgctgtcttgatagttaagagactagtgtttgttgaatagagtattaaacttctcaacctaaggctgcaaaaaatgggaaaacatgtgtgaagcctgagtaggaagaaggacacaccacatagcaatgtgctactcgtttgaggtactcatggagcagctctccatcaaacagctcagaaaagcatgcagagctggagaaccaagactttttaggcatttgtgtataagcaatagataaaatatctatgacaaaggacagagaaaaacaccccacatctccaaagtcctggtctgctgaagggtggtgggatgggaggaaggctggtaaaccccgctacatggagacacaaatgaacacagagagagagagagagaatgaagagaggaaaaatgttatcatcttcccatggaaacaaatgaaaagtgagcatgagagaacgtttgacacaggaattgggacctagtgactttgtgtgtgtgtgtgaagcagggtaaacaaaaatcacaagaaatctaactgaacctcactgatattttcaaatgatggaacagagtttgctgcagaaatgaagcaaaagggaatgggaatgggggctagcgaagaaagagtaactgtgggagatgttcttttgggactcttgtagcaaatttgtgagaaaagtagcatcatcacatgcacactagatttatagttgaccaagacaaaagcaaagcaactgcctgtttttaattctaataagaataaccagaaatttggtgaccttctctcatttccaagttaacctttattttttctctgtattttatttgtctccacttatcatcctacctttctttagatggatctgctgtaacctaacgcatgcgatttggtaagagtaaaacctaaaactaagtagctcattagtgtttagcaatccgtggtgtcatcgaacaagaattcctcataaaagagaggggatagaggcctgaaaattttaaataaagttcaaaccttgtaattagtgattctaaaatttaggtgtgtaaacttgagtaaagttttagtgtcacctgataagtgtgaagtaaatgaagaatcttgggctgtactctccaagtgtctgggaagttttcaaaaacccatatcctgggtaaaatgcattaatgtatggctgtgtgatatccattttaatgttgttgacagctttgggcagagaattctagctttcccctctctatatatgtaccccctttcctccacaataattaatttttagttgaatcaatgactgcccatccaaaaaacaaacaaacaaacaaataaaacatgtccgtaagacatcccagatcattctgattcaagtggccagaggctatactttgagagatgctgatataagacttctaaggaaaaatttcagctgattcccagttacatgattagcctatcactcctaggtagctactgagaaaaaatatagaggtttaggccaattagacttcatagaaaccatgatacttattagaacaattatttctacaagacttttttttttttgcttttctgttaatttgttttttagataaatcaatagatagactaatacagttggaaagacaatatatttgggaatatccccaagagggttgaggatacatactcaataatgatctgtagttttaccaatgtaatgattatttgatttatactattttaatattgattcaagaacaagtgctgtgaaaatatatagtactcttttattcccttctctaataggaccaggtttcacataatatgtaaaaatattgggatttggagccataagatctaaattcaagatcctttttattttctgtgtgattttggggaatttgctaatccattgttagctaccattttttatctgtaagatgagaatgagtatcttcacagctttgttgagagggttgaatgagttatgtgatgtgaacctcgtttcgaatgttagtgttacggatatccaactttcctcactggtttgtaaactgaaatggcaggtgtattcataaaataaatgactttatgctgggcacggtggctcacgcctgtaatcacagcactttgggaggctgaggcgggcagatcacctgaggtcaggagttcgataccaccctggccaacatggtgaaactctgtctctacaaaaatacaaaaattagctgggcatgatgacgggtgcctgtaatcccagctattcgagagactgaggtgggagaatcactagaaccagggaggtggaggttgcagtgagcagagatcacgccattgcactccagactgtgcaacagagaaagactctgtctaaacaaaaggaaacaaaacaaaacaaaacaaaaaatgactttagatttttcccctgacactgtactctccactaaatagccatttttcttccttttgctttccacatattgcttaatattgtacgtcaaatttatttcattctaaattgaattaaaaataatgtttaacattttctttcccttatcctttcattgtgaagaacttgatggcaggattcataagtgttttgccttttatactaaccaggttcaatcagacaagagtcttgaccattgcagatgttttatatcggtttgtttaatccatgaatgaactgatatgtgaaaaccttactgtatggtggtctcattctatgccacacttataggaagcatttattcaaaggcttaatagatgtctctttttggagatgtgactaaaatggaaaaaaagcacttgatttcttcaatgataacctaaaatggcaaagatgaatgcacctatatagaagctaaaggcatcataatcatatatatttctgcaaaacacattttttaatgtcatctatagaaaatctttctgggttgtttcttttttttggcatttggtcatttgttcattcagcaaatatgtagttagttcttagtgcaagcaaggcaccattctctatgttggatatacagtcatgaacaagccataaaatgcccttttcctaattccaatggggaatacattatacaaacaaagaaaaataaacaaaaataatgatttcaggttgtagtcagtactcttaagaacaataggctgggagcagtggctcacacctgtaatctcagtactttgggaggctgaggcaggtagatcatgaggtcaggagtttgagaccagcctgaccaacatagagaaaccctatctcttctaaaaatacaaaaattagccagacgtgattgtatgctcttgtaatcccaactactcaggaggctgaggcaggagaattgcttgaacctgggaggcggaggttgcagtgagctgagatcacaataatgcactccagcctgggcgacagagcgagactccatctcaaaaaaaaaaaaaaaattgggaacgatagcgtgatgttggagtgctttggatagggttaactggaaataattaaatggttaatttcaggacccagtgaaagacatcagcctctatgaagacccatgggaggacgggttcaggcagagagcagcaagcatcaaagagcatgtgcgagggctggcaaggaggccagtacagctggagggcagggcacaggctggattgtggaataagacgtaaggctgagaaatctgcaggaccacatgcacagggtttcatgggccatggcgagaaggtgggatttgtttcttgttgcaatagggaactattgggaaatttcaatcagaggtaaatcaagtgatccttactttaaaagtcccttttggatgctacaaaaataacttttggaggatggaacaaaaatggaggcaagcattttacttttgagtctattgtaattacccacggaagagatcgttatggctgtggctagggtctgtcgtcgactagctgagttactagcaggtaattttacctctatctatgcctttgttttctcatctgcaaaggggaaataaaggtatttacctcatagtgttgttgtggagagtaaataagctagaacattaaaaaaaagcatgaatctgcttggaatattttaaatgctcaattaattctggatgtttttattagtatcatgagtctaaatatacacaatggctttagtagccagatttattgcaattcttagtttctagattgtgtgtacatatcagatattttacttttccaactctgcttttcattcattattttttttactgtgtgaatcggtataagttaaactatgctgaggtcatgaacatgccccacactaaatctctgaggcttaacacaatagaggtttctttattacatcacagcttgatgaagagttgagagtcctccctctttcttttcactctgcatttgaaaactaatgcttttgtcgtatcagggaaattgtgtagtaaactgaagatcttactccaatgctgagttgttcctttattgttatcagttcctaaagatttataagagtgtctcaaaatgttcatttttatctgtaagtctcgtgttatttcatgatgtttccagcacattggaaagtatcaaggtctgccgggcaaggtggctcacacctgtaatctcagcactttgggaggttgaggcaggcagatcaactgaggtcaggagttcaagaccaggctggccaacatggtgaaaccccgtcctactaaaaataaaaaattagccgggtgtggcggcacacgcctgtagtcccagctactctagaggctgtggcaggagaatcccttgaacctggcaggcagaggttgcagtgagccgagattatgccactgtactctagcctgggagacagagtgagactccatcaaaaaaaaaaaaagaaagaaagaaagaaaaaagaaagtatcaaggtctgggagtctttgtgaaggtggatgttcaggacaggagctatgcaggttctcagatgtctggagcctgtagcccacattttgctcagtcatcgtgttactctgtcatttaaccttactgggatccttcaatgaggcacttagcaaaaaattgtacaataaacaaaagtatttttatattctcctacaaaaactcacacaatgcccaaagaatcatttaagttaatcacgttgtccatctctttgtctaaccatgaaggatccccatagtccattctagagagctttgcctagtccagcttgaaatgatcccatcaaaatgacttttatcatttgttttgagaggcggtaccattaatcttttctgtttccccctctctctttctggctcacttcaattcaacaggcagggagaagagaacattgaacaacattataaaaatgttaattcctaatgtcacggactagcccttaatcacactattagacatatgttctgaattaacgatcttgaccagcaagcaggaagacgaagattgactttgatgagtgcctgccattattttcaaagatggatgaagttgtttttctttctgactaaatgttttctcagaaacggtattctatttagaaagaaagagcatataaaacactttcttttgttggcagagtcttcttttctaaatcagcattttgatggtgtgtgttttgttcatatagtgagacatgtgctgcaatcactggtaatctcttggccttataactttggtggcctcgttctctagatttattttttaagcccccagcgcttaactgcaagcaatgaaataaagcatgtttagtatgtacagaaatctcattatcccaaacagtcatttcctaaagacgactgcggtgaaaatcagatctccttttctttgtgatctttacctgcacaaattctttctccacggcacactttgtcgaagtcctcctcaacaccaagtctctgagcctctgctcaaatgccatcatttgcataaaactgttcccacgacccctggtgagaagtcatattttcttactctgggcttttctagaattttattaactgctctctttggcactgatctcactctgacttccattactcttagctgtgtgcgggacctccttcctataaatgttatgagctcttttagggtagcaaaagttcattaaagtttatatcactcacgtattacaccatgacctttcacaggatacagttaaaccattgaatataatatatgcaattcacatcattacatttaattatataattttatgaattatatatttaatttatatataaattagtaattttatacaatatgaatataatatttaatttacatataattatatatgtgtgtatacacatgcacatacacacacacaaaacttgcaactttgcatcattctatgggcagaggctatgagaaaactgtacaagatctggtttcattaggttacagttaagtgaccagttgtgagaatagtttcttcaaagttctatgaagagtttttaactgaatgcatgggtaagtggcatcgagacttaaaaagatgaggcaggaccattactatcatggaaaactgctatctgcattgcagtgacagccaagcaccgtgtttgaaggggacaaaggcatggaagtcaggttacactgccaatcattggggctgggttggcacagactccaggtgaacccagattgggtttatataaatcacatgtgggacggaagaagggcagatgggaaagacactagcggtttctaaccatattgcaaacaccttgaaattagagccatcattgatctttctatgtacttctttataacccctacagaatttattttcacgtgatttatacctaatttgtattttatcagttattattgcaaaaatgctatataaccagttgccaaagctcagtgacatacaacatgcagtccttattctcacactcactcatctgtgcatccactgggtaactgtgcttcctgagttacattctggggccgtggctggagaggtcatgacctgctggggcatgttcccagggtcatgtcaaggaagctctggaagggcaggtggaaacatgcatgcctcttgaggtctacactggaactgaaccatcatcatttctgcacacattccatggagctacacaagtagcaaggccaagcctcacatcaagtggggcagtgggtttactccacccctaaacccactgccacatgtatttgctcatcagtgcagcaaatttcttttactcctgcaacttcaaacattgtatgaataaaagaaatgagaactaaaactcttcttgttggcatactgagtttgccagaatctaaggctatgagaatacattacatctaaacttagaaaaatgtaaagagaaacaataaccacaaaggcaacaacagctcaacagagcacagtctgtatacatctatggaactttctagctccattctgatattgtctggaattttgcttggactgttcatagcaacgggaagaggccagattctcttggccgtagctgcagttatcaccaggaagctgttgtgtttactgtttcccagttgtcaaaactttaattgaaacaattgcaagattacagagagatctccagtttgaattatgttcaacagctcccaatgattaagccatacaattgtgcaactaacctgtttgaattctcttcaatttcttacaatataaaaatcatcatttgaactaatcatgtacaaattagatttgtgtttaggtcttctataaaacatatatattttctctgtctttgaaccatttctctgcatataatatatacatattctacttgaggaaactttatggtcaggatagtgtggttattcactcattagcaaaatccctagacttgatctgctggaatgatttaaattcaagtataggagtctatataggctgaaatctctgatttaacaaatgaagatgcaatattgtttcccgcttttacttcctctccctcctcctccttattctctctctttctttctctcacacatacattccctccccaaacttacactctctttataagacattctagaatatgcaactttattttttatttctgtctttttgtggctcaattgagataattcttttccaagtttatgatgcattatcctgtttaggataattagaaaaatagaaacctgcagctggcaatctaaattggaggtaaaacacacctagaaatttctgcagtggagaaacagtgaagatatttggactttacatctacactgattaagaggggaagaggctcactgtgttgaaatgactgggggaagttcactggcaaggagttttataggcagacctaagacaacatacccttatgcagtctgctctgccaaatgggttaaatagtagttttgcaaacttttttcttttaatttgtttgtcaaatactctgctttaaaattggggaagaatttaggtccattaaaacactttgagtaaaaactcagaaagacactgaacatttgaaaagaagacagctacagggcttaaactgtgcctctcagtttgcatgttgtctgcaacaaagcaaaacacactcatggttatccccttgaaacttggggtagggagatcctgagaaggttccagcactcaatgctgacattgcgttgtgctatagtattattattgtgtggcagtgtgtaagatcaccttctgtgatcacttactgtgtacactctaaaacaaatactttcttaggaggatttatagatatagatatatattaaacatattacacgcacagacacacacacacacacacacacacacatatatatatatatgtaatttgagttttcccataccttgtttatatgcatgaggtcatatgacaataatatttgcatggaagtaatgtaaactcatgcaattcctcagtcgtattttttttataccctgcttacagaggaccttgacaactccctaagagctttgtggctgctactgggagttcctggaggagtctcccatcaggtcccagtcctcttgttttcttaatcttggctgttttgtggaagtccttgcgttgcatggctgctgaggctgtgtatgaaaactctggtttcctagccaaggagctggcctcacaaatccccagagccccaggccccggaagcacagtgcataacgcagacctctaccgcggagagatatatatgtcacatgcaggcagctgggggatagacagagtttttccccatttgcttcttgtcaaagtgaagtgccttcctggttttcaaagcaaaattgtggaacctccttaagccctgctcaccagatttcatagagttctttgtttatcagaagcatcaaaacaggtttatatttggtttaataaccccatttggtggaagaaatagagatttcagagatttaaaatattgatccattaagagatactaagtttctgcttagcttttgaataactcttctgtattaggggaaaatgtgttgtgagtcccgcctccacagcaaagaagtcagaatttaaatcccgaatctcgtttctagctgggacccaagtatgcaacttgtgctttacccatcagcccctcctgtgagatgctctgatgggaagatagccccaggaagcaggctctatgtgaaccttcttttttgcagacacagggtctgcagaaactcatctttggggagacaggggttgcagctcaagatacttgcagggaggtcatggtggtgcagacagcatgtcgactgaatccgtctctaggcgttcagcattcgggggcagccagctgggcagggttttatatttatgattctgtggtagtccagcatcttcataataatacattttggcttggaacaggcagagtgaattcttagcttctattcaagaacctgatcaattaagttctattttatctgttttatgctacccattttttttcctgttaaaccttcctattggaacatttgcaacattttgcaaagtgcagtttaaaaacctagccatagattctaaaaaaatgccctgatttgttctttatgttgttcatttactttgtctgcaatgagcttttccagatggccacaggtgacttatccgtggcctatgagttttgttcaggatgtcttttcatcaaagtctttcctgattggtatggtttaaaattgtaacacacccttcttcatagcacacttgctgtccttagcctgttttatattttccatatatgatagggtttggctgtgtccccacccaaatctcatcctgaattgtagctcccatgattcccatgtgttgtgggagggaccaggtgggagataattgaatcatgggtgcaatttgccccattctgttctcgtggtagtgaataagtcttacaagatctgatgattttataaggggtttaccctttcacttggcactcagttctctcttatccatgtaagacatgtcttttgccttccaccatgacggtgaggcctctccagtcagatggaattgtgagtccattaatcctctttttctttataaattacccagtcttaggtgtgtttttatcagcagcatgaaaatgcactaatacaacatacctcttatccctttctaaatactaaattatataagcatttttattgtcatttcctattaattaccatgtaacgagcaggagggcatgttttgtttgtttctttattttggtatgttttcttacgtgatttattccaagtgcctagaaacttgtctgaaatagtatgaatccttagtaaatatttgttgaatgaattcatagtttgtaaataaaatatttgtaatcatgctttgttccttcacttttgaaagaaactcctgtcaggaaagaaaaagttcaatttctgcaatggccaaaatttacagcctaggttgtgttttttcttcctgactacatggttagcatcaagacttgaggcgagtcaaacccctgtttgatcctcagtatcttcatttgctataatctctccagtactgcacagagaccaagacacaaagatgggacatctaaagggaaaatctagcaataatcctccggttttcatatatagatacataattttttgttctctctctttttcttcttgcttgttgagagtcatttggttaaaacgtgtttcaacttttaaacttctcaacctttaagccagacattaggagggaggcactaagaggccaaagcggtgcaagatgttgatggattcaaaacggaattaagagttgggctgctaatggaacttctagggagtaaaaacaccaaataagaattggtaaatctactagaagcaacacatccaccagaagttgcacacaaactggctgttcagagcttataccattagtaacaatgcaattaatgtgcttatagcctttcgggtagttcataaacaaagtatctcttgctcattggatttgactgtgtagtctggattctagagtctgagagtagaggcctgggctgttgaaaggagggagagtttgagagatttctttccattcttgggcccaaggacaacactgacaaatgtattcaaatacaaaatgcttcaccctcatgctggctggactcatgctgtgatgacccacctaagcttactccattcctgaatgtgctccatgctccaaataagcctgccagtcctctaggccaggtgtgcttggctcacccgagcagggatttaggaagaaaacaattcatgtgtagtattttacagtgatttacagttatttgaaactaaagaaaatgaattcatattgtttataactattctttaaaagaacacactggttaacagacatctccaattgaaactctagctttaaagatgacataggaattgaacttactttaggcagagtgtggactgccatgttgggatgactgtagtcctccaggccctctgcttcatgaatcagcacccctaaaatgctgatgattttcaaagtaccttctgtatgtttttctcatgaccttcagattaatgaaagctttaggttgcctggtctcttcctacttacctcagtggctttcatggggatgatagcctggaggcaagtaagagaaagttgttgctctttgtatatagagattaattgtgatttttatgtttgtacataagaatatgcatgtaaactagaatcttgattaggcaaaatttcaaccttgtaacatcctcagacaattgctattattcactgtaaaattgcaaatgatataaagtggcccttaataaatatttctttcattttttaaataagcacatgttaagcacctgttgtatatcaatcacaaataagacaattaccaaagggagcccaggcctcacatccttcagcctaatgatgtataacactttcatctgcctgtcttgttttggatgcagtatcactttaagaatgataattctaagctactgaaatattctcaatcataaaaaatccaacagatttcactaaactacattttgtaaagaaaaaaattgagaaggacaagactcaaaaatggtttccagttagctataaagactggaaatcacaggttgcataccacctttatgtgggttaaatataaccttcacaagggtttgtttggtccacatattatcagctttaacagtgcttttattttttttcccccaaatctttgagcttagaactaatgatgtctttttaaaaaacaaaatcagaggatatggcaactgcagggctactattatcctgagagaaatcaatgggaggccatcagaaccagccctcttacacagccaacctcttcttcacctgagtctttaacttcctcattgtctacccagaactgaggacagaggtcaggctaatcttggccctagtgctctcattttctctttggtagttttaaaagaaagttattattttttgaaattcatatattaaaatattttggtctaaattctgacctaacttactcaatcgtgcctgatctggtaagaattcaagtttacgacactgcctctcagcattgccattcatcaatatttgactatacaaacattttgatgaaaatgtcgtttatatgtgtacatatatgggcacatatagatgtagaaatacaaatttaaatatatagaaagagtgagaaagagagacagagatggaaaaagaaggaacaaaaaaatgagataacgaaacaaagaaatgaagaaagcaagcaaagggaaggggggatgtgagggagggaagaagacaggaagggaaggagattatctatatacatctattctccaagatattttcagctcagtttctgtgccatcccctgtgttacttcaggcttgccctaccctgactggtggaatatcttgtcttccagatggaacaccatttacctggtggattgggcggtccaatgaaaggcacccttactggggaggttcccctcctggggtccagcagtgtgagtgtggcctagacgagagctgcctggacattcagcacttttgcaattgcgacgctgacaaggatgaatggtaatgagaatctccatctttctgcaattgtagagaaagcacattaattgatgcataaaattccccaagacagaaggacatggatgagaaattcaatacaaactggagctcccccgatggtgacttttgttttttaaccttaaaaatggtaaattctagtgttttcagtatgacaacttatgtttggtacatataagcatgtggtcataccatcagctgctgcttcttcttttttttttttttttttttttttgagacagagtctcactctgtcaccaggctggagtgcagtgtcgcgatcttggctcactgcaacctccgcctgccaggttcaagcaattttcctgcctcagcctcctgagtagctgggagcaaaagcacatgccaccactcctaactcttctttttttttttttttttttttttttttttagttgagacaagagtttcaccatgttggccaggatggtcttgatatcttgacctcgtgatccacctgcctcggcttcccaaagtgctgggattacaggcatgagccaccgcacttggcccccaccagcttcttatattcagaacttcccatttcaaacaaggaatggcatgcaatattgagctttgcgattgagtcagggtatttatgatatgtggactatatgttttggggggagagagtgagagagatagggatgtggggttatataggctgtttcttcatgctcccattgatgtttcagtcaccagccttcccttttgctaccaataaacacatagcaaaggaaatgtatatttattaagcatctattaaatttcatataattatcttacttttgcttcttaatgttgagtagtatctattgcagagatgttaaataattttcccagtgtcaaacatgtctgtcaagtgatagatacagaatcagaaatcagccatttctgcagccagagtttcttagtctcctacaccaacttacttctgtaaaatcaatttagtttgaagcttccatgcccattacatttactcttcttttatcctccaggtgaactgctagttttttactgtattgattgtgaaaatatgtacagatcatttccaaatatacttttgttttgactgaatttaaagcattctttggttttggcttagcaattttgcttacttcatcaaatgctacttaattttaattaaaaattcttatgttaagctagtctcaatccccaaatttccctttagtgtttttactcactcctcaaactgttaacagcaaggactatttcacataaaatataaagttaagtcaaaatctcagttcagcaaggaaaggaccaggcatctgtcttcattgggtcctaggagatgtgtattatcacttcagaacaccctagggctgcttgggcaccagggcaggttacccgagtgccttctcctaaactcaagctggccgaagttatagggtaatgaattttgcctcttcatgtgggtaaaatcagatatagttaaccacaggtagaatgggcttctgcattctgtgagcccccactttatcctgcagcgaattctatctcattattgcggatgcctacaaaccaactatgatttgtagcctgggtggaggccatgtctctttaaacattatacctctcaagacctacagaagacattcagtggtaattagttgaacagattaatttagacaatctttaaagaagagaattatcgcaagatggcacctatgagcttgggaggtgtgttgaagtgttagatggttgtgctgccgtaaaacatattcaaacatctgctcccaatcgcttggattcactcattcctttgatttataggtttactctcacagtgcatattagacactatgtgtatagtcaaagaaacagatataggagctagaataggtagaagtgcttccccctagttactcttgactctgacccctcccctcccctccctcctccttccctctctccgtccttccctctctcccttccttccttccttccttccttctttccttccttcctttctctctctctctttctttcttccttagacggagtcttgctctgtcgcccaggctggggtgcaatgatgcaatctctgctcactgcaacctctgcttccagggttcaagcgattctcctgcctcaggctcctgagtagctggtattacagggcacaccaccacgcctagctaaggtttagtacagacggggtttctccatattggtcaggctggtctcgagctcctgacctcatgattctcctgcctcgacctcccaaagtgctgggattacaggcgtgagccaacgctcccggcagactctgagtcctttcttagctgccttcttgatctttgctcactgtttcttttcctttacccctttctttataggacatttgcctactgaacactacctcagtgtctcctcttacttgggaacaactgacccaggcttaaattactgcacactgaggggcagggaaaagcgtggccttatatcccttaattgggctgaagggctctgtgtctcctttcctaaaactttccactgatctcttccattccgctcccagcctctccctcctttgacttgctcaatgtttcactctgaacccctcatctgataatttcacttcatcatctagagtgagcccagagggattcttcataatgtcttctctcaccttgatcattccagaagttattacatatttcatgaccctttccatttcctttagagccagggactattttccatccagtgccattttctgtggcaagagacctcgctcagggcaccagaatttattattagataaggtcctgttcaacaatcagcctatcaaaggtcaagagaaaaggactgaacttcccctcttaaggatgcctgactcactcctggatgtcccatagcagcacgttgaccatctttgggcaaagtctaggtgagaacagatcagaaagtttcttctgtcattctcaagagggagtagagactgatattctgattcaacacttctgagcttcattcattgtcttagtgcaagtcatagcttgtgataaagggtttttataaatactttattatagaagcatttatatgtattactttatcagatatttactgatttatcacttacttagtgcctactgtgtgccagacggatagtctgctgtgcagagaaagtcaggggcattacggtccctgcccttgaggaaccctcagaacactggaaagaaaatgctatttagttattaggtgggtacaaaagtaatggtggtttttgtcatttaaaagtagtggcaaggtcggacatagtggctcacacctgtaatcccagcactttgggaggccgaggtgggcggatcacgaggtcaggagctcgagaccaacctggccaacacggtgaaaccccatctctactaaaaatacaaaaattagctgggcatggtggtgcgtgcctgtagtttcagctactcaggaggctgaggcagaagaatcacttgaacccagaaggtggaggttgcagtgagccgagatcgcgccactgcactccagcctagtgacagattgagactccatctcaaaaaaaaaaaaaaaaaaaaaaagtagtggcaaaaactgccatgagttttgcaccaacctaatagaaatacatgggtttaaaaaatctggcgagagaaataagcacagatgtgcctgaacctggggtagaaatgagctgggaaatttagattgtgaagagaagcagcagttacgttttgaaggagcagaagcagctagttaaataaataaacaaactggtgtactacaagtaggggttgggggtagggggaacatctgtgtgcagtggggaaatttaaaataatataaaaatcaccggcctcttaaaccacaaatatattggtgtggttgttgcacagtcgtcatttgagaaatgtacagaagataaaggaaaggaggaaggtcaaattcaggttatgaagctccttgtatggaaataacagtgagctagctttgtctgtacaaggattatgggcatacaataagtattcacacatgacaccaggcatatctttgtgaaaatgcatttattatttatctatcaaactctactatttactgcagaaaggaaaaatacaaaagctaacacacttgtgaaatagttaatcaagttcaacatacatgcaacttatttcttgacaactgactttccacacgtttcaaatttttgttttagaccaccacacctctttttatatcagtggtgctctgtgtgcctcagagaaactttggatattcttgccttgtaaaattccctcaagcttttgctcttgtgaaattaatcagaaaactgacttggccttgtatagcacgcagtggatagcggttgaatatgttacaactcctagatagtattgtcacttaaatgttacctatcatatcctgaattgttcttaatattttatatactgtacctcatattaacatctcaataactcttgaggttggttttattatttcttttccccagaaaaaagaaactgagtctcagagatgataaatggttcggttaaggtcgcttgactaaggggcagagtaggcattttagctgaatctaaggatgcccttaatgattatgtcaaaggagctgctaatgttggagttttgaataatagccagtcagtaaggatgctagagagaactctcctacaatctctcaaatcacatcaccgcagcatgcatgtttctttttgctaagccagggtgcttagggaaactggggcatcttctaagcctctggtgattgataattttttgttttgttttattatttttttgagtaagcttctcactttgttgcccaggctgttcttgaactcctgggttcaagcaatcctcccatctcagcctcccaaagcattgggactataggtgcattcaaccatggccgtcttgttctattttaataagccactgtaactgaataacatacatttcaataagacccaagtaaatgaagataatgagtgcatgttgtagggctgagtgaaagtgacacagctcacaaggttgaggtgggtggggagagaaaaaaaagtcattcagtgaacctcaaaagcacatttccttcttagagtaagaggaaagctttaactacccgtcggaattagctgatttcctaggggtttttctatctcagccaaatcactaaattgtaatgaaaaaggaataaatgaaggaacatataaagaataataattttactgattaatgactgtctgcaaaggaacttctctcaacataatcattcaatctctaggagtcctcccaactagatggtttctgaaccagctactttatagtgctggcttgttgagagtaagaaaggaaactctggtgacagctctgggttgcagaccctggagacagcacaggagagtgttgggctgtgtggaaggtggaaaaacagtcatccagcaagaggcgtcaaaggctggtggagcagcatgttggagaaggcagagagaatacacaatgtccctcatgatgatgacccgtggcccaaatgaagagtcttctcatccaaacaaccaggttgccctaaagtgaagctcttttacttggcagtagaacattcttttatttattttagaagaaagtacagaagttttcatttgatttttagtaactctgttctttgcctctcgcccttagtgtacccttgtataaagtgatatggcaaaaataggaagagaaaatgatgtaaggtgtaaattccggtcatctgataatccaaaaaagaaaatattttattcttttccataaagaatagaatatttttatgggatgttatctttttagcacatggaatcctggagctttaagctactacttactctttggttctacttttctgttacagagaaattatttaataaatgttgctaaattcatgaatgaatgatggatgaatgatttctgttagacagatttttaccaatgtatttttagataggtcaggccatagccatgatagaattagttgaaatttacttccttgttagccattactcctgtttcacaatctcacaataaatgcttaccaaattttaacctacatgccttttgctacagattgattttcttctggctatcaaaagtagttatttctctttctatgcccggattatttcatttaccatcatatattccaggtttattcatgttattgaaaagggcagggttttcttaatttgccaagcttgaacagtagttcattggttatatacacattttcgttattcatttattcactgatggacgctgagattgtttccatgtgaggggatagatatgtcaggtagcttgatttagccattccacaatttatacatatgtcaacacatcacgttataccctataaatatatacaatttttgttgttcaattaaatgattaattttttaaaaagtagttacaagtgaacttcctgttccaaaagttatctttgtatacatttgccttcaaaataagcttttgttttggtgaatgcatgtctaatccaggccccaggacattgccctccccaagggccctgcattcccttcccatgagatgcagaatgagatgatgctggatgcctcctagtggtgtcgaattttgctgtttcctcacctgggtcattatttgatctttcagaactctttcggtttcctcaaaaccttcacctctgagattcccaggctccatgcattaagggcgccttagaccacatagtatcttgagaaggggccccaatcctgaattctgagagaaataacaattcacctcagggcacactaacgttctatcccttatttaaaaataataataaattaggcaatctctattggttgaattttattattcattaatctgtttatgagctactctactgcttattgagttttgaaagtgcttgttctctaggcagacaggaattaggaagggtttatgtgggtttttgctcactcggtccctgaattcccagacacatcttgcaaactaatcagcgccagcctcttgtgttggagaggagtgtgcttggcatgcggtgggtcctccatgccttaactgctgaatgagaggatgcatgaatgaagagatgggacattttctctctccccatccacactttctagttattttctgctgtttcagtcattgaatatactcttaaagtatacattctggagtaacttgatactggcttccttatgctaatgttcccatgactgggtttcaatttttttttattttgtttttaaggcagaatctcactctgtcacccaggctcaagtgcagtggtgtgatcttggctcaccgcagcctcaaactcctgacctcaagcaatcctcacgcgtcgaactctcaaagttatgggattacaggcgtgaaccattgtgcccagcctacatttttttttttaggcagaatgttttgtgaggtacttcaatggaaagaataaaaaggcattgcccaattaagagataaagaaaaaatatgaaaatagaaaaaaagaacttgtaataacaggttgaaaattcaaaaccaaaatatcgcatcattactttgtagaattctaaatgaggtaaatagctgatattttgcctggcgtagcattaaagcaggttttttttttctttctttttatttaatgatgccaccatcctatccaacttttagggaaaaatatctaatatgaacagcctatcatccatgagttctggaaaacaaaacatagctatgaaatacttttttttttatcttgtggaaaacaaaacataccctgaggtttctattacatcagttatctgtcaagccttataaatatactatcactaaattgtctgtaaagtctcattatttgagcaattgcaaaattgtatcagaaataaaactcaaagtcattatagggattattattttgcatttacatgaaatgatcctctccctgaggaggtggctttaccacagggatattcagaactcaccagtcagaacacagatacacaaggagacattccttacaacttcttcttgatcagaatttactggaactcttggccaagtatgtctgaaggggacagctctgacagaatgggaagctggtgatgctgttctcatgttcctttcattctctctgtctttgtcatttctactctgcctggggctgcttccgtggtccatggcaatgctctctgtgaactacaaataaatcccaatgtctgcattttttaaaagtgtagtgccttcatcatgtagcagaaggagaaataattccatctcctttgcacatctgtcttataggtattttgtgaaagtgtcatgagctaattcatgtaataacacttagaatacacccaattgtagctatttttgctggtatcattgtcattttctggatataaaatgtaatgaatctctcagtaatattttattatgtaatggaaagaacaaattgtggatttgtcacttattaactagaaagcctaagtcatttagcgtctctgagcttctggtttctaatttattttttaaaagtgggggaatatctatctctgggaaatactggctgagttagcaataatttgtgcacccagcagatgtggcatggagtcagagctcaaagatttatcaaccatctttttattattattttctccattttcagccgatcttaaataagctataaaaggcaacattgatttatagaagttaaatggatgtctaagaaaagtctgtatgcatgtattgcaaatcaaaaccacaatgagataccatcttataccagtcagaatggctattaaaaagccatgaaaacaacagatgctagagaggttgtggagaaataggaacacgtttacactgtgggtgggagtgtaaattagttcaatcatttttgaacacagtgtggcgattcctcaaagacttagacagaactatcatttgactgagcaattccattactgggcgtatacccaaaggaatagaaaccattttatgataaagatacatgcacatgtctgttcattgcagcactattctctatagcaaaggcatgaaatccacctaagtgcccatcaatgatagactggataaagaaaatgtggtacatatataccatgaaatactatgcagtcataaaagtgaatgagatcatgtgctttgcagggacatggatggagctgaaagcctttattctcagtaaattaacacaggaggaggaaaccaaatactgcatcttctcacttaaaagtgggggtcgactgatgagaacacatgaacatatcggggtggggaacaacacacactggggcctgtaggagggttgggagtgggaggagggagagcatcaggaagaatagctactggatgctgggcttaaaaactaagtgatgggatgatctgtgcagcaaaccaccatggcacatgtttacctatgtaataaacttgcacatcttgcacatgtacccctgaaattaaaagttggaaataaaaagaaaagaaactaaaggggaaagaaagaaaagtataaatgcatgtatgcaatgaacaaaaacaaaacagaagtaatagcatgccagcacaaatttcattcaaccaccaaacttcgagtggagtaaggaaatagcactgaggttccttctccccaaaatagggctgctgtctgaaagtttattcttaaaattcaccatgtaactgatggatctgccctgtgtgtaaataaaccaagagattccttgtgaatgtggaacagaagagctcatggactcccagaaatcctgtcaaggtgatccatgggtaatctcagggaatgcagggctggaaaatgattgcaaattagtaaactaaaacctagtcaattgagctgtgtcttatgtggagaaagcctgtgtgcacagaatggggatggtcaccctgagacctaaggaggacagtgtgaggactcagggcctggctctgtgattccagcacagtccagaggcggcacagactaatgtgagaaacaccagcttccactcttgagagagctgctgtcggcaggtgggagacccgtgttggagcacaggagacattggtggttataggcaaatgctttggcatctaaatctgtgtgcaaatcctggcctttccatttgcaaatgataaaccttgagaagtttcatcaccttcctgaatctcagttattgctcctgtacaatgcaggaaatgtcacaatattttcctagcgttattctcaggattaagtgagctcatgagtgaaactctacttcaatgctcccatggccagggaaggcatccacggatataagttgctcatctgagtccccaaaccaccagtacataataaagcagcaacctcaaactctagcagtgcctctaatttagggatcttattttttaaaaaatagtttatctctggaaaaggcaacagtgatttaaaatagaattttattgtccactttataaatattttggtattgggactttgcctgtgagaggtagagacctcttaaaaggttttaagcaataaagtatgaatcatggtacatattatgtaaacatgtttcttggaataataagaagaatgataggaattaagagagtggatagattagaagcagggatccagtttatgtcaccagccccaaagcctaggcagaaccatgagatctcaaaataaaactgagtccggcagcatgaggataaagcagttgaatggagagatatgaagaaggtgaaattggtggaaattgttaattaagagtgagggaggaagtaagaaagaaatgaagactcttatgcttatgatctcagcaactgagtgtacaggacaagtcattcacagagttgagtgacagacaggtgggaaagttgacccctgagaaaatgactagtgaaggaggttgaacatcttagtttaaggtgcctgatgacatccaagggaaggatttagtagacagtcaaataaatatatattcatgaaggaacatgtgtgtgtgtgtctgtgtgtctgtgtgtagcagcaaagaaggcaaaagtaaaatgtaaaatggtgcaacaaagtgaaggacattaggggccgacatgttccatggaaactagcaatttaataagagaagtctcagtggactgaaggggaaaaaggccaattgtcgtaggttgaggaggaaaagggtgcagaggaagatgagatgacagaatgcaggcaattatctgaagaaaatttggctctgaagagaaaagaagggaagtaactagattgagagatagggttgaggatgactacagcatgcaagcagaaagagtgggagaagttgaaggtacaacataaagagagagcttaattgaaggagaaagtgccctgagaagtcagaagatgagattcaggataaaatactagccatggacaaggggaggattgctcaagccaagagaaagcaaatcacagtgggttcgatggtctgactttgcagatacctttgctagattgctatttaatgtcgagcttattctctacaaaacattaaatcattttccaacagggaaaacaagaattacacacacatacacaagtcaatatataaatcaatgtcacaaaatattttatgcaagaaattaaaattagaatagagagggaaaagagaatacagaacatttgggaacatttttgagaggaaactggagttgagtcttgagaaatttgaagagttggagaagacaaacagttggtgtgttccagagagagatatatattttggaatcatcaagatctaagtggtgttgaatcacaagtatggtgtatagtctaatagttttgacttttaatctacttgcttcctgaataagaccaaaggcaatctagaaatgtataaatatatttctagaaaaatatatatatacattatatatatattcattatatatatttattatatatatataaattatatatatatctatatatacacattatatatatatatataatggcaccactaattgtttctttctttgtattgagggaatgttctacaaattatgactcccaaaatcttcatctgtggtatttttaaaatcagttttacatctctaacgtcttgagggtcattttaatttcttagcagtaaagtgacattgagtaaaccttggctgattcatataccaagacctgcttttgttttcttgtatctgtttgtgaaaagtcctatggtttcagatttctggagcatttatagaaaataaaatagtttctgaacattttaaatacatactttatttgccttcaccccttgtttcttatgttaggaaataaaaacaagattgcagatgtggtccagtccctcccacccacccctgtgtggagcacagggagatggatattatcctggggtagactgtatatttgaccactcaatgcctgcatttgctttggttggcagccaaatgacctttaagctcatttaaagcttcttgttacctaaactcctcggtctttttttttttttttttttttttttttaaatctggaagccttgagaaagaaagcaaaagagaaataattgctccttaaacaaagctaagacagaattatcagcaagcatcagtgcagcattgcagacttgaagagttgcttgcaggcatcttactggccattcctcctttgcagccataagaaatgtaaaacatcatgtaccccactcaggagaagggggtgtggggtctcttgaggttgatccactcagattcacataaggacttcaaagggaactgagttcttgaattcttcctataattttctgtttgtctgccatatatataacgttttatttgctgcttctgagtgactgaaagaggaaaggacacaaaagaggggaaaaaaacccactgtaatttttaatagttaagtcacccaaattatatactaaaataagcttaccaagcagcagttaaccaaaattcgttgatgaaaatgaatggcagtctgtgacatttcatcaaacctgaatgataccccgcccccaccactctgccactctaaatttggtgaaataccaaaattcagatatttaaacttagagaagaccacattgactaattctgtaccatacccttgctcttgagaatatttaatttttttcttgccacatgcgttttattatttttggtcatactaaagtattttttaaggatcatatgcctattccatgtgcccttgtagactccataaatgggaatgtctggctgctctgctcatgcattcctggtgtggggtgccgtttcttgttctccttttatatattgtttgtatgtcatatttttatttcaaacttcagtgagaatttccataagtatgtattgagtttctactatgtacaagttggtgtgttcattgttttgtatgcattattccctttgattaatacaacaatattgaattattgttattattataaccatttaaaacataagaaagctgatccccagagtgacctcactgatgttatacaactagggtgttgaggtacatggattcaactcatgtcgtctgatcccagcgacaggctttcttactacatacaacacaatcatctctcaactgtacttaggaagggccttgtgcattgttccaaaggaagtgaaagtttgcagaatccttacccttggcatgaagaaagcaaatctacagctgtagactccttgcctatcaataggtaccaccatcatttgcatcattttattgtgactaaaacccaccatgacgatcaccactaccatcaccaccaattgtcctacccattgttttgaagtgctggaatggtacctgtcactcacaaatttaattaaatccgatcatattcctaatatgaccttaaaagcaggaataaatacacaaattccccttgatggttccattgcctataggctcaacacagccttcatctgcagtttattggtccagtcagtgtgggttcccattataattttttaaagaaatttaaaattcactgccaatattcaaaaactgaaaatttttacattaagattctagcctggctctttggtctcatattacagaatagcataatttcctgttgctagtgagtactacaggcctgttttagttgggacagctattttatacttatctctctttccccctgacaagagattgtgtgtcaatttccatttattactaacacaaagctggattcgcatgctttttgacttgcttggcccctgtaggcatttaaatttgtgtctgtttctgttgcattaaacagctttagagagcaatttactttaagttttcaggtaaaaatattcttagtaatgtgctttgcatcatcaaactaaatacaatttctttcctctgttatttggaagataattttattcttagagtgctatttttagatcccaacactttgacacaaaaacatcaaacttttgtggaaaagatgccagaatgtgtatgaaaggcagtcgttggcattgatgggcagactttagaaactaccattttcaccttgaaaatggaaatggagagacatacaattctattgcagtacagaatttcttcaggagaggatatgggtttggtcttcattccacttcggctgtttggaatttgctttgaaatctctgcctgaaaagataccggaatgtggagattgaaattcatccctgtgtctatgcaacattcatagatgtactttcaagctgagacaaaagccttattctatatcctttgaatggcctctaagtacaggtattcgaattgtagatattgtatggtatatttctttacattttccttttgatctgtaggaatatatgtacaggtgaatatttgacttattcataatcaagatgaattaatatgtttttctccgttttcatgagttggataataaatctgaaaatttaattttctacatgtggtgtgtaatataagctctccaatacaaaatcataggtggatgcataaaaagataaattgacttgcctggggccacagagtagttcaggaacaaagattagaactaaaataagtgtcactgccaccatttttgagcatttaccgtagatcaggcaccatgctaagtgactacataatctcttttaaacccatcagtcactgtgatgtagatattatctccattttaaaattgagcacactgaagatctcagaaatgaaattatttgcccagtctaacacagctaggacctggggactgagattccagagcacagctgtatacttctaaaactatgtccttaaagacctggggtagatactggggataccaagaatgtggcattgtccctgtctcttctgtggtgtgaggtgtgactttaggccagctatctaatatctctgagcctcagtttcctcatttgaaatgggcataatgacacctacagcataggaatttttttgggggaaaaatacctatcccctagtttatttctgctcaaaaccattgtacactcaatgctagtttcctacatccaatttttccttctcagccaaatgatgtggcccttaccatgagtccaaaaacaccaccttaaacaaaaggggaaaatatccaatggcttatcctattctttctaaactttatccaaaggtgattagtcaatattttatttgcatggttaacaaaaacaaagccagagtcactagctaccgagatctttaagaacaaaatgaaaagcaacgaagcagtaactataaagcacctcgagttaaaaggtggttaaaaaaaaatctaaacttgattaaaacctgttggcaggtggctgaaacaagtccttggagtgatttttgagtggaatttgtgatggctgtttcaagttagttgctgagatagccgatctctttatgggaatgagaggtgaggtttaatgtcacattagcacacattgagctggtgggctgctcttagccaccaaaagcagcatctttgtaaactatccatttctacaagcacacgtggggaagatgtaaaattcacttgtttttggaagccagtcatgggttttgtaattaacattccttcccttcacatacacttaggcgatgaaaggccttctgttttccccctctctgcccctaccctgctgcaactggccaaatcacttctgaaaagaggggtcatggaaaagagtccctagattatccacattttgtcctctttttttcttaaatttatgttttgcaggacaaatgatactggctttctttccttcaaagaccacttgcctgtcactcagatagttatcactgataccgacagatcaaactcagaagccgcttggagaattggtcccttgcgttgctatggtgaccgtgagtacaaaatcgaaagaagctttctctctgcattacatgagcacaagatgttcttactcccttatcccttttccctgcagtgtgccctagtcttgaaaattatccacatgtccagtgctttcccataccccactgaaaacgataaaccatgttgaaggattttctcatttgcaggacgcttctggaacgccgtctcattttatacagaagcctcttacctccactttcctaccttccatgcggaattcagtgccgatatttccttcttttttaaaaccacagcattatccggagttttcctagaaaatcttggcattaaagacttcattcgactcgaaataagctgtaagtgccctcaattatgaatttaatgtaactgatcaacaaacaagttttagtcttgtttttgccaccagtcactagtgggcatttgtaccagcaaattaatctcactggacatctgtaaaattagcagtgataatgtctagttccttctgatgctttatgattttttatgacctgtcagtatttaatcagtcattctcttatcaaaacatggatattccgaaaattcccatagacacctattacagtttccaaaggtatttcttacctgtgactttaatcttccacactacaggactttattcatgacactttccatgcaaagctgaaaagaggattattatgcattctattcatatttagggtctacttttttgctttgcctttgttccaaaagtaatttcctgacttatttcccacactaggagcgtgtgactatccaatcagaattcccatggtttctctgccacttccccatggacagtggcgtatctaataaacttgatgccaggatgtggatcaccttttagcactgcatatcctacatataaactatattcagtaataatcatgatatgtgaagaaaaataatgggaatacagatggtgacatttcctataattaaacattttgtatataatcatactaatgaaacaatattccaatactaataaaatacaatttaaaaaaattacatcaagtggtatttttaataaaaagggaaaaagcatacctatatattgctctgttgcgatcatagtaacattaaaatttatgtttctgagtctctacttctcgaaatttgacagtgacttcataaaatttaagttttttcatatgttcatgttcaaaagagagtgtgctcatgtccatttatcttatattgagaaaataatactttctattaattttagtttgtttcatatgaagcaagagctatacaaatagataaggttttaaacttcctatttgttaaaaattcataaaaatttcattttatactaaattatgtaaattctggtactgttaatgtttttacttcaggattgattctagaaacttctacatgtctctgcaagcaaaaaaattctactacaataatttcaacagaaaattaatgataaatttctattttattaggtaaaaagttaccatattcctaagaatttgaagttgcttgggttctagtaggatgcaaattttgtctcaaacctctgtggttccatacattcatgtattcaacattagatttgagtcaaacaaagctagcacagtaattatacagatgaaaaatgagaacttgagttcttattcttaaaaataaacaattagatttgagtctgtatttttagaagacaatggtaaatctagagttctatgtattaactttccctcagaatataatatttattaagtggaaagagagaaaacatactaatttgaagtttatatatacattgttaaaaattaacagtagtgtcatacaaacaaaatatatttgtttatttttaagagtaagaacttaagtcaaggcgcagtggctcacacctgtaatcctagcactttgggaggcctaagcaggaggattacttgaggtcaggagttcgagaccagcatgcccaatatggtgaaaccccgtcgccactaaaaatacaaaaattatccacgtgtggtgccaggtgcctgtaatcccagctgctcaggaggctgaggcaggagaatctcttgaaccccactggcagaggttgcagtaagccaagattgcactactgcaccccagcctgggtaacaagagtgaaactttgtctcagaaaaaaaaaataggttaaaaaaaataaaaataaacagtagcttcagcatctattgaaacagaccaacaaacgatttgtttggtgaagggatgttttatcactaacattgcttagaattacttgtgtatggtaataatttttaaaaagatgtatttttagtgacgtttgctatttttttggttctctgcatgcagcacactttttattgcttatagatggggtaggctgtacccaccaccttgcccttgttattaccatgaccataaagactcaggcttgtcattaggtgccctatgtatgtgtgtctaaatgaatgtttttctgtagtttgattgaggcaattgaccatatcactataatgatgtgactgcatgaaatacccttgaaagcataagtcatgtcttagcaacagaaattggaaacttgagagctccagaaaaggagacaaaaaaaaaaaaatgactggaggagatgacagaggtgtttaagtctcctgcaaattaccaagcagctaagtgtttcttttgcagttaccacacaatacatacaaggaaaaagatcttcttaattggtagttttaacctccttttgctccaactattgagactattaatgggaggaagctcttgtggctttggtgtgaaacaagatccctcatacctaacatggccagtctctaaaaatgttgagttgaatgccaacaatttcataatatggatataataacttcaatgtaaatttaataaaaatcaggccccatggccttttgattcattaaagcagcagcaaacgtatattattacaaagtaatgactgatgatttagtgttaattacgtatcaatgtccagtttgtttgcactttgtggtactgtattttagaattacatttgacaaaaatcaaaacccactgaagtaattgcttggtatataatatatcaccagattggagaacatatactctccaagacaagattttatataaaaacattgaaaagttcaagatcttatactctcaaatatttgttattattaatatttaaaaggggaaaagaccaaagtgggatggaaacatcttgtattctttatttacagctacactcatattacgcattttaggcagatggaatttttaccctaaagggttcatggcaagaaacctctatagaccaggcacttggaaaggaaatggccttttaacagatgcagtggctcagaatagatttccctctcatccgcaaggagtgttcctctaaaactatctgagcagcagtttccaaggttgatatatccgaattattggacagggaacagtagattcccatgaaattttcagtccatttccttccagcctgctttcaaagatatttgaatttcgtagcccatactctatgaaaaagaagacacgccactatgttcacaagtcttagtgaatgtgttttagtgggcctgtgaaaacgataactattttgatacctatctcacaatggctgtacaggtagaaattgatattttagagtagatgagatcagaaggaaatggcttttgagagtcagtctggcatagtggaaagaagctagactagaacccaatgtggatttgaacttttgttcttccaagtgggtttgtgagctgccttgagcaagttcttctcccttcctatgcttatttatgcaacatggggttggtgacatccatatgccacccagatgcctttggctgcaaataacagaaaattcaatctgaactggcaaccacaagaatgggaattcactggtactggagcatgtgactaagcccagaggaggtaggactggcttcgtttatggttgttttcagtagtttaacaaagttgtcagtcatctgatggttttctctctctgttatgaatgttgaatgtctacttcggtctaaggctggctctccatcatggtggagctgcatcccagctggtgaagaatccctgctttccagccttacgagcaatcctcctgagaggccactcacttggcccccaagaaccaatgtgtgtgactgggaacgtatacattgcagattgatttataccagggcctacccccacaccagagagtgggctagcttcccctgaagcccatgggaatgggaaagagggaagagtctcccaaagtgaactcagtattattagaaagaaggtagtcgtcagggagacaatcaatgaggattcttctaaggcagttgtcagaactgaaatgtgtaatttatttttaaaaataccttgcagaaatttgctgagctgctcaggggaaaaactgtacatatatatactgtatgtatgtgtgtgtgtgtgtgtgtgtgtgtgtgtgtgtgtgtgtatatgtatgtttatgtatatatttactgtataaatatgagagaaaagaaagagagaaagatttaactttatgatttcagaagtatcatactgagaatattacaaaatatgatgttaacttggacacactatagttagaacctcagaaaatagtacaaatgaatactactaataattacacttttgttgaattgttgagcaattattctgattagacactatacaattctttacattcctgatttcattttctttccaagcactcccatcgatgacgatcactgtgttgtactgtgattaccaccacacagtgcacgggtaggcaggatgaacctagagaggggaagtggcaagccctgatcgcacagctgggaaggttagaatcgaggacccacccagctctgtctgactccttgcagcaaccccgactctgctttgcaccagtccacaggattgacaatgttagaacttaagagaacatacaattatttacctccaggttttgaggcacaggacataaaggaagcccctgcaattttgtgcaataccacaggtactatttttctagagatagaaaatgtggctgccatcagatccttgaagagattatgtccctgaaaagttttaacagtattttatttagttcatatttctcattttacacatggacacgtagaaggccagagagattaactcactatgttaaggccttatgaattatttattccataaatcgaccctgaaatctctctcatgccaacctggggtggggattgaggacacagaaatggagtgtggttccgtcttcatggagctcaggactgagtgctgggagaagtgcagagtgtgtcctaaggatattctctaatgggcttggtggtcagtcctggaagaacatcatgcaggagtcttcttagcagcttcttctcatctcctaggagcacttggtagaaactctgttacagccctaaacatgccctttcttttttttatcagtcttctcaaaagtaaatcatgaactcatcttgtttcatttgtctcagaattctcagtgcctagcacagggtctggcttgaaaaaaaaatgccctgaaaggctaagactccttagttttgccttgaaccataaagaagtagctggtgagagaaggcattcgtcagaaggttgggggaagttgaacttagagggtaagttcatgatagagctaatgctgtcattggtcttctcccttcctattcagggccagtgggctatgtccacctcttcagcaagtgagagccagcttgagtttgccttaagggccctgttatactgggccacagtgggatgtatcattcattctctcacattgttttcaggcatctttattatctattctagctttgactagccagggcaactgcacaggtttccaggtgtggaggttttatcgcaggaataataatttaaaaattgagccctgggaaacaccatctggattcacatccagactctgccccacccacactgggtcagcttacttaggtacagcttactacctgtaccttacttccctcatctgtaaaagattccctgtctcataaagttgtagcaagtcttagtgagtcaattaatgaaaaatgagtagtaaggtatttggctcacagtaagtactcaataaatattaactatttttattgaattttactgattttattgaattttactgattctaggaggtgcagcttaaacatagtatgtctttaacagttgctttaataaagttaaataataataattttaaagactttgcaaggaccctaataacttggtataaaactgtaaaggtataaagaaaattgcagaatggcatttagtatgtgcagtgtaatgatgtttcagtgaataaaatgagaacttcctgtatacaaggcacagtgctaggtgctgggtatacgataaatcagatgttcttctagagttgcagactcgggggagacaataaacagattattatacagcagggggctgcagtttggagcagaggtaagcacagatgggaaacctattatggaggttgtggtcagggggcaaggctagtcacagccagcgaaacagcaagccctccccaaacatgtgttgtctcagtggaatttattatccacaagactagccttgcaggaaagcttttagcaaaatctttaacattcctcacccaaattctcaccaatcttattctgtgttttatagaaaaatgtaaatgtggggtccagtcatctctcagttaagtgtttttaaatttggggatgtgcagggctgccaggtggcactggtgatctgaataagaaacagagaaagactcaaggggccaccttcactcttatttagtctaactgctcatcactcaatctgttcccttcaattctgtttcctttaaggcatgaatttgtcacctgaagccaatttgcctaggttgaaaaatcacagatcacagtaataataacaacagccatcacctgttgaacatgcagtatgtgccaggcacagttctaataactttatcaggattcgtgtctaaataatctgatgatttaagtattgtttttattcccattttacagacaagaaaattaaggcatggtgacattgaaaactcgccttagatcacagtagctgcagagtctaagctcttaaatcccattcttactgcttccaccttactacctttcctttaggccagggctcggtagaaagcaaaagaattcgagctctcagatactcaaaattctgtgtaatgcggactttgatggaggctgctttcagttaaggtttaaaggctgggaagaaagtgctctgaggtggagtttgtcttttggcatttccgataatttaaatctggcagttgatgacttcatcaaataaatacccatttcctattttagggggtagaggagagggagcaattgtgaaggtgcctagaaaaaaaggaatgcctagcatatgaaagttccagtcctctcctcatcctcaatttgtaaattacaattagcctctccatttcctttacatttagaacattgttatgtgataatggaaaacacaagacaatatactcaacagagcaacatcgtgaagaaccctgcctgtggagtcagattctgctaaccacttaagacacttgcagcaaattatttatatttctgtgcactttagttttctcactcataaaatgctaataatggtacatttctcatagggtggttttgtgtattaaaatgagataatccatggtcagtgcttagcatggtgcctggcatagagtttgttgttcccactgtgctaccccttccaattctctctcttaatggttatccaccattgccactatcatcaccaccaccatcactggcgccatcaccatcaccttcatcaccaccatcaccaccaccgttaccaccatcaccattaaccaccaccagcactgccaccatcaccatcactgtcaccattaccatcaccatcgccatcaccaccactgccaccaccactatcaacaccaccactgccagtgccatcactaccatcaccattaccaccatcagcactgccactatcactatcaccattacccccctcaccaccaccactatcaccacaaccattatcaccaccattgccacgaccaccaccatcatcatcaccaccaccaccatcaccatcatcatcacctccatcaccaccacccccatcagcaccaccatcaccatcagcattaacattatgcccaccaccaccatcaataccaccactaccacagcactaccaccaccaccatcactgctgccatcaccattgtcatttcaccatcatcagtatgcttacttctgactgggtgccatctggcttccattatacaaagattgttatagagaggcagaaagaataatggaaggagtcccatgtgatgacaggaggcttgggtttgattgcaggtaccgccacctgcagcagtgtctccttggacaaggcgatacaactttctgagcttttttcattatggaaatagcacaaatgcttatataacatgcattagtaaaataaggaggaagcactggacttcccaaggcctaagtctcctccctgcaggagtggagctgccttgctaacctcatgtctgcagatatcctggaggacacagctgaagccacaatagatccagaaaatccagggcctcggcattcatgcaggtatatcagatgagcatgaatggtccaggtgcctatcctgtttcctgaatttgcaaacgtagcaggaaaaaaacaacttggaacaagtatacacatttaatttggtagctgttactattaatggtgatttcagtgctgcagggatttcaaaagaagtcttctctatattgatactgacttacaatcgtttctcccactcaagcctgtgccttgaatgagctaacaactccctctatccttcctgttttcctttccggtttcagctccttcagagatcacctttgccatcgatgttgggaatggtcctgtggagcttgtagtccagtctccttctcttctgaatgacaaccaatggcactatgtccgggctgagaggaacctcaaggagacctccctgcaggtggacaaccttccaaggagcaccagggagacgtcggaggagggccattttcgactgcagctgaacagccagttgtttgtaggtaggggacatcttaaggctccttttgtgctaaaccctgcaagatcactgtgtgaccatgcccaagaaaaaattctcttttatctgagatctgggatatgatcaaaatgtcataaatcatttctaatggtaaatttcattctatacattcttttattctggcttcattggctacatcgagttaagataatgctaacctttagcaaattttgaggttgtccagattctgtacattttctttttgtaatattgtcttcagatgcccagggaccccttttgttctacatcattgtaatataaatctactccaagggacaggacatgtcaactctttacaacttagtgggtgtagactgtaagtcatgggctgcccttccaagtgctgccccagtcctgataattacagatatccatgcaatgatatagttgaaccattttaaagggattttcgtcaacagtaacatggttgagaaaggaatgatccctttctaaatcagggggctctttgatagtacctgaaatcatagcactggggatcaacctgccacaggctgttcatctgaactggcaactgctgctggtgggggcctggaaagatccaggcatccttctttagtcattcctcactactttcattccactcatagtcactgagcatctacaactggtcaggtatcttgttagatagtgggtattgaaagatgaattgagcactaccactgcttttcaaggagtttataatcctctggtgtgtgtgtgtgtgtgtgtttcacagagaagagagcatggggttttggaagtctctcttcagtgcctgagccttaactacatttatgttggcattttgtttcccttgacataattcttacattttgttaaacataagggagtgcgtgtgtgtgtgtgtgtgtgtgtgtgtgtgtgtgtgtgtgagagagagagagagagagagagactaatacagggtgagccttatagctgtagttaaaaaaaattaacataggttgaggagggcttgtaaagctttaaagtacaaaatcgagctcttaaagttaagaaatattgtcaatactaccaaaacaaagagtgtgcttttatataaaacttggagttcagatgtttagaacagtgatgtaaataagtgacagaatttgtcagtctacccagatttaactttgtttccttttttgtttatttattttttttttgccaactcccacactacatagctttactgctagtgatgaaatgccaccagcattcaatggaagtttccttacttgcttcctttaaatttaggtttgtgcaacttttagctctgaggaaagcagtcactaaaatcacaccagctaaaagaaagcaagtaatagagtgtgaggatatcatattctctcttctcaacaggaaccatatttctttctttgtctgttatgttccccagatccagcagaagctaagatataaattatcaaaacagttttgtgattgcaagtcatttgtttaattaataactcatatatgtgatatgattcactattaaaatattttaaaaatttatattgctgttttaattctatttaaacatcacattttgatgggtgacttctgaggaaggttgctagtcatcaaaatctaatatattttttggtggaatcaagtcaagtgtttcacaattttcataaattatattccatgccaaagtttaatttatcttcaggcagtatttatgaatctttctggctgaaaggtatatataaagacggaataattttttaccctttcatgcaaaatttatgtagctacaaaattatcatacaggctggatatgtgataaagtttgcgcaagtcaaaagggaaaggcggcagctgtgtttcatggcagatttctatctgcagacgtttcggttaaattgatcacaaatgcaatgagctgtaagagcatgtcgatgggtctggaggagatatcttgctggagctggagccaaggtcagctgtggcaagagcacctgcttctgctatgtttctctccaataagtcccatctcagatgttactctgctttattgaatttgtcttaatgtacttgaagaagaataaaatgctgttggaggtcactttaatggtctttcagtttgaattttcctatttagagttcagtgatatgcccatttagaaatgtcaggtagccaacaaagctgaagtctcaacatttccatcttgcacaattcagttgttcaataaatatatagataaataaataagcattttggtgcttagttatagtcaccaaaatgaacaattgcattctgtattattcagaaattgagaggccctggatatttatatttgctagggaggaaaagatatcattggcgtgtgcttctttactggaatagattgagtgtagcattacttaaatattaatttggatatgtctgtctagatatctttggccgctgaaggatctttcaatcaaaatggagcatccttcagcattgtaatcactgacacagctgccgtggtcatgagtgtttcctgagtaccagaaataggctgcgtttttacaataggatgttcctctcagcactgcccctgtcattggaatgtgacaggttgaagtgctgatacatgagtcaatgcatactggatttccagaatcaatattttaacttcaggctgttatatcaccatgatggttagggacatttgcaaccatgtcatttcaccagtcacatttctttaacagagcaggagactcttcacaacatgcagcttctgaaatgtaagctgcaagcgtgtggcattctcacctttggaatgctcaatagtaccgccccttctgctttgttattcccccctaatgtgtccatcaatgtgaggatgaggcaagaaaaatcgaagatccaatggagagatctgagtatgcattcctggtcagatgccaacaagccataggccctgggtagaaaactaactagcatgagtgtactattgtctttatctgcagaatgaaaatgaagagactgtaactgatcttctaaggcttgaagatctgctatctgcatgtacaaattaggaacgactgtcacacctacagtcatgcccatgtgtacgtaacagtaaagaaaatgtctcattccctccaaacttaacgcaagatctttcaaaatatgcggcaattatagagtggaaatcttgtgaagatggggcctgtgagtctcattttatgactctatttccttctactttttatttttcccatgggcctattttttttttcttggcccaactgctctatttgtgtcaaaataaactgaagctactccaaacttacaatcccctggggaaaatactacactgacttgataagtcataacatttggagagatcccccaaaattgctgttcttgcttccaggctggaagggaattattactcctatttcaggtgaagcgtgtcaaactcagtgaggtcaagggtgaagccaggcaggcttggcgtgcacatgtttattttgtgctctggcacttcctaaactcttgatttgtggcataatgcaacacttaggtaactggcctcagtctcctcttggaatagtaacttatattttatgcttgtgagtgcctcatgaagatagccttcctgaagcacgcctgtagtgctttccattaggcatgatgtcatgtgtctcacagtataggaagagatctatattctcttcacattgagaaataattggaaaattatctgttagcatatttttacataaagctgtatttgcatggaggataataattatcatgacatcaacggtgaaacaaaaagtgaagaaataattgtttttttaacattatataaatctctgattatgtctactattcccccataaaagtgtatttttttcaaagttaaataatatattaagtatacttcaatttttttaggaaacattaatgtatgactttcaatgtccccttaccaattacataagggaaattgttttggttggtttaagaagagggtaagagacctctgagcgctagcgggcaggtcctgggactgcctcagtagccacataagaaacactagaagagcacccagtggccactcaaaaatgcttctttagtggggaaaaaaaaaaaaaagatgaagaacacctgggtttgtccctagcaccagtgatccacaaaatcaggttcttgtagcttgaaaatgtttgaaaaaacattggttctgtttttatattcaggaaaagtgagtgattaaatcatcctttcagcaaaattttgtctcttcttgaagatgttgagaattggatacatttaacccatcccaacacccattttagtgttttctactcgctattatatattttttgaaacagagtctctctccatcgcccaggctggagtgcagtggtacgatctcaggatctcagctcactgaaacccctgcttcccgggtacaagcaattctctttcctcagcctcctgagtagctggggttacaggttcatgctggcacatctggctaatttttgtatttttaatagagatagggtttcaccttgttgcccaggctggtctccaattcctgggctcaaacaatctgcccaccttggccgcccagattgctccctactatttcagacacacttttgaaaggtttgtctacaacttcttctgctttaattgagctcatattgtgatcttttggtctctgttggattgacaatggacaattgaagcagaatggagggatgtgtgtgtgtgtgtgtgtgtgtgtgtgtgtgtgtgtgtgtgtgtgtgtcaggattcatactgtcttttttaaaggagaatgcagcatggtatcatcttctcatgcagctcagaaagagaggacccgggcttcagacctcacaaaaactcaaagttagaagcagtaatttgattctcttggcacttccacttgtcaacatttataactcagtaaagaaagaaatcattagaagagcatcatttatgtgaaactggcattctaattgtaaaaagaaacttaaggcagatctttctggacaataaaacagttctccctggacattcaaggacccaatctgaggggcaattgcaggaaagaaatcaggctgccctggagctaatgtgactgccacatgctgagtagccacaagggaagccccagttggaaaagagcaaaccagagaggtggctgaggctgtaacactgcctagagcttagtgagctggtttccatttctctgagtctgcccagaggaagcagatgactcagaggaggtgagaaagcccttgggcagagtaggggatgggaagtgtgtcgaaaacctccagtaagtcctactggccaagttatactcttctcattttgttatgaagttttttttgaacacatgcacaagtggtgtctcagccaaagcttcgtctaccttttccatgcacagtgtgtcatcatctcctttaagggtggccttgcttcagtttcagcagcgctggcatcattagcttcatcaatacccagaccgagtttgatcatcctgtcaatcctgttagcacatgtctggggatcttccacactcaagccagaagacaggaacacattttcataaaccaggaagcaacttaatggaagaaactctccaaaaggggcttgttttccaaagaaaagtatagttcagaggagggaaattataagcctacctaggcgtgttgtaaagccattcaaaaatagctcagagagaggattctgaatggtaatgtagtgtccgactcacattctgcttaaaaggattgtaacaaatagagacaagttaaaaagaaaaaaaaaaaagagtttcttctgaacctggaagaaagggatgtggattcaaagctgcttcagtagggaaggtgattttgtagaagaggaggtaagaagtgccatgctccaattcggcttccagtgttatcgtccctgtttcaaggtaaataaggatctgctctcaggctcatcttccgtgtgtagaggggcttagggatctgtggtaggaccttgtaatctgctgtccaggtctcccttcaaagaaggacttgctctgtggctgggagtgctgttggtggacagtcttcatctgtctgcaccttcagaagctgcctcagctgcagagaaagccttgaccaaggtcatgtcctttccagggggattcacatccagtgactgagccagagtgcaaaggcacaactgttgggcccaagaaggaacatctctggttattcgttctggcttcagcactcccggtgggactgtgctgggctgatgttgggcctttaccatagttcacttttctgcccattcatactttctttttcttctgtccaaccataagtatggtttccaaggtttcccctaaaaatatcctgtacccttaactccatcacagaacttgctttctggtgaacccaacctgagaatcaggtatatttttcgtgcaacttacacacatgtgtgcatgctcacacacatacacacacacacatgcttcttttaaatcaaattaattttcttaagtgaaatttatttttcgtttctcctgagaattagctataaaataatgcctcttcctctcctactttctttttccaaagcactgtttcatgctaataggttattaagaccaagtttgcatggttttgcttcattaccctttgaaggtcctggtactcaaactaaaatggacctgcccctaccctgatctacctgacagactcctcttcatggataatgcagactttgatgagtcagatgaactatctcctctcaagggagtctatcctggtacacccccctatctctgtgagcacacacaatacgcctgattatactgacctgattgtttcatctcccctttctaggagtttctttgtgggaagacgtagtgtctaatttatcttcacatctctgggaccagtaaaggttttctaatatatttagtgttcaataaaaatctaatggattaatgaaagtgaatgaaggcagagctccccgtgccgtccattccactagtggctttatggtattaggcaagccacttactctctctgagcctcagttattccatctgcccactgggcttaataataatcaatagcttgcaaatcagtttcaaacattgaatgcagcaatggatgtccctgttccacttgggattttcttttaagggttcttaaataagaatggcaagcaaaagactgtttcaaatgggaaatgatttgtgccttcaccccattggaataatgagacactccttttggaaactgaggggttttgacatttaaaggacacactcaattggtgtaatggctccagggggaaagatccctccctacgctggattttacttcttctcacaaatcaacagaaatgtctccacacactagtgtacttggagtgtgagtgcctcaaaagctgaatgcaggtccttataaaggggaaagtttcttgccattttcttggccatcgactttaaagataaagggatttcaaaaccacattttcaaattactatatggttcacatacgcctgcttcaaaattgttattggtaaattacattctcactgctattattttccccctgatctgttcaataagacagcctttttttgggttgtttgtccaaatcagagttgtgtccaatctggtagtgagaggatgtgcccagaccagaaatgggacctttacttgtgatttaagcataccagaaataaactgaaagctgaccacactcctaacacatttgcaatgccttctgggcagtcaggatttggcctcagccactgaccttctcttggtctggactgagaataaagtgcagcaaaaagccagactatatgattgttttaaattgaaatgactttctttagcagaatttattcttcattctcccagggatcaacctcctcttttcctactatctcacccaaaagagtttttaaaagcctgtgggtgcttcggtggagtttggagcattttgcaggatggggagtgagggacagtggtctgattctgcactgccacttgcttttctttgtccttcatccttttttccccactcacattcttttccttccataattcactgagcaaatattttccaagtgcatgctcagtcagccctgggctgggcaatggggtcatggagataaataagatccattcactctttgggaggtacaggctcagggaagaggtgagctggattttctagtaagtccttcatgctgtggtatgtggtatgtactcaaggcggtatgagcagggaaaactggatgcagctcccaactccatgcggaggcaggccccaggctctatttctcttacgttgtgtaagtgtttatttcctgcctctctctttcttatattggtgaaataagattaatttgcagttagtacaatgtctagggaaatttgcccttggaaggcagcctgagacttgtgtgcccactcagtgtgtaggaagcagatctcttacattgctaagccagttgctcacttattcaggtatctgggaggacacctggagcccaaacgcctcagggcctaagactgaccatccttccagatcttgctgtctatttggggtactcaacgtggacactgcattccccgccgccatctacactgcactggagccctgctttggactcgggttcgtcttaaaatagtgagatggtacttctatcaatgacagagtcaggtgcccttttgctccatattctctgccattttcccacaaactcttatcctcaaggaccgttcttttctaccttttatctcccatcctttcacagataaattaattcatcaaaaacatgggggtgggggttactgtcaggatgaggttgttgccctgaagggcagattcaggctgacaaggtcttacccaataataagaaacagtccttgcccagaggagtgtgctccaaaagcagtaatggagggcagtggagcagttatatatgtatatatgtgtgcatatgtagatgaggttcatttcttttttataatacctccactctcttagagtttctgaagcctgcagttttcccctttccgtcagagcatattgtgttatgcgtttcctctgattccatcattttttatccttttgtttatttgccctcatttttctcctcttttatcttctgcaaagccaccttgcttccttccatttattcctgaaggccacgtaacctctgatggtgcctgcatgcccagcaggaaaatatggatgataatgtgtcctgcttgctttgtgttcacaaaagactaaaagcctctagatatttcagtattttatccttgttattattgttattctaacttgtccccatcattatgtattgtgaaattgatacctttttctgtactagaaggtcatgtggaccttaaacagtaggaaagatctagcttgaacccagtataggggaggcttcagaccaaccacaagccataggtagaaatggaaagtgtaaatcagatttccaataagtatcccaggactgggagaattttagttcaattgctcacatttttttttcatctgtagtttgtaaaataatcactggcatttagcatattgaccaaagaactttaaaagaaaaaaaagcatcattctgagaatgcaaacaattaaaatttaatttattgctggtgggagtataaatcgaaacagttaagaagactgttttgcattatctactgaagtcaaacatatgcataccctatgaccaacagttctactcctaggtatacatcaacagaaatatgaaccataataaatacagaatattacttatggcagcactattcaaaatagccaaaacctatactatgcccattgagagtagaaagaaagatgatttatgaaatgtttctcacaccagaatgctgtacagcttcctttattaatatggacaaatgtcatcaatacaatgctaggcaaaagaagccagggtcaaaatagtacatgcaatgtgattccatttaaatcatattcgacctctgatttcagaaacgggttagtggtattcttagaaggggtggttggtgactggagggaagcttctggcgtgctggtaaaattctgtcttttgttctggttgctagttactttggtgtgttcagtttgtgaaaaattatcaagtcatatattcctgtgcacttttgcatttgttcttgaacacaagaaacaataaaacacagtactaaaaacagcctcaatcattgaaatattttctcatcatcataagttttaatggttttataagtagttccccatatagaattaccatgacttatttatcattctcttttgtcagacatttccctcccccagtctgtaacaactatttcaaaagatcaattaaatattaatatttctgcttgtaatcctcctccaagctccattttcagcttttttctttaaaaagtgcaataaagccagtaataacaatgctttaatggctcttgatatggattgatgaattattattcacaagtctttcacaacatttatttctaccaaacaaataaggaaattattttaatctgttaaccaaattcaagttatcactaaactcttttccagtttcctgagggggtttggcatttggtttgaggtgtcaaaatttgtagtgaggattaaatcaatgaagcatgtagaaggtttgatattaaataaattcttcgttctgatcactattattattttaccttttgggcatccagttaatactaccagtattattaaatagtgtatgtttagtgattcctgagcaagaaatctctctatctggcaaaactcaaccagatacatgccttatccttaaggaaatcacattttgaaattaaagtctacagtaggatttcctcctggtaccaagattctgccaattggagaaccaggacttaaagaagaacataattgatagttagtgtacttgtttttattcatcatgtatatgttaaaccttctgccactttagtcaaaaagtctgccactttttgaaatctaggtggtaaatgcagctgaacttcagtagaaaacaaactgctccatgttcaagggcataaaaataaagtaaggcaggaagaaaggtgggagggaagaagggaggatggaaaggtggcactgtactaatttttatgaaataagagcctgacctgatgcagtctgtgtttttccaggggcttctctgaaaatcagttttgctggagcatgtgcaggaaagagcagatacacatgagagaaatagaggctccgcgtttgtgctcaaggagggtaaaaggaactgagatgcttctctgaaagcaatgagcatttgtccaactgacacatggaggttttcaaagacagtcttagaatgatgatagtgaagtttttaagagttgattcatactcagtccaaggaaacatcatcataatgaacccacttgataccaagggccaactgaagagtatcatacaaaattgcttctagctaggccagccaactaatggtctaagttgtcaaaaagactgatagagaatcccagagaataaatgcatgctggtatattatttggtgaaagaaaacatgtaagaggtaagaggaagaaactggaagaatcacttagttgtggtattgacccaaatcgtctaatatttgtcttagaattttagggcaaggagctacatgcaggctttgaaggtcgccatgtccagtgtgactccaggctttgccacataaaatctgtttaattccccactctggccaaagcaatctctgatgttaagttttcttaggcaatgtggatgttaaattttcttagggaatgtgaatgatatgaagaataccttctttcccattgacaatttaatgagtttagtataaagtttctagcctacaactagtatgactagtatctttaaatattgtttttagaaccagaggcattgctctggtcctcaaagagctcagagattaaggctgagaaaaaaaaaaaaaaaacaaaagaaaaagaaaaagaaaaaaaacccttaagcatctctaagtaaaaagctacatgttttttgttcttctaaaattacagtgaactgtatacaagaaacaaacaagtaaaaatgaaagtatattagagcaataggggaaaaattaaatacttgcagtggccaggaaggcaacatgaatgaatgaaatcatcctggtgggttctgtggtcaagtggagagtgcatgccctatcttaaaggagctgaccccagtgcagttgagaattgccatgcaagaaagcaggttcattgttaagagatgttctgatttttcaatgaggaactaactagaatttttagaagtattttttgtgttttaaaaaattgacaaataattaaaatgaggaaatgatcggtgggtagaaagataaatgactaataagtttatatgagttcaggtgtgcatgtctgcgactacaggggtagtgtaggacaaacagtggagtgcatggggatggataacatactagtaaatacaacatatgtgaagaggtgcaaagtctagataggccatgtggcatgagagccacaagtggttcggaatgcttggtgcactgaagtcagtgcaggaagtgtgggagaaagaagctggtggggtaaggggaggccagatctcccttgctgtgtcaattgtgatcaggaatttcagcttgatccctaggacaatgactagtttccaaagggtatcaaacacgtacagcagaatcacattttcaaatttgcattaattctagccacaaaatgctgaatggaaaggaagagcaggggctgaaggtagcatgtttttgcagggattcaggttagggtgacagagaatatactgaaagcagtctccaggcatagaaagaagcagacaagctggccgttgtggttcacacctgtaatcccagcacttggagaggccaaggcaggaggattgctcgagctcagcgttttgagatagcctgggcaacatagtaagacctcatttctagtaaaattaaataaacaaataataaaaataaattttaacgaattagctggtcgtggtggtgtgtgcttttggtcccagctactcggtaggctgaggcaggaggatcgcttgaactttgggagatggaggctgcagtgcgctatgatcacaccaccgcactccagcctggatgatagaatatgactctgtctcaaaaataaaacaaataggcaggcaggaaggaagaaaagaaagagaaagaagaaagaaaggaagaaagaaagagaaagaaagaaagaaaggaagaaagaaagaaagaaagaaagaaagaaagaaagaaagaaagaaagaaggaaggaaggaaggaaggaaggaaggaaggaaggaaggaaggaaggaaagaaagaaagaaagaaaggaaggaaggaaggaaggagggaaggaagggagggaaagaaaaagaaagaaagaaagagaaagaaaggaaagaaagagaaaggaaagaaagaaagaagacagagagaaagaaagaaaaaagaaagagaaagaaaggtaggaaggaagcaggaaagagaaagaagagagagagagaagcaaatggattcagaaacagatttctgggagagggagagaaaatccacagggctggcgtaggggaggaggacagtgagagaggaggatgagggaagattactgttgcctttctgtttctgtacaataagttttacagaagattcatgcctccaataactctctacacatagtaggtaaaaagggccgcttttaaaaaattattctctttataaagaaaaagcaaacttactcctagttttctcctttgtaaagactaaaacagccaggtaaaaatggaaatttagttcactgtgcaattgagttcataactcactgtgtcattacggtttgtcagcatctgtaattgaaataatcccccagatttgtgtcactatcaccaggttctgtaagtctcaaaccttaaggagtgcatttttgcccgagaaaccaccaaccccagtcatcttcttctccattaaaaaagttgttgactaagtcacacgcaagaaaatgtgcaatagatcttgcattcttcacttctgttaaagaaaaatgacactaacaagatatatgaatagttattcaaatccaccatggggagtgacaacaaaatgagaaaaacaaaaccaaacaaaacatttgactacatatatcctctcctctttattctacacactctctaggaaagaaataatgaaccttcctctatgatctgcttgtgtttataattgatttatcttgtggttaaagagatttacttaccaaaattgagacagacaggagaatgtaattggggtttggcctcctggcctgcttgggtatcacttacgggaactgaaaataaaataattgaacacatattgtattctataaatcattacttcagaatgcaagacgagatctatcccttaggataaatttctatggatgtagcaagtgaatgtcatacatatatttatgagtctgctgacctggtgggatttaggaaaaacagcccttctctccccactctcccctgccccatgtccccctcacatcctccccatttctaattatttccttgctttcctcaaagccattgacccaccattgggccagtctgactaatgccaggaattctttaaattatctattcattcctttaacttacagctttgtttctcacttaacatctctattccctgtctaagattatgcatttcaatttctcatctgatccactttgataaggacacatttgtatctggtcatttgtcagacaaagatttaataaagttgtagaataatttctagaatgaggctcagatgagagatcctaagggtacagaaaacgaatgacaagttggtcctgaccttggtattttcccttccaccttttcctcctctccattagtacatctggtagacctcaaaggcctgtgtgtggctttcactcatccatatgtgtagacttgagcctgaagatttgaaacaaatgttgtgttctttaaggccaggctgtacctccacctcccctgggttctcccaggagtttcagcaccaaataaataccttctaatgggacttagcttaatttgccggcttgtctttcaacacacgtttttctgatatcagaggggtaggctggtggaaaactggatttctgatgggaacaaaacactctgaaatattaaatctgcctgattcttgaataattttcaagaaacatataaaatctctctgaaatcttcaagatatatcctcagcagaaagttacaagcctattgtgtattccacaaaaaagaaatctgtcttctaaatcataatgtaataataagctcattattaatcagcttaatttaaggattaatcagcacatatatattaagtaactggttctagccattgtgaaggtgcaaaagaaggcataagagagcagcagtgattgaacaggtattgtattctatgttattttttttctttctttttctttctttctttctttttttttttttttgagacagagtctcgccctgtggcccaggctggaatgcaatggcatgatctcggctcactgtagcctccgcctccccggttcaagctatttttctgcctcagcctcctgggttcaagcaattctcctgcctcagcctcccgagtagctggaattatagatgcctaccaccatacctgactaatttttgtatttttagtagaaatggagtttcaccatgttggccaggcgggtcttgaactcctgacctcaaatgatcagcccgtcttggcctcccaaaatgctaggattacaggcatgtaccaccatgcctggcctattgtatgatcttagtgaagcctcaccacacacccacacaatagattgatttttattttatagatgaagtagctgaggcttaggtaattccatggtcaatatggctaatcagcaagtgacatgcgtttgactccatgtctatctggctctggtctatccaccttccactccactgcactgcactgtgcaagcattaggaagtctactgaagttttctaagttggtgtacctaacagcttctgtctaactttgccagaaaggacagtcccactctgtgccttccacttcagatgaaagtgtgctgtggactgtgtgagaactttttttttcacaagaaacatggccatctgaagttttactcttaaacttgtaaaatacaggaactacaatctttcactttttttgtatgtatacggaaagagcttgagggagggggttcccagcctagaaggacatgtatttttttcttaactaacttttattttaggttcagggctagatttgcaggtttattatgtgggtaaacttgtataacatggatttgtcgtatagattattttgtcacccaggtactaagcttagtacccaatagttatttttctcttatcttctccctcttcccacccgacaccctcaagtaggacccagtgtctgttgctcccctctttgcgtccaagtgttctcatcatttacctcccacttataaatgagaatatggggtatttggttttctgttcctgccttagtttgctaaagatagtggcctctagctccaccattgtttctaggacatgcatttatttgaggctctttggaattccaactctcactgaaactttaataaaaaaattaatttagaccttcatgacaacagagaactacttaactcttacccatgccaacattaaacctaaatgtattgagccctataataccttacatttgtttccttttatttaacctcttagggggaacgtcatccagacagaaaggcttcctaggatgcattcgctccttacacttgaatggacagaaaatggacctggaagagagggcaaaggtcacatctggagtcaggccaggctgccccggccactgcagcagctacggcagcatctgccacaacgggggcaagtgtgtggagaagcacaatggctacctgtgtgattgcaccaattcaccttatgaagggcccttttgcaaaaaaggtaccttaggcgctcctgtttctcctgagtgcagtgctgtatcacctatacgctatggtcaggccatgtgatactcacactctgagacagtctttatcatctactctcccgctgtttagagagtctgcatagttcttcaacgtaattgcatatacttattggtattacatgtgttcactggcaatgtaactgaactggatggataattacaggaaaacaccctgcccacggccaaaaagtcagttaagtagagaaagaggtggacccacatttctgttgttagctagattgttagtgaacacattaatatttccacttccaatccctcagcccgcaaatgtaatcaaagaattgtagaatctagccctgggggagccttagagatacttaagccatcttaaattattttttacaacaaagagaatatcagtaaattagtaaacacagtaccgtgtatttggtgaaatctctctattccgcaggtgacttgagcgaatgtctgaggctttaaaagccctgtctgaaagttcatatttagttcattggtgggctgggactgaaacacacatgaaagtcaaattttctgctccaggacttttcctataccccttcacaatctcctgagttcattacattgacacaaattaataatcacggatatacaccttggacaaggaatgaggatcattgcttaaattctctagataaattcaagatacctcaagaaactagaaaatctcaatattcagtataaatacgtaggatttttcaaacataaggaaaaagatttggtgtactcataatttttgcaatattttaaagacggaaaaagtttgttcagtaaataatgtaaacaatattttaagagcagcatttaaattattaaaataaaatgcttgaatcactttgagacaccatttgcaaacaaacaatcagagcaatgataaataattcttctcaattcattaaagcatatcttcgaagcacctttacaaagcaatggtttatttagtccagcttgctactgttggaacttagaaacaaaagggaaaaaaagcactcactgttttatttgaaggatactatagtttgagccctccgttcattcatacaggggccttctcctgaattagtttgaattacttacttattattcctgaagagcatgtcatgcttcttgggagaaaattaatggtaaaaattttcgggctaaccgcatggaagcttaaaataaaacagtttccattccaggggctcatattatgagctaaacaagtaaagtgctgctaggtattcacactggcggaggtctctgaacaacttcccctgagaagtgtgaatgcttccctttgagccatcccacatgctaggaggagcacgaacagaataaatactatgagaccctggcactgaaatgcacaagcattcttctcagcatctctaaccaagtcttttgtttggaagaacatggacagtagacctctctgcatttctctggggacattattcaaagatctcgtagatcatattgttctaaatgtagcctaatttctttttttttttttttttttggctcctttctccaaaaccattcatactaattttcttctgtccacggccctgtatcttttccctgcatatgttgcaacatctctgtgctccctcccacttttaattatgatctgcaagttacataggcaagtgtgtgcctagccttttcatatgcttcgtattttactatttccaaactgttcattctttctgataattctaagaaaattatttcctctatatttagtcctcgcaatgtaagtaagatggcctttttagtcacatctttgagccctgccaactgcctctggggaatgtggccggaactgaaatgggaagccagtggctacaagatggttctgaacagagggtggtctgtttggtgattggggcagccttccatgctatttactatggcgcagtatatttcaaggagatggtgtgtaaatactgaatatatcttggatagaattagggtctttttttcattaccaattcctaggtcagaactgtgtttcattggcgatttttccgtttctcataatgatacgaagaagcaatcatcataaaaaataaactagtaattaactgcaacatatattcctcatccaaacaaatagagcaggtattaaaatctaaatttaacttattggggctcataaaggtggactgacttgctaaatgtcagatttggaggtccatctagcttgtttttggttcattttttctttatgaccctaatttcattctatacatgaacatggtaataggattccatcgtttcaaatacagagcttttgttttgtgtattttttctctctctttctattatcgagatgtaatttatataccataaaacccacccttttaaggtgtataattcagtgatgtttaggatattcacacagttgtataacaatcaccaccatcagtttcagaatattttcatcatctcaaaaagaaattccatgtcattagcagccacttcccagttacctcttcccgtgtccctggaaaccactaatctactttctttttctgtagatttgcccatcctgagcctttcatataaatagaaccatatagtatgtgatctttttgtgtctgatttcttttacttcgcataatattgtcccagttcatccatgttataacattcatcattactttattcctttttaattgccaaagagtgttgcgcagtgtgaaagcaccacagtttgtttatccattcatccattggtcagttaatggatgttgggatggtttcatttctttggctattatacataacactgctataaatatgtacaatttttgtgcaaacatatgttgtctatcctcttggatatatacctagaagtgagattgttgtgtcaaacggtaactataggtttaatctttttgaggaacttcctaactttttcaaatcggctgttccattttacattctcaccggcagtgaatgagggatccaatttcttcatcttcttgccaacactttttattgtctgattttttgatgatagacatcttactgaatatgaaatgctatcgcattgtggttttgacttgcattccctaatgactaatgatattggatatctttttcctgtgcttattgtccatttgtatacataaattttttggagaaatgtctaacatcttttgtagattttaaatttttcttctttttactagtcagttgtaataatttgtcgtatgtttggaatataattcccttatgagatatatgatttgcaaatgttttctccagttctatgggctgtattttgtcttcttcatagtatcttttgaaacactaaattttaaattctgatcaagttcattttctctagtctcctatcttttttatttatacatttaggatcatagataaggaagccttacttaatccaagatcatggtttctcctaagagttttatagttttagctctcacagttaggtctttgatgcattatgagtgaattttcatatttgttgtgaggtagggggtccagctttagtctttggcatgtggatatatccttgtctcaacaccatttgttgatgtgtgtttgttgttagctctcttatcccccctacacacacaccattaataaagaacttgggtaccactgtcatagtgttttaatttaaatgttttttcttcttaattaaaatgtaacataattatttataaaatttatttgaaaatttatttagaaatctagaaaagttaaaacccaatctaagtactcaaaaataatcattaatagggaattgcacttccttctagttttttatccccttgcacttaatataactaagataattttgcccattacattttatattctggattttctttatttcctttcaaaagcatttctatgtaagtcaccaatatttgtaagcatccatcttaatgattgcaatatgttccatctggtgctactaccttctcttgtttaatccatcctattaccagagcattactgctcacagataaatcgtggagctctggcaccacccctgctcaagttgaggttctggttcatctacagtccacgttgtatgacactggttgtgtacctcaacctcaagattccgtggtttcctcatctacgagatgtgggaagcgcaggactctttcacagggagtcgtgtttaacattcgatgagcactctacaaagaacatgggacagcccacagcatgtaaagtctcactaaatgctgactcttcttattgattgaaatttttcattatctaaaattttggtgtaaataatgctacaataaacacatatattgattattttcttaataacagaatttcagtgaaaaaaataaaagtatgtacatttgggtgctctttacatattgccaaaaacctgtccagaaatcatttaatacttatattcattttaatttataccatttatttttactttttattatggaaaaatggcaaacatatgctgtaggacagggaagagtttaagaactcccattcaccggttatctaacttcaacagttacaaactcatgatcatttttatttcatcggtacactcacctcctatcctcctcctttattattttgaagaaaatctcagatataatactatttcatctacaaatattacatcgtatattgctaaaagataagcactcatgataaacacgtagccacaggatcattattataataaaagtataataatttttgaaataattgctcagtgttcaaatttccagttgttttatttttatttaatttgtttgattttatctaaattaattacagcttggatgatttctggataatttctagactattcattacccaggactggtctttctgtttgttctaattccaaatctaattctactactattattaaaaccagctactgttcattgagttcctactatgtgctgtgcttttacgtactttcttccaatcctttcacccatcccaagactgaattcatcctgatttatatttgagtaatgtgagattgaatgggatcctgtgattgcaggacatgtgtagattcaggttttatctccaagtctacaggccccatggaggctcagagacgcaccttccagtaccatcccatttccagctccttctcctacttcatgtcacccatcaatgccctgtcaatacggagatcctcttgcaggtctcaggaggctctgctctcagagacatccagctctggaaaatattgtctctgtcgctaacacatcaagcccaaggttaacttccattggtccactggcaatttgttttgttttgtttttgtttgttgttttgttttgttttgtttgacagagtctcactctgtcacccaggctggagtgcaatggcgcaatctcagctcactgcaactcacgcctcctgggttcaagtgattctcctgtcttggcctccccagtagctggtattacaagcacctgccaacacacccagctaatttttgtatttttagtagaaatggggttttgccatgttggtcaggctggcccgaactcctgacctcgggtgatccacctacctcggcctcccaatgtgttgggattacaggtgtgagccactgtgcctggcccaggtgtttgttttttttaaaatatgtgtcttaccatctcagaatctagttagcataggttcttccaccaagtggatgctcaaggggtgttgttgatagtggctcggtggccttggagaatcatcatggtcactagaaatcacttgcaagttaaatatctttatcctttttggccagtggttttagatgctcagataactcaacccatctgatcaaaagcttaaactcttagattataaagtacaagaaactgaaagaataatagagtccagctgtattgctgaatttagctttatgataaaacagacaatatttaaatattaaaaataactagaactggggctggaggaagagtgacaacagaaatttggtttgacatttctaattacaaaatgcttttcattttcaatttattgtcttaagtataaagaaaaaagtaatatcctgtatatgcccatatctatgttattcctaacagaatgctctgaattttacttccatttaagcacacacacaaatatcaaataaaagtcctttattttgttaactaggaggcagtagctcaaaatgcagaccaaatatccctgagtaaatttactcaaggaaaattcttgaatcaagctgatgataaccagaattctcactgtcacagatgtctgctgcatatttttataaacaggagtaccaaggttgtaacctgcatgataaatgcaaaacactttctctgaacctttagtaaaaatgaactagtattctcaatctgctaggcaatatgcataaatatgcaactttaattttttggcactattacagactgttacagaattttcacaaggtggaacacatttgcaatagaattaggaagaaaaagccaggtattattatattgtaggtgccactaactcaatcagagactttcatggggaatttggaacattccatatgccatttagggcaaagggaaattaatcatgccaatatgggtttatgtttactgtgcagtttttatggcagaggtttgctgcctgatctaaggtgtgctgccctatgaaagagccttccccacacactctgttactgtatagagataaaatttaaagtgaactcaagagcagccttgatctaaggagagtatctcagcatttggacagatgaacatttaataaatgaatatattgtataaagtctattgggatggattcaggttaatttctcttctaacactctgtaagttcaaactgtacttggcaactctcttaagtgctttacatacatcagatcatatacatcagagaaatactgatgaggtaggtgttatgattcccattcatcagataagaaaacattctccacaaagttcattatcttgcctgggaccacatggccggcatgaaaccaagtgagactcagatccagtgctgagtcactcagtgctagttccactacactaacatggtaacagttggtgtgctagagcattcttcaaggaggctgggtgatttacatatcccactaaatgaattttatcagtttttagatcccgtatttcttcctggtggtggcagatctccattcagtgtgttatgctagagggattgtttcccataggaaagcctatttacccaagtcttggctatattttggaactgagtaccaatgcctacacagctaaaaaaatgagtttaagagttggagacctatgtcttttctactttgtccataaatttcttatttgctgttttcgttgttcttcatgatttaccaacatcatagagaattactgctgctcaccccaatgtcttgctctgtatttagagaccatccacaatctccctgagataccagagaagaacacaaactagaactgtcaggttctcagttttgggagtaagatggtgccagtgtatttctctatgcactatgctggaggcagagacatgttatctttgcttctcaggaaattagccaggcaagtggtcattattttgcagatgtatgtagagctggacttaaaccacaggaggaaaacctgagctttcttttctggctatgcaaccctgttcaaggtttgtaacctatgagagcattaagtttttcatttgtaaattaagaatagtgacttctgccacttcaaaattattgtggggaacatgttgtctgatgcatgtattactcctcacacagtgcccagtgcataggaaacgagaaagcagctaaggttagcttgaacaatggatctaaaggtttcaatgtgtgctctcccctcttatattttgcagaggtttctgctgtttttgaggctggcacgtcggttacttacatgtttcaagaaccctatcctgtgaccaagaatataagcctctcatcctcagctatttacacagattcagctccatccaaggaaaacattgcacttagctttgtgacaacccaggcacccagtcttttgctctttatcaattcttcttctcaggacttcgtggttgttctgctctgcaagaatggtgagtgtgatggcatgatacccagcggagtctcagcctgggctggagggacggtgcatgccctccagaactctgcataatttcaacctcaagttggtcccatctgggaagcttatttccagacttccagccaaatccttgattattctttacctttatgagatgcaattggtattcagggccagtgtcaattcactgctgaagtctcaaatgcattgactttaatttgcctcaactgaatagcagtaattctttattatttattctgtgctggaatccattaagtgcaaaggagaacatcataagcatatccgaatttcagaaggacacttgccacatgtattttgtcatctttgcttcagtcttctttactgagggctgttaaaacaatgagcatacatgcaggctgtattaatagaaggcaattgtccaggtcttagagagaagtagttagtatatgagtcataaccttggggaataggtggcttgcttctgggaatcaaatttctttttttcaggctttttttttaaagataatgacaaattgtggcatttgctattttgaaacagaaagatttggggcattttatttgacaaaactatagtactattgtttcacaaatcaaaatgctatcacttcctttatttttataattactcctacttgatacaaaattcacaaaaatacagggcaatattttcctaatgctaaataaaaggattattttttaaattttatttattatttaagcttcaagactagtgataaggtcaatatcatagtatctgaggaagggatcatttttcaatttgcatggtatctaataggttctagtgcctaaattgcccattattaatttaagcagtaggtgagaatcagatttttggaaagcatttggacaaaatgtaatacgagaagttgagagtgataagcaaggtggaatacacttcatgcaaggaatggtgaacgacaccacttaggatggctactgcgagttaaaattttcttctgatactgcttaattccaccctgcaaggatgactattcttgatatagtcatggcaggaacactattagatcaaaaacttatggggtagaacatacaacagtatgatataaaaaacactgtcctgtgatcaagaatacaactttcttccctttgtcatctgctggtatcataagatggggctgggccttggcagattctgcccaagccatgccactgagtttctgcacggacagtggtggaacctagcagaaaggaagcctggagtgtgccccatacacagagtcctctccaggccttatgaggaaactctaaattattatcttgctttattttttctttggtttattcctctttgattcatcttgctttccagctatttacagcatcaaaaaccatgaatgatgaatgggtgtaaagaaatgatcaaatgctgaatcaggcatgaagtgaaataatgatgatggaccacatgatgttaacaggtgtccttctttctaagataaaaatagaagggaaggaaaatagacagaaatagagactaggatgacaatggctcattctaagcccatctggacttgaagaatccacaagagagagggggaaacactatgggtaattagatctgtttatcaatagccctttatgtgattatgattaggaccattctatcaacatagcaggtcttagactctgcccatcagggctttgtgagggtgataaagctgactgaggacactgaggcatggagaagttcagtaggtgggcgtgccaacgaggtaatctatggcacagtggggaccagaatgcaggtttcccaatagtcagccagcagcctccgttctaaacaatatcatcctctaatgatgtcattggaccatagtaagatggttggttacaaccaatgcgagattttttccaaagcatcttttgggtatagttccataggcacaattgtacctgtcaggccatgcctagggaaatacagctgccatgaagacagacagtgcataatgaatataattgtatcaaattgcacacacatatacacacacacacacacaaatatatataactctatactgagcactattttaattaatccacacaacatttacttctcatcacaaccctgtttgattgatttattgtagaaactgaggcacttcaaaatctcacagcaagtaagaagcagagctggattcaccctcccttcctcagtctggtggcatattctgtattcttaaccacaagggctaaactaagagtgtttttaaaatgcacaatgttttaaataatgtgaatctatttcattgagaaagcattcttgaattctaccctgcccctatctttttacatcctgaggtcttactctattaaaagctgcctgatcccataggcatctgcatgttttaaagtcctggctacatgcaggaatcaagaaggtacttgtgccttgtttgtatgattgtttaagtttaggtctcagggcatgtgtgaaagttcaggtatgagtcctgagccaaatatgagtgaccatggcctgtgacacagtcctcaggaggtcctgagaacatgcgcccaaggtggtcaaggtacagcttggttttatatattttatatattttagttagctcaggctaactcatgggagatggatgtccaggacattgttgttaatagagtgtccgccttccccactccagcttggaacacccccaccacaccttgctccagggaacccatagcagtaggtagtgggaaagataccctgatttagaatcctggacatctcttgccatctccttatactgcagagatacaactaagatatgtgctcaatcattcattttttattaactctgtgggtaattactagtcaaactgcacagtatcaggaactgtgaagataagaaaagaaatgcaggactaagtgctgtctaaaggagataaggaatgagagactaaaaaatctgccttcaactttttgaaaggcaatctagatagaggaagcagtcatgtttcccacatttctacagcaatctaactagaagggagactttgactaaattttaaaatgaatcttctaaaaattcagggattataacagtggaataaagtaccttgagtggtagtgaattctttgccattggaggtcctcaaataataatgcatgactatttgttggagaaaccataataactatcacaggagtagatgagaggaaaaaataataacctctgagtttcttcccaagtcttagattttgtgattctttattcccttcttgtgtagtcttacattaatatttctttctgttaaggcttcatttgcagactttgaaatgctgctttgaggaataaagaatcgatattcttacagcttgttcccagtatgtttgttctattaggccattgacctaattaccagagaatcatggggggtgagaattgcattataaagaactgggaatattttaatgtgactttgatacactgtcgtgaaaaaaaaatacctgtgaaaatactagtgggagttaaggtttattagaggttgcaaaaagatcagaaaaccacagggtttaaagggggaggttatttattatctgtgagagtttttatgataagattgattcaaacctccctgagaagaactgagagtcttctgttagtctagctgtcttaacctttgtgactgaagatagccttgggaatctggtggaaattataagagggccactcttacagggagcccattttgctttctccaaataaaatcaagtatccgcctccaggttgtgcacaatggctctaattttagcactctgggttaagaagtcagcaggtggagtaaggtggatgagttgcataaacactgcacacaattctcagcttgcaaatttatttaatatagttgaacgggccagaggaaagaagatcaacgtgattcaaagtcatggttataagtctctccctggcaggggtttgattttccagggttggaattcttctgtgccctttatcattattcttgaaatttctccaactagagaatcattctggttaaactgctgctatcttttcaaaggaaaacaggtacttcttcctaaacaaaaagaaattagtttaatttctggaatggaagaacagaggcagaaagagagacattttgaggtcacagagttgttaggaaagagaaggcagttttagttctataacctagggctgtggccacagacaacttctctgagtctggacggttggaggagaaagggtcttgaagacaggaaaagggtacagaaagggagatgagctcattctcaagatacacaggactttcacagaattttatttagtgatggctttgccttctccacagtagtggggatttctctttcaaatttgcaactcagaaaatattcatggggcacttaccatgtggcagatactagctcatgtactgaagagacaaagacagatagaaaggatccttccctggctttaagaaatctaactggccaggcgcggtggctcacacctgtaatcccagcactttgggaggccgaggctggcagatcacgaggtcaggagatcgagatcatcctggctaacacggtgaaaactcatctctacaaaaaattagccaggcatggtggcgggtgcctttagtcccagctactcgggaggctgaggcaggagaatgatgtgaacccgggaggtggagcttgcagtgagccgagatcacgccactgcactccaggctgggcgacagagcaagactccttcaaaaaaaaaaaaaaagaagtctagttatgggacagaaacatagttaaaaaaacgaatgtcatcgatgctaggtagaagtctgttctaggtagaatgagttaaagatgatcaattctctctgggagagaaggtcagaaaaggcttcctagagagggtgatgcttgagttggtcatgaaagataaattagtgttctccagcagacattatattttttcacgaaaataaagattatttttgattgttcctcattttctccattttattcacattgcagttgaaatctatatatgtgttatgatcaatttctgtttctattcttccatcatcttctttgttgatagaaatgcaaagtcaaatttagaatatgcactaactctagggctatccatctatggtgaaatcctttgggtacacaatccaaatatggttcccagatcaccttctggggaggctgtgcagctgccctccagcaccaaatggtttgtctgactttgcttcaggatttcctttttatcaatctttttttaagcatatgcattcaaaagatgcactgtctgcatttgtgattgcacacaccttggaaggaataatgatgaactgcgacattttatattttgagcacactaactcaagggaggcaagaataagaaggaagccagggagggagcattttcaaaacacaaaactcggcagtggctagccagggctgggttgaccttagaacatcccctgccattcctgctatcttatggaagcccttcaaagtgtaatgctgcctccacatagcccctccctgacaccagcatatgcttgatttcctcagagcagcaagaatcctgataaacagaaggggaaaagcaagccttggaaggattattttgacagcataactaagccctgaccacttcagtctctgggcttgtgtcaagtaacactttgctgattttgaatttaaaattcccagtagtcttttgctatctcccagactttgttttagttgtttcattccctacatttctgtgctttccaacaatctcttgtactttcatcatccatttcacagtaatgaggttatgagacactgtgacctctagagggcgataaagagtcctcctggtcactttctcctagggaaggtcaatggatgataagggcaggacagagggcacttccattatcacagggttagacttgggtggtaagggtgggcctgactggagaaacagtggcatgcttagtagcactggatctggttaatctttcttgtttctcttctctttgttgttgtttatgctttattttctgatatgctcctaagtcccaagaagattgctatgaactgagttgtgaaccacccccttcccaaaatccatgaccctcagtgtagctgtatttggagtaacagggtaattaggttaaatgaaattataagatcggagccctaatccgacaggattagtgtccttaaagcaggagacactagagaactctgtctcctgctctctctttgaatgccatgtgaggacactgagaaggcggccatccacaagccaggaaaagagccctcaacagggaccgagtcagccagcacttgtgtttgtatttcccagcctccagaagtttgagaaaataaattgtgttgtctgagtcactcactcagtctatgacattttattgtagccaactgagccaactttgcaactcattgacaaaggtcaaatgagatgatgcaagtaactatgctgtgtagattgtaaactataaaacacactttatttccttattggtaaaagtaataatatgaatgatctgcatcctggggttatcagagcatgaatgtgaaggctagaatttggggaatttggggttaaaaattaatactcctctttgtatgaaatactctttgtatgaaatactcttaaaaattaatactcctctttgtatgaaatactcctctttgtaatgaaaatgtgcagtgcgtagaggcagaacacttgggcctggaagggacattaccctgaagaaggagaaagataaggtacagggtgtcctcttgaaaaccggctgtctctagtcacaggaaacagattttaatatacacaagcatgaaaacgaaaccttttaagaatgactttctcaattgccccctgacacagaccttcagggaacttccctgatgtctctaaaatagagaggggtgtgtgtgtgtgtatatagagagagagctataataactaagaaacagagttatgtgtagaactaactaacaaagacttctgctcactgcagtgctagtccttgcacaatacacctggggcaacatagtcaaacacaaggaaactccccacctcaaccccaacaactttggctgtggagctagctgggcagcatgtgccagcatcaaagaaaatcaaaatagagacaatagcagcttctaagtcagtcctctaagaccctcagaaaagagctagtatggaaataaagccaacaaatatgtcaaaatacaatcaactctacaaacatctgtttaatacctactgtctcagtttgccagggctgccaaaacaaaataccacagactgaatgacataaacaacaacaatttattttctaacagttctagagactggaagtccaagttcaaggtactggcagtgttggcgtctgttgaggaccctgcctttgtgttggccacctttccctgtgtgctcacatgatctttcctcgtgaatgaggagaaagggagagagagacagaggggctttgctggtgtctcttcttataaggacactaatcctataggatgagaggcccaccctaataacttcatttaccctgaattactttgttagaggcctcctttccgaatacagccacactagagttagtcttcaacatatgaatcttgtggagacacaaacatttattctataatacctgccatgtgctagatgctgttccatgtgctcatggtagaaaaataagtatggtgtagttggcttcagaaagattcttggggttaagattaatatacaattcatctttgtaacgtcagtgtgaggcagagtaacttagcacatagttcacctctgattattcttggatttaattaatgtattttgaatctagtaggaggagaagttacatatacagtgagaggggaaatgccctatagaatccataagatgttataggatgacagtggggccatattggggaaagggggtagctcttcctggtgcatttcaaaagtcttctagtataaataggcatgaatatacattgcattaattgagttcttaatcatattctttttgagattctgtcctgccacctgtgatgtatgtgtgggaggcagggttgcttggggagtgggtctctgtagagctggcattctgtggctctacgttctcacagcctctgggtcttctcactttgtactttcccagtttaaacgactcttcagaaattttccaataattgagcaactgctggttttttcagcaatgctggttgcttacagctgtactgtgagaatcagaataattattatttgcccttatgatgcttcattgtttatagaaagaaaaaaggagtgcacaaagtgccttggttcttcatctgtaaatgtgggataatcttgttggtcaagggtctcacagccgtgtggtggggcattaatgagatcctgtctgtaaagggcttggagaaactcacttgaaagatgtggcataaatacaaagaagggttattacaaaacagaccaaagaacaggctagttactgaactacctttattttactttttttttttttttaagccagggataaagaaaatgggagattgaatgtttagcttttggactggaactctaattagaggtttaaggattaagaaaatagttggagtcagtgtgaagaagcttttctcagagaaaagacatgtttttattcttcttagagcacttgacctgtaaatacttacatcttgagatgtgaaacaaattcaatgaaaggcctgagctcagggcttattcggttctctgtgcagttaattaccttttgtccagcaaggaggccttgaattatcattatttctcctaattcaaagtcattgaagatatgtctccactgtaataagtagtttgacctctcgatgttaagaaataaggactctgactgtcggatgccctgttctaaatctgcagtggaaagatgggtcgggggatagtttccagccttaagaatccagttcaaattcctaacaccagccatatgccactgtctttgatctttcagctagaaaatatttcctagcagctaatacctatcaagtgctgagtatgtgccaaggcatagttttcgtagtttgcaaacattaattcatctcattctcacacaatgactatggagtcggtactagtatttccctattttacagacaaggaaattttggcctagaaaggttaaatgacttgtccaagaagacacagcaagggatcagtggggctggaaatcaaagcccattatatttactttttaacttataaactcttctgctttgttctctgacgtttcatggtactgtgtgtacttctctcaaggaacctgccatgtttttctggatgcttgctcaagcccccatccaggttgtattcttgtctaggaatgccacatttacttcctgtgcaccccaccaccacgtcttgcttgtagatcttcattcaagagaggggccaggcagaaataatggggtaatatatcaggagtgctaaaacaccactggaagatttagaaacacaatgccagtgaaggaacttgccacagatctcctgatatttagcaatttgtactttgatgcacaaggaagcacacaggactaacaagtcaagaaaaaaataccatgcctttattggtgtcagtttctgtaatgcaagtttcaggatgcagcaagagcctccagctccgatacccaccagccaaatcccacagccactgtcaactgaaatgctgtagtggaatagcacacaggggagtgctactttcttggaacaagtgattttaaagtattaatagggctccccaggattttttattttttggtcagaaaaattacatgtgataaatgtatgttctcatttaaacatgaagaatgaatgtgcagatttattatctctcccttcttaaactccttcaaaatgacataaagcaggccaggcacggtggctcatgcttgtaatctcagtacttcaggaggccgaggtcaggagttcgagaccagcctggccaacatggtgaaactccgtctctactaaaaatacaagaatttgtcgggcgtgatggtgcatgcctgtagtcccagctactcagaaggctgaggcagagtaatggcttgaacctgggaggcagacgttgcagcgagccaagattgcaccagggcactccagcctgggtgacagagagagacttggtccaaaaaaaaaaaaaaagacaaagcaatcaaataactttttattttattttagaagtaggaaactgaaaagacaaagacaacagaagggaatttagtatgagtgaaaaatatgaactcactgtgggaaattggagagcagataaaggaggaaggctgcctctgccccaatgtttgctgaacagttttcctgttcaggctaatatgcaagttctttttcacttccatcccaggcttattctttagcatatagaagttgaaccaaagattgtccaaagctgaaggcaaggtgaagatactgggctaaatacggaaataaaggactgtctgcacactgggctatgggatccctagccttattttgtggccctgttcccagagctcttatggtaagactttttttttttctctatactggagataagagtccttgaccatggaagaactgaacagccccatgaaaaacatgtgtgataactggaattatagaaatgtcccctcattgaaaaaaatactttacccatatgatcaccagacagtaaagcccatctactggcctgcgtagctccttcacttgggaacttcagtccaatttgtagtgcctcagtcataagtgtgaacaaataaccaaggctactcagtactttcaccagccttccaagacaaaagatgacaatgaaagcatacaaataaaggtaatggagaaacagaggtgatgcaagagacacaagaaacatcaacaacataatatcttcagctagataggataatatataaacccataaaacaataatatggtatttatttatttatttatttatttatttatttatttatttattaagaaacggagtctctctctcgcccaggctgcagtgcagtgccatgatcatagctcactgcagcctcaaactcctggactcaagggatcctcctgcttcagcctcctgcgtgtctgggaatatagctgcaagccactctgcccggctgggaacatgatctttaaaaaaaaacctggcaaacaatgagaaataacttttggaaatgtgatagagaaatttgttaaaaaatctagaaagatgggagataaaatctgagaaatctcctagcaagttgaataaaaattaaaaaagtgggcaatcaaaaacaaagaagaaaatcagagggtcaaaatgtaatgtccaatatctaatagtatttacagaaagagagaataaatgtggaggaggtgttagcaaagatataattgaaaatattttatagaataaaactgatgtaaaagtttgttctcttacccagcacagtgcatagaaaacggcacacacaaaggcaaaggcaaaatcctaaatctcctaaagatagatgaatcaggagtcagacagatatggaacttctgaagaaaaacactggccatttgcagatagtggaaaaacaccacagttctaagcggaaatggtttgcgaactggaatcctatgtttagtcaaattatcagtcatgtgtaatgtcgttattgaagacttcctaaatatctttcctgggactctacttgatatgcatgcattcattatctgatattgcataaaaactaccaccaaacttagcaccttaacgcaacacacatttatcaccttatatagttctgggagaggtcaggaatctcagcctggtttaactggatgattccagctcttggtgtctccgaggtcaaactgttgtcctgggcaaagagcttgataatctgcttccaagctccctcgtgtggctgttgacaggagatttcaggttcttgacaggctggttttttaatagcgctgcttaaacagcatgtcatctggcttccccagatacagtggagggcagggggaaagggtatagagggaggacacaggaggacagttaaaacagaaattaaagtcttttagaaccttaactggagaagggatgcctagtccaacctgggagagaattacacaagggtgtgaataccaggaggcagggattattggatgccatcatgaagattgcctgtcacaacgtggttcacccaattaaagaagtatataaaaaagaaagacatgagatccaggaaacagagaacccaccacagaacaggccaggtatttcgggatagcagctatgcagaaggcacagagaaaaaccagtctgggtcaatggttctcagctgggcatgctattgccctcccagatcctctgggagggtgcatttaacaatacacagagacatttttcattgtcaagatgggactgctacaggtatgcagtgagtgggagtgagggatgcggcaaaacatctgtaaaaccaggatagccccccgatgaagaattatttggtccagaatgttaagaattttaaagttgaggaaaccaaatctataggcgtagaatgagatacaagaaaacaggccatttggaaggaggatcctagaaaagtctgcaagtaacaaataccagctttatcacttgcatgcatatatcagacaaacaataaggactttgaaaaccaacctcaccaaaatggtgatagacctatacagaaagcatgacagggaatcttatgtgactgggtctcagaaagacagctccttatttacaaatgtgggtgggcaaaagattatatctaaaatggataaatcaagaaataacaacatatttagtaaaatagagttaaaaataagaagagtaatggaactaaaataactgcatgtgaggaggaaggcgagagggtggggcaacagctgctttcttatgttcagttattctatactatttgactttataaatgtattacttcgataaaaaattgaatgcttcaaataaatctattgttagattataaagaaagttgtttacagttttgttaaaagaaaattagtttttttccctaccaataaatatgtataaatatctaaaggatattggctgaagacacataagatgactatgtggacagtggcacacatgcccctttttgatgttttcagttaatgtagttattcaatgagtgaatgaaggaatgaatgaacaatgcatgatgaaataattaaattgaaaacaggtcaggcgcggtggctcatgcctgtaatcccatcactttaggaggcggggggggtggatcacctgaaatcaggagttcgagaccagcctggccaacatggaaaaaccccatctgtactaaaaatacaaaaagttagctgggcgtggtgtcaggcacctgtaatcccagctactcaggaggctgaggcaggagaatcgcttgaacccgggaggcagaggttgcagagagtcaaaattgtgccaccgcactccagcctgggcaaaaagaccaaacctccatctcaaaaaatatatatatatatattttttataatatatataaaatttatatttatatattatataatatataatttatatttatatattatataatatataatttatatttatatattatataatatataatttatatttatatattatataatatataatttatatttatatattatataatatataatttatatttatatattatataatatataaataatatatgtatttataatacataagtatatataaaacaaatgattctaccctttttttaatggtaaagcacattttatttaaatagttcatgctaaggctagtaagaagctcctcattgccagatctggttcaggccttaatctccatgagctacctagagcacacatatggaaaccaaaaataaaatttgaagtcccccaaccccccagtgatcagagtggaatccctcctttatggcagagcactccaaagttaacttcaagaactggtttaggccatgacaggaaaggggcggttggacatactgcattataccctccccacttttggaattcaggaaaagtcaactagcatttgacatcaacccagaccttaaatctcataagaaatatttgcaatctattctctctaaatccagccacctggaggcttcatctgcatgataaagctttggtttccacaacgtcttatcataactcagacattcctttctattgatattaactctttcaaacagtctgaaaaattgtagatctacctataacctggaagccccatctttgagttgtcttgcctttctggaccaaaccaatggttatcttaaatgtatatgattgatgtcccatatctccctaaaatgtataaaaccaagttgcaccccaatcaccttgggcccatgttctcagggtctcctgagggctgtgctgtgtcgtgatctatgatcactcatatttcactcagaataaatctcttcaaatattttacagagtttgacttttcattgacacatgcccttacaagagcattggagctttcttggccacttctcagtcttctggatgaacaccttgtcctgagcctaccctttaaatgttgactttttgtgtcagctctgggttttttttgctttttttgtttttgtttttgtttttttgtgatggagtcttgctctgtcgcccaggctggagtgcagtggtgtgatctcggctcactgcaagctccacctcctgggttcacgccattttcctgcctcagcctcccgagtagctgggactataggtgcccgccaccatgtccggttaatttttttgtatttttagtagagacagggtttcaccattttagccaggatggtctcgatctcctgacctcgtgatccacccaccttggcctcccaaaatgctgggattacaggcatgagccaccgtgcctggcctgttttttttttctttttttttctttttttgaagaaaagatataccctcactgagctaactcatccattcccatttccaaaacttcagctggttactgtatcctgatgaacccaaatctatatgcctagcttgggtagatctatttggccttaaaagaattgtctcaattacttacaggggcaactttacttggttgtcccctaggcctctaaaactcaacacttcacaaaatgaactcaagctctacctcaacacctccccaccactccaactcctcagctagatctgcttctgcttgattttttcttttttcagggaaatgttctacattcaccaaaatgtccatgtcagaaacaagcatcactcttcttttcctctttctcacccctctggagtccatcaaacaccacactttactgaatatacttatattgcatgtggcatagctgcttccacagtctctttaaatctattcaattctttatacaaagatagctttggctatctttgttctggccaccctaatcttggaattagattactgccacggagttcaaattcttctcccaacctctaggcctgtacccttttaattcattctccattctgaccagggtgatcttttaaaaattcaaatatattcatgtcacttattttttgatagcttcccattgcctgcaggttcacctctaaactctcctcaatcccaggctcttgttattctctgaagtttccttttttttttatgattcttacaccccactatactctctgtctatattaagttgtgctcagatgattggatgcatcatgttctgtccttcctctaggtctttgcacattttcttacctttgctcgaatcctctttttttttttttcctgcctccattccctccttgctggaaattctaatttctccaagttttggttccatgtcactttctctgggaagctttcctggtcccctcccaaagactgcattaagagcccttcaactgagctttctgtatcagtctattacagaaattgtcacaagcactgttcacttgtatccactgctatgatctgaattccaggactcagcactcctggcctagcacaatgtgggggcccagtgtctacaggcgataaatactccaccattgtggacaacttttcttagtgaaattgcttaagagcttcttttaaaaatagggcatttttttttcaagcaaaagatccttttttacaagcatatactaatggttcatcttcaaaagagttcactggcatatctttgttgtgcactaaagcacagtgaagaaagaaaaagaagaaattaaattggctaacaaccttgcttaaaagcacagaaataaaatgagagtaaaacttaaaaaagttgcagataataaaaatggattgcactcttcttcttatttctaattttgatagatatttttcttctcaaagggtctgagagaaaaatatcttaaaagggaggcaatttaaaacaggcaaaatattgcattaaaacaaagagaggggaaaaacgtgatcaagtcatcagctccgtaatgctaatactgttggttttcaggtgtttgaattgcccaccttaggtggggcctctaaaaagacaaatgagattagagatgaagtgcctgctagtctaaatgaaagcacaacaatgaaaatcaaagaaacagcacacttaattcccctctgacgttcctgatttccagctctccgtagcaataactaagtaagcctgggtgtccagcaacataggccatcgacatttgtcagaattttcaataaactggcaatgaaagactaaatccatgcaaggtgggagatgaattagcacatagccaaaggtactggaggaataagcactggtttcatagctgaaatattttttgataaagtaataatcctcggtaatctctctccagctttaaataacagccagtctttgtgccggcagtttaattttgttggctgcccttgtcttacaaatatatttagtggagtctggaatatcattttgtgctgaaagctgaaggctttgtcatgctgaagccaggcagaggcaataaatcaaggacaaagtgaaaaggaatagaaatgggctatcggaaacttatttccccagagcggccgagctttcgtctcatgctagcaggtgtattgcatcagtcatgtcttcctgttaagtgcctatgttgtaatgatattgacttacaactacattgcaccctggttggcattgctccgaagtgcttaagatgcatctatgggaaatacatgctgaaaatagcgtcatgaaaatatacaactccagttttcttttctttcttttttttttcttttcctcctctaagatcattcttcccaggaaatgggatttaggtaacttccccaagtcacaccatttgtacatggaaaggtgtataactgaataattttatcctccagtaagaactgtgctgggacacgatattcaacttcagcttcttccactaatttcctcatttgtgtctaatcaattaataaatgacgttttaaaggtaagggaccactataaacttaaaatgatgaaaccaggactaatgttcttcaagatctgtgtttgccaaattggtcattactgagaatggattgtggagaaagaatatttaagtgtttataggggtctgtgtcttaccgttagcaatataaatgaataaaaatcactatactaggaagccggggagctgggttcttgtattagttttctattgttgagtaatacttctacaaatgtgctggattagaagagcaaacgtttcttatctcacagttcccttgggtcaagagtccaatcaccatttgtctgtgtgctctattcaggggctcacaggctacaatcaaggtatcagctgggatgtggtctcatcagaggctcccctgggaaaagttctgtttccaagctccattaggttgttggaagaactcagtttcttgtagttttggttcctattttctttctgggctgccatccagtctctgttcccacctcccaaaggccacgaaagttccttgtggcactccctattggccttgcagcttactttttttttttttttttttttgagacagagtctcgcttttgttgcccaggctggagtgcaatggcacaacctcagctcactgcaacctccatctctggggttcaagtgattcttctgcctcagcctgctgagtagctgggattacaggtgcccactgccacacctggctaatttttgtatttttaatagagaagaggtttcaccatgttggtcaggctggtcttgaactcctgacctcaggtgatccacccgcctcagcctcccaaagtgccaggattacaagcatgagccaccgtgcatggctgcagcttgcttttttaagccagcaaaagaaagcaaatatatgtatgtatggatgagtcttttaatgtaattacagagaggatattctatcacttttgcaatgtaatgtaacctaatcatgcgaatgatatcacatcatcgttgccatattctatgtgtttaaagcaagtcacaagtctcaactacactcagaagttggggttctatgtggggtgtaaacatgagggccaccctagggtgtttctcccacataagtagtccttattattattaaaaactagatactcatatatttgctgtaagcagcaagaatgaatgacttatattaacactaaacaaaattgataaatctcacaaagttaatgttgaaaaaaacagacttaagaaaggcacattctctatacattcattttatataaatttttaaaacatgctaaattaatctgtgctcttagaataatgttaactttggaggtagggagaatgagggaatgcaaggggatttatacggtgatagaatgttctgtctcctaaagtagatgcattccatttgtaaaagcatatggagcatggagtattatatttatttgcacttttatagacataagtacaattattccttatacttcaaaaaaaaagtaaaacaacacaacacacaaaaaaaaacaaaagccctgagttaacttagaatagatgcttaatttctctggctctcagttttctaatctataccatgaggttggtcttgatgatgtttaagtctattctaacagattatagctagagttgtataaagtcttgagaggctataaaactcattggatgattctgaagagctcaggagtcatcgtgtcccagcacagttcttactggaggataaaattattcagttacacgtctttccatgtacaaatagtgtgacttgaggaagttacctaacccccaatgcacttttgttttcttgaggccttattcagctcaaaacatatctatactctactaatttggcaacaccttctgactaggcacctatgttataaccagggtggagagcaggcagtggtgggtgaatctggcctgggggtaaataaaaaggaggtgcattgcagataattttaaaacaataataaaactgagtgcaaatgggccggtcttgtgttaccaccatgtaactgcctttctagacaacgttagccaccgacacattctcacacactgcagcggacagttccaccactgccccgtgttttcacttggcaattgtgctaaactcatataaagcactggctgcagatatagctaagatgtgacactctatgctgggatatatgacatggaagctgagggatatgtgcacacccacctaacagtgcgttcacaccaagaccctcttcaaagagaggtctggatattcagaaacatactatattttagcctcacttgtccctcagcttcctcctccaagccccactgagcaaccatgatccctggaagtattaggtaactggctcccagaattgcttgcttgaggccaagagttcaagaccagcctgggaaacaaagagagacccccgcctttacaaaaataaaaataaaataagcttggcatggtgacatgtgactgtaggttgtcccagctacttgggaggcagaggtgagaggatgacttgagcccaaggggggtttgcatggctacagtgaggtacaattgcactactgcactccattctggacaacagtatgagaacctgtctcttaaaaaaaatacatctccaatttagtacctcttgattatcccttcacttatagcttcaagacaaattctgaatccaagcactgctgaccacctcacccctgcaggctgccatctcctcccccactttccactccatccgctcctgtagccacaagcctcttcccaggccccctgccctctcctctggactgcagtagtctcttctccatagggcacccagagctatccattcacagcatgagagaccaactgcatttctcctctcaaacctggatctagcaggcagtacacaatctggcccttaaagttgatcccagacttttttcacctactgtcataggcctggctcatcgaccttctcattatttctaggatgtgcccagcaggccactgttttgggttttacactaactttctctatgtgcaaacccatttagctcagtttcatgtagatcccttgtctgggccctacatgtcaccttgtctggcagtctttccctgaccacaggctgccatttgaggaacccaaggagtggggcttatagagaccatgccatctccaaatcagccccaaccttcactctctgccttctacttggcttggtgtttcttcatcagcttgttatctggaattatattcttaatttatttgtttgttgcctgtcatccaaaccttaatgtaagctttggagggcacagatgttgtcctttgtagctaggatggagtttagcacagagtagatattcactacagtattcagttgactgaatgattgaaagtctggtttagcttttacattagtcatattgaattttcactaccacttaggactcctatttctgtttggtaaaatttttccagcaaataacatggcagtatgggtcggtttgaccccatgacctgagctttgttgggaattttaatcatctgtcatcataatttcatcaaaattttcttataaaaaatgagtaaacaactggtgatgctgttaatggagcacctacatgaaagcaacgttcaggccactgtgaaattaacattatcttcaaataatagttggtcagtggagcctgctgggctgagatgtgtttgaatgatttcatcctttagcttcagggctgaaattaagaaccaggttagaccactcaaagttaaaggaaagaaacaagagcagaagggaaaggaggtccaggaagccagaacaccaaaaactgtaagaaaaaacagacattgagaaatagagagtctgggacaaaagaataaaagcagagaaaatatccaggcctcgatgccatatgtccctcaggctttcccatcagctgctcagttactgtgtgtctctttcttaaagtttcttcccttggaccccatgctttctccatgtaggctctgccttacttcctgttgcagcattttagcctggttggtgaaattgcatatcaacttaaggctctagagccacacagctatttgatttgcagaacaacatgtaagggagaagattctctcccttgcagaaatgggccagacctggacaaacaaatagaacttccatgagtgtgcattgttttttctttccttactctggtcttactacacacccagagtcaagctgttatctattgtaagttatattaagcctttagtctgtttttttgtttgccgggaaggtagatgtgatgtcaaacatttgaggcattttgaaagtctcagaatattaggagattttatcatcataataattggggattgaatccatttacagtaaatgtcccagtactactggcccattctatcacacattgagagaatgatggttttccactccataatgatatctaaaccacaatttgatctgtgacccagaagaagggacctgctctccctcaccagttgcttcctaatccctctcctcaggtgaggtggaaaggaaggggaaaaaaaaaacaataaaaatgcagcgaatttaggagaaatagaagaaggaaatgacacaaaggaaaggggggggagaaagaaagcaaaagagaagcaaacattaaataggtacaatccaaaaatcctatcagtggagttcttgtatcagtggagttcttgagttgatgggcttctagtttcaattatttgtaatcttctcttaaatatggtagtccctcatatttattcaacaagtcattatgcgcattatctctttggatctgtataccatgcctgtattaatctgatttgctgtcatagctgacaaatcccaaatctcagtagcttgtaataatattatatgccacttactttcacattatatctcactggctgtgggttagcttctgtgattttgttccatgcagtttttcattcaaagcccccggttgaagcaataactctatttaggattttctatttctcaagatagaagaaaagagtgaacaaacttgtggaaatatgcagtggttctcacagtttgtgctcacaggctctttgtcaaaggaagttggagggttattcccaacatcgccaggcaggaaaccatgcagttcccacaaggtatggccggtctcatggccataagccagggtgtgtaattaccttttataggaaaagtaaatatgtatctgggaacaataatacaacctacattaataccagagtaagttaataaggcttgtgggcccactccacttaccgataagaaaagagagggacagaaaactaaggagaaaaagagcctgacctagatctcaggttatgtaatttccagataattgatatggcctttctatccactttctttccctcccctacttgcattttcttttacactaaggtagcactgctcaaacggcagcaggcaccagaatcacctgaaagactccttgaaacacagatgactggaactcactttcagaatttctgatttgttatgtctggcatagggctttttaaaaaagttttctttttaagcaagttcctagctagtgttgaggatgttgatcctgggaccacactttgaaaaccaccgctttaaggtccatctccagagtagagtgcaatgtacaactgttccaattacctattttttttagcctttttgtagaataagtgaacagcgacttcagtgaattggttctgtaactttaacagctccactcgatcttaggagaggctatagcagccccacagtagtagctctccaagtgtgatccctggacctacagtaccagcattgcctgggtatgtgttggaaatgcacatcattgactctgctccagaactactgactcccaatttctggggatggggcaaagccctctgtgttttacgcagtcctccagatgattctgatgtatgctcaattttgagaaatgtggtttggtcctacagctagactgcaacaccatggtgaggtcttcaggacttgtttgctacatgcctgctgcttgctagaaatgaaagctctcaggtcccatcctatatttactgactgatcttcatgttgtggggtttcttcttgcagagcccctagtctctgccacattacccagccatttagtccatttattacaactgactgtctgcttgactttcagttataattttacccctgaatgatccttggttctgtgctctgtagcctcaggacttatattcctgctcatttccctggccaatattagaaccttactccaggtgtagcttatcagccctcttggaagggggttggtgtgaggatgcttagacagggttgatgtgagagcctctatttctcatgatttgtatttttccattaaaattcttcaccttccttcattacaaccttgtcttaactcttgccctcattctttgagactagctttatggacaattttaaccagtgtattaaaaacataattacagtcatactattgtgtatttatgaaacacaaatcatctaatcagctgattgcctttgcatgagttgttcatgagaaaacatgatgcaattaccagtccccttccaacgagatgtactattgccattttaaaaaagcatttctacatccagaagtcatttagtcttttctttaaataaagtaaaaaaacaaggctgcagacaatgaaatgagagaaacagatcgacatctctaatgattctaggcaaactctgagtcatttcacttcagatctgtgatgtttatacagcaaatgcagatgttatgtttactcactgcagagcatttcctgaaagtcttggcttgcatggaaaactttcatggggtattcttttagacagtgtatgtcttgctagctgagaaaaattttaaagaaaaaaaacttgacctcagaggatattgacgtagaggtatctgaggttaaaatgtcagaaggaagacctttgggaacatgtgaatatttcccgagtcccaactctaccaatgtgtgaccatcatcactgaaatttggtcatatggaggtgcataaggcatgtttcttgtcttcaacgagctcatagtcttgcaaaatacaaacaacacagagaaaaaatgaaatgttttatcataaatgctgtgattagtgcaaccaataatttatcaccaaagcaggcattcacacaacaggtatactttgtagctgttcctggcacaccgcttatatggtcactctagttacagttgataagtgcagatatgaagtaggcttagaacggacatttccttgtgggatgattctgggaaagctacctaagacaccagatctagtgcttattgaactaatatttcattgtcctgttgatctttagagccattcactatatatttacaaactatcgtgttggatgtcgagatctctttctaaagccaaaccattatcaaatgctttgtctccttttcttaccattcacacatttcacctttcaaagaccgtcaccacaccagctccatgccctactggttacgtacagaaagagtaacagactaaggttgacaagcatctgtttaaccttgattttattgcaaaccagccatgacacattctactaatcagtaaacatctacaaacatgagaaggacatcatcagtgtccctgctcacattgttctttggtgcccttatcacactaaagagttgtacaggcagacctatggatgagtcaccactctgacacctcaccagttaggtgaccttagagaagtccctgaacacttctgaaccacaggatgcccatttgtaatagccacagaaccatggagggcattgtatagactgagcacagtatatgtgaaatgccaagcaagtttctgctgccaagtaggtatctggtgcatggtgatgagttgctgtcattattctcactgatgcagttgctaactgcaacatagggctggccatgagtgacagttctgattttttttttctttttttttttttgagacggagttttactcttgtttcccaggctgaagtgcaatggcgggatctcggctcacttcagcctctgcctcctggttcaagcgattctccttcctcagcctcccaagtagctgggattacagatgcataccaccatgccaggctaatttttgtatttttagtagagatgggttttcgtcatgttggccaggctggtcttgaactcttgaccttaggtgatctgccctcctcggcttcccaaaattctgggattacaggcatgagctaccatgcctggcccttatgttcttttagatgagtgaccatgctctttcccaaagccatctggggagtcatcctccctttttaccatcttcgcatgttattttcaattttcatactaacatgtcagaaccagtttgctgcttattcctctgctgtactttcaaacagaaaatagcatgttgttggcaggttctgactgtttgattaaaagaaataaacaaaaatctgtgatgaaacagttcactatgatgtttaatccatcgtgtccatggaaaggggttcattagccagaatctcactctgaaggatgcccaaagctaagagatcaggggaggcttcactcagtaatggcatctggtgaaggttagcatgaaaaaaaatccatggtttgtcaattacttaagtaatatcttgtcccagcatggtgatgctcatggcaactcccattgattggttttgactgctcttggaataatactggagccactttgctcccagctggaagcagagcacgatcagtagtgtctgcctggggtagtaaaacaagaaacagaaggcttctcttaatgtcctaccagtcctaatctgtaaactaattgcaggactaattcctacaggactgtcacacaagcaaagattttatgccttatttattaatttatacacgttccaatccatcttgtactcctggatttagcatactcttacaagctttcagaaatgaaacaaagattagttgacattcatattcttttcagtccacccttttattcctcctaaaaacggtagacttctattcatattacaaatatttcaactacttacatattcttaactattgtaaaaataagagaatggtcaatgaagaggacaatagaaaaacctgataattattagataaattgagataactattttaactatatatactgagagtgtttggtaaatataccgcattctgctatggtctatctacactctattttcttgtatacaaggcatagtgtatgtatgcctcttacctttaataaggataacaaatttactttcttaaagtaattgaagaacagtaatttacctgtttccaatagtatttattttttagatttttatcatctccaatgaatacttgcttgtgcccagggataagtgtgataacacaggggatgtttctatgtaattatttatctcaaagtcccatttaaactgactctccctcaagaaggtcccttacaataacaagacaaagctatgaacagcaccttagacagttgaccttaactatagaacacctcttatactgtgggtggagtgagagtgagtccctcacaaggcaggaagcagaatcttcagggtgagaaatgaatgcatcctaatggcactttcctgcttggataggaactcattcttaatcagaacagcttttgaaatgggaaacacttgtgggaggggaggattatactttagggcctggaaggggctgctgatcaaaagtctctttttattctggaatctggggagaaggcagaaatcatatactttatttttgtggaagacctgctgctgtactacaccaagcattcttgggatcggggcatgacgatgatcccatccaggatatccaggaacccctgaattacatcccatgctttgtatctgttggaatttcctatgaacagcacccatagcttgtattagaagctcacaagtgtctgtaactgtagaagattaagaaggctcaggagttattgtaactcattttggcttacttaataaaagtaaattatagagactgaaatatttctactggatatgcttgcattttagtatgctctgttttttatataacaaacataattgcataatgaaattaatatattagcctcaagtagtttttaaaaaaaaaactgaatcatttggatcttgagatcttactgagttattactacattaattattaaatatcaaaagaagtaccttagtttaagaaactttataaccatatttctaccatatttgaaacctttccaaagtatttgtcttgctgttttaattctaatttcctgggttccttgtgaaggtgaaagtctttggtaagtttcacagcctttcttagtgtcagattgggcccatagaggttcaaattttgattgagtaggcttaccattgggagagtgggatgttaagaaaactcagggatgagtgggaggtaaagagagaaggtggggaattagatgaagtgtggagcttccaggccagattcccagcccctccctggcccctgatcactttattctgggatgaagcccagaataagtttccctcttctcccctgtcttttgctccagggctacacagggtttgcaaagtgtggtctctggaccaacagaaggagcttcacttgtggactcattagaaatgcaaattctgatgctcccctccaacccctaccctctcacatctgcaaaactggaagctatggggtagggcccacctttcagtattttaacaaaccctctaggtgatcctcctatttgaaaatctgctattatagccagacactatttctgaaacacccctgagatagcgctcacctgagcagcaggtaaatgtgtaccttcccagacctcttcctgaagatcctgtttgattgcatctgtgatgagccccagaaaggctggttgtcaataagtaagtatctacgaaaatttttttcttttctttcttttttttcttgagacagggtcttgttctgccacccaggctggagaataccagtgcaatcagagcttactgcagctttaacctcccaagcccaagcgatccttccatttcagtctcttgagtcgctagggccacaggcctgcaacaccacacccacctaatattttttattatttccttagagacaggatctccctgtgttgctcaggctggtctcaaactcctgggttcaagtgatcatcttgtctcggcctcccaaagtactgagattatagatatgagccaccgcacctggcctacaaagattcttcccgctagaaaacattggcattaccaagcaagcttccccaccacatcctgtggcacactgtgtgctggtggcgagtcacaggggttttcaggatggattcccctcaaatctcactgaccaggtgggtctgggtcagttaaagtccttgtactggtcctctctgagcagccaagtcagtgcactccagtgtctctgcagatgtgatgaaaaaagtcatgagatcttctaaatctgatgttttgtcctccagcataacccacgtgaactgagacatccttcttctgtcatgttccttgatgagacttaacccacatgacagacagcagcgcctccatcttgaaccctggtgtcacagtatctgaggttagaggaaggaagtgaagacgaacatagtccacttacatatttttttgatttgtaaataaaatactactagttcagtgtttgtttcgtataatacattttccttttttatcgtaattaccaactaaatatgatgtagcttttcataagtagctctatgttaggctcataaacattaatgcttattgtatgccataatagagtaatacttaaggcaggtgagttcttttgtctgtgttctgtagtttctgtgttttcttcccccacttcccttgttgtctgttttcttggaccaaggctcttcgtatcctagaaactcttcaacttgctgcctctgatttttcctgttctgggtaaactggtagagtaaattgtttccaattcagctccaagctgctcttcctttgagttgctcccacttgcacccagtgtgccatggacagggatgtcagccttgagtgacaggaaaaatgttgtagtttgacagctgagtccactactgctgtaatcttgcaagaactatttaatctctcaaagactttttcaaaggttgtaaagtttgataataatgtctacttgttatttaaaaaatatggtattggccagacgcgttggctcacacctctaatctcagcactttgcgaggccgagacgggcggatcacgaggtcaggagatcaagaccatcctggttaacatggtgaaatctcatctctactaaatataagaaaaattagcctggcttggtggcaggcacctgtagtcccagttacttgggaggctgaggcaggagaatggcgtgaacctaggaggtggagcttgcagcaagctgagatcgtgccactgcactccagcctgggtgacagagtgagactccatctcaaaaaacaaaaaacaaaaataaaaatacataagttattaaggatgaatgcacagaataactaaaaccatgctttgccatatcgtaggttttcaaaatatttgaattcccttctcttcttagtcctatctaagctgtgtttgaatagttggattagcctgagaaatggcttctctataagtataaggcaaatatttgcttaacaaatgtttaccaaggacctactatatgccttgcagaccaatgcaagtgttggcaaaaaaaaaaaaaaaaaaaaaaaaaaaaaaaaaaaaatcaatcacttaaatcattaaagtaagttttgttcaaaagtcttactgaagactatagaatgaggactatagccccagagtggtccttcagagaagctgtcagacttctctgacacagtgtttcagcccacagcttacatatgggggtgggggttcagtaaatgcaaaatcacatcaaaattgctcacaagtgacatcaaaccagaatcacaccaaggttttggtgtaagagtacctctggtcatagattacaaaggcacaatcattaaccctatcagatgtcatcttatgtgcaagaaaaggcaagggctagggtcattcatactttaaggaatatagtgactcgggcaagagatgtggggggccatgtgccctatcctgttttgtcttcaaagtgtctggagagctatacatcattccagagtcaggggcttgtgaaattatgctggcaagctgaaaagggccaaaagggcttcttccctttgccattttgtctcacaagatcccccctttgatcataaatcaactgtctggttgcatttacagaaccagtatggattgttccacatagctaggaagactctttccttaggaaggtcggtgatcttcatttgtatttgtaaggaattgggcagcatgcttactttcctatttgttggaaagcatattttgaatatcttctattttttaactagcataatctgattttctttcctgacatttccctgcacctaacataacatctcaacaggactatacaaggatactagagattatacatagtggtatatacataatagcatcactatcagttacaaattagaaattaaaaaaaaaaattgataatcatgcaacaaaattggaacatgcatttgcatattttttcattaattgtactatgttttttcctttttagtatccatatttattattatttatgaaaaaatttgacctagagcttattataaatgtttttagagaatacttcaaaataatactgtggatgatgaaaactttgaatagccatgattaaaatatgatgaaagttcccagttgacaagaacatctagttatttctattatatgcagtatactaagataattagaatcatgactgacagtgccacatcagaaaaatcaaacttttataaagtttatgtagtctttagaatactcacattaataacatttataaaaatataattttagaaaagatttaacataatcaaaattatagctgataccatattagatttctatgaatttatatattttatgtgatttatagcaataacatacccataaatataatggaaagaggatctagattatttatcatttgataatattttctatacaatctacctaataagtctaatattttaatcaaaaagacttaatttagaattttgatctttgggaaaactgcaaaagatgtcaaaatgtttaaaatacttgatcaaaacagattcacagattattataaaataataattattcatttcactagagtcataacatggatgtaaaatacttaacccttttaagctcagttttcctagttaatcaaaaactgaataaagacaacacaggaattatcttaatagagtgtaaaatctttattgtgtaggccagctactaaaaacataaagaaaaacctcccatagtgtcattgcctttttttatgaaaagcccattcagataactgtcaaatctgatgaaaagagcccttgaattcaatcagacacaggaagagtgcgtccagggtcatgaatgtacactatataatagaggaatgtaaacacaaaactagtaccttgagcagagggaatacatggcttttagtaacaatataggaaatttcctggttacattgaacaattcagacatatcaagaaaagccaaggcacagaatcaagttatacttgagaaaaaaattgtttttctggaccttcaagataaacatttcagcctcaggtcacaacagcagagttagaactggagaaaaaaagttacaagaactgatgaaaaagttgaaagagagagttatcatctcagctaagcaaaaagttatatcttctcaaggagaaaaggaactgaaggcaattatgtataattcacaaatcaggtgcagtgaaataggcaaaagttaaacttttgagacataaatctgaaaagcttcaaaaagaaactgatttcagaattaaaaatcaaaacctcttgcaattgcagtaagagcaaatcagtatttttagataaccttatttttctaacataactgacaaaattttgttttgttttaatatattttaatatcaaagctcaatctttagaaagacaattatgaataatgttatttctattatagccaacttgatcatataaaacatatctttcatacattctcttttcacaactatatcatgacttacccagaccatttatgacatgcttgcactttctggtttgtccaataccttctcttttttaaataaccgctcattttactttaagacaacaatttatgtaagcttctttctcatacaagattaatatctttcctcttaccttccttaccaagaatacatcatcatatccattccattcatatacattcttcatatctttctttcctacttactggttcctttctatcttgtttcatgaataaccactgaattagataaaattgtcctttttctcaaaatgatgcatttttatgcttttcttatatttttccatcaaaaaaccatatttttgcatactttgtatatataattatatattaaaatattttaaattcttagtaaccttaaattttagtcaaaatctaggaagcaagatcttgaattgtctttcatatatcagtattttatatactaaaataatttcctaatttttagaaacatatttccttataacaaaatttttctctcaattgaaaatgacccaagtattgaatgattatctattatttaatttaacataactttaatatttaaaattacatgaaaagtttatttacaagtatttacctaatttattatttttaacagattgcctagattacttatgaaaactgacatattggacaaagctagtcatcatttaaatttatttccaagttgaccatttttacagcctgtgaatatcaagtgtttacctaagtaagaactttaaaattaaatacatgagtattttgatgatagctcagaaaattcggttgttttcattaaaccaacaatattaaattagtcttacttataaaaagaatacacacagatctttctgttttgggctgagtttgtagttttatgacattctaaaacctgccaccttaaaatatctagcagaggcaaatatagaactgtctcttcagtaaatccaggcaaaaatgtatgctgatgattctgaagacaattttatttttattttatccataatttttaaacaagcttatttattaaggattttcttaagtcacatgaactggaaaatatttaaacttactaattcatgagtgctcgtttatttatgcatctacttagtaccatatgacacaacatacagaataatacacatacatatgcaaacacttctcaacatatatacacacatagaaataaaaatattatagttttcatttcagaaatttagttatgagatagtaatataaactcactaatttaaacaagacaattagacctaaattatttccaacaaaattggaacctttttccatgactaaactttatttgacccaataggtaatctaatggaggctgtggaccaaaattttgggtaaagcattttccatgaaagtttttatttttagaaacttcttttaccttttttttccttcaattccaagtgagttaaaggataatacttcaatgattacattttagggagaacttgccaagttgtgtaagataaacaaaatctccagttactaatacagccttgaagtaataatgccgtaaacaatgagttttatctcaacaccagtagaatagacaacagattcaagtaggcagaaaaaataatagagaacttaaaagactctgcaggttaactctatagttgcgaattttttgagtaatgatcatttaagctctgaactttctttttctttttttttcttttcctttttttttttgagacagggtctgcctctgtcccccaggctggagagtggcacaatctcagttcactgcaacatccacctctcaggatcacaccatcctcccacatcagtctctcaaatagctgggattacagatggacaccaccactcccagctaatttttgaagtatttgtaaagatgaggttttgccatgttgcccaggctggtctcaaactcctgagctcaagagatctgccttccttggcctcccaaagtgttgagattgcaggcatgaaccacggaacctggacaaaaatttcccttcctaagaaacaaaagatctcatggaagaacttacccttttgtcaaggagtgtaaataactagctgaataaaactcagcattggcaacaaagtatgagatctgagactcaggagagacccacctagtcatctgcaaatgtggaggagatgcaggggctttaagggccatgctggtaccaaggctctgggtccccacaatgttccaaatggtccttatctgtatactatgggtttcttctgggacaccatgattgttgactaaagaaaatagaattaagctgtttagaaagttaaagttagttttattcagaagtcttactgaagactaaagattatggaatgaggacctcacctaggagcaatccttcagagaggttatcagatggctctgtaacagtgtttcaacccactgcttacatagaggtggtgagggttcagtacttcagtacatgcaaaaatcacatcaaacttgctcagaagttacatcaaagcagaatcacatcagggtttcaattcaagtgtagatctggttttagattacagaggcacaatcattaacttcatcagatactgtcttatgtgtaggaaaaggcaagagctaaggtcattcatattttaaggaatatattgactcaggtaagagatgtggtggggggcatgtgccctgtcctgttttattttcaaagcctctttctgaggagctgcacatcatcacagagttagggactttgtgaaattactctggcatgcagaaatgagtgaacactgcttcttatgtttgctactttgtctcacatgagaaatagaagataataacaaaggaagaaatgtaagcaatctactacattccaggcaccatgtataatcctttatgatagttactattagtattattccacatcatgaaattgaggaagagcagttttaaataaattgctgataaattggcagaaccaagattcgcaccagataccctgctcttaaatttgttttcttgaccactaattcacaaacttcaaatttgagtggttcattctaaagctgatgtctagtatctttaataataaaaaaccctctttgccccaacttacatatgcacaaatgatattttccttaaaaacaatgctttagacaattgattctgttatttcatcttaccagctgtactctctgaaaagtgaatttactgagcacaaatacccagggagaaatggctaattgtgccaccacgtttcctagccagctgttccacacagagagaagtagttcatgtttaaatatccaggctgtaatggggggtattgcagcagaaggcctctgcaagctgccagaacacatttcttgtttaatggcaatggagacaggggctggtgtggtgtgatctgtaagtaacaggacagtgagctcttttaaatcatgctaagggagctctaggcaaatcatactaagggagctctatagtcaagtgcactgtggcactgagggtgctgcttacctgtctgcagctgcatcctcaacaccttcctctatagtgtacttgctttaaagatacctttaaaatatttcacagtatatatatatatatatacttatcaaaggaagtttaaaaacaagtacatgcaaaaagaagaaataacaaatcacctttaaccccatcactaagatagataggctaagatttcattttgtatccagttctctagtgaccttggtaaagtcataaaatgtattgacccttggtttactcatctataaaatataaataataatatatattttgaaaggctattatgaggattaaataagataatgtaaagcacatatcacaatgcttaaaacagggatcataattaataatgacttttatctaactaccaatagatacttaaatgcaaatgtaatcaaactacacagttttagaattatcttcatttaataatatcgtgtaatatttccacattgctacatattggcaaacaaattgtattagattatgtagtttgttttcatctttctcattgttggacactcaggttaatttaaaattttgctacttcccttttccccaaatgttatgatcatttgcttactgctcagtcctttgggtctcaattattgccctgtgtaaattcctggacctgaacgactagatttaagtgtataaaaaaatccttttaaaatcttagatatccatttcaaactgccaggattgctgcagaacttgggaaaggtccatcctgacagcctctggccaagacccaagaatgcaggggcagttgcttggaagttaggaccctccagagtggcgacatccaggtccatgccagagagtttgacgtggtattaatgaagtctgaagcataaaatccaaccctggaatggcatttgacattaccccgtccccaggcatgatgttaagtgtcaggcttctggacaattactgtttgtaggatatctgttatatggtgtgcaagcctggaaaattacattattttttctaaatctaacaaattatctgtgaagtagacattagtatccttattttgcagccacggagcagagaggttagatgacttgtcaaaactcacgcagtaaagaatgaccacctcacttgctctcttctgacttactaaaaacaatacaaaaagattcacagagggcctgtatctcttgtcctagatcacacatactgttatcaacaagaagggcaccaataccctggcaaacatattgcctgttccagtcttttagttagattattcagaaaatatcagagagagagagaaaaggagatgggcatgctattagtagaccatggtaagaaactgcacctttattctgtggccaatggtaagtggcagaaggatttaaaaggcagagaaggtagaagggagaaagatcagacactggagaaaagataggatttccgaggggatagttttaggaaaaaaaatggctaaacacagattttagaaagttatttaccttggaaagctcatgaaagattctgaagttaatgaatggtttccaaaatgctttgtaaaactccacacaaatacagttgcatattattagtagtattagtcagaagctaatatgttaggacagatattgatatcataatgtcatctaaaaatataagtggtctctaaaatgaaattgttcctgccacagacagcttatcctcttacaggctttcattgtcaaatattcatgtcagttttgtagactgtttatagagggaggaattgggaatggtgatttggttttctgttttgcttttgattttctaggagaggattcctgggacacttactcatagtggctatcatgctccctcctgcccgtcctcaagaaagcatagtaacctcccagctctatgtgaatgtgtgctgtggtctatgggggtgcaagtggattgcagtgtgctgtatctgtaataggttccatctgtgctcttgagtgttctgctgatgaattctcactacatccatgggtaatatgccccgggttgttttaagattatttaactatcttcgtgagtgtcagtatataaatatgctcttgcccagagaggtcataatccccactgaacagtgattaattatacacatacctcgtgtttgtattgcagcttcccccagggagctcaaagcactttgcaaatatgaattgcgaataataaataatgcctttgatttctaagacacctatctctaaggtcttaagtttatgcctctctcagcattctactaggagcaaagccctcacaacccaagggcaagagtcagcacctctcatcttcccctgtgagaggggatcgtgaactattcacaggcctgattttaccagagtggaactgagtatgtgagggacaggaatgtataaaggcagggaaagtagaagggagagaaaccagacactggagaaaagataggattttccagagtatgactatcaaaaaaaaaaaaaggttaaatgcagattttagaaagttacttacctcaaaacactcagggaaaattccaaagttaaaacaatacagggtaggtggggcatgtgacactaagtgccatttagaaggaaaaatgtggctttctactaaatcttgactatgagaaatcctcattaatcaacaaaaagatgaggtaggagggaaggttcaaaacatggactacaactataattctcagttaatttgaagcaccttagtgagtaaattccaacattggcgaaaataattcatttcttttgctaccgaagatagttatccagataaaatgtatgtagatcagatggccctatttgtttcacagtttactctatttttagtccctcttttatccagggaaaggggtgggagagttatttgggtcattttttgcttgagcacagaactcaacagcaattaaattatcatcgagcaaaagtgatattttaggcacagttgtttacaaaacagtaaataaataagaaccactggttcctttctatataaacacgcttctcctaggaattcatccatttcagaatttccccttcactaggcagaaatttgaacttgagatgaggattaggcctttcagaattctttggctgctgcctacatagcaaattgtacacattcaattgatatcaattggtaatgagactagcactccaggccactgttttcagtgttcaaaaccacactgacttccttctaatttcctgttgtgcaaatggagctcttaaatgtggtgctgcattaatagaactcttttcagaatcattttaacaatgacaaaaataatgacacagaggatcaagcctaagctgactagtgatgatgatgataatgatgattcattaccttgattctttgtagaatgtctgcaaatgtagcttcagagggattaaaaaataataatcaagataataattgcaagaatagttaacatttaggaatattatgtgccagatactcttaaagtgcttaattcagcttcaaccttcacaatttaatgaagtagaagtagatactatgattatatacattttgcacatagggaggtgaaacactagaagaccattagatttttccaggctttcacaggtgatatctagaggccttgagatctgatccagattgcttagctcttaaacacgattctggcctgcctctcaaaaaacatgttgatgggcacacaggcttaagatttgaactgggccactatgtcatggagctctaccaggattctatctttgaaaggggtgtcttatgaaagaacatagtttttattattatgcgttttgactagtctttcagctggtgatctgggaagaagtaatctgaaggcaacattcctaacttactataaagcaatgtcttatctcatgcagctggctgcgaatcaaatagggtcacagtctacacaaaccccctattcataactcttagatctccatttccgctcttcacttctctccaaaattctggttccacatttgctgctgttggtttgccaactgtagcaaataatatttcacaaaaaaatagtggttaaattgattcttcccctgttgtgaaacttgcattttttttcttcctctattcttacttaaaacacttagtaaattccttatttccttaatgagattagtatttattaactaccatctgccatatatctttctttgataggtactgaagatacaaagatgaatcaaacagaatctctgtcttcccagagctcacatttgattagaagagtcatacattaataaaatatccatactagtagaaatataattatgaactgtttcatgtgacaaaatttagggtactacggaagctcatatcaaaatgagggacaatggggatcaaagaaggctcccctggtgagctgacctctgagagtgggctgggttggctgagatgggtggtgctccttccagtagagtgtatggtttgtgcagaggttctcctatgagggaagatggggtaaggaggaactgaaggaaagtctggctggtataaaggggataaagtataaagagagtatattttatacagagtataaaagggaatgacgtgagaggggctgtgagcagactgggtccagatcactcttggacctggaatcctaggctcatggctcttctctttgccttaacgcctcaatgcacacaatctgccaccaaatcctgtcaaaaatgacacacactctctctctctctctctctccctttccccctctctctttactctcctatggcctcagagctagatttccctttttaaatccaatcttgcctgaactctacctccagccctccagccttttagatgattttccacctccaatccttctttaccctggggcatcccttcattgagagctgcagtttttccttttgatttttctaaaatacattttagactactctgttcttaagaacatttactgattcctgaaacttctgccttataaaccaaaacacagtgggacagagtgaaaagccctttagcatctgacccagcccggctgtacgtggtgcactgaacttcccatcagaagttcccatcaacccttttgtctgaactagaatgtactgtcaattgtgaagggcttcttggagagctccggagatctttgctaaatgtgagggaactcaaactcaattacattttatttttctttcaaggaaaacacacttgtctctttttcaaccttgccataagtgaacaaatacatgtgacaaggtaaaaaagtgacacagttttctttctatgcataggttttctgaatcacatttatggcttcatttagcaggtatttaggcagcacttaatacgtgtaaggaagtgaggagggggaataataaagcttgagaggatgtgagtctctttagcatgaagtataggacatcaggaggagattcctggagagatgactgacaggttgagataagtttagaacatagggcaggtattggactttactgtgttgatagctaaggatgtttattcactgtgaagcaacactatcaggtatggtggaggaagacaactttgctgctgatataggggatattctagagaaaggatggccagtgggaaggcttgggcattacagaatacaagggagatcctcttgaataagctggccctctctctcgccattgcatactgcctcagagcctggaatattttctctgggtcatgacatttgttttgtttgtagatgtgagctccatgaaagcagaggcattggctatgtagtctcagaatccagcaaacgaaaggtggacagtatgcatttagtaagacatgctggctggctgcaactaacaaccttatcacatcacagaacaggtggactcagaggcagaacatggagccctgccccctcacaatccagaaaagctttccacctgattgtctttatgccggtaaacaggattctctgcttatgtcttgacaacttaacgttgtgaaaacagaccaaagttattcatgagctagttacacgatttgttaatgattttagaaaatggtttaggaaatcatctctaattgaccatcatttatactttcatttatgaaagtgcctggagccagcactaactagtctgtcttccctgcacttagcaggctgcatggggctgacagaagcaaggaaaacatgaggaccaagcaatgtgcagaccattctgaccaagttacatcattgacatctttaaactttaaaaattatcattctgagctcaacatacattttttgaatgcatattgagtggtgcacatgagatgagatgctgaggatgtgttgtggagttggttattaaatgcagtgtggctcagcttcctgttatgtgatgcatttgtgctgtgggtcaagttgccacctaccccactccctggaatgacatcattggaaaatgtatctaagccaccattcacagtagtgcttcttttgaaattacccccataaataacattgggaaaaagcaaatgatgggttggttaaaaaaaagtcatagctcaaaagaagtaatgcctcccttcaggatcggagtttggtttcacctctcaaattgctcagcaagtactttcttctacttcttccaagcttacacgcccaccttccacccaaccatagatatgcactccatctttttttttttttaatccctttgctttggacatgctctttcatttagtaagatcctctgttttcttctccttctcatggctaatttttagggtcttcaagacccttcaagacccatggctaataattaaggtcttcaagaccctaattccgggtttatctttccttccaagccttctctgatttcccaactctcctgcctgtggatgttccctcgcagcattcctcttcacagtattataatagtctgcttattgttatgagtaactcatcactagatttgagtgtcatgggagaaagtctgtgtctccttctgtagccagtgtccacaccgttgtccctggtacatgacaggtgttgactatctgcctgttgtatgtggatggaaggtttgcttcccagctgagccctgcactgggatcacagagatgttaataatgtgagcatgagctccttgttagacagaagtgtcactgtcagtggcatttcaaccaaccaggtaacaaaccacaaatcgtgacccaatatttctgtaaaattgcatctctttatactgtcagtatctgtagttaccaaaacttaaaaaaaaaccttcagaaacacagaatggctgacattagttccaaatattaaaaagttttaagtgtcatgctcaaaagcatctatatttaaaagcaattggatcataaaaagtgaacataaaatttacacagctgcctcatcctgaatactttaaagactaattactctgttgagtcctaatgactattgccttcaagccctgtaaattatatataaataagagaagagagtttgtaaatgtaagtgactctaattgggtctcagaagaaagaaaaacagatctttagtagctcgatgaaatctctaagcccataaaacatcggtcagtttctcccatggagttttgtggagtgtaccttttatacatgcaacagagactgaattcaaagggcaggcctgaaccaaggaacctgtttgattttgcttgtatatatgaactgaaaaatataaattaaagaaactcctgatttcataattcaatgtatttttatttccttgaaaaagggctgccattcagtgaagcatacagtaaggaaacctgtcagaacagagtcccatggaagagtagcagttggtctgtattcattcccagtaatgggactctttttctatgcaaatgcattttgagttaaaggtaagacaggttgtagaatattttgtgcaaacgtaaacagaagcactgaaatagaagaagataattgttgcttattaaagtgcttagaatagagctgaatcaagtaaaccagaacccatcactgaatagtttggggatttggtacctgtttactacttcctttgagagttttcaaggttgtttttgaataagaaatgaatcgagccctagaaaaccatcatagttgagtggatctgaaaatgctcagtgcagtgcagttactgcctcatgagaaattctcaaaaagctgagaatattctctctctttttaattttttttttaatttcagtaggttttgggggaacaggtggtgtttggttacatgaataatttctttagtggtgatttccgagattttggtgcacacatcacacaagcattgtacatggtacccaatatgtaacattttattcctcactatgcccccaccctttcctgagtccccaaagtccattgtatcattcttatgcctttgcatcatcatagcttagctcccacttataagtgagaacatacaatgtttggtttttcattccagagttacttcacttataataatagtttccaattccatccaggcatttaggttgctgtaaatatcattaatttgttcctttttatggctgagtagtattccttatccactcgttgatcgatgagcatttgggctggttctgtatttttgcaattgcaaattttgctactataaacatgcatgtgcaagtatctttttcatataatgactttttatggctgagtaatatcccttatccactcgttgattgatgagcatttgggctggttccatatttttgcaattgcaaattttgctgctataaacatgcatgtgcaagtatctttttcatataatgaattcttttcctctgtgtagatactgggattgctgaatctaaccgtagatctacttttagttctttaaggaatctctacattgtttttcatagcggttgcactggtttacattcctaccaacagtgtaggagtgttccctgttcactgcatccatgctaacagctataattttttgatgttttgattatggctattgcaggagtgaggtgatatctcattgtggttttgatttacatttccctgataattagttatgttgagtagttttctatatgctttttgtctatttgtatattttcttttgagaattgcctaatcatgtccttagcccactttttgatgagattgtctgttctttcattgctaatttgtttgagttccttgtagattctggatattagtcctttttcagatgtatagattgtgaatattttctcccactctgggttttctgttaactctgctgattatttcttttgctctgcagaagctttttagtttaattaagtcctgtttgcatatttatatttgcttttcttgcatttgctttggggttcttggtcatgaagtctttgtctaagctaatgtctagaagagtttttttcaatgttatcttctagaatctttatggctttaggtcttagatttaagtctttgatccatcttgagttaatttttgtataagatgagagatggaggatccagtttcattcttttacatggggcttgacaattatcccaatacaatttgttgaatagggtgtcctttccccactttatgtttttgtttgctttgttgaagatcagttggccgtaaatatttggctttatttccaggttctctattctgttccattagtctatgtgcctatttctgtactagtacaaagctgttttggtgactatggcctaatagtataattttaagtcaggtaatgcgatgcctccatatttgttctttttgcttagtcttgctttgcctatgtgggctattttttggttccatctgaattttaggattgttttttataatgatggtggtgttttgatgggaattgtattgaatttgtacattgtttttggcactatggtcattttcacaatattgattctacccatccatgagcatgggatgtgtttccatttgtttctgttgtctatgacttctttcagcagtgttttgtagttttccttgtagtggtttttaaaatttttttttccaccaatgtgaaatgggttgagattttgatttgattttcagcttctgttggtctacagcagagtagcagagctactgatttgtgtacattaattttgtatcctgaaactttgctgaatttatttaccaattatgggagctttttggatgagtctttagagttttctaggtatacaaccatatcatcagcaaatagtgacagtgacagtttgatttcctcttaccaatttggatgccctttatttctttctcttgtctgattgctgtggctaggacttccattactatgttaaatagaagtggtaaaagtgggcatccttgtcttgttccagttctcagggggaatactttcaatttttcctcattcattataatattggctgtggctttgtcatagatggcttttattatgtaaaggtatgtctcctttatgcccattttgctgagggttttaatcataaagtgatactggtttttttctaatactttttttctgcatctattgagatcatcatgtgatttttgtttttaattttgtttaggtgttgtatcacatttattgacttatgtctgttaaaccatccctgcattcctggtatgaaatctacttgatcatggtggattatctttttgatatgttgttgaatttggttggctggtattttgttaaaaatttttgcatctatgttcattggggatattggtctgtagtatttttttttttttttgctatttccttccctggtttttgtattagggtgataatggcttcatagagtgatttaggaaggatgccttctttctctatcttttggaatagtgtctataggattggtaccaattcttctttgaattaatgatagaattaaactgtgaatccacctggtcctggccttttattttggtggctatctttgtattaccatttcaatctcactgcttgttattggtctgttcagagattttatacctttctcatttaatctaggacggttgtgtatttccaggaatgtatccatctcctctaggttctctagtttatgtgcataaaggtgttcataataacctttaataatcttttgtatttttgtgttatcagtagtaatacctcctgtttcatttctaattgagcttatttggatcttctctcttcctttcttggttaatcttgctaatggtctatcaattttatttatcttttcaaagaaccagcttttttttttcatctatcttctgtattttgtcatttttgttgttgttgttgttgtttcaatttcattcagttctactctgatctttgttatttcttttcttctgctggctttgggcttagattgttcttgttttatcagttccatgaggtgtgaccttagattgcctatttttgctcctttggactttttaatgtagacatttaatgccataaactttcctcttagcaccacttttgctgtatcccagaggttttgatagatattgtcactattatggttcagttcaaagaatttttagaattttcatcttgatttcattggtggctttgttcattttaaaaaaaatttttttgtctttgttgaattgggttaatttcacagccttgtctgtgagctgtgaagatctttctcccgcttgtttgattggactgctgagactttccggtgcatttctctaagtgtgtccttcatttccaggagttgtaattgtttttattttactgtctatttcactgaggaatttctctttcatatcctgtatcaggtttttgatttctttaatttggacctcacctttctctgatgcctccttgattagcttaaaaattgaccttctgagttctttttgtggcaattcagagattccctcttggtttggatccattgctggtgagctggtatgatcttttgggggtgttaaagaaacttgttgtatcataatgccttaattgttttactgattccttctcatttgggtagactatgtcagagggaagatatgggattcaagggctagtgttaagattttttcattcatggggttctcctttgatggggtgttctcccccttcccctaggaatggggcttactgagagccaaactgtagtggttgtttttgctcttctgggtctagccacgcagtagagctactgggctctgcattggtattggagagcttctgcaaagagtcctgtgatatgatttgccttctgatcttgcagctgtggataacagcaactgctgcagtggaggtagcaggggaatgaagtggactctgtgagggtctttggttgtgtttttgtttagagtgctggttgcatgttggttggcctccagccaggagagggcacttttaagaatgcatcacatgtggccctataaggaggatgcattcttgccttaggaacacctggctgagtattcaggattttcaggtggggagcagggccatagagctcccaaaagcttctgacctttgtctttcactacaaggatgggcacagaaagaccaccaggtaggggcagggctttctgagttcagcctctctttgggcagggcttgctgcagctgctgtggaggatgtgggtgtgacttcgagtccaatggagttatattcccagggggattatggctacctctgctgaatcatacaggtcaccagggaagtgggggaaagcaggcagtcacaggcctcaccccactcccatgtagtccatagtcctgaaggctggtctaactttcattgtgcccctccaacagcatcgagtctatatccaggcagccagagaccagggctgagaacttgccccaaactatgagtttcctagcagagaaagcaagccgacttacaggcttttggtatctcagggaccctgcagtggtgatccagttccttcaaagggtctgtgggttctcttagctttcctggtacgttcctgtggtagttcttggagcaaaagtttacgacgtgagtctccacacactgctctgtccatccaagtggcggctgcaagctagtcctgcctgctatctgacatcttaattctcgagaatattctcttgaggatatctaattcttttctgttctaatcttttcttaccttgcttaagatggaaattatggaaaataaccttaatgtttacttttgtcataaaaattggctttattttccatagaatttataatttttaagcataaagtgtctctttttccaaaaagcttaaaaatatttatttttaaaaaaacttggagtcatatcattgcatttaaaaaaatgtttacttgactaataaggattgaatacattcaagatgtacaatgtgatgggtcgatacatataaacactgtgtaatggttaccacaatcaaaaaaacacatctatcaccacccatgctttacattagattgcctgaacttgttcactttgtaattgaaaatttgaccaacatcctctcgtttccccaaaccccagtccctggaaaccgctattctaccttctgcttctatgatttctacctttttggattccacatataagtaagaacatacagtgtctgtctctctgtgtctggcttatttcactttgcattatgtcttccaatatcatccatgttattgagaattaaagtatttttattatttcctgtggctaaataatgtaccactttttctttactcactaatctctcaatgaacactctggttatttctatatcttggctactctgaataatgttgaaatatacatgaggtgcaaatatctctttgaggtactgatttctggatatatatccagaagtaggattgatggatcatatagtagttctctttttaatttgttgaagagtcttcaaactgttttccataagtgccataccagtatatgttcccaccaacagtgtacaagggttcgcttttctccacacccttgccaacacttgctacctattgtctttttgataataaccatcctaacaggtgtgaggtgatatcttattgtggtcttgatctgcatttctctgatgagtagcgatattgagcaccattttgtagatctgttggtcattgtatgttttctttggaaaatatctatccagaacttttgctcacttttgtcattgtttattctttgctattgagttgagttctttatatattttggatattaaatccctgccagatctgtagtgcaaatattttttcccattctctaggtcacgttttcattttttcaactgtttcttatattgtgcagaaacttcttagtgtgatgtggtctcatttatttattttggattttgctgtgtattcttttggtgtcatataaagaacaaatattgccaagactaatattaaggagtttttcctccatgttttcttctaggagttttatggtttcagatcttatatttaactctttattttcaagtaaatttttgtatgtggatccaacttaatacatgtgtatgtgtgtatctatcttttccaacaccatttattaaagaggttgtccttttttacattgtgtattcttgctgttcttatcaaagtttagttgatcacaaatgtataggtttatttctgggatctctcctctattactttagtctatgtgtctgttttgatgccagtaccatactatttttttgttttgttttgtttttgtttctaattaggaattcagcatggataacataagcttttgatcactatagttttgtaatatagctagaaattatgaagtgtgatgcctccagccttgttcttctttctcaaaattccttttgctatttgggatcttttttgattccatatgaactctagaattgtttttctattgctttgaaatatacaattggaattttaataagaactgcattgaatttgtagctcatttgggggtggtatggacattttaacaataatgattcttctaatctatgaatgtgggctatctattaatttatttgtgtcttctacaatttctttcatcagcgtcatacacatttaacatttgattgtacatgcaatggttccaggacaagttcttaacaatgaagcttggcctcagaatggtcacaaattgtattttagtcttttgctctgggacgcctaactgagtgggattatctatgtctttatttaaataattttcattaaatgtttttattttctatgatgggggctaaggaaggatgtcaagtatggctgctaaccttcaggaaaattgtaggccacagccaaattagagggaagaactgtgtgaaatggcccatatttaaatgtccaacccaattaaacagacctacagttgtcccatatgtaaaattagcgtaaagttaattataagtaggccatatttttcagattgaaggatgaaatatatgaaatacatttgagatagttcctagaacaaaatgggcaaccaatgatattttaacgatattggtaataacagtaaaaataggtcactaattttgtttcccccaaattcatgcccacctggaactgaggattttatttatttgtaaaataaggtcttaacagatgtaataaattaagttaaaatgaagtcatactggataaaatgggttctaaatccaatgactggtgtctttttaaggaaaatgagatgtggatagagagacacagagacaaatagggacacacagagggaagagggccatgtgacatgaggatagaagcagagattggagcaatgcacaccaaagaacaataaggattgtcaggagctaccagaagctgaaaagagacaagaaagcatcctccccttgaaccattagaggacaagtggacctgctgatatttctgtttcaaacttccagcctccaaatttctattattacagttgcccaggagacaaaacagatggtaaatggaaccacagcactggatgagattgtgaaagcagtgagtattgatagagaagttcctagaccgagcccggggactttaacatgaagaaagcaaggtgacatcgagaaatcagcatggagagagagaatgaatgaccagtcaagtaggaaggaaactaggagagaaaaatattaggaaattgaagcattttagaaagaaaagaatgtgactgtattgaatactaataaaaataagatactgattatgaaaggaaaattcgatttatcaacatacagttcattggtgaattaataataaaatgaaagttttggtggtagcttagggttaaaatctgactggaataagtttcaaaagtaaattaaaaagaggcattagagaaagtatagataacgccttaaaagttttactgtaaaccatcagggagcagagaaatgtgacattagctaacattaaaagagttgcaggccgggcgcaatggctcatgcctggaattccaacactttgggaggccgaggcaggtgggccacctgaggtcaggagttcaagaccagcctggccaacatggtgaaaccccatctctacaaaaatcagctgagtgtggtgacaggtgcctgtaatcccagctactagggaggctgaggcaggagaatagcttgaaccctggaggcagaggctacagtaagccaagaccttgccactgcactccagcctgggcaacaaaagagaaactccatccaaaaaaagaaagaaagttgcagaagtttccttttagatacaaaaaatgctaatgggaattatatagcagaaggaatcaaattttaaagagaattgtaaaggaatggggtgttgcctcagtagtgtctttacaaggtgataacgatgagaaggaaagaatacgttggcatcagataaaaaatgaggataattcatctaaattaatgaaaggaaagtcagcacataggggttcagctattgacacgtcagtaaatgtgggggcgggactttgtggttcttttacaaatgtttcagttgtcttcgagaagatggagacaagattattagctgagagtgaggaaggagaaggcagaaatgaagagaaggcattatatggtcgccttagccaataggtgaatggataggagaaagaagctgagattaagaggagggggaaggcccacatgaagttggcagtcctggatataaagtggcttataaacagtgtgcatggtttgtgttttcttccaccagataaaccattcaaaagtagggtaagcaggcattgttcggacaaacaaatatccactttcaagaagcaagaatgggccaagggacttgaggctgtaaatgagaggatagtgatggaccagacaatatgagctgggaaaggagagaggagaggacacaaaggagttaagagctctgagtagatggtgagattaacccttacactaagtattggagaagtccaggcattagaggaagggaattagaaagggaagagattgtagtcagaaaacaaaattcctacagttgcaattacggagggtttgcaattattagtactaacaaatactgaagtctgatattgagtccatgatgcactaatcaattatgactgacagcttgaaaaacagttagatggaggtgctgaagtgggtgtgcatggatatggagacattattgtgtggctctcatgggacctaagatgtgaataaggaggggcttcctggcacagatctgtatcaggagcattctaggtgcagagaaaagcaggaataaagtctccaaagaaggagtgagctagcacattaggggaacataaagtaggtcagtagtagttggagcttagtgggtgagggcaagtgtggaatgaaatgagaccaaagaggtacaagggaatatgatatagtttcttgcagaccatgtcaaagaatttggattttattctaagtgcactggagaatcattaaacattttaagtagtggcatctggtttatagtgtaaatgcttattttgactgctgtgtagggaatggatgggtgtgggagaatgaggaggtgaggctggaatctgggagacaagttcagatgtgttgtagttgttcaagtgagagctggtgatggactgccttgcggcatggtgaagacctggaaagaagtgcaaagatgcacaatgtatttagtagagaccagagggctgtcgatgacttggtgtggggcacatgtataggggttctggtcaagaaaatgaaacaaaagaaacaagtatggctcctagaattttaacctgagcagccagcacagaggggtgccattatgtgaggtggtaaaaactaaaaggggagctttttggtgaggacaatctggttagcagaaactgaaagatgcataggaagctgtctaagtctaggattgacatgaactgatgtggaatagaaaagaatcaacatggagaagagcctgctctttcaaagtgaaatggtaaagcaagaaactagcaatgccgtagtaaagggagaatgagagcgaactcttatccctcagtggtggtccagagtctggatcagtcatccctttgatgatgtgagggccatagtgctttgtgtctttccctttagatcttatatgtacattgtggcacccaggctaacattcttaaatatcactttgtgtcacacatgtgtttgctgctcctaatggaatccccctttacagaaacaggtaaaatttccttggcattccttgccagtgtggtctctttctttaacatttcattccaagttcccattccttttgtggggtcacagtttccctacttttcaaaatgatgaggttggttgtgcaaatggctgctaaggttctcatccgctccactgtcctacagttctacagcttcaggtacggtgagatccagctacatcactctgtttacatcatagttaatagtatatcactttttgttttccaaactaagttctatcttgcttctacaaaacttcttcccagacaaactctttctaattacctccacgcattttttttaacttttattttagattcaggggtacatgttgaggtttgttacacagttcaactcatgtcacagaggtttgttgtacagattattttgtcacccaggtactaagcctagtatccaatagttgttttcttgatcctctccctcctcttaacctccatcctcacgtaggccctggcatcttttgttcccctctttgtgtccatgagttctcatcatttagctcctacttacaagtgagaacatgaggtatttggttttctgttcctgcattcgtttgctagggataatggcttccagctccatccctgttcccacaaaagacatgatctcattcttttttatgactgcatagtatttcatggtgtctatataccatatctactttatccaatctgtcattgatgggcatttgtgatgattccatgtctttgctattgcgaatagtactgcagtgaactttcatgtggatgtacttcaacccttataaccacttattgattttgaattcacaaaacatgtattccgtagcactgatcaaatcttctccctttccctctgcttatacgtccattcctctatccatccactcatccttctatgctgccacacatctcttttgaggtagcatgacatagtggaaagggcacatactttatatacatctgcactccttggtttaaatcccatttcattatgaatattctcattacagttttacttgtggagtttttatacctctgtaaaattccattttttaatctgaggatttaatgaaaaacctatctttagtaccaggttaggtgcctaatacagagtaggcacatcagatcagccagtgtgactgttgcttttgtctccttcaactagattataaggtctttgaagatagaactgtagcattatagccatttgtttctctagtgtcttacaccagcaggcattgaataaatgttagtttataatttgggggaagtgttgataacattctccatagtggctattttattcaacaaatgtcttctggagatttaagatagcatgtcccatgttattctctttagacacaaagatgaataagcaacaattcctcctaggggagcttagattcaagaggatgagaaagacaaaagagtcttgataaattgagatttgtattctacgtgaccagagtggcaatatggtgaaaagaaagatgttattagtctttggggcaagtggggacctgggtcacatggactgggtcttaaataatgaggaggagcttgccagacatattaggaggcaagtaggtgttttcagctaaggggaaaagagaaacaaaataaaacaaaaacataacaatgtgcagaggcaaggaaaagcatttggagggatactgcgtgttcaggtgtgtgactaagatataataatacatacataataaagttggaaaggtaagaaaggacattgaatgtcatggtaagaagttggactttctcatatagaattagaaagccttgggcttttgctttttttttttttttttttttttttttttgacagagttttgctcttgttgaccaagctggagtgcaatggcacaatcttggctcactgcaacctccacctcccaggttcaagcaattgtcctgtctcagccttccaagtagctgagattacaggcatgtgccaccacgctcggctaatttttatattttcagtagaggcagggtttcgccatgttggtcaggctcgaactcctgacctcaagtgatccgcccacctcagcctcccaaagtgctgggattgcaggcatgagccattgtgcccagccacctcggagttttttaggcactagagtcatatggccacatatgtgttataatattcatattaataaaagtgtggaaaacagattagagtaggaagagtagaatggtgagaaaaggtaaaacagaaaaattatgttcttgtacaaccaatgtacgagagtatttaccctaagtcccagctcaagatactgaattagatatttgaacttttaaatttaattaatgtaattttattttatttttcaaaatgtttattttcataggtttttggggaacagttggtatttggttacatgaataagttctttagtggtgatttctgaaattttgctgcacccatcacccaagcagtgtacactgaacccaatttatagtcttttatccctcatccccctttcacccttacccttgagtccccaaagtccattgtatcattcttatgcctttgcatcctcatagcttagctcccacttatgagtgagaacttacaatgtttggttttccatgactgagttacttcacttagaataagggtctccagttccatccacgttgctgcgaatgccatttatttgttccttcttatggctgagtaatagtccatggtgtgtgtgtgtgtgtgtgtgtgtgtgtgtgtgtgtgtataaaaaaataaagaaattgtgtgtgggggtgtgtgtatatatacaatttctttatctactagttgataaagaatatatacctatacacatgcacacataccacaatttcttaatctgctagttgattgatgggcatttgggctggttccatatttttgcaattgcaaatgtcactgctataaacatgcgtgtgcaagtatctttcttgtataatgacttactttcctgtgtagatacccagtagtgggattgctggatcaaacggtagttctacttttagttctttaaggaatctccacactattttctacaatggttgtactagtttacattcccaccagcattgtagaagttttcccttttcactgcatccatgccattatctattattttttgattttttgattttggccattcttgcaggagtaaggtaatatcgcaatgttgttttaacttgcatttccctgatcatgagtgatgttgagcattttatttggacttttagaccctgagttcctggtccgtcatccccttgtcatgtgtagctgaatttcaagtaggatataaataataataaaatgccttgctacaaggtactgggtgatccttggctgagtattagaggtgctttgaaatagatccaacatatcctacttcaggaggagtgtagtatctcttccatgcgaggttctttcttgaagctagttatgtctacttagacgtatacagagtctaacattgatcaacttaaagcctggccaaatatccatggcaagcttgtcagatctgacctctggatacttagagcatgaggtcctgggggtcaaacctgcagggaggcactggtttctgggctgtggctcatggggctcacaggagtgatacaaaaagctgtcctggggatctgtgaccaaatcccagtaggctgagctctctctgaaggggcaaatggtttccactgtattccttggagaccaaggcattgtgttggccaaatgaagttgtggggtggagatggggtgacgaggaagagacagtgagcctccccataagtacccctcccacttcaactcgtgcagctctacatttttttttcttttctgtactagccttcactgtccgcatcatttgaatacagtgttgcaattggaaacaaatttgaaaactactggactcggcatataaggcaatctcagatgcatgcaaaagagatggaaccctaaacacaggcaatagtcagcaggttccaggcagttggtgggagcccaaacctgagtaaattttctgaggtgttacagcctcagatgcaggtgagaaggaggctaaaccagtgcagagactgctcaactccaacaggaccaccagattctagcaagctcctttggcatgccacccttgggattttcaagatacgtatacacccaactcaggccaggcaggggagctcatgcctgtaatcccagcactttgggaggccgaggcgggtggatcaactgaggtcaggatttcaagtccagcctgaccaacatgatgaaaccctgtctccactaaaaaaaaaagaaaaaaaaatgaatagttagctgggcacggtggcaagcacctgcaataaggaggctgaggcagaattgcttgaacctgggaggcagaggttgcagtgagctgagatcgcaccactgtactccagcctgggcaacaagagtgacacttcatgaaaaaaaaacaccacaaaaacaaaaacatatacacccaattcaaggataacacactctaggcgagacagtgtataagaacaagtcaagtgaattggtctctggacttaataaaaataagtactatgagagttgtcctgttccagagaaattattttttagatattaaaaatttcaacagcccttgatgctaaaaactctcaataaattaggtattgatgggacatatctcaaaataataagagctatttatgacaaacccacagccaatatcatactgaatgggcaaaaactggaaggattccctttgaaaactggcacaagactgggatgccctctctcaccactcctattcaacacagtgttggaagttctggccagggcaatcaggcaggagaaggaaataaagggtattcaattaggaaaagaggaagtcaaattgtacctgtttgcagatggcatgactgtatatctaaaacaccccatcatctcagcccaaaatctccttaagctgataagcaacttcagcaaagtctcaggatacaaaatcaatgtgcaaaaatcacaaacattcttatacaccaataacagacagacagaaccaaatcatgagttaactcccatccacaattgcttcaaagagaataaaatacctaggaatccaacttataagggatgtgaaggacctcttcaaggagaacaagccactgctcagtgaaataagaggacacaaacaaatagaagaatattccattctcatggataggaagaatcaatatcgtgaaaatcaagttaaataatgggttatacttaaagtaatgggttataagttagtatttgcaagcctcatggaaacattgagtcaaaaagcatacaatggatacacaaaaaataaaaagaaactaaatcatatcaccagagaaaacttcaaataaactatctaacaatgcattttaaagaagcagcaaagtaagagcaaatcaaagccaaaattagtagaagaaaagaaataataaaaactggctagacatatgaagaaagatgaaactggatctcttccttacaccttacataaaaattaattcaagatgaattaaagacataaatgttagacctaaaaccatgaaaaccctagaagaaaaccgaggcaataccattcaggacataggcatgggcaagggcttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaacaagtgggcaaaggatatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcagggaacaacaggtgctggagaggatgtggagaaataggaacacttttacactgttggtgggactataaactagttcaaccattgtggaagtcattgtggcgattcctcagggatctagaactagaaataccatttgacccagccgtcccattactgggtatatacccaaaggattataaatcatgctgctataaagacacatgaacacgtatgtttattgcagcactattcacaatagcaaagactgagaaccaacccaaatgtccatcaatgatagactggattaagaaagtgtggcacatatacaccatggaatactatgcagccataaaaaaggatgagttcatgtcctttgtagggacatggatgaagctggaaaccatcattctcagcaaactatcgcaaggacaaaaaaccaaacaccacatgttctcactcataggtgggaattgaacaatgagaacacttggacacaggaaggggaacatcatacactggggcctgtggtggggtgaggggagcagggagggatagcattaggggatatacttaatgtaaatgatgagttaatgagtgcagcacaccaacatggcacgtgtatacatatgtaacaaacctgtacattgtgcacatgtatcctagaacttaaagtataaaaaaaaaaaataggcctggtgtggtgactcacgcctgtaatcccagcaccttgggaggccaaagtgggtggatcatgaggtcaggagatcgagaccatcctggctaacatggtgaaacccatctctactaaaaatacaaaaaaatagccgtgcatggtggtgggcgcctgtagtcccagctactcaggaggctaaggcaggagaatggtgtgaacccgggaggcggagcttgcagtgagccgagatagtgccattgcactccagtctgggcgacagagcgagattctgtctcaaaaaaaaaaaaatttctaagacccaccaaattattcaattatttcctccctgcctccctctctcccttccttccttccttccttccttccttccttccttctttccttccttccttccttccttccttccttccttccttccttccttccttctttccttccttccttccttccttccttccttccttccttccttctctcctttctttctccctttcttccgttgtttctttctttcttttcccttctttccaaatttactgggtacttaccatgggccagacactagaaacccaagaaccaatgagatatgtcctggctcccaaggattttattgatttgtgcgagttaggcaagtaagtagacaacacaacacagtacatgttagaataaaggagatggtagggcctattggatcagttatgggcagtttacagaggccagggagggcttcttatgagagggaaacttatgatgaattctgaagtatgggagagtcaacctaatgagaagggcattctgggcagcggtgatcaccatgggctgttgtggcccttgggaaactcatgctctttggaaccggctgaatttagtttttaaatctgacctcatcatttactgagaacaggaaaagttatttacttcccagcagctctattttttccgcagtaaagtgaagaaaattaaagagaaaaagcattctagatgaaagtggagtattgagtaggtgctcaatcatgatggaatacctgtgctaagccaaggagtgtaacgatgtctagtaagtgaaaagggatcttatcagggtgtgataaaccatcggttcttttaagaggattccttatcatgtgtttaagtacttttttaaatatagattttcaattttttagaaaaacagcatttataatatctgttgtttatttctaaaaataatgatgctggccaggcgtggtggctcatgtctgtagtcttagcactttgggaggctgagacgggtggatcacctgaggtcaggagatcaagagcagcctcgccaagatggtgaaactgcaagtctactaaaaatacaaaaataaataaataaataaatagctgggtgtagtggtgcaagcctgtaatcccagctacttgagaagctgaggcaggagaatcacttgaacccaggagatggaggttgcagtgagccgagatcacgccactgcactccagccagggtggcagagtgagactccatctcaaaaacaaataaataaataaatataaaaataatgatgatgattttgcctgaatacggggaagaagaagaagaagaagcagctagatttaacttgagtgctccaacatggataggacctttaaaacttcgagagtagttgctagtgacaaaagtttatttctttttatacatatttattccagaagcaactaaggctcaaattagttttatttttatttattttattctattattattagtttttgagacagaatcttgctctatcgcccacgctggagtgcagtggcacaatctccactcactgcaacctctacctcccaggttgaagcgattctcctgcctcagtctcctgagtagctgggattacaggcatgtgccaccatgcccagctaatttttgtattttttgtagagatggggtttcaccatattggccaggctggtctcgaactcctgacctcaggtgatctgcctgccttggcctcccaaagtgctgggattacaggcgtgagccatcacacctagcccagttttatttttaaactaagttttattttaagctaaggctcaaatctcttttattgttaatttccacattgtgaacatcttatctctgtttatatgaacaaaaaatgatgtgtgtcctttatagtgtagcaatgttaatatataaacaacaagaaaatgataccaaatagacaataaatgcattacagcatgtcagagaaattgcatcgcattcatggccagaatattcaattcattctttgctttattagacttagggacaacaccttccctctgacaattcactgtctgtggaattataaacttgcaatgtctatcattgctgtcaacctaatgaaaggggatggggacagaaaactccagggaggaaatggaagctcacagatgaagcaagccgagggggtagaggaaggcctgaggatagcgggaataactctgggcccaggattctccagagacaaatagacatggcaatgccaggcaagaagctgatggtgatctgaaccactggagtgcacagctgaagaggtggaaatgtctcttagctccctaacaaagccactgaagaagacgctcagggaggtgattaatgagcccccagctctgacccacatcccttctggaagttagcctttcatggggtcaaacttactttgaaaagtcatggagtgaatttgcttccccaagagtcatgtgaaatgagttagtgggaggtttcagaacatcacattcgcgggtggagggatactttaagaggcactgattgcatcaaagctcctaagaaggcgagtgaagtatttgtatggctttggaagaactagctgaggtgtttttttgtatcacgaacttggatattgggggaagcttcagaatactttagcagataggaactctgctgagattactaggtcctaagaggaatggtggcaagagggatgccagcaaacatgtataaaatgaaagtgttttcaaaaatggaaaaatatgtaaagaatatgtgtgtgaatatgaattaccagaacagtaagatgttaagagagttcaacagccttaaggaatgtgggggtcgatcactatgtctggcacgtaattatcacacactggtttattttatgaggttgaattaaatgttaagacacacagattcttagaaaagtgtggaagggcatattgcccagcaacccaccagtgcacgagatgggcctttccctgccaggggcaggaggggtaccttgcccgtgatctgcacagtgactcgcccctaccagctcctgtctgcacaaaatatgctgctcttgggagcagccattactttttaagtagtaaaataacaaaaataataatatccggaaatctgcgtggtcagaaccacagaaagagaatgaaccaggaaaaccaggaccaggtatagagagcttctccttctggcctcagaagtgttaggcaatggcctcatagctccaaactacatttttctattcttaatttattgtttcacatgcatgtattctgaaattctatgagtagcaacttatatttgaaatggtctctgccctctccccgcaaaagtattcaaatacttgggtgaggactggggatcagtcagggacacggtggttactcacaaccctcttgccttactggattggcagtctgggaaagatgggcaggctgagagagttcagggagtttttctttgggatgagggaatatgagaaactttgaggggatgagaaagagttactttagttgttctcagctcaaatttgagcagatactcctttctccccaatggccatcagcttatgacatcgctcctcaattccaattattttccattcccacatatgtccaagggaagagctcctgccattttgtgtgtgggactccagtgactccagaccagatgacccctacagacagaaaaggacagcaagcagcatgcagttgggctgcttggctcaactctcacagccagtgacgctggggaaaggatcagatgaggaaaagtgcctgtcacagtgtctgagataaagtagcatctcaacaacttattaccccatggcaatttttaaatatagaatgtctttcaaacatttttttaaattttatttttaattgacatataatacttgtatatatttataaggtacatagagatgtttcaatacatatatgtatagtgatcagataagggtagttagcacaaccattatctcacacatttatcacttgttttggaaacattcagtattctccttctagctacctgaaacaacatacaatatacttttgttaactctagtcatcctacagtgctatagaacactagaacttattcctcccatctagcttaatcttatttcccttaacaaatctctctgaagtggccattttgcattgtgagctaatattctctctctctctctctgtctctctctctctgtctctctgtgtctcacacacacacacacacacacacacagaattgatacacttctatttttaatatgtctcctgggagtctcatatgtctaaattctgtttcattttgtaagaaatgctgactgagacccagtaaattgatttcctaaccaacaaggaatagctaacagctgtttgaaaaacgcagtcctaataaaatttgaatgttccagtgggctgtaaagggttaaaagggttaatggaccctaaagggttaaagtgaggcactgtgccctaatctggccacattcccatcatgggcattatatatcaacgggtgataacaggactgagttctctttccagtccttagatataaaagggagacagcaattaggaagaaagagagttataggaagtggtaggaattgaagagaaagtagaaaagatcttaactctaccttattaaagtttcatgatccaattacaaaatagatgttttattttctaaactggcattttggtttgtgataacaccacacacacacacacactctctctctctctctctgtctctctatttttgcagctctcttcagaattttctttagggaccctgataaatatacgtgatatatttttaaaaattgaataatggaaggattaagacctggggccctaataatcaattaaaagataatctgatcatgtctttgcattttataggtgctgctttatattctaatttctaatatttttctttcaaggaagcttacaggttcgctatcacctaaacaaggaagaaacccatgtattcaccattgatgcagataactttgctaacagaaggatgcaccacttgaagattaaccgagagggaagagagcttaccattcaggtaccttccttactttctcctgcttcagccaatgtgccttggctactctatcaaacttttctaagcttctaccccatgccagtgtagtgcctagtgctggaaacatagttacaaatcacacttgcccccagacttggaagaactaggatagtggttctcaagatgtgcttcccatgtcccaccagtatcagcatcacttgggaccctgttagaaatgcagattcttgggccaagtgtggtggctcacacctgcaatcccagcactttgggagtctgaggcgggcagatcaagaggtcaggagttcgagaccagcctggccaaaatagtgaaaccccatctctactaaaaatacaaaaattagccaggtgtggtggcacacacttgtagtcccatgtactcaggaggctgaggcaggagaatcgcttaaacctgaaaggcagaggttgcagtgagcagaaatcacgccattgaactccagcctgggagacagagcaagacttcattaaaaaaaaaaattaaaagaaaaaaagaaatacagattattggctaggtgcagtggctcatgcctgtaatcccaacactttgggaggctgaggcaggtggatcacaaagtcaggagttcgagactagcctggccaacatggcaaaaccccatcaatactaaaaaatacaaaaattagccaggtgtggtggcacgcacctataatcccagctactggggaagctgaggtaggagcacttgaaactgggaggcggaggttgcagtgagcagagatcccaccactgcactccagcctgggagacagagtgactccatctcaaaaaacaaacaaacaaacaaaaagaaatgcagattcttgggttccacagcagatctattaaattggaggctatggaagggggaaagcagcaggtgatactaatgtctgctcaggtttgccaaccgctgggctgcattaaagtgaggaagacgcatgggcaaagaggaaatcataataggctgtgggaaggcatgtggtggaagcaggcacaggtgatactgaagagggtgctgatcccacctgggcatcagtacttacttcctggaagaagttaggagtaagctgagtcttgaagatgagtaggagttggccacagggaggaggagagtgctcaggaagagggtccatgtgagcgcaggctaaagctgtctgaaagcatgttgtgtgggaggcaccccatgagatctcagtgggctccatataaagggccagcagcagatgatggcagagcccaacagagaatagacagagtccagatcatcccctttaaaatcatgaccctcagcaagcccttgcatctgcctatcaatcactccatgttttttaatctgttctcctgttctcctggttgaccattttacactctctcctctttacttatactgctaacaattgccagtttgtcttaactctgagcagatgactttgctttcttatttcttgtaagaatttacactcttacattcagaagagaatatccgcacattctcaagagcacattacctacctaccacatgtgtgtttgcactctctctccctcctgaatagttcatggttctagctaaggcctgaccttgctacctgtgggtcagatctgataccctactgaagaaaatcactctagcattctccttcctccctccctttcatcatttattccagctctactgaatggctccccaaagcctaaaacaaataattattacatgcattaagaactaatatacagacaacaatagctaaacaagcaaacaagccagcatatctctgggtaaagagaggaaacctttctcttatctgacttcttacagtgttccattctctttgtccttttcttgcccgaatttttggaaatgttgtttatatgcttgttcttcatattttccctacctttttcttatacccataccgaaaaggtattgcctctgcactgcagcaaaattgtacttctcaaggcatcattgtgcttacctggcaaaatccagtggtcatgtctcagtgttatctttccttgtcctctcattgacaactgacatagggattccttcctgttcttgcaacttgacctaagtctttattgcttgcccaatacaactctcgcctgttgatccttctgcctgtgttagttgctcactcttgtctcttttgttggtttcccatcatctctcaaaactctaccccaaggaactctcagaacgcccaaggactccagcttctgcttttgatctacactcactccatactcatctcattcgatctcacatctttaaatttcatgtacatgctgatgaatcaatcctgaatgtgtatctaacactaatcctgtccctggattccagaccttataccaactacctactgggcatatctatatgaatatccgttaggcattggaatatttaagtaaatagttaaaattgacttattaggaagttctcctgaaacaatgacctcatcccctgcaagcatgtcccagttagtggcagcttcatttttcaagtccatagtttcaaaattgtggtattctccttttatctctccttctcttacatgcagcatctcgtggatcaacagcatctacctttccccaagccacccttgccctttgcttggattatcactgtttacagttgccttttgattgacatctccctgctcctctttaggttccctggctgtctatcctcaacatagcagtcagagtgatcctggtgaaggaatagatcctggcattcttttgtccaaaccctgtcaatgatttcctttctcgtacagagaaaaagtcaaaggtcttccagtggcttataaggatctccattatctgacacccctgctcatttctggttgcttctctaacctcatctgattatatgccctctggaactctagttgtgccactctggcctctttgctatttgcagagcccttggactcactgctttgcctaggatgctattctttatatatactcatgtccagttcttgtacttccttctgcactcaaatgattcaaaaggtcattctcattgaggccatctctgatcagcttatttaatagagcaacctatttccttgacgtcaaccctacacccccccttattcttgcctgcattatttttttctctcagcacttaacttccaatacaatgtatttacttatcaaattttctgtcctgtctccctcctctagaatgtaagttgcctgagaacagaggagggtcgttctgagcagacgtgccaaaggaaaatcatggcaggggagatgggaggactatgtatgagtccctggtggattgcactcaagctgtgcaaagtcaggcacatggctaatgggatcttagtctcctcttcttacaggtgaactgtaaaataatgaggactctttctgggaatagcaccatatgcatagtcagagtagagcctggaagaaaccagtaggatatggctagcctgaaaaagtgagaatgaatggggagggctccctaggaatgggaaggggactgaacaaatggagctggaattagccatgggtgaagtaaggagggatctctaaaggatggtcatagaaataaagtcctactgaagtcccagtgttggcttttgctcacccctgcaagatgggattatcaatcgtccatgttggttgcagctaactgttcagctgccctctcctccccaggaccacatgttttgtcagactgcaatccttgcccaggaaaagctctctgcccacaactaaatgagaccaggtcagaattatgggacaatggggacagtggtggccctaaggacaaacagagagaaagggggagaaatggaaaatgagttcctgcttcctattaatgttaatcttgcacagcaagttcctgagcaggtttcatttgtttgcttgtttgcagcaaagaatttggtgagaaaatctctgtggggagataaatacctataaaacgctgtatacagtttcccagggagaagacttgtgtgaaaacccttatttcacaaagaagaaagaaaggggtattttatgtgcgttgtgggcaaattagcgagacctgtctaatctctcctgagagaaaatctcagaggggggtctgctatctgtatgcattttttcaagctatttccagatgggatcgttttatgcttcttacctgcagacctctgctgatgtgcctttgttttctgttttcctgcagatggaccagcaacttcgactcagttataacttctctccggaagtagagttcagggttataaggtcactcaccttgggcaaagtcacaggtatgttgttctagttcatacctttccagtgggctttattaaaataaatgaatgcataattttcattagggtgtttaaggattcaggtctggagccttttgctcccataatatctgagatctgaaaccaagatttcttattcagaaaatgccaagatgtatctgtggcagaaataggcaatgcatttctatctactttataaaaacttgcaagaggtaaaatactaaaataatttagcagaatacttaaatttttacttaattttcaaatatatttttaagttttacttaattttaacttaaatgtatgagtgcatacattaaggatttgagcaactcaatagttcatcaaaaattttaaaggcattgtaatttcctattataatagtgaatctttttttttttctattggaagttctgtcaattttcactttatatatgatgacagtattcattacatgcatacaagatagaaattttttatctacttgatgaagtgaacattttatcacacttaagtgacctttttaaactttagtaatgtctttttatgcttaaatttattttgcctattattaatatgcctattacaactttgcttaacttagtgtttgcctggcctcttttctcattctttttctttcaatttttccttttctttcagctttgtaggtgatcttgtgaagaacatactgctagattttattttttatactcaactgtccatccatttttttataatggcaaatgtaggtccttctacattgtggggctacttgtaaagttggattttgtttctgctacccgatttcctatgtatccagctcttcctgtgattctatcatattctttctgactctctctctatcacagtacaatgcagaaaacattaataactcaatgcatggtaagcagaaatacatttaacacgtaagttagttgcttacaagattgttgtagtacttacagtgtgggttctttttggggtcttttggaatgacttcctcgtgccccatactgtatgcaaattcacaggtagaaggaggaggtatctgaaaaatggctgtggaaaaagcatcacgggcccctgcttttgcttgccagtagaaagagctgaaaaggcataaaaatgattcttgctacagccctcaagcttcataaagggtttataatttccagatgtaatgttgatccagaaacctagctgaagtagggtcaaaaaaatgtccattttagttccccaaatagcagttggaagaaccaatcaacactgatccctgattgagtttatttctgattccattcacagtcctaataataatcatttttatatttttcagatactgcttatttttgatttattaatatagacactagtttatacattcctcatttcttcctgtatctcagacttttctatcttctgccaggctttatttccttctttttaactaaattcttttgaattattttctgtttaaggttcccttcattatacatacatatacatatttacttacttatttatttattttcctgaacaaaagttttattttacctttaatcttggaagataattttgctagatcttcaatgcaatattgaagaatattttctctcaggtactgagaaatcagtcagaggtgtaacggagccagtggcactggcctttaagaaccaggtatacatgtctctccccaactctgcatccttcagtggtggcaggatgccagcttgaaatcagctgtagtaggagggtttacactgtggatatcagaaatgctaaaagccaggactttccctacctcttcctactgaagagccagtttcaaagactcactggcacatcagtgtcctcttgttttctggcttccccggttgctaccaagaagtccgctgtccatctgtcctgctattgaaggtgctctgaccacctccatacctactacttacaagttgatttaaagtcatccttttttctttgatgttttgcagttttgtcatcacgtatctgcttgtagatttctttttaaaatatcttacttgatatttttatgtttcctgttcgctatgtcatatgtatctatgtatccagttcctatttattattcatatgtatctgttcatcagttcttaaaaattctcaacatatcaaatcttgcttcctcctattctatctactcaattcttctagatctaaattatatgaacttagacttgctaattctatcatcatatttcttaccctctttttatagctttcattctttgatataacatcttgcattctgggcaattcatttggctttagcatcacattcactagtcctctccttatttaggcctaatcccattcaatgaatcatttcttattgatttcatctttcatttctaaaaataatattttgttctttttgaagcatggctattaataaagataatttgttgtctctgttcttttgtttgtttccatctttttatgtatttaggcatttcattaatagttattaaacattttgtctctgataattccaacatctgaagtctgtgagggtcccagtctgttactagctgttttctaaatttttcctgtggtaacttgtttccttatgctgtgtgtgtgtgtgtgtgtgtgtgtgtgtgtgtgtgtgtgtgcgtgcatgtgcgtttgttcatattgattacaattaatttgtgacaactctaaggatcaaaaattaagacactctcctcaaaataagatttttttttttttaacttctgccaggtgccaggaggtactaccaatttaggacaattttaatttctcactttttttttctgaacagagaagaaatataaatttgagctccatacctgaatgagatcagtcttctggttgaagtcttagcggaaatgttgttactattaatatcattaaccaaattaaaacacccttagaaagagggaaaatgtgggcttacggaccacaaagcccagacctttttcatggcccctgctctgtgtaatggaagttccaataataccctcttgttaaaaatgaaaaaaaaaatcctcattaaatcttaccactgtgtatagcattcatatgacccttcacacttttagctaagccaacaataaggctggtgaattgaaactttacagcaaggtactacagacaacttgttattttatttctggtgctttgtaattatcaggtagaaaagaactgttaagattgaggaggaatactgtattagtccattttggcattgccataaatacttgagactgggtaatttataaagaaaaaatgtttaattgacttatggttctacaagctgtataagaaggatgatgctgtcatctgctcagcttctggaaagcctcaagaatcttaaagtaatggcaggagacaaaggaggagcaggcatgtcacatggtcagagcaggaagaagagcgaggaggaaggtgccacacaattttaaacaattatatctcaccaacttactcaccattgcaaggacatcaacaagaggatggtagtaaaccattcaggagaaatcctccctcatgagccaatcaccacccaccaggtcctacctccaacattagggattacaattcaacatgagatttgagtgaggacacagatacaaaccatatcaaatacccaataaaatgtcttcattgttctaagaatgggagacatctgctcactgggctgccttcccatttgaactgccgttgaacagatggaaggattttgaccaacacttaaccttaacactctggtctatgaaagttccctagcagaaggtaaagggagacaatatgaacattcaggcttattatttagaaaggacgctaatcctgggggacctttggaacaaggaaaccaaaccctatgtatcagaaatagagtaaagtagggatggagaaaacaggaagagatggtattaaaatggctacatggaattaatgataaatgcaactgaacttcacaattttagaaaagattgctttgtaggacatttccaactgtaaatcaaacactagaaagcatttttcatggtagatatgaaaagaaaacatacgtagtaaatctagtgtctcagttttcttcagtaccatcaatagcatttcattgcaaagcaaaagcaagtttgttcattttctttttgtctgagaaaggaaaaattccttactaaagaggactgtggtttagtacatactctataccagccacggtgctacagatactgttataaataaagcagttttttgtttgtttgtttgtttgtttcctgaaggtccccatgatgtagatactggcccatgaaaaatagcagatttaattgtgtacattaaaacttcactgttggttctctaagaatgttgatgctcaaatccatcaagttacgggatattgcaaggtttattctttggtttactgacatttcttaactttcaagagagattacttggttctggcctattgcatcagtgaatttaagaaaaataacattaaaagagagagagagcacatatttagggaagtaatccatttggaagagataatgtttctggaaacttgcttatttcatttgaaagtatagatgtgtatgcctcagattcaaacatagtgtgctttatcactgttatttctaagtctctgtttaacttggccctgtcacaagagcgtagacagccaggcagacataggaattgaaaaaacttgaaacttctgaaagaaactctgccttttttgtttttaatttattttttttctggtcctgttgtccccttctttactcttctaaaatatatcaagaaaatttgatttcaaaacaaaaactactattgtttggtgaaattaagaattaagttattattattatctcttcttaaagaagacttcttgccaatctgcagaattaagaagtagctactttttaaacatatggaaacaggttaaagtttaggtggaaaagaattatagtactgcctttaaactattgctaccaaattctgaagagacattaaaatggaatttgcactcatggcatgctgatagcattatttttttatgcagccaacgtttgttaatctcctacttgccagtttgataggcctaagctcacacctgacagaggcattattcttctgctccaatggctgtttgcccatctagatttcaatatttacttgcctcaaaaaaaatacagaaattgaaagaatttcttctcaagatgcataaaatttacagctaatctgtaaattgcagagctatctgtgagcacttacacatgattttgacatgttaaaatgagttctgattgcatctatagaacagggttctttaattctccccaatccctcaggtttaaactttgagcctactgtgtcttgtccaacattacagtatcattgaatgaaaaccctgaatgctttcacataaaatcactttacaagcatcttgcagaggttgaattatggctgccatttatagaaagcacagaagaatttatgcatataaataaaaggtgtgtacttcaaaatgctcactttggaagactgaactctaattcctttttgattttggacacagagccttcttatgattcaaatctgggagtcaatgctaaaccaggaagcaaaattctacagtggaagatgctcagctttttggagacaaattgacccatgtttgcatctctcatgtagttaaccattgtgtgaccttggtgaatttatctaacctgtttatggttccttattggtaaaatgaggatagtaatacttaattcatttaattaattcacagagctgtgtaagtatttcttgaagctttatatgcaaattacttggtatttagcatatactcaagaaatgttggcttatttttttctttactttcaaggttgtagaaacgtaaaagagaaccatgagggtttttttttttttttttctgttttcttttttgttaatgtgtctgtcaaggtgactgtaagtgtaacttccagggaggtgctcaactgtgctccaaaagagcaattctgaaccatggtgagtcatacagaatctagtgtgactcattatcaattagcactgtttcaagggtgtatcaaactcataccagcttcaacaataacaacaaaagagaaaacaatagttggtgaaaatagaagtttcaaggtgtaagatctgcttcaggtacagctggcttcagaatctcaaatattatgattcgggtttttccagtctgtctgtttctcactccacatttgactgcttaccgcttggaggtgcttcatttgcaggcaagatttcagtggtaatgaaggtgaaatcatcaactccaggtttaagtagcagcagttcaacattccatgtggaaagaaaacctcccacttttaaagttccagaaaactttccttatgttaagtcatgggattgagttttcaaggaccaatcccagaccatggcagtgttcaggtgattgggatctactgcatggccatggccaaattattcacccagctatggctgtgaagagagtggagatagttcagcgttaattgcatgggttgaaaacagggaaaggctacttctcagaagcaagttgagctgttcttaccagagaaagagaaagatcaacaatgatctagtaatgccacctcttcttctcttttgcattttgctctcccttttttaagaggagagaagagggtgcagttatagccatgggctaggaattgtggctcatttggggaaaggattgtgccggtgtgcatcaacagttcaaatatgttgcggtatgaaaaataatagttgagctatgctcttttaataaataaatgcatgtaatcttctttagaacaagtttatagcttccaaagtgactcctctaaaagattatttcattttaaatgcataggcttctcaaattatatttcattttgtttatggtcatacatagttctttagtaaatactaaatctccaaaccacagcctttttcagactcaaatcctcacattgtgtgtaattgctttatattttgtccagataatttttaatgatactgtctgtttgggtaataaagtattttagattcgttaatctaatttgaccttccgcatcatgaaataaatggtgtgttttagagcatcctgaaatatcagatgtcagtaatcatcctaacttcccaaacacgcatgtcttatattttctactttgtagataaccagcactgaattgcaactgggttagatgggatttttgttatttttttcctttaacaataacaagttacattttttccccacagagaaattcagtagatgatttagtttctcctcatgcaacaggaatgtgtgttatcttctgatttaagatgcaattttatttctgtgtgttaaatgaatcacctcatgatagcagtgccagcgtgctccatgctctgcactgctctgtagaagttgtctgttttttctaagagtgaaaccactctatgaatagcatgcccttgagttactcattttatatcgtcacttgcctgctctgtctatactagtgactaaaaaaatgaatgaagtaaaaatatcaatgatatgttgtttccaaatgcagactgtcttcagctgggaggagctgttagtaatctccttctaagaggggtggccttcacggatttgccagacattacacatctttgcctgactgtgatagtgaaggatgttttgtgtggtggcccagaagtcacatgacatgactctcattgatataaacttcaaattcgttctcaagcaaaaactattgagcattactatggccacacaatgtgtgaaacaaacaaatataacagcaaaaaaactgtccttgttctaaagatcttgcttatcttaaaaattaattctttcaaaggaaagttatttgggtgggatctgttggtagtattaaagtttttcaaggttttgaagtatcccgtgtaggctatgctaaatattagattttcttcactgttacaaaataatagtactaaaaatggtataatatttatagcatgctaataccaatagtatcataaaactagtagttactgttagtattattatttcataatatctttctgtatgctaaatctaaactcgttccttatgctaatttatttttcccctggtcattacccagggagataagtaccattcttatttctatttttatagatgagaaaattgagtcacagaggttcagtgactttctcaatatcacataaccagtaagtgtctggattccaagctcctaataaatcctgccacagtttggtttttaaggaatgatatgaaaatttcacacaatgcacagttcatttttctgctgagaagctctgcatcaaaagtttgtctttttagacttaatgggcttaaaagtagaggtagagtgagggagtctttaatcatggagagaggatgacacatttcttgtaagtcaggctttggaatcagctctgggttcaaattatgacttcaccactgactaatgtgacctggacaaattactaaatattccaaacttcagtcgtctcaattagaacacaggtatatgttattatgacaattataattccaaaaatctggtggtaatgcaaatgatgtgcctaggatgatgcctgccatttaataacagctcagtaaggtttgtaacaccagtataataataatataagaagccacttcatccaacctagcattttcccttttggactctaattgccttccagctaaaggtatcctagtctttatgtaacaaagcttaaattttactcttctctcccactctaggggaatgaatggataaggcaaggtgttaacatgactttaattgatgattggtaaacagtggaggtggtagtgtggacaatatatttttatttttttatttgttgttcttttcttttttttttttggagatggagtctcactctgtcacccaggtgcaatctccactcactgcaacctctgcctcctgagttcaagctattctcctgtcccagcctcccaagtagctgggattacaggtgtgtgccacctcgcccggccaatttttgtatttttagtagagatggggtttcaccatgttggccaggctgatctcaaactcctgacctccagtaatctgcccatctcggcctcccaaaatgctgggattacaggcatgagccaccacacctggccaataatacttttgataaaatcatctgaaaagagttaactagaccaaaacccacctgaaattatttaaacttatttcctcaggagtcaagctgcctctgatgggttataatcatgttatactttgtgagtcagtcaagcttaaaatcatcaaatccagtccgatgcttaaacaccccagacattaccactgtccctctccacttctcagcatggggtagtcatgaggttccaaagacaagaccccagcctcatttacggttttatcttccctgctactgtattggcagacacatattacatgttctataatgtatgttgaaggaaaacacacacaggcacatgcatgcacacacatatatgtataatgtataaatattagaactgtggttacctgaaaggttatcacactacccatgactgggcccaatgttgtgcagctagctgcctcccagacttggatgagtatctccagcttcctcttacaatgtatttttctcacgaatgtgtgtggtagtgagatgggaaatgaatgggttgggagtcagacagtgctgagctcaaaccatagaaaggttgcttcttagctctgtcatgactaacatcacctctctgagccttggtttcctcatctgtaaagtaggagtagtaatacttgctttatttatttgttttgaagatatgagataatgcctgtgaagtgtctggcgcttagtggtatttgaaaacagcagctactgttaataagatcatacaaccatgctgcctattgattttctttgcctgatatccctcttccttgccgatggctctgctattgatttgtttgccctttgcctggggaatctgggccagtgttataaatgtcaatgttgacaaggtaatgaagtaaaaaggatccaagctaagagtaatgaactccctgcggcggccttatagggacccctctgaagcttggtgagaatggaagcactgtattggccagaagctgaaagaaacaagtggaacaagcacagattagaattctaggtgctttcccacacagaaggagagggaattgaggctcgaggagtgttgtgtggccactggttactcatttagtctaccaagattttatttttgcaggatgccattaatgataataaattgagttttaaaacagattaacataacgtaaagctcactgtcacttaggaatgattgtatatgccatttatccatttctaagaatgatttgacctgaatctgtgtatttttcctttacacttgcacaattatcattgccagtgatcagtgtcagagctagggtcttgtggttaatattctaaagttctctgcctttttcttgataaagaatcacatggcctgcttcttagtgaggaaaataaataagtaaatcattctacctaggaaattctagttttagttaattcccttaaaatcaactgctgcctactctaatcaactctaatcaatcatatataagacttgaatatatgccttatctttctcacttattttcttacctttttcttcaaaatgattccatagaatataagccttgcacagagcatgcctcccataaaagataaacattatataaatatttggaatcagtaaattgctccctaacattgtttgtagataattcattgaatgcattattgaatacctattatatacaaggtgatataataagagaaaatatgaaaactttaaagaagtaaagcctatggatctttgttcccaaagtgataaaacaagtatctgtgaggataagacatttatttaattaggatataaatagttttgataagtgctttacagatggagtgtgcttaatattcataaaaagaagagatcatttctagctgagatgacccagaatgttattgtgtggaagatcaccttgactttagtcctgaagcacaggtttgacctcaatagatggagtacattccaggaaggaggaatggtgtgaaccaggtaagactgtaggaaaacaaagatagtaggatagaaacagtaaataggccatctgagagggtttcatacatgcagcagagtagagggagacaagggaaacaagaacagtccattgggagaatattacagaggacatccagtgctctgcaaaggcattcagaatctattgtgtagagaggagagagcatggaaaggagctctcgtggtcagagctgctgttatcagactctcttgttagtaacaagcaagatagaggaaagagagactggtatgcaggctatgctaatgcctaacctttggatacgaaagagatagcaatggaacaggggagcaggtgcaggtgcagtttgtaaaataagaattggaagatttgggtaattcactgggtaggtgggtggcagagtacccagggaaggaatggagaggacaagaggaaaggaaattacagcagatttttccagtcattacagagggaaataaattcgttctggtctggcctgagcccgagtttactgacttggggcataagttacaatggattataaagctgataccttaccctcttcctttgagccagctctccagtcctgctcagctgcttctggatttgagaaatccctgtcatcaagaacagggggaagagaagtggattggattgctgtgaggagagtccagttgggggccttcactgtggcgatgtccacagtagtccacagctgcatgggacagatctctcccagccttgaattttttaccattgcctgacttgtatttcttatctgtgtatgtagctgcttccttgggaaaagtgtggtccttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattataggtcctaaaactgaagcagtcttaggaaaaccagcacagcctgtcgcctaagccacactcagttcaggggttttgaatagtttaatggaactggacccagggctttgaatgccagatgaacaactgagtttcatgctttgcctagccacagctgagttcaggggccaacatccctgaggatatgctgtggtttgaataggtgaggttagaaaggagcgagaatgaaccactcagcccactgaccagcactcactgagtctctgccggggtgcagcatagagcaccaggtgtgctgagatgacaggaggggggtgtgggattgtttattcccttaaatattcagtgccctgggtggaaacccaaaattgtgtgcaagcagtaattacagaacaattgatctttaaagcatggaacttgtattcaaagggcatcattaaaagactagagaaaggagaaatcagaagtaaaactatgtgtaaccaaggtcctgtttccctactgattttgggtggaaggccagatcttctctatgaaggatgacacactctgtctagcgtatgcagagatgctgtcttcatcagagagaagtcctgcaaatatgcacatttcagatgcagatcacatcagctgctttaggtctgtgaacaggaagttccatatgtgtacgtctgttttcacactgctaataaagatatacttgagattgggtaatttataaagaaaaagaggtttagaagactcacagttccacgtggctggggaggcctcacaatcatagcagaaggtgaaggaggagcaaaggcacatcttacatggaggcaggcatgcagtgcagaaggggaaaaagccccttataaagcaatcagatctcatgtgaactaactcactatcacaagaacaggatgggagaaactacctccatgattcaattctctccctcccaaaatacatggggattatgggaactacagtttaagatgaggtttggttggggacggagcctaaccatatcaatatatatcatccattctcttttttttttttttttttgagactatctccttctcttggccagactagagtgcagtggcatgattttagtaacctgtgcctcccaggcttaagcagtcctcccacctcagcctctcaagtagctgggaagacaaggtcatactgccaagtacagctaatttttgtattttgtatagagatgggctttcaccatgttgcccgggctggtcttgaactcatgggctcaagcaatctatgtgtctcagtctcccaaaatgctgggattacaggtgtgagccactgtgcccagcctgtatgtgccaattctaacaagagcttactttatattgggagctgcagaggttactttggcttgaggtgggagataggggctttggtcatgtgtgtgggtagagtgcttctcaaaacatgagtgaaacttttatacacggagacaccaagctaagctttcagagtttaatatggaatttccagtttaaattatcttctttataactctgggtatagcaatgtttttttgtgtgtatacatgtatatgtatgtccatgtgtggtgatgtacatcctggtacaggtatgtatgtgtacgcatatgtgtatgtttgcatttgtccatgtgtgtacacatattggtacatgtacacatatattcgtgcgtgggtttgtacatgcatgtatatgcatatgggtgcatgcttgcatatgtccatgtgtccacatgcataaacacgtgtgggcaactgtgtgctataactgtattgtatatatgtatatctggatatctatgtttctgcgtagttgtgtatatacatatgtctgtgtgtgtacaggcacatgtatatgtgtgtgtgtaaatgtatgtctgtgcttgcaaatgtacatgtacacatatgtttctttctgtatagtgtctgtgaatacatgtacatgcatgcccatgcacgtgcatatgtgtatgcatgtgtgcatgcatgttccactctgtgtgtatatgtgtatgtgcatatctgtcatgtatgtctgtgtgcatgtacatgtgtgtacctatatgtgcatatttctatgtatatgtgtatttgaatatctgtacatgcatgtctgtatgcatgcacatgtgtagtcctgtacacatgtatgtcagtgttttgcatgcatatgtatgtgtgcattcatgtttctctctgtgtgtatgtgtatgggaatacttgtacatgcatgtctctgtgtgtgcatttgtttgtatgtgtatgtgcatattcctttctgtgtgtatgtatgtattcatatctggacatgcatgtccatgtgtgtgcccatgtgttttgcttcttttctgagtagtcacatttcccaatttgctttttctctgttatatcatgtgatctctcattcttgctagaggctttactcatgcttctgatgatcttggactgtgctcatgtttcaaaaggaagtgtctggaatgcattgccttggagccaccctgaagagtagggctgggcctttagttagataactccaatgtctttatctttagctcatttatcttgggacaggcacatttcctataaaaaaaactttcccatcgcttgcttagagagaaagaggttctgaaagtcgtagtgcagacaagagctggtggatgtcagggtctactaggtaaaagtccctttatgtctcattttttggtgagcacccttgcctcatctatcaacattactctcacctacctgtaataacccctcagtctcatagcacttctttattcattttccaagcagtatagttatttgggggatataaagggtactttttcgaactattttctgtttctctaagattgctttacttgcgagagaattgctgtgaagctggctgggaaagaacaaaagacttttggatgctaagtcttctaaatgtagaacccactcatatcagtcagggttcaaccaatggagcatgactagtaggagataatatattgagatttattgcacagaattggttcatgcagttatggaggccaggtatgatgtctgaaatccactgggtaggccatcaggaagtgcagctggaactctcaggcatgagtggaagttgctgcccctaggtggaatttcttcttctttgggaagtcttaaaagccattctgctcataaggtcttgcaattgattgaatgagacccacacagattatctaggataatttcccttacttaaagtcaactgattgtggatgtcattcacgtttacaacatacctttacagcagtacttggatgagggcttgattgaataagtagggactatagcctgctcaatttgacacatcctcagaccattataataccctctctttattttttattgaagtgaaacgcacataaaattaaccattttaaagaatacaattcagaggcatttagtatatccacaatattttgcaacaattgtttctatctagctccaaaacattttcatcacacacacacacacacacacacacacacacacacacacaactcagtacccattaaacagtcacatctcatcttcacccctcctcttagctcctggaaaccactaagctgctttctgtctgtattgatttacctatttgagatatttcctataaatggaaccatacaatttgtcacattttgtatctcacttctttcacttagcatagttttgatatttataatattgcagcatgtaacagtactacattcctttgtatggttgaataatatgttgtatgcatatgtcagggtgttttttaaaaaatctattgtcctttgatgaacatttgaattgtttccatattttggctgttgtataaatagggctgctgtgaacatgtgtatatatgtatttatttaaatacctgtttttaattatcttgggcatatctctgggaggggatttgttgccttttgaaagccattaacacgcgagggctagcccagtggaatcaatcaaggaaattgtatattacaaactgtgcttcccacactcttaccattctccttgtcaaaacaaagagatacttaaagatgattctggttggatttattcttttaattatcctacatttgtgtatccaagatcagggatgccacactttaccctatcaattctcaaatataagttaatgaggataaggataatcatggggtaacatcccaaggttattctctaatatgtggttcaaggagattttgttaacaactagacttggggcaagtggtggaattggaggcaggagtgtctctgcactcatagagcactgtgacagtgagcagctgccttacatctcttggttgcaaatctatcctctttgaaatgtcagagactgccagatgatctttggagtttattctagttttgaacattatatgattttgtgatgcatgaaaatgttatgaactttggctttgaaaattctgatgtcaaatctgaccccaaagtcatatttcatgctactttttaaaaggggagaaaaagagaattgaaacccaatttgctgacccaaattgataaatttctgggctgcaagcaaacctacttttcagtaggtgatgaaaaagaaattgagcttgatgatatttacagttaaaacagtaacatgcatttaataatcacatgtaaacacaagtgtgaatatcttatgatattttatacttttatcctgtggaattccaaactccccctgcttacctcaccgggaggcatagttccttacctttataactgacacctgtgcatgtactgaccacatgtcctgggcttcccatggaagtgctcctttcattgactgctggctgcaaacacatacccagccactttgactgttaatgagctctcattctcatttgaaatatatcattacttctgtgtgtggtcatcctggatactcttaatctttttcctttttcttggcatagtgaaaaaaatatggaatttggagtcttatgccaccaacttccattgtagtctggactctgaagtatggttgttaagtggaccctgaaatctttttgacagaaattcctaatttatagtactgtggtgactgaagctgtgtaagctcttagttccaactttgagtcccagattccttcaacctgcccctcctaaagtgtggtctttgaaggcaggaacattttgttgtcaatattcttatcactcccactttgaaacatgggcctttgtgctttgtctatgcttctatgtgtttcataatacacttcttctgattagtaatgcatcacaggtggtagacatgttttcaattcaagggggaaatgcttgcactcctattcctgattttaggatccctactagtgtgaccagtcatgctagtctactcaagactgcgggattcccagggatgtgggattctaggcctcagttttcttatctgaaaaccaggaatcatcatagcaacctaccagagttgctctgaagattaaatagctgtgtatgtatgtattatatgcttttacacataccgcttagtgcacagtgactgctaaatatttaggtgccatatggaggcaattatagctggggaatctgaaaatgaggatgaaagaaggaactcctgtgaaattcattctagaaagaaaacttggcagaaaagaaacttcacacctcctattctctctgttttaccacattttcattcctggcatgggagaccccgtgtacagcctggtcttgcagagccaggccctgtaaagtcaggcagtggaggtggaatgggacagacaggcgagtccaagacctgaaaagccaggattgttttttgttttactttatctaaaatgcaatgagaagtcatcaatgattttttttaaagaagattggtttctttttcttttttaataattttaacttttataatattttagatacagagggtatatgtgcaggtttgtcacttgggtatattgcatgatgctcaagtttgggatatgattgacctcatcacccagtattgagtatagtattcaacagtgagtttttaaaccctttctcccttttaatagtcctcagtgtctattgttgccatctttttgtccatcctaatgtttagctcccacttattagtgagaacatgcagtgttttgttttctgttcctgtgttaattcattcaggataatgacttccagctgtatccatgttgctgcaaaggacttgatttcattctgttttatggctgcatagtattcaatagtgtatatgtaccacattttccctttccatccaccatcgatggacatgtagttcgattccatgtctttgctattgtgcatagtgctataatgaacatatgagcacatgtgtctttttggtaaaacaatttattttcttttttaatatatacctagtaatgggattgctgtgttgaatggtagttctgttttaatatccttgaggactctccaaactactttccacagtggctgaactaatttggatttctaccaacagtgaataagcttcttcttttctccaagcctcatcaatgtttgttgttttttgactttttaataatagctattctgattcatatgagatggtatctcattgtggttttgatttgcatctctctaacaattagtgatgttgagcattttttcataagtctgtcacttgtacgtcttcttttaagaaatgtctgatcatgtcctttgccctttttttttagtaaggttaactgtttttagcttgctgatttaagtttcttataaattctgaaaattagacctttgtcagatgcatagtttgcacatattttctcccattgtgtaggttgtctatttaccctgttgatttcttttgctgtgcagaagctctttagtttaattgggttacatttgtcaatttttgtttttgtcacaattgcatttgaggatgtggtcataaattatttgtcaagtctaatgtctgaaatggtgttcctagcttttcttctaggattcttatagtttgaggtctagcttttttttttttttttttttttttttttgagagaaagaatctcgctttgtcacccaggcacccaggctggagtgcagtggcaaaatctcagcttactgcaacctctgcctcccaggtttcaagtgattctgctgtttcagcctcccaagtagctgggactacaggcatgcaccatcatgcctggctaatttttgtatttgtagtagagacggggtttcaccatgttggtctccaactcctgacctcaagttatccgcccgccttggcctcccaaagtgctggaattacaggcttgagctaccacacccagccttacatttaatctttaatccaccttgagttaatttttgtatattgtgaaaggtaggggtccagtttcattattctacgtatggatagtcagctatcccagtgccatttattgaatatggagtgagataggattcttaaatatagcattttccttgtgttttcctagagagctcttttctaagctcttttctaaattttatgcttttgattttaatgtaaaatatttttgtaggcattcactcaagtgctcctttatgatatagctggtgtttattgattaaactaaaatgcaaacacacttcttgtctgttagtgctaatgccaataattgctatgataaaaatagtagcaagtgcttttgggttttattattatttcagataaggtttgtcctctggatcagtgatttttttttgtttttattaaagtatttgagtgatttaaaccaagacagtattatcgccactgttatatgtgctaggatgctgggaataaatatttcaaagacagtcacatactgtcattttttagaagaattactgagttttagtcaactggcatttatttcaccaaagctatttatccaactctattgacttatatctgtaaattctataggggtagaactttgggagtattagaaataatatacatagattttaggagaatagctctttagatttattatttttatcctgatttgagaggtgagaaaatccatgttcagtatcttgtccaagctttctctagtacatgctattggtgctctatcatagcccctgactttaccacttcaataccagctcagttacaacctccacacttgaaattttgctaaaatctttctctggtcatagaagcttgttttccctatctatatggcaatccggaagtgcccaggttttgcttcctcctgggaattatcttcagccaattataatgtgagctgatgcattaatatcttagctccctcaccatccatagagataagtctgattgtgttcttcactggctcctggagttttcctagtgagtttaagctctcgttgtccagtgctggttggttcccttaatgtttccttcccctccttatctctgccaccaccctatcagtgctttcttcacttctcaaataaactacttgcactctaatgcctgccttggtatctgcttcagagcaaatttaaactgtaacagtcaccatccattcgtcaattggttgacgtggtgtgcaaagccagatttgcttgatgccaacaatatgtttattccactatgtgatgtagccttaaataaaaggcatataaggcagaaaccccatttcgtagagcttctaattttatatagacaatacattagtgcaggaaggttgaaggagtaataaaaagagctgaatcaaagtaaaatgctagctgaaagactaattagaacagccttagtcataagctggtaagtgtatagagacatacatgggtggggagtctccttctaccgacagacatgttagatcttagaatatagtgtataaacaagtgctgtgtatttaccatgtgccaggcaatgagctaaaaagagctttaccttcattattacatttaatgttcacaaaaaaagtatgtggtagaatctattgtggtgtattaaaccacctcataatttagtagcttaaaccagtatccattttataatatctcaccattttgtgggttagaaagttaggcggatcctactagagttcttcagctacttgtgacattgactaagtctcagttgctaggtgatatatggctagtggctgggatagtctggaggatctaaatgaatttgctcacatgctgggtgccttgatggggatatctgggggctgagctcagttggcctttcttgctccatttagtctgaggacctctccacagtctctctagtaggcagaaagtaccagccctcttgaaagctagtctcagaactggcagggaataattttcaatgtgttctagtggagaaagcagtcacaaatcagctcagattcaagaggaagggaaatagaccccatcgctcagtgaagggcgtgatgacgatgatgattactgtcctttttgatctacaatatgcaggcactatattcatccccattttataaataagaaaattgagcccaaaagatatcatgtaatctgtccaaggatacaatgttaatgttgaaccctggaagtctgattccttggtgataaaaacctgttctaaaggggaaactgtgtacatatttaattgaaggcaggtgtagagaagaagaaagtttatttgttagaagagagttgaggcagggactgcctatccagcattcaatattcactatctttttcttaattaaatacagtggtgtttatggtttgttgtttttgtttttgaggaagtaatattcccaattagaaacagtacatttcctagcctccattgagttaataatggccatgtgacattgtcctggaccatgtaccaaaagcagaagtcacaagagttttccaattggcccggcttcacaattatgggcccttcaccgtccctgctttcttctccctggaacataggggtgatggctagagcttttaaagtcattaaggctatctaaggctacagtctatggagagggaagtataagtctagaaagaattctgggcctctgatgatctagaagcaagataccaaccttggactgcctaatatcagacttctcattaacctcaaatgaaataaactctgattttctttgagccactgttttcttcttgatatatgcagtcaaatgtaaatttaacttatgaggatgatttatgtttttgtactttctggaatcagatggagaaactgggaaggaaatgctacaattatagcaaaatcaacagctgtactagaagaacaatgatataaatttccaagaactgatgactctgtgagctggacaatcccttaggggttccttgccctacagaaaagtcagtggatgaatttatgtttgctcacatctgggtcactgaaaccagtttgagctccattatactggcagccacctcatcatgtagcaaagaaaaaaattcaagagacaaaacaagaaagtataacatgagttctgaagcaagagctctagataaagaattctgtaggaggcagagaagggaccgttctctttaaactgagctgggcgggaggttttctgcaggtggaggcttctggactgggccaagccctacaggtgagtgctatactgtaattgtggcatgcttgcttgaagagctaagcaggcaacctttatgcagacacaatatccaatgttttgttctcagttcgacctcaattagtatttaccgaattgaatttgtggtgtgatttgaagcgggctgcaaaacacactagttccaaaatgcctcctatacagaaatcccagaaatatgttttttctttgcatgaaggcgttgaagacttttaaaatataaatatgctgtcttgaagaagagcacagtaagcgatcatcacgcattatcaccttattaggttgccagtcagttaacaacttgtttcattaggaaggaagggtgtttgactctctgggatgggcaaagtttgctgaagaaggttaataagttcggggggaaaatgattgctaaattatgaaaaacgtgtatagaatataatttaaagattcattcactgggagcattaacaattacaaaaggaagccagtgtaccatcctacaggctgggactgggttcacagaggctgggttcaaatctcagctctgccactttctggctgctattttgggcaccttatttaatgtcttttgtttccatttctttgctttaaaatgggcagagtaacacagaagatggtccagtgtcatcaggcccttaaagcagaatttagtgcacattagagatcgatttgtgagaaatattatgcaaacagtcttcattttactcagtacagcaggatggtaaaactgaccacacaagctgaaactgggtaaagcgatcttaataagaactatggtagttccatgacctttaaaatttgtcatcaaagcagtgtgttgtctttccatgtcttaatgctactgtatgccatttctctgcatgatggtgtacttaacctggtggaagctccataattagtgtctcctagtattattatggagcaataactacaaagggcatcctgagtggaatgtaatattgccttgtagtatgagataacctgctacaggttagaatcagaatgcaggagacttggcactaaaaaacacagaaaggcaagtagcactggatactgtatataatggtcacctgtgggaccattctttttttaggctggactccagtcccagagaatagttccacttttccaaattgataacagccaaatttaggtcattcaacttaggctctctggatctttatagaggccagtatacgactcatcagaaataactgacttttaaattgtaaaaagtgtatttcataaaaatgtatatgataaaattacatatatatattagacatcagaatatgtatagcagttagatataactcatcaaaaatgaccacattttaaacacatacatcatatgtgttttattacatatgtgttaaaaaatctcacttggctttcaaagatgggcttacatgtgtgtaactgactgttggttgcctacccagcatccattttgactccctttcctttaccaagagtgctgttacttgttttagaaagacttttaacaaataaaatttgcaatatgcttacatctgtaataaaaagtagataatattaagtcactgaagatgcccagtatggcttttacatttttttggtgttcttaacttcacaacttataattcttcattggagtaggatatatttctatgattaattttaagctttgctaaaaaacctctcttggaatatgcagtacccttgtcttgctcatttcctttaataaagtaaacaacatagctgtaaaccagtacacatgagtcatttattctgactccacatcaagtaaataatgaacaacctaggaggaattatttttgtttctttcagtcccaaagaaatgagattttatatcaacgtgcaaatcctgctgttttttattttcttttttctttttcttttttttttttaagacaaaatcttgctctgtcaccgaggtgggaatgcaatggcctgacgatggctcactgcagcctcgacctccaagtttcaagtgatcctcccgcctcagccaactgagtagctgggactacagaaacacaccaccacacctgcctaattttaaaattctttatagagacgagtcttgacattttgccagggctggttttgaactcctgggatcaagcaatcctcctgccttggcttcccaaagtactgggattataagagtgagccacagcacctagccttcaagtcccagtcttaatgccaacaaagtgatttttatataaaaataagcagaattggcattaggagtataatacctaggagttttaaatttggttatgtagctaaggttttactgattcagcactcactgtcttacatccatccaggggcctttacataatgcatgttatcaagaaacccaattaaaaagtgaaaaattaatttagccaggtagttagtgttcagttgaaataatgaattctcaaatggtagaaggtttgtttactgaattgacttggttatattttttttacttcttgtatcattaatatctacctatcatctatctatttcttcatccttttatctgtcagtatgtgtgcatttttatataagaagactcatggaagacctgtgaagtgccagaccttatgcaatgtcgacccatttgatcattcaaaaacatttatttcccaacttctgtgtccaaggtactttgctaagaagtaacaccaggtatggtggctcacatctgtaatcccagcactttagaattctaaggtgggaggattgcttgagcccaggcttttgagaccaacttggcaacatagtgagaccctttctccacaacaaattttaaaaagtaaccaggtgtggtggcatgtgcctgtagtccctgacactgggttggctgaggtggaagcattcttgaacctgggaggatgaggctgcagtgaaccatgatcttaccatttcacttcagcctgggtgacagagcaagaccctgtctcaaaaaaatagagaaataggtggttagttacaagcaaaacaggaaccctttcttcaagaaactgatgatctagagtggtacataaaggaagacttgataaccacacacatggacacacatgcaattatgaagttagtggaagaatcagaagggaaatcaactgtttttagtgatagagaataagacagtgggaggagggaggggtgctccttaggaaggtgcccaaggaagtcctctgtgaggaaaggactttcagtctggcacctgaaaaaaaggagcctgtcatacaatgcttgggggaaggccaatgggcactgtgaagagtcggtgcatgggccatgccttgtaaggcttgtggagtcactgtaaacagaacagacatcgtgatgtgtggcaaccgggcttgcattgccattccggttccatatcaacagttcatttagttttaggtatcaaaatgctgagaataatgaagaggaatattccctgtgcactcctggcaaagttgtaagaaatattaatgaagttctaatcagaacttggtttgcttcatcaaagagagcgttctggataacatgttgtggatgtaaatgtaaaagtaaagaaaatatgtttatcaaggtcaagaatgaagaagtttgaaatgcatgcacacacacacacacatacatgaatgtcactgattagatgccattattgttgatattaagagatatttattttttcattcactaatttattttactaatattggcttgacacttactctgtattggacactgtgttctggttgatgtgaatgaagtcttgaaaaggacagcctttcttaaagcaagaaggggaggacagacaaaatggcaaagcaaaggcagcctaatagaattaagcaaaatgccttaggaatatggaagttcttttttttttggtttcttttgagacaattttgctcttgtcacccaggctggagtgcagtggcccaatctcagctcactgaaacctctgcctcctaggttccagtgattctcctccctcagcctcccaagtagctgagattacaggtgtgcaccaccatgtcccgctaatttctgtatttttagtagagacggggtttcaccgtgttggccaggctggtctcgaactcatgacttcaggtgatccacacgcttcggcctcccaaaattctgggattacaggcataagccaccgcacctggctaagaatatggaagttcttaacttgctttaactcctacctatctcttcagtgtcatcttttgccttatttcagacagagttaacttcatttttcagtgtcttaaacgtgacgcactacttctctctttactttgtaaaggttttgttttgtgcctgaaacatgtaaccatcttctattcatcatttaagcctttatttgaatatatttattccaagcaatcttttttaaatcagtgtttctcaaaatgtgttccacgaaccatctatatcataattacctgaaaatgtgttctttaaattgcaggtttttgcacacatccccaaccacaccctctgaatgagtagggaaccataaatatacatgttagtacattttcctgaaagttcttttgcattctcagtttgatcactgttaccctagatttgtcaggggtctcttttatgtttccatggacataatgatctccctctactataagatttattgcctgaaatctttgctggtctgctaaattaatccaccaatatgattgaaagctcacagagataggaggaatgtgtttgctagtcattgtaagtccactatcaaacatggagctgtgtctaggtggccaataattagatgtatgttttgcagagcaggtacagaagttatccaggtcataaagggacagaacagtcttccaggcagagagaatcatgtctgagcaagttagctcagatcatacacagcagacaggttggatgtgtagctgggagactgggtgttagtgagtgaatggctgttaagtcaggctagagaaataaaattgtgtttagcttatgaacaatccatacctacagaaaagtgtcacgcatagcataatagaaaaaaaagggtggagggggcctatggccatgaaacctaggtttcaggcctgaattggccttggactgattaatttactttaaacaattacttgaccttatgtgttttgtctttccaaactggaagttgtgtataattgtctcactttctcactttataaggaaaaatatttacataggacatacaaatgagcatactaagataaacataaaagcagtaagcaaatgccaagtgtgtgtgtgtgtgtgtgtgtgtgtgtgtgtgtgtgtgtgtatgtgtgtgtaactaaatttgacaatcctctttcaggattgaaagatttatttatttcttggattttgggtcctccttgtagttaagttttcaaactgtttgtcccttacctgaaagccacaatgaactccagagggaaaaatttttacttgtatatacttctcataccttccattaacattgattctgcttaactatattttaccttgatacaacattttactcttataagcccctgttgtatgggtctgtatggttttgtgttgttacacttcagaattcaagtgtcataagtaacttttcacacatagaaaatgtcatgttacaatccagagcaatgtctgtttttagcgaatttctgatcttttcgtgtttctttcatataaaaaaacacacatacacacacaaacctgcctgcacaaaattatcctggattcattctatcactctcttcctgtaaaacaattgcgaatgtgtaaagtgttgtgcattctgaggctacacttgactctttgctactttctctggcatcacagatctactagatttaatagaggagcatagctttacttacaagaaataaaggtgtttgcaaaataatgtagaaagtcaaattttaaatgcccaaaaacgttagtttaaaataagttaactaagtcattcaaaatttgagtgctacatttgttcaattgtgaatcagtagtaaatggaaatgtagtagagttccacagcaagcatattagtatctacaccatagttctaaatgcaacagtacttgggcatgttgaggggcactgaagccaggcaacagagcttggaactgatgaatagtaggaggagtaaaagattttactattactgctaactaccactccccccggcctcctcctcctaacagtatgctttcattatggcgatatgttagtcaaaggatgaacatttagttagactggagaataagttctggagaaaaaattcaagggacctattgtgcatcatggtgactgcagttaatatattatatatttgaaaattgctgacagtagattttaagttttttcacaccacacacaaatggtatataaggtgatccgccatgtcacgttaaacatcttgacttagccattctacaatgtatgcatatatcaaaacatcatgttgtgcaatataaatatatacaaaaaccaaacaaatacataaaacaccaaagctgcattaatggttattgagctataaatttgatttatattattgtatttatttctgacataattcatgtggtaggtactattatccctattttataggggataacattgaagaaacatggaaacagatatcatatgggcaagttcatgattcatcaacttaggtagacctaatttccaacctgtacctatcagcagctcgtgctgtttttacatcacccttggaggacatggggctaaaatcaaaagagaatcaagaaccttattttgatgatatttaaaatgtattgagtgacagaaactaagtcaatttcaaataagacatttggatatgctgttgttttttctttccaagatgcctttggtttcttaaggcagtgacaagacttttgaacattgtaattctttttttggataagatttttatgttagtagaaaatcttgggaaaaatgaaacagggaacactggtatttttcagtggtgtcgcctttgcttgcattcccattttgtcagcttttgaggagccatattcactattaagtttgtcttcaacatccattctctaacacagcacatgaaacagtccccttatctaactccacatgaatctaatgtaattttaacctaaaaacagaaaaatgaattaggaaatacatttgtctttaatgtaatacagagttcagtgaattctgtgaggcacttaaccaaaataacttgtgctttccttagtttttgcaacccattttttagataatttatgtaaaattattttactctatacaggagatattttggagggttttttttttggaggctgcattgcttaaatacagtttggcatttaaaatcataaagacttgggtttaaatctcaaccctgctacgtgatcttcagtacatctttgaacttcttcgagtcctagttacttcatttgtaaattttgaaggttgagaacacatatccggaagaacttttgaggggaatagaaataattcttcgacaacaattattgcagttgtatgtagctactcagtgagtggtgaatgttgagtattttgcagctttaaaagtattgtttttatcaaattattatagcatactacatatcagttaatgctattataagaaactaaaatcatttagaacctttctaacttttgtcttatttttgttttttttcctctccatctatgtaagaatctgagaaatcatgatctcgagcatcatgcagagcatattttctcctatcagggattcttgttctttgcatttcttttcagaaacacctcaaggtttctgtccttatagtacatctggaagaagcacacttccctagagatagggctttatttaaaacatctcttcattcaaggtgagaatgtcatttgctggcatttcccccgacttatcaatgtgcctattcttacatctggagtatgtcatgacagtcactatagtgatgtcctccaaggacctggacactatgtaggcttctttcccactgagtcctgggaatgagagctggcaatgttgacttagatccttcaggcagaactacaatgacttgccattttccatgttctgaaatcctacaatgcaaaaacctcatgatagtttatgctcctcttcccttgtcttctgcctcttcctctaaatatttctgatctttaactctaccaccaatctgtagctaatgcatattctgaattgtatctgggtacagtgagttctggtgccaccagcaaaaaacatctagtccattaaagttttttgtgagatgctttatgtgggacacagtcttttaatgctcatcataccaaacaaacatatgtgatcctttcatgaataagtagcaaatatataccaatgctgtaggagatttatttgaatatttggaagatagaagttttctcatacatctcagagtccttttatatttgaagaagtgacacttcacattattattggattttcattatcatttttgggaaagttctcacaaaatctcagacctgaagttgtagacagaattatagagcacaaagatgtctgtgtcctaatcctcagaacccaagaatacattaggccatgtgtcaaagaggaagtaaagttgcaaaagtaattaatgttgctcatcagctgtatttgaaacaggaagataatcctgtattatcaggatgaattcagtgtaatcaaaaaggtcctcaaaagtgaaagaaggagatagaagagaattataggttgaagtaagtatgaaagaaaggcacagagaaatgtaacattgcttgccttgaaatagagaaggagtctacagaagccatgggatgtgggtggcttctagaagctagaaaaggcaaggaaatataatattccccaagagtgtcaagaattaatgcagccttgctgatacttgatttttagcccaatgagatcgatggcagacttcaaacacacagaactgcaagatagcacacttgtgttttaagctctttaaagtcatttaagtttgtggcaatttgtcacaccagccacataacaatacacgatttgatttttttatgtgaaaagacagagatgataagttggctcagtttacatgggtgttgatggaggagagtaaaattagagcaaaacttagaaaaggcattattaaaggaggttaatttctcattttcctccatatccttatcatacctcttaatgttgccaacataatgcatgcttatagatcagtggaggctctttgaccatttatgaatcaaaataaaattataatctatgccagtagatgagagagtccctactgcctttcagaaaacaaacacattatcttaataaataaccatctcggtacgtgaagactattacaccttaggaaaaaagatggctcattatgcattgcagttttatataattgcatcatagcagtttgttcaattgactcttttaagaaaaagaaatggaatactgagtaatcttaccaccaatcttgaagaaaacaagacatttgatcttgctatgaatcccaaattattgcatgtccatcttttataaagtctcaaagatactttaggaagttgaatgctgtctgctgtcataaaaaacccatgcacaccaatcagttccatggacagaaccaagcaggtggaaatcttgaatagaaggtcagtctacacaggtggcttaaaataatttacacaataaatctttggaaggacaacattgacttctaatccctctacctctttattttttttctcttgctacatttttgagtgaagtgttgtaatgaacatcatagggtgcttgcactaatcaccagtatccaaagataaatgatgatgcagataatgatacaaattttataaagcacctaaaatacagaacagatttattgtctttgttacagttcataaaatacatgaatgaaaatttagaagttggggaaaatttttatctcaaagcagaaatggccctgacaattttctatgaaatgtagttgatatattgatgcttgcattgggagtggaggtggggaaaggagataaagagagatagataggggagggttttctttactcaaacaataacaaggtaatttctgtaattttagatactactcaaagaggacccagcatataatttggaaaaaacaaaaaaagtaaaggacttctgattatcttttacattgcagagaatcttggtttggattctgaagttgctaaagcaaatgccatgggttttgctggatgcatgtcttccgtccagtacaaccacatagcaccactgaaggctgccctgcgccatgccactgtcgcgcctgtgactgtccatgggaccttgacggaatccagctgtggcttcatggtggactcagatgtgaatgcagtgaccacggtgcattcttcatcaggtacactcaagagcatgcacaagggagcttctgtcactagcactactttttgtgtcttcaagaagcttccagattaaagagttggctaatgtgactcagtttttactttgtataataacaggtggctaaaaattatgactgatatttcatgggtgattttatacatatttgatgtagttttatttttaatatgatgagtaattaaaactaaatgcatagttgtgtactttgcttattatgcacgtatataatgcattgtgtatgtgtgtgtgtgtgtttgtatacatagtcactactgttgaagtggatactgctccgagaattgaggtatttagagaacagggaggcagcaagctggtacctgaactaacatgataattcatgtgattaaaataaaccttttttagctttattaagaaataattgacaaataaaaattatatattttcaaagtgtaaattgtaataatctgataaacatgcgcattgtgtaattactatcacaattaaattaatcaacacatcactgcacagttaccctttgtgagtgtgtgtatgtgcatgcacatctgatgaggacacttaagattaactattttagcaaatgtcaagtaaacaatacagtatgaataactgtaatcatcatgctgtacattagttcaccaaaatttgggccaggtgtggtggcttatgcctgaaattgccgcactttgggaggcaaacgcaggaggatcacctgaggtcaggagttcgagaccagtctggccaacatggcgaaaccccatttctactaaaaatacaaaaattagctggccgtggtggtgggcacctgtaattccagctacttgggaggctgaggaatgagaatcgcttgaacctggaaggcagaggttgcagtgagccaagatcatgcaactgcactccagcctggggtatagagtgagactctgtttcaaaaaaaaaaacaaaaaaaaaaaaaccaaaatgtatcatcttctgactgaaagcttgtactctttaaccaacaactctccatttcctgcacacaccagctcctgacaaccgccgttctctctgtttctatgagtttgacttttttagattccacatataagttatatcatatagtatttgtctttctgtgtcttgtttatttcaaattggcataatgtcctctaggttattccatagtgtcacaaatggcacaatcttttttaatgctgaaaatttccaattgtttgtgtatatgccacaatatctttaatcatttaagcattaacagagagtttgtttccatatcttggcgattgtgaataatactgcagtaaacacaagtgcagaaagctgcaggcatctcactccctgatttcaaactatattgcaaagctgtagtaataaaaaaaaaagcataatactggcataaaacagacacatagactaatagaatggaatagagaagccagaaataaacccaggcttatttaatcaactaatctttggcaaaatttccaaaaatgcataatgaagaaaatgttgcttattcaataaattgtgatggggaaattgaatatccacatgcaaaagaatagaattggacctttatcttataccatataaaaattaacttgaaatggattaaaaccttaaatataagacctgagactgtaaactccaggaagggaacataaggacagatctccttaatattggtcttgaaaatatatatatatgtttacatgacaccaaaagtatgatcaacaagagcgaaaatttaaaaaatgggactgcatgaaactaaaaaaccctctgtacagcaaaggacacaatccacaaaaggaaaaggcaatctacagaattggaaaaagaaatgtttttaaaccatatgactgatgaagggttagtatccaaagcataaaaagaattaatataactcaatagcaaaaaaaaaaaaaaaaagaaagaaagaaaagaaaaacacttcaaaaaataggcaaaggatgtgaatagtttttttttgtttttttttgtttttttttttttccacaaaaggcatacaaacatccaacaggtacatgaaaaggtgcttaacatcactgatcgtcagggaaatgcaaaccaaaaccacaatgagatgtcacctcacagctgataatatgatggttagtatcaaaaagacaagaacaacaaatgttggagaggaagtacagaaaatggaacccttttacactcctggtgggaatgcaaattggtacagccattatggaaaagagtagagaggtttgtcaaaatattaaaactcgaatcctatttctgaatatgtaacgaaaataaattaaatcagcctttcttaaaagtagaaaaaacccacagcaccatcatccatacattctctgcttcactaccctctaagtgccttttctatcttttcttagtcactgtcattttgggtgtctgaaaatgtatctgggattttgtcttaatcaggtatgataaggtgacaggcatgagatgattgcctttgaaagaaaagtttatttcttacagttctcaagaaaaagagatacattctaccactcagagccacatggagaagtgctagggttggtcaggagggagaaagagaaaggggaaagtgtggtggggtggctgtgttgcagcttccatgggaaggaatggggtgaaccaggtaggcaagcttgagccagttagaattggatagtttgaataatgtgggcaggatctgcgctacaggggtggtctctagttatctaatacctaatacttggccttgagtgatttaaggcaagagaaatactgggttgtgaatgtgagttagataaatggattagtgtgggagatgggctctggattgattggtttgtgtataaaatgcatgcttgcaggcctattgtttgctatctctaggaatcagctagccctgagaggggcagtgtctccctggccagcaagatcctcaagatgtcaaagcatcataaatactgattaaaaaatgactaatacactgagataaaaccaagacatcaacatgtatcaacaagtcaatataatatagatagaaacagtgatagtgtcttcattctgattatgctttaaagtggtttgtatatgggtgagggagtattatcagatttttctaggatgctttttctaaatccatgggatatatattttgttcagattttgctgctaatattggtatgaaatatgggttttgcaagtagtggtgatgaagaggctaggtctgagatgtttgataaagctcccattttactatggtattgttttaccctccccttgcttcccagcacacactaagaacaatagtggtaggtgttgaagggttctggaccacagtaattttctattacaggcacaattcccccagcagtggtctacgataggtcatgatgtgttagtaggaagataaaaggtgggacatcttattgcattaaacaagtctaggagattttaatatcttgggaaatatattgagaaacacgcactctcttttatatggcaggactcttagccaagacttttagcctgagatctgtagtgcccagtccaatattttgtaaaaattgagaaataaattttttaacaaatttggtaacctgagtaggatatttaaatatttctatctatctactcttccagcaatgtattgcccactcctttactgttttatgtttcaccattttattcttcaaatatgattttgagttctttcaggtaattcttgtgattctcctgttaccttattcatcacacatcttttaagcagctacttagtgttaacttccatagttagtggagataacaaaaaataagaaacatttaaagtccctaattttagaaatctgtaaagatgatggaaggcaatggttcagggaattagggtgtgtcattggatgcccggcactatatcataatacagtgtgagcaatgctaaaggaaaaatatgaacagagttttgggttgtatggaaccaagaaaaggcagtaaatacattttagatgaactaatgatagatttataaataatctggtcatggcaatgcttagggagaagggtttgcaatgttcagaagacagaagcccattacaaaaggaaatatgtaagttaaaattcaaatttctggtacagtgtagcatatttagtaatcagtgaaaacccctcacaggtaaatcattaggtgcaagtgtagaagtccaacatatttcagtaatgaggagttcttatggaatgttagctctctctctatctctatatatacatagatatttcatagagatagatacagatagttgctcaatgtctatctatattattatagtatacaataaattctattctataagaatagatatatagatatagatatgtatgtataatatatacataatatatagatatagaatatataaaatatatagatcttgatctatatctataattatatctatatctatatttatagatcaagatctatatatatgatataaatagatagatacatttaagctgagtcattctttttttgagagggggattaaaactaaaagatagctctaaaattgttaaagacaatttagacacactgtgaagagagaagtactattgaaataaatgaataactaccccaagggttactttgccgaaggtgtccattaagcatggatataggcatggtatttttaacttttgtagtcatgttactgaagctgtcatcatactagatctgaagtattttatttgtagctttaataaatattagttagaattaacaagctgggttaatatatattaatgtatcattagcaaaatttgctagaaatggggaaatctgttgtgaaatcaatgttaagtaataaccaaggttattattttggttaataatgttaaaagtagtacatagactcaataagggagaaaccattgtaagtcggagtaagaaaaaaaagccatgaggctggatgcagtggctcacacctgtaatcccagcactttgggaggccaaggagggcagatcacaaggtgaggagtttgagaccagcctgaccaacatggtgaaaccccatatctactaaaaatacaaaaattagctgggcatggtggtgcacacctgtaatcccagctactcaggaagctgaggcaggagagtagcttgaacctgggaggcagaggttgcagtgagctgagatcacaccactgcactccaacctaaatgacagagtgagactcagtctcaataaaaagaaaagaaaagaaaaaaacaaaacaaaacaaaaaaacagaaaaaggtcatgatctaataaaccataatggatgattcagatttgaatacagtcatgtaccatgtaaagataatggtctgcatagacagtggtcctataagactataacggagctgaataatttctatgacctaatgaagttgtagcaatcataaggtcctagtacaacgccttatccacatgtttgtggtgactctggtatgaacttactcctcaataaaagcctcaggcattttcttcaggaaataactcagaagaaggcattgttatggtagcatgtggtacctcttgcatattgttggccttgaagacctttcagtgggacaacatgaggaggtggaagacaatgatattaacatcatgaatccacataagcctgatctactgtgtatgtttgtgtcttagttttcaggaaaaaagtttaaaaagtaaaaaataacagtaaataaatttaaaaatagaaaaaatcttctagcaaaaggatataaagaaagaaaatatttttgtatagttgtatgatatttgtgttttaagtgttatgacaaagaagtaaaaaagttaaaaaaataaaaagttcacaaagtaaaatagttatagtaagctaaggataatttattattaaagaaagaaaaaaagtcaataaatgtagtgtagcctaagagtaaagtgtttataaagcccgtagcagtgtagagtaatgtcctggaccttcaccacttactcactgacttgcccagagcaacttccagtcctgcaggctccattcatgataagtgccctgtgcaggtgtagcatttatttaaatctcatatttttactctgctctttctatgtttagatatgcttaggtacacatatactcacaaatgtgttatagttgcttatagtattcactacagcaacatgctatacaggcgtgtagcctgggggcaatagtctatactacatgtacagcctaggtgtgtcataggctgtaccacctaggattgtgtgagcacactctatgatttccacacaacgacaaaattgcctaatgacacatttctcagaatatattctcaccattaagctacacatgactgtatttataaagaagcaggaggcattttaagtaggtggagtagcacagggataaacaagaataacaagcacagtggacagtgtgatacaggagatctaataactaaatattttgaatttcctctcttcctgtctccctccctccctttctttcttctttctttcctccttgtcttctacccatcttttaccatacctcatcccctctctccctcccccttttattgactcctctgatttctcattttccttctctttatctgcccgctctctctctgtctctaacacccactatcatcattatcaccccatcgttatcaattggtgacatatatatatatatatatatatatatatatatgttcttctccatgtatgtatgcatgtatgtaggtcatccaggtgtacagagatgattaataatatcaatttccaactccaagttttttccaccagacccaccttatcaatgtcaccagttctgaatacctgctccatggccagcaccttctttaattacaatacccttcccatttgaccccatcagcctctctctcatgttgatttgtttctgctccgatttcaagagtcctaggaaaaggccacccctggacaccacaaatggcataaactaccacactcccttcacttgaagacacaataaatacttaccaaacatctttcacgtgtgtctccacatggctgtgtggcaagtgctgtggtatgaagaattgcgtgtcttggttttttcattagcaagcttgaggtcccactcgtgagactaggatgtgcatgtttatacacataaatgtgtatgtaattaatagtaagcaaaattataagaagaaacaagatttagtgagcacttacgttgtatcagccactgttgtaaaaacaagtatattaacttgtataattcttacaaaaccttttaaggcaaagactatcatttttaccatttgacagagaagaaagtttaaatgacacctgacaggactaatgatgtcatatgggggcttgagttctgttgctgcctgcacatcaccaatcttgatatttttcaagcagcagagaggagtaatagaaagactctgagtgcagtagttggatagctttggtgtgaattttgcctctttcatgaatgatctgtaggacttggacatgttatttgattgtttcaatctagtttccttatttgccaaaggggaacaacaatactcatgttgtagtcattttccaatgatcaaatgatacaacaataataatcatagtggctacttataagtgtatagtagccacaaggtcctgaaaatttagcatgcattatatacacacatataggtattactactctcctttaatacatgtgcaaatttatatttaaaaagaggtcttcctcaatgtcaccagaccaacaaacaacagagcaaagactcagattaaggcctgcgtacccttaaacttgatgctttttcttatatcatatatggtactgtacacacagtacaatttctctctcatcagtgaggcctgctcctgaaggtgttaattctccagcacttttgttctttactgtcaataaactcaggatccttttgcatctgaagaaaactctcaagcagagcagggcatcatgcataggaataggaactgtccagctaggcaacaggggacattaggagcagggtgagggcatgtggacaggataccaccatcctctgttttaaccccttatcttacaatttgcacataaacaaacagggccattgaactatggggtgtgagcagtgcacttcaaatgctttctgcttgtgcatgttttttgagttccttgcaacatatcaactcacaactatttgagggcacctggtgtaatgcacaggtgtgtcattccaggtgggccacactgtaggcttcttgccagtgctttgagtgagaagtaaagtcccatgtcttttactcctttcagatccttttgggaagacagatgagcgggaaccactcacaaatgctgttcgaagtgattcggcagtcatcggaggtaaacaattcattgttgttgaatgcaaaaagacataaacgatcctgtattctggagaaagttatctgaagctttccttaattatggccatccagcactcagagccccctacattacctgcaagactgtgggcttttcatgagtagtcctgtgtgctgaatgatcaaaagcaccctctgccgacaccagcagctctgcggattcatcttgcctctgattcatgaggcagctgagcactgagtcaacagctggagcatttacttacagacagcagctcacattctgctcatttcatacagttttcactgtttctaaaatgcaaacaaagcaaaccaataaaactaaattcggggaagaagccatgttggggcagacaatgggtgaagccgcagtcctgtggagtattccccaccaagtgatttgggttaggtctaatgagcagggtgaagcccacagaactgtagttgcaaatctcactgcacatatggttacagatgcagaccttgtctgctctgctgtgagctcagctctcctgcttttccattttctcattgcctgttggcctccccacttttttattctgcttcagcttggcttcctcctgctgtggcttgatttttccatctgggtctaccaacacagaatgattcccaagctttgcttcatgtaagatgcctgtgaaagaccaaactcatttctatctgagaaacataaccttagcaggtgccgccatccctgccttctggaagcctagatgaactgatccttggcagatggcgttttccttttaaaaacctgcagtacctctccatttagcttatatttaatgagccttgctatgggtcaggctctgtgctaagtagaggaatatggggatgaatgagccagcgaggagatgggtaaacagacaacaagacaaccagtgaagtctgttctgagggaggaggtacaaatggctatgggagcacagaggtgcactcctgagaacatgaagaaaggaaaaccacgcctttccttaaggaagttcctaaaacttctgacctgaatttttgctccagagaagctggaccaccttaatttttgtttggcatagagaaatgtgggaaagaattttgtgcctatttctctttcaataatttcccatttgacaagtggaaaaagaaagacttttgtgactgctgactcctctccagctatttacgtgctctatgagtctctttaaggacagggaagtcatctgaccccctaggaaaattcctggaggcttgcacagctgctgactctgactatcccatgcattgaaggagtaggaaccagtttcctatttcatctcttaatgcagcatcccactcatgggaatcactcactaccacccagtttattcatagacttgctaacttagatgattttactcttacttgttctaacatagttgtagaaaatgccacaaaatgatttaggaacatatatttataaaaataaatcttaatcatggcctcagttctaaaaaaaattggtggaagacatgcaatccatttatgaaacttacaaatgtccatgcttctgtaaatcataattcattatgcccaaaaatagctttctgaaatagacacttttcctcaatatctcctctccttagaaaaatgaaacagcaaaatatagaacttattacaagtaaattctttgcttatcatacatatttttaaatattttcatgctgaaatactacattcatgcagagacacatctgccgcttccatgttttcactattcctttattgatattgcctttcatgttccaagagccttcctggcaaaggtaggggtgagaccctagggtaagcaagaatagcttgcaacataatccagttaaatcacacacagtcagaataaaggggaatctgatgggtctggacagaggtttgccatctcagttgactttgagtttctcaagaacagaggcatcttgtcactgaatgagccttagtttaacagagttcagagcagtgtaaaaatgttctaaatttatagcgatcatttcattattaatgaaaatgttttagcaaaacaaacgtaacataaaacaaatttacatcaggagagcatgtgttaagatgtgagatatttaagtaccattttctaagatgctaaagtaactctgaaatacttagttgtgaggtgacaaaaaaatgggctaattacaaatgattctgacacattatttatagcagacttgaaaaatttacaaagaaaccccttgctagtccaattccatatgtataagatggtattctcagttctttaaacaaaaccttctatggttgaaagtgtctctcgcccccagttagtctgaaagaaggaggttttatagtaattgaagacagggcctttcagcaggtctttatttctgggcaggtggcagagttgcgtttgtgtgatttgttttgttttgctttctctcctacgcattcccctcatctggagggaatccactctcctgagcagatgactcatgacgatttccttctctctttccttcccctttctctccaggggtgatagcagtggtgatattcatcatcttctgtatcatcggcatcatgacccggttcctctaccagcacaagcagtcacatcgtacgagccagatgaaggagaaggaatatccagaaaatttggacagttccttcagaaatgaaattgacttgcaaaacacagtgagcgagtgtaaacgggaatatttcatctgagaaactgcagggttcctactactcttttttcttgttgttcaattatctcctccccctcttctctcctgtcttttgatttggtcattctctttattttctgcttgccatgtcttttctggaacatacttgcatccaccacagcatcaattcccttgatccagcccaagagaccaggcagccatggccactgccttcctctctgatgaacctatcgggtgaaaacgaccactcaagagactgacttcgccattcaagacaaggaagagacacatgtgtgcactcctgcatgttcagttctgtacttccagtttctaaaatgcactgttcagttttccaaccacttggtggttcaggcttgctttgaacctgagctcttaggcacatgacggtcattcctgacatcctccccagctcaagtctattcttaccatagaacccagggcagggagagaagaacctagaggcctggtttgctttggtggcattgtaaaaagagtaagagaggtttggtttgtggtggtttgctttctttaccataagcaatcccttgccttaactcatcaccctttttcactatgacccttagaccctgagtattttcaaatatatgattgctgatagtagtgaccaaaactactttgttcctttcttaccactctctcctggggccgacacgttgggacagcacaccatagcataaagctaggggatgcatggaaatagcagcttgaaactaggaggtaacaagaaagcttctaggaagtagatgttccatatcttcaaaatgcctcctccaattttgtaagaatgctagctaggtattcctgggattattatactgagatatatatatatacacacacacacacatatgtgtatatatgtatatatatatgtgagtatatatacacacacacacacacacacacatatatatatatacacacacgcacacatatatgttgctgcagcataaagaaattgaaataaaagtttaaaatagtacccggttcaatgaaagagcctaaaccatcttaactcagctttaaaacaaaaattaaatcaggaaaaaatgaaaaaaaaactgcatgaaagaagaaaaataccaaacagaattcttcccttccattcactcactaaagacctggtgaagatagttaattcaaatttgcaagtttcacattttttaacatcaagctattctccaagaagtttaggatgcattaacataagtgaaatggtcacctctagctaactagcattgcttgatttcagaggagcccttaggttctgtagcataccacattttcaaatctgctataccctatatacataaagacccttccaaacatctttttataggcttaaactcccaaaagaggtggtgacaaatttcagggtctttgtcccttttggtaacaaagcattgaaaacagtcattccttcaagaaggcaccttgagctcatccatggggtggcggtaaagatcttaatgatttttctgtggcaatatgcatcattctttgtcctgggccatcttggagaaaaaggtaaggagaagacaatgtaaatgctccaagatagtggaaatgctcatgtaatgattcttaggtgtggaaaatacttgctgattctctttatgaggcagattcaatttagaaaacaatgaccacagctctatttgccatccttgacagttagcagacattccaacttgtgcttagggtacactgtctctcgcctctcacaatgaggaacttagttgcttcattccatttcaaacacagcttttctttcagtttcagagcttatgagttaaggatttagtttgcaatcatatttctctattttaagatgttgtttcaaatgcatattctctcctcgaaattttctgtggatttgagctcaatcgctttatcatctacatgatatcttttggctagtacatttattttaaagtgattttaaccatgatatcatttctctccttttagttttaataagatgaatgattctttagtaagatgaaggatctttaaacactgttttcccctgccctttcctccctttcttcaattttcatttttgaattttctatttccataaaaaggctatataaatcagccttttgcttggctatatattcctttgtcccctgaaataaaagtcaccatgaagtgtagtaggtttagcctgaagcagctccaataatgaaatagaaaggcaaaggaaggtatgagtaataaagctggaactcttcattattcaatctttgagcagtgaggactatgttttgctgacatagtgctaatagaagaaatggagactagcaaaggctaactcagagtatttgattttctcatctaagtatatatgcttgtagattgtcctgtaggatgaagaatctgtgaagctctatcctgaccacaatggcactacaaaatcaactggcatcttcctcacgtgtgtagactccatgcacactacataccacagacctaaatgtagatgccaggacagtgccgtctacacgtcactcctataagtagtctcagggctaaagcagaattatttttacagggttgaattatttcataaccccagagaacactaactttcactagatatatatgaaatgcaagtgatccgtaccctccaaagtagaatgtaatttacaattagaaatcgtgctaactctgactgtctttcctcagtggtaccaagatctatgtagttttatgtaattgttcaattgtgtgagtgttttaatccttctgcaattatcatctcgaaggagactttgaaagcatcttaatctctctttaaccattttttttttctttttcctaccacattcaggtttcccaactacatgctctggccaactgggccaccatgatctcttccacttaaatcctcagccttcaataactgctgtttacaaaaagatcttatggaatatggatcactttacagtaaagccaaaagtacttgtgaaatttcacattttaatggagctgtttcattgatatttttttccaccaaacaaatctatttatgtaagcaacagtatatttgcttactctaaaatatatttatcctactgcatcatttattgcatatatagcctcaattgccatctttatgaaaatttgtctggagaaatagacatttgtcatttctatagacatatttttatgactaactttgcctcttctatttaccctctgctgtatgcagaagattttaaggatcctagcggtgatgttttaaaacaacttttttcctctccttagtaataacagagatggtattaacttgacttctaccttttgtcagactcatctccaccaacgggtagcaagagcaggatagaacaaaataaagagattgtttttcttttttcattcatgaagtatttatggaatgccaatgagtgccgggctaggcattgggtgaacatatataaattacaccttgtttttgcccttggggagctcaaagtctagctggcaaggcatgtattgttgcaacagggccacacataaagtgtcctagaatgcagcacaaggtcccgcacaattatttttgtgaagcatctgccagactgaaagaaatgtaaatttctgggaaatatctgttattttttaaattactgcttccaccttctgtaagctgttttgtttctcctcctcaaagtagatatctatcaatgcatatagatttctgtagaaaggggtggattgacttttaggaacagtaagaatagatggtctctgtctctgccatacatttgaggaggctgaattctctacattcttgtttcgggtcaggttgggggattccaaaagtcttgcctcccatgagttggacctaagagtgtccactttggcccctctccttcccttttctcagttcttccacagccatgtgtttatgacctattgcatgccgttgttcttccagatgttcctgaaggtggtttggttgtcatccagctcttcctaaaaccctccttagtcctgatgagccattttgactctacataacatttctgaacctaactgaagtctacccttccatcagtaattgactaaaaaaatgttgtccatttatgtgaggtctcacctctgagcctgagtgagtgtttcctgtcttgaaggtcatacttgctccctctctgcaggaagttaattcagttagaagagttgcactgggagggtgcaagcacagccaacttatccagtccaagatatccagggagatgaggatgagacctgttgaattttttcttaggaaaggaaaggtcttgacagactgttcaccaactgccctagcttcctttaagcttccccatagctaccatccatcaaaacctcattgcagctgtagcctaccaaaaggcctttgggatacctgtatggttctgccagtcattcttccttaatgaaaaggcttggacatacttagtcctcaattatcctacaggtcatgtatcgactaaataaataaactgacttcattgtttctgaagatggcaaaggcgattaatggaagaagatgcagacaaactcaaaactttcagaagtctaggaggataactgagtgctattttctgtctcatgcagtttgaacatgttttctttaaaatacacataatgtaattgaattatttctatatactgttcttgagtctttcttgacctcttcttttatcccctctttcatagtcttgtttgtggaaccatctactctgcagatttttattgtctctaattatcagctctgccttcacaaattccaaatttgaaccacctaaaggggaaaaaatgcaacacacacacgcacgctcacatgcacactttgtacaaatagggctgttattcaacttttctcttgaacattctacatacatatctgtttggtagggagagaagcattcctcttttatgttgacaattatttgaatccttcatataaggttttaataattaaccggtttgctatttttcagtgattattttatcttattttgcactaaggtactctgaggaagaacagaaaagcacattttctagtgaaatattgtactttgtaagctagatgtctgtcttatgtaatgtttatagtctacaaaatggctgagcagacatgaacaaaggttaatgcaaaagttggttttggtttcaaccacacctgctgcgaacttgacgaggaggaagaggggccagtggcagtaattggtggccatctgaggtgaggaaggaaattgcttccaccatgaatcagtggtggcagcctttccactttcatggctcctcactcaggagtctctttagtgcatttggatcattgtcttactcattagggaaagaggcaatatcatgggctttgcatgaataattctttactcacatttgcatgattttttttaccttccaacacttcttcagtcacattcttttttttcaatttttaaattttttttcaggattttctcagagtgctttagaactattattataattatctaacctgcccaggttaagcacccagatgcaactttcaggaaatgaaactgtcagaaaactgccctaggtctattatcaatcagagcccctgtgagtggaagtcctcagattctggaatccatccagtgtctttcttttccttccattcatcctgacatgaataagcataacataactgtaagaaggagtgtagtgtcccagccctgacaacgagtaccgccagggacctaccatctaacaccatctgggaacactattttttctcagtccttccagttgacacaaggaaaccctttataaaataggacaaaattaggagattagtcccaagccaagaccaaaggtgaagataattgtgttagtgattaacgcctggtcttattttaacgagtgtcatagtcttacatgcttcagatgccagaaatatcttcagagaacgtgaacaaagtgctggatatgaaacaggaataatgcattcctctacagactctttgaaaggctttctctttcaagaaaccttgaagggaaaatattaacgggcatcagcctgggcatactttcccatcagagtcagcctctatcacaaacattttacatgaaatattcacctagtctattctctttgaaaggtagtatcaacctgtgtaaccttgtcctgccttaaatactgttgcaaaaaataccaaactttgcttaaagcagcatagttacattgagaaagagactgcctttagtgaggacaaagaccaagaattttctctttctgaatctggcagttgacaggcctcctgatatcctgtgttgccttggactaacattttccttagtcactagcctagggcagaaaggcagccatgtataaatgaatacccatggccatgttccaatataactttatttacaaaatctaatttagttcataggttacggtttgctgattcctaagatagagcattacagtgtctgtttcagatgggaagtaagtcttcctatggcatgttcaggccctccttttcagggaatgagaaagagtggggagggtatttcaacaagtaataaattgcagaataccctccccacaaaaatacacatatgtcagactctttattatggtaaaagcacaaaacaggtcatctttttgtggaaatgctggagtctaccttttcctttttatcttctgatttttgttcctaaaataaaatcccaagtgatgttgcctcattccaagtcagttttgtagaccatgtaacatgtcttaatacactgtatggggaaaaaataaaagttagccttagatttctttgttttctatggttattgttgtacagaagaaagacaaactgtaaataatgtatatttaataaagagaacattttgtatgattttgtgtggaagacaaatgtgccttgctgtgttttcttgagttaatgaagagtcaaacaattaatcccttagctcccattctcaatccttagaccattaactcacagacaacataacctgtggggttgctggagaaacacgaaactcccactggctgggtttattgatttcagcatggctaaaagtgctgtcctgggctccctcatcgctgagctgagttatcccaggcgacacgcctggctcaaatgtgtacaagagcaagctcattgattcagtcaatgtcagcttcagtgttctggagccaccttggtttcagctacccacgtgaaacttcagactctcctccatcctcatcagtgcccactcacaggaactgtatttattctgcctcctgccctacatctttttcttacaaaggaccttaaccctatgtgtttgagactaaacaaacactgctgtgaaacagaacccacttcatgtggtgcttattaagccttctatgtatgaggtagtcagcacacacacacagaaatttaaaacggacggtaatttcaacagaagagagacactaccagatttacccttaagtaaaacctaacttggtttatggtcctttggagaagggacaatagcaggataggagaagaggaggagagaacagttaggggccatttcaaaagcctgagggagggtggtgctggcttggactagcactgtagtaggaaagattctagtagtagctgggtctggacagaaacaacagggatggtggattggaaagagagtgtgtgggggagaaaacaatcaagaaagcttggatttggggcttatgcacctgagtagattggtgcagagtttttgttttattttgttttggaaaatggtgtctgtaaaatgagaagggtagacaagtttaatttcagattttgttaaatttgaggtttaactaggcagcaagtatagatggaaggtaagtggctgggtacatgtctgcagttcagcagtgaggtctggttcgcagacacttgagagatgtgtatatgtgtatatgtctacgtatgaataggtatatccacacacacggccatgtgtgcatacacacacatgcacacaagttggcatcatctacggcaggagtataactaggacataggtctagaaacaatggatgttctagaaggataagctacacaagggaacctgtaaaggtgcactgaaggacgaggaaaaccaggtgagtcagttggagccctgactacaaagtgcttcatcaggaggaagcagagagttattagatgctactgagaaactaagacaggtgagaataaataaaagccacaggcctagcaagattaaggcactgatgaccctttctagagccatgtaatgaagaagttgggagaaaatatgattggagtcagctgaaaagttggtgaagcgctggggaggcgtggaacaaggctcagggcctatgagcagtagagacgcgtgaacatcagagcctggaagactggggctcaaataacataaaacccctttccctaattttgtgatttgaaataaattaaccaatgtaacccttatattttgcagataaaaattgggaaacaaaataaaaccaaaccaaaacaacttcacagatcctgaggattgaatgagatcatgcacactcaccaaccatggagattacatggtcaggggctctctacaatgctgtgtgtcattacttaattttttcatcatattctaatctataggaaataaacacacatatcacacagaatcaaataaagtgaggcatagaaaaggcaatcatgcttagttcggcatgagggggtcaatcgtgatttgtaagcaaatcgggctagaaataagtctaattctggctctgccataaattaggtctgtgacctttaataaatcatatgccgagagcctttgagatgtctcccttgaaagaaaggttgtgaacctaaataatgaaatgaatcaattatcttaaaagaaatgtgataatttgtgacagcaaagaaattggccttacaggcttttagacagagtcatgacttaaaatgtttctgttttttgttttttttttgagacagactgtcactctgtcccccaggctggagtgcagtggcatgatctcatctcactgcaacctctacctcccaggttcaagcaattctcctgcctcagcctcccgaatagcctccagaggtagagaagtgaatcaccacacccagttaatttttgtatttttagtggagacggggtttcactatattggccaggcaggtctcgaactcctgaactcaggtgatccacccatgtaggcctcccaaaatgctaggattacaggagtgagccaccgtgctcagccagcatgttaactcttttaattggtagctgagggatagtaagtggataagtgccttctcatctcgtctctgagtttcaattcctcgtcactcaaaagattttattgtatttttttgttttgttttaagctattaaatttgtggtaatttgttacacagcaatagaaaactaatacaatcatattccttagcggcctcatcatcaacctaagcatggtaccgcataggaataacagcatcttcctcataaggctgttatagggataccattagtttaattttgttaaaggcttagaacagtctgtggtacatatatgagtgtttttaggttgtcaaaaggtgtttaaacaatattcatatcctcagaaaaaattttagcttctctcccttcttttatcatgagcttgattctagtggcatagcagaatcagagtaaaacgggaagttcatgaaggactatgttagtttgaggtctctttttcatccctgcatttggtgtaggccaatgaattaaaggagaaaaagatgtcttttagtccaagcagacatacagtatgtgggggaaaaaaaaaactaaagttatttaaaaatactcaaatttgtaaacgatgtcttagcccattcaaactgctataacaaaataccataaactgggtggtttataaacaagagaaatttattgcttacatttctggaggctggaagttcaagatcagggtgccagcaaggtcaggccatctgctcttgcatcctcatgtggtagaacgtggaagagggagctctgttgagtctattttacaagagcactaatcccattcatgagggctccacactcagaaggcctcactgtctaatacgctcactttacaggttgggttttcagtgtatgaattttgtggggaatgcaaacattcagcctactgcaaagtcggtatgcatttattttaattttcatggtggttcaaaaagaaacttctcctggcctcttatcaggtaaataatctcacagtgcctgctcctctgagccagaggccaggctgaaaagcattttgaatgcatgagagcaatggctgagctcagtctgacaccaacacacaggggttgctgagagccaagtccatgaatgtgaaatccttccatggggaggaaacaggagccctaatgacagcgctgactggtagaaaaggtaaatccagttcagccatgtcctctgaagcactccaactgttggaaagggtcttagagaattcaaacctgtcttacagcacatctttcacctgcgtggaggagaaatgccatcagctgaaagtgcacaagaatgctctctgtgaaagggcagacatggcagctctcactttcctgacactttggtttggagactgtgacatcctgtccctctctcccaggacccttggttgtgtgtgaagctcttatttaagaaatacaggctttatttctatgaagtgtttagaatagtcaacgtcatagagacagaaagtagaatgatggttgccaaggatggcgggaggtgcagggggtggtaacaaaaagaaaatgaagagtcactatttgatgactactgaggttcaattccatctttccgagcaatttgggaagatgcaaagagttctgaagatggacggtggtgatggttgcacaacaatgttaagtgtacttaatatcactgaacttgacttcctgctagcaaggattaaaagaaaattttttaagaaaccactgaactatatacaa

SEQ ID NO: 256 - DNA, 365710 bp, Homo sapiens
tcttgggtcaccatacaggcattaatgcctatattcctgttataatattcataaagcctcctttcattcttgaaaatattcctgttttggaataatctgtctggccgcccaatataaacccttctgcatatatcaagtgaaaagcttctttatctaagaggcaggagtcatccaagatcttctctttgcagactacacccttggagagactcattaagatgaaagacacaaaaaggcctaagaattgatttactttgatcacttaaagaatacatcttgatgtttgaaaataattttaaaattatgttttcatgtgtgtatatacgtgattttaaaatatggacaattttaactttaaatttagccttggtcatatgaacactactgggacttcaatatttaaaaaatatattataccaaataccagtattttttagtaactgggttattattatgttctcttttcccaaaataaaccgacagcctcacaaacaatgagagattattaaataaaggaagaaatgttaggaaatcatgtctgactattttttccactgattgcaacccgacattattggagatctggtcctttacacagagtgggaaatctccaagacgactgaaggtggttgagtaatggctcagacctcagccactcactaattaacttacctgctgtatcaggaaattatgtgagtaaatatggtcatttacttaacttatttgatattcaaatcactggattattaaaataatattttgccaagtcttacacaagtgactttagtctaaaagaaacttaaacactggatccacacagacatttttagtttatttcttcaagcccataaaacaactctaaaatgtagtgtttaattgtccctaccctgtctatacatctgtaagagtctctgtgctcataattataattatgattcatgaaaagaaaagttctttctctggaatcccttacttttcccctactgtctccttttttcctttcctcagtttatctaaggtgattggacaggagtcatccagggctatagcaactccagttcaggttgagggaccaaggaaagctgttaataccctaccttctgtgggaaaaatctggtttcacttgtgggaaaaatctggtttcacttgtagaacttgctgcttcagtctgttccctcttggagaagctagtgcaattctaggttgccgcttctatgccgtgcccctctttctcctcacaatgtgataggaaagcacttggaagggcttgtgcccttgcttggcaccccaaggcaaattgtaacacatggccttgactgtcatttatatacgatattctctccttttcccccttttctaaaggatgagcatttgaaaacaatgcaactttaatttttattgattaaagggagcataaaaacatgattggctcaaaccattttaaaagtctattgtatccttgagatataggtttgttctatgcctctgtttccttcagcccttacatccagcccttcagtgagtcttttcaagtctacctctaaaatgtgtcttgaatttgtttactttttatcttctacaaatatcatcctcattgtagccatcatcatctctcgcctgggtacaacagcttcagaaatggtctctttatatgtattcttgccttgctacaacctattctccatagagaaggctgtgatctttttaaaacaaaattcagtttatataattcccctgctcaaaccctccaatacattcttaccttgttagtgtacaaaatacacaattcactgaaatctaaaaggccctgcaggattcagctgcagactatatcatcctttatctttaccatgacctcttttgcttacctgcttctaggcatgaagccatttctatagtcattggacagacccaggtctgcttaaccttcctctgatcttttcagggctggctcctttctggcattcaggtttcagctgaaatatcaccactttgagaggccttctacagctattccatctaaagttgtcccttacaacctccgccggaaacttttaatcacaccacattattgtagagacacctaacaggtttttgttttgttttgttttgttttgtttttgacactaaatttgtaatggctaggtgcaaacagttctggtaacttcctctctcaggcccctcaaggtctaaagaagactaaactggcttaatagtcattgtcaccagcaaatcagtggaaactgcaaaagaaaaggagttcttctaggagagaaaggattgaagataagccaaagagtccttctcaccacatttggggtatcggatctctctcccctggggcttgtgtttctgaaacctaatgataggactcacttcttcccttgaaatttctgaaggagggatgcctgcagggcaagtggaaactacagtttaggttttctaagaaggaaaggttagggatgtccacatcccagttctccacatttctgggaaaggatgaagtagaggatctcttcagtttccatgatctcatgtgaaagtgactggcattagctaagggataggacttgtagagctgaactggtagttgcttagtgggatttctggaggcaagagacattaagtagaggatataggacataccactggtgggagctgaatgaagatgccctttgtgcatcttcctaaccacagaaaattacaatgcccccaattcatcaccctcttatatctgtgctctatgcaatgtaacttcgaagcttgtcccatcaagggatggagttttgactcttacctggcctgtgacttgcttcagccaataaaatttggtagaagtgattgtgtgtcagttctgagcccaagctcaaaaggccttatgagctttcattctgtcttaaacccctgggatctcttggaccaggctagtctgttagaggatgagagatcatatggaggagagatggcttttccaagtaatccaccttcctaccagccaatactcttatgccctgccagctggtggcagacacatgagagaacctagctgagatcagccaagcccagcctagaccagatgaatttcaaccagcagacttgtgagcaataacaaatggttattattttcagctactgagttttggaataggttattatgctgcagtagctaatgatatgtgggtgaaaaaagctgaatactgtctgagaataccatttgttaccttctatgcaactgtcattctaaaagaaaccaccatcagactgacattgatggagaaaacaggtctttcctttgtatcttagtccatttgagcagctataacataaaaccataaactgggtaaacaacagaaacttaatgctcatagttctaggggctgggaagtccaagatcaaagcagattcagtgtctggtgagagtctacttccccatagatgtctatctccttgctatgtcctcacttagtggaaagggagagggcctctccaggtccttttttataagggcactaatcctatttgtgaggtctctgccctcatgacctgattacttcccaaaagcctcacctcctaatactatcaccttgagggttaggatttgaacatacaaattttgaaggacaaaaagcactcatatcatagtgttctgcctcagatggcagctggctccggatgcagctagcatcccaagggctggggccaaaactgagtgatggcaccgcagcagaaccagctgagcagtaaccacgattagggataggattaggatgagagccattgtctggcagccaatgcaagcaaatctttggataaaagatagtggacttaagagattttaatgttgctatctgaagcactagaagttattatgaggtttttattaaaaataaaacagctctgtgtggaaaacaattctgtactttttggttaacatctgaagtgatttaaaagaagtatagatttatgaactattattatttcctttactagctatgttttatgacttctcgtaattactttaaaaggggttttataaacatagaagtttacatttcaaatgggtaaaaatgggtttctggtaaaataatttgacagcaagaatgtcctcaaatatcaaaaacacaggtaaatctgtcacctttgataaagaacagagtcaagtccaatttatcttattttgccttagttgaatagtcaactacgaaaagctctttgcctagtctgctatgttgtcattttttctcttttaagccaacaaagactaaagcatgttgcagcatatgaataaagaaattctagatccaattaattcatttatggttttcttttcattaaaattggttcttgttgtatacgtatttttcttttttgtaatatcttataagaggaatgatgtaactttgccaggtaactttgaggcctctgctctgcttgagcacccactgagctgttcttttgggtgttgtagctctggattgcaaataggtgcttgcagaacatttgttaaagaagtgattgaagactaggtactagagcatagtgaatgtgactctgaactttggaatgagacagatctgggtgcaaatcctggctacatcagagatttgttcatagccttattgtactgtaaaaataggacaacaaaattactgaaggagttaaaaaagatgaactatgtaaagaagttagcactgtgcccaggctagcacaaggggatttttacaaaatgattctatgagaatcatggaataagctaaatcggttctaaattgaaaataaatgttccagtaaaaagttacaacaaagagaagctcaattttatagacataaactttacataacatatgagccaagtgatcatttatgatacgccaatgttgcattattctttttaaaaatgttgtagatagaattggttgtttaaaaacatttaggagttagatcatttttcatggtctaataataataagagattaaacagggttgtgctctattactgatagtgtaaatttaccttaagtttggtaaaggaatgaagagaatatatgatgaggatgttttcaattgatgagagtcttgtcttcctgtgttgctgtcctcagagttcctgctctgggagtcttttataggtgagaacattttttcctgtgattcttttatcagtagaataattcccttagatataacacaacaaggaacccatcattttttccagacaaactgtaagactcagtccatacttcgtcattagaaaattttatgtccttgattatttaacctctacaggtttcatttcaacaaatatttgaagactatattaagcagaattaattcatcatacttgatgctccgggtattattaaaaatgagaggacccaattccagtcctcaaggagcttacaattaagtcagaggatgcagtacaaaaatatttctgaaacaaggccggggaatgtagatcatcattaaagaggcacaaattgtgctctgtgctgttcagaggcagaggagggtttgtctgatgggaggagggcaggaaaggaatcatcttatagctaacacctgaagtaagccttgaatgactggcagaattcccaaagccactttgcatttcagtgggaggcagcaacatgaatacgctgagacatgctcattctgcggttacaagtcactaaatctggttgtggcaaaatgtacatttaagggaactgataagagtagattgggtgacactgtttaggactctgaatttggcaaaaggttttaattcagcaggaaataagaaatctcatgttcttcatctgaataagaagtagccttgttctctgtggattctttcaacaaacatttattaaagaaacagtaaacccataatttcataattatttagttacaatgcccttctctgtactatgattctataattatttgtaagtatatttatttagactaacaacaaatggatagattttgtccactgaaattttttgattccaatgcttccacgtttgaacatagtccctccaccttagaactcagttagagctttataactactttgtttattgcattttgcatgttcatatcctattattattacgtatttatacatgtcttcttcttccttttttttctgaatgttaaactccagacagtggggcccacgttcaatgtatctttgtatactgtgcagtggtcggtttaagaagcattcaaaaatatatgttgaatgaataaacaatttaattaacatctgcttcctagtgaaatcactagactcagtttaaatggcttaaattacatactaatttttacctggaagattcttgttgaaaatgattgaaaatcttatttaaaaggccaatttctcggctctcttaataccactgctttactaatttgttggagataaaacatcgcattttttcaagtttgttatatttttattacaacagtaacacatgttcactgcagaaactttacacattacatataagcaaaaagaaaaaatcataattctcaaaatctcaaactataagtaaccacagtcactgttttagggtagtttatgatgcagtctatgtgcattttttttaacgcttttaataaacatggctaatttgccctttagaaacactgaactattatatgttcctggaattgttgagaatgctcttcgcttatagtaacaccacgtctaatcagcaatattaatcttggcagaatgggtaggggaaaatagttcctttataaatgtgcatttctttgaatactaattaaattgaatatttttcataaatgtattgaccttttctatttcctttgtaaactgcctctttgctttttggcctatttttctattggggtatttctttctctctctttcactctgtctctcaaatgatttttcagaactggatgtatattaaccaacattttccccagtcatttgtcttttaccatatttcctttcagagtcactgatccctaggaagagtctaataaactaagtgaaagtcacattatgatcgcctcttcctttcatttctaaactgagtaaatgtcatgagctagaatgtcttctaggaagggaagcaaacctaaaaacaaccagtggaatattattttctctatgaagagaattattttcagaagcaacggtaaacacagcatttaaaataaaaagatgtcctaatttacttttggcaattactcagaatttagaattgatataactactttctttttacccttaagaatatcatacatagtgctggcctaaaaaggaatataatgggaagtgcatgctagggatgacaagtcagatttggtaattacagttaacagtaacgtctgttcatccactattgacgcattgaagtatttccatgggatatgtaagggagtcatgtatagctgtgccccataaattcaataaagaatgaacactcttatggtttggtaactgagaagttagctgggggcaatggtgaaattctttcttcctgaaaaatggaaactatgaaaggggagaaaagtgaaagacattacaaaagggaacaagagcaacatgactgggagtacagaagtatagaaaaaaggaaaaaagaaatagacataaagtagacgagatggacaactaagggttaggagaaacacattttaaaaatgtattaaatccaaattataaaaaatggtacaatgatcattgtaaattgttaaatttatatcagtggggcattacaaatatggaacagttttttaaaatgttttcaatggaatttatccctcacatgacataaaaacatttaattgtatcttcctttaggcataaatgttgaaagaagttcgttttttaaatctgttaaattttttaagtacatacgtgcacacagatgaacttggtgttagaagtgctgcaagctgtttattaaaacttagagtgctgtcagattcccctgatattttcagatgtttgtttaccagcagtagcttcagaagcaagaagaaaaccggatcatttataattgtatttggcttagataaataaaaggtgtttggctaaaggttcttcctaattgaagtcactttaaaattcaataaaaagaactggctaaagaagcaaaccctaggtatacaatagtttgtaatcatgaaaccagcctagattcaaaccctttcctgaaagaaaaatagagaaatatttgttgccctggggatgttggtgtatctagaaacagaataagcaacagataataataatttgaagttttatttattcatttttcactttcttccaaaatcttgcttgggtcaatattagaaataagaaaagggccattttgaaatataaacaaaaatataagtgtttagctctctcaaatatcttaacaattatgaaattattaaaatgtttaagaaaataattctaagataaacttgatttacttgtattaaaacaaaaattagagacaaaattgtggacttccttttaggtagttttaaagcattactttaaatagtttcaattaagtgtaaataaggtgaatttaatagtctgacaaagaaataaagcctggatgctcttagttcaattcattagtgatggcaaggtatataaagtaaaattgcttagagaaagaaaaaaatcaaatgggataatacttcaaaaaaatagagactgatcaccaaaagtctaatgaaggtttgtgaatcatgtttttcaaatggccatttgagtagcgtgactcatgcaatatcctccctccttggcctctttccacagtcagccaaaaattagtgatgaaaatcatatgagaaggaaatgtatcaagtggttttaaatcctgacatagaaacatggtttgcatcaccatgaatgccgaactctaaaactgcaggtatcttgattaggttgagagagaagtttaaaaatcacaagtgatactttaatggtttcactccaatgaagtggaaaggagctatcttttaacatttttcttaacatctttattttttgcctgcctgattttatttattccttgatctgtgagctctgatatgtgaagtgtatttctatggttctaaggtaacttttaagcttgatgattttcaccattgtggatcaataatataatttatcctatttctcccactgtggcaatactgaaataaaaatgtaaaaccagtttatctgttttctaatgcctggtttactcttctgaattctataaatcattctgtttttcatatatacacatacatatgcatacactatatgtatacatataaatttactatatatgtatatatacctacaaatatatatgcctacaagtatccatatatacctcctatatatgtatataaacctactatatatgcctacaaatatatatatactctctctacacacacatacatgcacctacacagaaatctgcaggaaaatgacactttcacatattcaaagggatcccaaaagagttcaaaagccaagattggaagcaccaacccatggaaagatgtatttaaaatcacaaaatacttctgtggacactgagaaaaaccaagccacacaaacgtttacatatgagcgtgattagaaggtgggcagactgccttaatcaactttatataaactcttgacataaaagtgaaaaaatgaaacataaatgatatattttcttagctcaaccgttaaaaagccaattacctactcgtgaacgtttgccacatacaataatactttgaagacacttcatgatcagaagtgagaaactctaggcatttgcatccaaccgtcattttatctgtgaaactgctagtaaaacataaacctgaaaggcattactcccagctctaaggcgacatcgctgtcattaaagaaaacctgtgcctgagttggctgagtaccttcttgcagagtcctctgtcctcgcggagtgggagggtcacactgggagagactaataagggcagagatgcgtcccccttccccactcgcagggagctcactcctcggcggtgccgcagccctgtccggactccactgcgcctctgaggggctcaaatacgaattcaaggtaagctgcgcggctttgcgaccggctctgcacttgccctctcacacatgcccgggctatgtcatctgctcgtgttcctagttatctgtgtgcatctgcttttcaagaaaatgtaaaaactgtgctacacatggaaatatgtttaggtggataaataatgcacacctgcatacgtttccataggggccttaaggatgggaccaaaaacgtttggcaggagacggccactctcatgtggtacataccatgtagttcgtgttcctatgttcacatgatgcaggcttcatgcgttacacctaagttctaggtggtttttctggctatgtgtgtctgtgaagcggaactatggagcactgctgatgcgggtagggacagacatcaaatacattacaaaaaaaatggggggttaaaggagtaaaacaaactcactatcaattcatgccgttagagcgctttttttttttttttttgacggtgttagccctggaagcgaggcagccagttaagcggcgtaagctaagagacgcggggttccggtgcggtgccctccggcccggggttacctactccacatgtgggtgtttttcccaagtgcggcttctggggggcggcgcgggcgcgggcggggattcccggactccagccccaccacgttccggagcgtccggccctgttccttaattaccctgcagcatgcgcagcgcggtcggccacagcgccgccgccgtccccgcagtcctccctgcagccaccgccgccgccgccggaacgtcccagtcgcggcgcgaggaagacgcggccccagcctctgccgcctccgctgtcagagtcccgaggccaccgccgagagcgcgccggcgccgcagccacagcggccgagaaccaggaggcggcgccgggcggcccagctagggcgctgcagggtcgcgaggaagtttgttggcccggaaccaagcacgccgtcgggcacgctagctccccgagagcaggcgggcgcgtaagcgaacccccttagaggttacggagggagcgggaagccggcaagagggtgggcagaggagctgggggacaggcgggtgccacaggagcccccgaggagcttcatttgatgagaaggtgaagaggcagaggggaccagcgtgccttgtcagcctcaggggacagtgggctggagagcaaaaagaggagggcccagaatgctgataataagtagttttaatagaacaatccgtgaatagaggcaagagagtgatcatcggccacagcttgagattgggagatggaagagtaagggaaataaattgcgccacctccctcaatccccaattccaagacgactcagtcccatcttctgcttggataagtctgaggaggattaagatgtgaggataatcactctgctgtaggggaatttacatctgcctgttaatggaggagatgaaacaaacgcacaccagtatctattttcaaccaccacccctccccaaaaaggagagaacaccaatgcctccccctctgcccgaatcaaacactgctataattctttaggagactaaagggaaaaaaaaaaaagaaagaaaagagcccctgctcgtatgtggggtcttggcatctccttgtttttgagtggtgggaaacttgcaggaccctctctaagtagagagatctttgatatgggcctgcaaagctgagatatttaggtattccagtggtgaaaaacatgcataaatgccccttcctgaggagggctgacagggtttttgtgtaggaatatctcttcaggatgaaaaagaggagggtgacccccagaggcagaaaatttatgctctctctaggggatagaaagtggagaaagtaactgtcaggtgcttccgttaggttttgtcctacctgagctctctaagtgctaagggacctaaatggggtttcctgggaaaggagggagacagtatggcaaaagagcaggaaagtgaacctgaaactgaaatggacaggactaagaaagagcaaaaaggtgaaagaaacccaaatgtgattattaccacaattgggacatcatctctatatctgaatcattctcatcctagaaaaccatccaaaacagatgggaactgttggtattttccaaaaatggaaaatttccatctactttctggtcctccagtttaatctctcctgctgcaattttagtttattttctccagcaggcagaaatgccaatgtgggtacacagagtcaatggttctagaggcggaagaagatatgaagttagaaaccatggtagtgtgactaagaggcatcacaaatgaaaattcaattgaagtatgaaaaataaactgaaatgcaaggaagtagggctatagatatgctaatatataaccctgaaaagatgctggaaaaaaaaaaaacccagaatgaataggaccagaattgagtcatctgaggcaggccacattgaggatgtacatcttaaacaggcagagaataactagcttagcagaagagatccagcagggagggcattccagccagaagaaattgcatgtgtgaaggcttagaggtaggagcaaacagtcatgtgcctggtaagacagaaaatccaagcggggtgaaatctgagatgagtagagcagatagcacctgccaaggagagattggaaaggactggctaagaagcaataggctttttagggtgttattttgtaagccaataataaaataatcaggtgagcaagttgcatattaaattcgatagaaatatgatgtatgcagagtggactattaggcctctcttatctatgcatacgttatgaagcacaaaggatttctgacctcctctttttaagagaaatcaaaagtaattgtgaaattttaagattattagatcagaaaaccagtagagcccttcaaattgaaaaaaaatgggaaaaaggatgaatttgaaaatacggccatatattatatattaatttaagatgatattggatcattgatatagatatatctgtggaacacaacagagcaagagaattgtaatcagaaaaaaatgtaggtcagttgtgatggttgaaattgagaatggtaccggaaaagttgatggaaacaaatcatagttcagagaagtgagtcggtaaaacagacaagttgatgagaatggagagaataggttaagtgtgctcaaagggaatcccaggtttgagaccctctggaatgtagacactagtttggaagtaacagaagtaataacaaaactgaggaaatgtaatagagttggacatatttcaaagtagtacaaacattaggaactagggagtatgctttctgtggaggcagagagcaacttcaatagtactatttttttgtcccactaagtaactgaaattatgttcactgagctttcttttagtaatttttactctatttctccatcattcttttctttatgcccatcattctacagatgttaagcccatacctgtctatattacttaatggttcccaacctttgatttgtttatttttagtccaagtgtattgccttagactgtatcattctacagattgatcccatgaatacctactaaatgtcaagtttaaagaagacacagataaataaaatacaatctgttttctccaagatgttcaatatagggaagagaaagaatgcaaaggagttatagcagtgcagtataaagtgtgcagaagcataagtgggtattgagctctgttgaatcacaggacagtgagtagtgaactctccctggtatgattctcacagacttcacagaggacatggcatttgagctacacgttgaaggcagactaagtgttttccagatcggagaggattggaaggactttccagtagccaaaaaagcacatgcagaaacctgtgaattgttaataatttgatggcggagagtgtttggaaggaggtagcaggacaggtggttggacagatgagttgaggccccactgtaaaagagccttgagtgcctcactttggagtgggcaatgaagagccaccagaaaactttgagcagggcagttaagtgactaggtctttgttttagaaatagaattcttgagaagtagggaggtggaaataaagggaacaagatggagaaaaggaatccagttaggagtctattgcaattttccagattaggaatggtaaaaacgtgaactaaggcagtttcagcgaggatgagaaagttggtatggattcaaaagacgtttacaaatagatttgatagactttgacagagatttgatatggggtgagggtgaataaattgaagatgattttgaaatttttaacttgagttcctaaattaatgatgatgcctgtaattaaaatgtgtaggtcatgaggtttctgtagaatataatgagggcagaaactttgcctaaattgcaaaagacatctgcaaacttacttcaatttaattactccagccactgataaaactaaggaataatgctagacctagtcgtaaactcttagggatattttgcctgattattggcttgaattttttactctataggcttggctcttcagctggttttctctaatagtttacagactctactatagcttcactaaagacagattctaaagattggtgaaagaacagatgtgtaacacctgttgtttttgcttatttacacaatgtgtcacttcataacagtatgaccagattttcctggtggagttacgtatgtataggcatactggatggtggtcaagaagttttgatttaaaaatcaacctacacagtcacacattatttccctttataataaatgctctgaaaacatgagttctttgagtcatttaacaaattaaatctacttttttgagagttgagatgccatgtacattaaatgtaacaacgtatgtaaagcaaataagtgttctctttctatttcctcctctttctctcttttttcatggttcctttccatattattttctattttggtgttggctttaacactctgaccttttacctaacaccaagtttcaaagatgtacaatgaacactttaaattgttagatggcttaacagtaaaaatgttaatgtttcacaggcagatttgatttggctcactcaaaaactggtgctgagaggctcctgaccatcttatttagcaagtccaccatttttttttttttttttttttttgaaacggagtcttgctctgtcgcccaggctggagtgcagtgctgtgatctttcggctcactgcaacctccgcctcccaggttcaagtgattctcctgcctcagcctcctgagtagctgggactacaggtgcctgtcaccacacctggctaatttttgtatttttggtagagacgggttttcaccatgttggccagacttgtctcgaactcctgacatcaggcaatctgcctgccttggcctcccaaagtgctgggattacaggcgtgagccaccatgcctggctgtacatgttattctttgttttttgtttgtttttttgtttgttttttgtttttcattttaactctttagtgtctctcaaagaaaacatgatgtttgtttacttttgagctctgtgaccagagtggtacaatggactttccctatttggctcactgatttatccccagtgattgttacatagtggaacctcatcctatcaataggtatcaataggctatctagaggccaggtattaataggatatcaatagatatcaatagaatatctattgataggatgaggtttcttaatgcctatgattaatggtaatgagtaatgattaaggtttcttaatgtccctctctattcattttgtgttttctatatacaaataaagattaataagaacttaaaaaaatctatatccttattcaaatatctttggtttcgataggtgccttaatgatttcaagagctagattaagaaagttgaagggacaatggcgttttaaaattcacttacccagctggtacccaaaattattccatatggcaaatgatggtgagaataatggaatggggtaaaggttagggctaggccttcagccacttattatctttttgttgccataagaaatatattacagggacggctgtctgaatgattttaagactttataggctccatcaatgttgtctactcaagactgccagtgctgggcacactcaccattgtgattttggtgctttgtagcactggggaactctggggtctggccagaatcttgatagaaatagctgaaaatttaagagaatgcatgtaggaatgtgatatgtctgtcccacatcctgagagtaaacattatgatatagcagtaaaagcattttagtcaggcagacttggacttgaatcccaggctttgggattattctatgagcgttagtgttttttatgtgtaatatgcggatataatacctgtcttcagtaccaacattaggcctgctctggaccctacattttagaacaccccactatagtcttgctctggatgtgcacccgctctcagagttaggagtttacagagctaaggggacctgcccacctaaaacctgagcttctagaccagtctctgaataatcaagatcctgaaattccctgaaaaaaaaaaacgatccttaatcccccgcagcatctaacagaccctgtcgttgggtccatcttcccagggaaagaccacaggtgtaaacactcctaggcccaaggaatggtcaagagttagctgtttgcaggcattatggacacaactttgacttactggcatatttacatatgcgtgtgtgaggcttttcaagctgcagatggacccaagaaagaaaaaaaatgagggatgaactttggtttaggccagaggccaactcatcccatatcacctgctctgttacattctaacttgacatggactttcaagactttatgaaggtatttgctgaagaaaaatgagaaagcatattattttttatgagtgttattagctttattttaactttcaaatatttaaacatatggtatgcagacctcttgccctgtacccaccctcataataattaacccaatgccttaaagaccccacctcttaatactgtgacattggggattaagtttctaacacaggaaatttgggcaacacattcaaatcatagcaccaatattctccatagccttcttaatatgtactgtgagccatctttggacaagtttgagaaaaaaatttgagggccttaagaaacctcaggatccacatatattagcttgaggttcttcattagccactccattgagaaagcattaaagatctatattatagcttaacttttatctgggaggagcaacacattaaaatctgacaacattggcttggttcatttgtaaatctatcttgataatcacctagctgggacctgtggggacaggaaggaaatgtggcaagttttgatgagcaaggaggttgtggacaaagccaataattgagaaatccagggaaggtaccagagatgtgttcagagcatcaagaagaagcctgagaaccgcaggtgtcagggaatggtgagaggtttctggtcaggaaaaggagaggttcagaaagacacaaggcaaactttgcccttgtcagttttgttgaggtcaacctaccggtgcctccagcaaggtttacaatctgaacaatttgtttttaaaacatatacaaggatttattttgagagcttgatgaaaagtttttcaaatgttcctagctgaatgggctacacttccattttatcaggatctgaataatagaaccctcaaatagcgaacacattttagaaatgtgcagagaggctgggtgtggtggctcacacctgtaatcccagcactttgggaggccaaggcaggcggatcacaaggtcaggagatcgagaccatcctagctaacacggtgaaaccccatctctactaaaaatacaaaaaattagccgggcatggtggtgggtgcctgtagtcccagctacttgggaggctgaggcaggagaatggtgtgaacccaggaggcggagcttgcagtgagccgagatcgcaccactgcactccagcctgggcaacagagcgagactctgtctcaaaaaaaataaaaaaaaaagaagtgtgcaaagagaaataatattcatgataatgacccttgaaagattataagatcttgtaatgccttaagaattatttttaaatattgaattatcactacagattccaaaataagtatatttcactgtatctcaagatttgtaaattggcagtctcttactttttaaaaattcaacaaatatttattgagtctctgattttccaagtactgtgcaaggcacctaggatacagtgatggacaagacagatatagtccctgctctcatggaacttagaattgagtggggagcaataaacatacgtatacagaaaaaataatgtctaagctagagaccaatgtgcttcttggtcaggtaagggcttttgcgcatagtaacatttaaattgaaaactgaaggatgaacacagaatgttccaggatgaggaaataacatacacaaaaaccttgaggttgaaaacagcctggcaatttcatcactggaaagaatggtaccatatgaggctggagatgtggttaggggcctggttatttgggacttctaggctgtagaacagcttttggactacattcaaagtacaatgggaagccattaaaaagcttgaagcaaggaagtgacatgaaccaactctcattttaagaaaagttctctactgctatgtagagaataactgtggtcagaattcagtaatgaatgaattcagtaattaattggaagctgttgaggggtctagaccagggtgatctgaactgggatagtggcagagaaataagagaaataagtggatgtgagatgtgtttggggtaacactgacatgacttgttgatggtttggaagtaggagatggggataaggaagacagaagaatcagtggggtccttgggtttctggtttgatcattttgatgggtagtaattactgagactgggaagagcatgagaagaacaatttgtggttggaaatcaggaatttatctggatgtattaagttatagatatctgtgtgacatctaagagagaattttgaataggcagctggacacacagtctaaagttcagtcaagaggactggatgggagatgtaaattttagattaaccatcttacagataatatttaaagccaagagaatggtgacgtcatctaaggagacattataaagagaggaaaggagggctcacagatcccagtattaagaaatcagatagaagaaaggtctgagaatatttaaaaggaaatctgagagagtgtcagatcagggaggccaataaaagagagtttcaggaaggaaagaattgtcggctattggaggtgccaccaagaattgaagaagggaagagaaacggattcttctttcaagttcctgctgaacttggtgagaggcatttcagtagagtagtagaatggcaattcttcgataactagaacatttagtcaactagccataaatcttattctgcaaatactttggataaatgagatagaagctaagtggctcaaggaagtaattaggagatgtcaaggtcgaattcatatgcttatagctttgtagccctctggttctttgttgttttaacagggaccaaagcttcggtgaacataaatttctaggctgctttgacacttctccattgtccaaatatcaatatcaacctcaagcttaagagacaggtacaactaaatttttccaattattgtttattaatatgtacagcaaacaattataatatcaggtaccttttgaatattgactaagttaaggccctatataatacacatgcattaaataatttattcctagtattatttccaatttgaagatgaataaattagggcttagagaaggtacatagcttttccacaagtagcagagtccagacatgaagccatgattgtcaccactgtgccaaactactaatttgtcaaccaatagaaatcacttttggttaaaaatataaccatggatttctctaaaaataagatcaatatttatgagttccttcctttgaaataaaattaatttctttaacagttaccaactgacttgaaataatagctaggataattttgcaaagtcatatgaggattaggactatatctagatgagagaattcaaaagaaataaggcttaaaaccagctgtttgatatttagaatgacacatacagttttaatattgcaattgccacttctagctattcacccagaaagatctgaaatcttgaattaattttaaaatgctgatcttagggtatttggcacacacagaataccaaagaagatggtggctttagtttttttccagagtgtctactgatagaatttagacactggtataatgaattcttttatatttgactcttgattaaactttgaatgatggcacccaagtgatatgacatttatttgcatatttagacctcttagaatagctattttaataatactgcaattaccaaatacactgagggagccattatattttcacttgcaatttatttccacattagttgcttcactaaaaaaattaatttaaatgatgtttaagttttccattacaggggtcctatttactaaatcttttatttcagtaccaaaggagtagaagtgtacattcagaaagacaattattggaggtaatacattaatattaaatatgatgtcaatggcaggctcaggtgaggtaggcgttgcacgtattcattttttctttataaacataaggcaagattacttttcacatgtgcagtaatcacttcagtaacagtgattattcaatccaataacaacatagttaagtttatagaaaacatgacatcaattaagccaaaatatgtaaaactaatattcagaaggaaaaacagacttgtgaataatataattatattttaataatatgaatcattgtatattatacaatgcaaaaagcataggcaacttaaacaactggattaaaaaaatgggcaaaggaggctgggcatggtggctcatgcctgtaatcccagcactttgggaggccaaggtgggcagatcacgaggtcaggagttcaagaccatcctggccccatctctactaaaaatacaaaaattagctgggcatagtggcaagtgcctgtaatcccagctactcgagagactgaggcaggagaattgcttgaaccaggacctgggaagtggaggttgcagtgagccgagatcgcgccactgcactctagcctgggctacagagcaaaactctgtctccaaaataaataaataaataaaagggcaaagggcaaaggagttgaatagacatgtctccaaagaagatacacaaatgattggtaagcacctgaaaagatgttcaacatcactaatacttagggagatgcaaatcaaatgcacagtgagataccatctgacacccattaggatagtaattatatatatatatatttatttcttttatttatttatttatttttgagatggagtgttgctctgtcacccaggctggagttcagtggcacaatctcagctcactgcaacctccacctcccaggttcaagtgattctcctgcctcagccttccgagtagctgggactacaggtgcccgccaccgtgcctgactaatttttttatatttttagtagagaaggggtttctccatattggccaggatggtctcaatctctttacctcgtgatcgcccgcctcggccttccaaagtgctgggattacaggcatgagccaccacgctcggcctatatatatattttttaaaagacaaaatagcaagcattatctaggatatggagaaattggagcccttgtgcattgttagtaagaatgaaaatcgtgcagctgttatagaaaacagtagtctggtttctcagaaaattaaaaatagaattattgtattgtattgtattgttagcaattttacttctgattctatatacccaaaagaattgaaagcagggactcaaacagatatttgtatatccatgttcatagtagtagtattcacaatagccaaaagatgggagcaacccaaatgtccattgatggatgaacagacaaaatgtggtatatacatacaatgaaatattattcagctttaaaagaggaggaagttctgaaacaatgtacaaaatgatgaacctttaggacatatgttaagtgaaataaagtcatacagatacaaatactgaatgattccacttatatgaagtacctagattagtcaaaatcatagagaaagaaagtagaatgaaggctgcttggagttgggggagaggaaaatgggaaattattttttaatgagcacagagtttcagttttgcaaaatgaaaaaagttctgcagatggcggggatggttgcacagcaatataaatttatttaattccactgaactttgtatttaaaaatggttatgaacataaattttatattgtgtgtatttgaccacaatgtttaaaaataaaaaagtgtcagtttaagtgtagttgcttaaaaaaatttaaaagcagagaaaatttaactgataagaagctgtatcaacatcaataactaactagaaactaatctgaaaatcttttcagagcccttatcatacagattaaggtatatattgagatacaccattgcatatataatcatatttcctgttatatgatgatatatgatgtaacgttgattggttttgctttggtaacattttctggagatgttgaaaggagctgcatacaataaactttattcaaatttttttttttctgttgcagatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattgaaaaggccatagattaatgtactataacagaataaattacaattcattgctttcttccattgatcttcccatgatgcacattaggaattcctaaaattacctcatttttttcatacgcatagtatattagtctatgtttcctttcatcttcaatatttacaagtatacatacatgcatgtgtgcctctgtgtgtatatatgacattatgtatctttccctttcctcttcaataattattcaagttataagtatggaaactcattactaattaggattaacaaggacatatctaatcttaattaggaaaaagtgaaaaatcggataggaggtataaaaggaaatgtagtttaattatatgttcattttgtagtatctcagatgaggcaaacaaaaggttgacagatctttagagcaccttttgaactaaatagacaatatttgcaattattaaatgtatcagtcttttcataaatatttccaaaaggcttaagggcaatttgaaatatttaccttcatctctgcttttttaaattgattatgtggttaatttggaagacttttcttgaacattgagtgtgtataagttacttagctaaatgcaattcatattacaaggttgaattaggcacattggagaagccatttgctagggaaagagaaacttcatctctcctatgcaaacgatcacatataatgtattctgatgataatcacatatgattatgtactctgagactgtattattgtgcctattgttttgaatattttttcaataatttttgctaaacaagtataaacccactctagagagacttttgagtttgaggcacacataaaatataattactcataaagatctaacacatcgtagtctttcagagtgttatgtaagtctttatgattttttattatttggcagaaggtgcatttcctaaaataattcacatgaaagtttgaatattctgttattgtacaaaagacatcctgtggctgtcatacaatttgggggggaaactctttcttcagtgagaaattaatcagctgtgactcatggcaactacaactatgtaaaaaaggaaaagagatgttagagcagcggagtttattctgatacgatttctactcttctgaatttgtcttttttgtaaagaaatatagtaggtaatgtgctttgcaatttaatctgatatgacaggacttttttagttagaaggaagaatgaatctttggttgaatagggacagtttttaggcacatgctagtgggtagtaaatgttcttgatgatagcaaggatttgaaggacctaaataaatggttctccaattttaacatgaaaaagaatcacctgacgtatttgattcctgagacctcctatcgcatattcccattttgcaggtcgtactggggtgggatttggtaatttacatctttaacaagctccacagatgaatctaatgcaggattatctgaggaaaactcttagagaaacacttacctttgggataattaacagacattttggttttcttttttcttttcacctggttaccttgcattttatgcaccattttatgccaaggttacctttttttgttattttattttattgtttgcttttagtaactttttaaaattgtgataagaacacttaacatgaagtctgccctcttaacaaatttttaagtgtataacacagtactgttaattataaacacggtactatacagcagatgtctagaacgtaatcatcttgcataactaacacttccccatcttgggattcccctgaatgtttgcttttgtagctctagtatctcaactctttaatcaggttacatgatgtataggactaccaaaatgcatatattctgatccaatttacttcgctgaattaatcttttgaaagattttcccaacaatgtgaattcaaaattaatctgaaccctaacaagattcacttaacatgaagcattaagggaaattaataaaagaaaaaattacgtttgtttttatcatgctatttggtagagggtgttcgtaaagcaacacgtactgaatgtgtgatggaaattgcttaacttcaagtatcatttgcattaattgaaaatgtcagcacagcactatcaaagggattgttgaagaagatgacaagctgggcatggcctggaaggagacccttcttgtgtcttgtgtatctggttcacagcgcaaggttccctttttagtttcctcatgtgcagacctgcgcgtgtggtcactaaccatttaccggagggaagtgattacatctaaaaataaaatataacaaatctgagagagagtctagggtttcagggctggagtctgtgaagttgtcaacagtttactattaaacctaaatatatgacagatagattggaccttttaattgctgtaccttaactctatggtatgttaaatagttacctggaattgtcacagttgggacagaatttaagagtaatatggagagattcaataataacttgaattttaaaattttgaaggtattaggaattcagtcatttcatattctttcgtcaatttgcctattgagatcatgggataagatatatttgtttattttcccactgcaaatgaacttccatttgaatgtggcagtttcagctcagttacttgtcaaaagaaggtggggaagagaattgtgttaaaatatatacaatgctagaaaatctcaaaacttgctttaattagttgcttaaaactctttcctctaatatagactatgtatcaaataattaaagtttcatctactttctttaatctgttctaaggcaaaagtactatatcatcataaaaagcaataagaaacagaaaaccagagtttaaaaaaacaggctaaataaatagaaatgacagaatgctttttaaataacacattttcctttcattatgataaatcttcagtttaagtgtccagattgacttgattataaatttaaatttaggcctgtaactattcatataagcccttctaaggtagttttctattaattacaaggaattacaaggaaaaaaacctattattccaaaatgtggcttttactagttggcaaacacttcacgcttaaactcagagtaaaatgtatgctgttatatagagaattttattttgtgtttttaagaaattcttgtgttcaacattggtaccatgtaaaaatccttcattgacaaatgtactttgtaactcctaaattttgaaagtggaggaaagcttcacaatgattagataaataatgtagcttctaactaggtattttcctttggaagaattggacatttaagcagaggcatgaaggcagtgtgagggcaaggcacgtgaacacctggaaagcagtcacttggtccccaggctctgaggcggcggcatgcttggcatgtggaagaaatagcaagaaaaactgggggactggagccaagtgaatgagggggaggaggtgtgagggtacatgctcctgagaaatgcatctgtgctttctgtgttgtcaaaatctgatttctaagcctgcaaggtcaaaggctagaccttggacactggtaaattcaccaaagcaataaatcctgtcctatgagacctcttggaagatggtcaacctttgccatgtaggacccttcccggatatcaggtggacaggcaggcttctgaatgtatgcccctcattacctcttggtagccttatgtcacagttaattgaatattgtcatattgtattattcataatacattgttattaaagtacagatgtgtggagatatgtgcattttagcaaagttaaaatataagttataacttgaccagacaaattatgttttctttccctgcaatcagcaaactggtgtataagtaatacaagaaccctcactaaactgcaaagagtataacagaactcgtttacatttattttgcacgatgactgtaactttgattttcccatttgtttttgtattacccaaggaatgacctcatcccctggcttttcctaaggccagaagcctctgtgtccagagagcaactagtccattttcagtctgagtattagcagtatacacagatctttcaggtattaaatcagttgaaaaaacaaaacattaaaataacggattttagctgatctgagcttcttagccattcgagaggagaaaaaaggaattcaacatactttcagggaataataataaaaaaaaagtgtaaaagagggatttcaacatacctatgattaatactgtattaaactgaagatttatatgaatgggtatagaaagtatcagacctggccgggctcggtggctcacacctgtaatcccagcactttgggaggccgaggcaggcggattgcctgaggtcaggagttcaagaccagcctggccagcatggtgaaatcctgtgtctactaaaaatataaaaattagctgtgcgtggtggcaggcacctataatcccagctacttgggaggctgaggcaggagaatcacttgaacccaggaggcagaggttgcagtgagccaagacaagatcacgccattgcactccagcctgggcgacagagcaagactttgtctcaaaaaaaaaaaaaaaagtatcagaccaatgagaggaaaaatgtttaacaaaagatgtgatgttatcttaagattagaatgcctagcaatacaataggaggtcaaaccagtaggataaaacagagattaaggggaaaagtgattttctgtgtgtgtgtgtttaagcacatgtttaaaactgagggtgggagcataatgcacttctactaaagaatgaagataatttcttaggtatgctattattttgtttaaaatatgtatttaagaagcaatgttcaatacagagggggaaaagttggttataggacacttgtgttttctttccactctaccattgagtggctggctttgtgatcttaactcctcttggatgactatgttcttaggttctcaggattctaatttttggaaggagaaggggtaaacatcttttttaaagtatgtattttctttgtaggtaatctagataaaataatgatatacccaaatatgatctagctgccttcctttggctcttttctctttttttttttttccagactgagtctcgctctgttgcccaagctggagtgcagtggcgcgatcttggctcactgcaacctccacctctgcctcccaggttcaagcgattctcctgcctcagcctcccaagtggatgggactataggcatgtgccaccacacctggctaattttttgtattttcagtagagatggggtttcaccatgttggtcaggctggtctcgaactcctgacctcaaatgatccacccaccttggcctcccaaagtgctgggattataggcgtgagccaccgcgctgggcccctttggctcttttcagtaccccccaccacctctgtaagttgcccaggtccttcaagccaaatcaggaggaaagtggggctgatagttattaacatcttagtatgaatttgttaaaaacatttgcctttgcttttgaaaaagatctgttaaggttctctaagcagtgcttcttttaaaaaaattataaatatttaaaaaataaattttattgtgtatatttgaggtctatagcatattatgggatggatataattaaatgactactgtagtgaacagaataacacacctatcacctcacgtagttacttatttttgtaatgagtggctaaatcttatttaatgaaaatctcaaatgcaatacaattttattgtattttgttagtccttatgttgcacattccatctctagatacatttatcctacatatctgctattttgtaccctttgaagtgcatttctccatttcctccctacctcacaccagtgataaatattcttttattctctatctctgtgtatttaagctcttttaaaaaatattccacatgtgagatcacacaatattttttttcctgtgtctggcttattttacttagcatactgtccttaaggtctatctatgctgtggaaaatggaaggattttctttttttaaggctgaataatattccattggataaaatgtctaaatgtaatcacaaaaaccgtaaaactcccagaagcgatcatgggggaatagttccccaacattgaccttggcaatcatttttggatatcacatgaaaaatctcaggctacaaaagtggaagtaaataaatgggactaagtcaaactaaaacacttatacacagtgaaggaagcaatcaacaaaatgaaaagacaacctatgggctgggaaaaaataattgcaaactacttatctcatggttaatatacaaaatttataacgtatttttaaaactcaatatcagtaaaacaaataatctgatttaaaaatggacaaaggatcaaaatgcatatttctacaaaaaagagataaaaatgtccaacaggtatatgaaaaagtgatcaacattactaatcataaaggaaatgcaaattaaaccaccatgagacattaccttgtacctataaggatagctattatcaaaagacaagagataacacaaacgtggcaaggatatggagaaaagagaactctagcacactgttggtgggaatgtggattggtatagccattatggaaaacagtatggcggttctgaagaaattaaaaatagaaccaccatatgatccagcaacccctcttttgggtctacatccaaaaaagatgaaatccctaccttgtgaagatatatctgcacccccatattcattgcaacgttattcacaatagctaagacatggaaacaacctaaatgctcatggatggatgaatggaaaaagcagtgcgttttttttttttgtgtggtgaaattttagtcattacttttgctatagtccagagagcctttgaaatgacacggtgctttgcctctgtctacttgacataatatttggatatttgagtcttttctgtagttcttcaaaatacatgcacatttactcaaaagtgctctttactttatattaaagtatgtattttaatacttaaagaaatgaacatatccaccttgtgatagctatttccactgccttgccatttttgtgtaatgaatccataatattcatgtattcagattattgtgccttaaatcttacacctaaataattaacatttagttttattttttttcagcttttcaccacaaagcacgtatgctaaagatatgaaatggcatttgatttttataaaggcttttagtgtagaaagactttaataaatgttgctagaaatgttgaattccattcatttcaaatgataggtttattactttgaaatcatcatatatttgctaagtcctcagaagaatttaaataagatatatactgtttccaacttggcaataagccaaccaaagtgtcataatggaaagcccctttctactatcttgagacttgttttgctaatcacctactggggcttccctacatacattgtgagtaatttaatcttatttattatggttacatagtcactcgtagtcattataaaaatataataagaatggagtttttttgagtttttcaagagtcatttttagcttaaattattttctcacagagatgctattttcctccttttgttgagatattacacacaccaaagttgacaaatcttagtgcacagtgcagtgaatttctatggatatatttatacccctgtgtaactactactcagacctaaatacacattctcaaaacccagaagccttctgtgtacctgctcctagttaacatttcaccaaggtagccactacactgacacagattagttgtataatctctagaatttcgtataaatggaattacacagtatgtattaatgttgcaggacttttccttagttcagctaaagatgagttccttgtcccatggccatgaaaattcaggctcacagacaacttgaatagtgagtaagacagggttttattgggtgaaaaggaaggaaagggggaaacaggaactctcactaggccagagtccctgctagagcacttcccaccaggctgattgaatcccaggttccacacaggaaagaggatgggccaggctcctcccgctaaaaagggtgtgaagttcccaaggctccatctcagtgggcagcctggttggaatttctccaaggaccccctctcacctggctgtctcattcctccctctaaagaagtacatctaattgctcttagattaaggataaggatgaagaccaatcttaacttcttcctgctgacagggtgtgctgttttggggaaatggcaggtggagctccctcagaggcctatctaaggtttcccagcagaaagggccattgtcagaggttccagttgcattaccgtttagagtttgatggcctgaaggcaagaacagacaaagccggttattagaaaacacgtatcaaaatgaaacaaggggagggataaggcagctcaaaaattccaaggccttttaccagtttgcacagggagacggaggccaaacacccaactagcaaaaaaaaactttactcttttgccagcatgttgggcttctgggtttccttccccagagtccaatcctaagccaactagtttaaggtttgggaaattaactctttctagtttgaaggatgcatttaaggggactgtcctctagtacaaagacacaattacctatcagtgaagagaggacagaggagaagaaaggaaaaaaaaaaagagagagcacctgtaatcccatcactttgggaggctgagatgggcagattgcctgagggtcaggagttggagaccagtctggccaacatggtgaaacccatgtatactaaaattacaaaaaaattagccgggcgtggtggcttgtgcctgtaatcccagctactcaggaggctgagtcaggggaattgcttgagttgcagtaagctgagatagcgccactgcactccatcctggtcgacagagtgagactctagctcaaaaaaaaaaaaaaaaaagcagtgttcccattttttcttgtttattcacacttctgtattatttttgttttattcttgtccagtgttactttacctttttttgttaactggtgttctttttcccaacctgatatacttgatattcctttgtcagatgtattggcaaagtaggatgtgtacaggggggctgaggggaactagtaacaaggaaacaaagagcctttatttttttaagaagccttttttaaaaaatgcaaaatgcctaaaggctcttgttttgattcgtttatgaaaggaaaacaaaccagttctgtatctatggtatattgttgctctttatcttccccaactctaaccttgaggaaagaactgccatgagctttgtcactatttgtaaagaaaattatttttcttaacgtatgttggagaagactgctaaatagaacttgtatcagactagacagattttaatcgtgactttacatgcaataatgataataatttcatgtatgataattctgaagatatgaagaaataggaaaaccaaagcaggaaaaatggacaagtgatatgttacaatttctcaggagacaccacttgctcccgttctctttttatctcactcactatgtgatctcatctctcctgtggttttgagaggtgaagccaactggacttcctgggtcaagtggggacttggagaacttttctgtctagctaaaggatgataaatgcaccaatcagcactctgtaaaaatgcactaatctgcgctctatgtctagctaaaggattgtaaacgcaccaatcagcactctgtaaaaatgtaccaatcagcgctgtgtctagctaaaggactgtaaatgcaccaatcagcgctctgtgtctagctaaaggattgtaaatacaccaatcagctatctgtaaaaacgcaccaatcagcgctctgtgtctaaaggattgtaaacacaccaatcagcactctgtaaaatggaccaatcagcactctgtaaaatggaccaatcagcaggatgtgggtggggaaaaataagggaataaaagctggccaccccagccagcagtggcaacctggtggggtccccttccacactgtggaagctttgttcttttactcttcacagtaaatctcgctgctgctcactctttgggtccacaccacctttaagagctgtaacacttgccgcgaaggtccacggcttcattcttgaagtcaacgagaccacaaacccaccagaaggaagaaaccctggacacatcggaaggaacaaactccagacacaccatctttaagagctgtaacactcactgtgaaggtctgcagcttcattcttgaagtcagcgagaccaagaacccactggaaggaaccaactccggacacagttttacataggatttatatgtcagtcactcccaaatgtacttcacagccctcacctctcttttgaattccattcctaactgtctatttgataactccattgtttcaatttcttaatggcatgtcagatttaacacttctaatttctcctctttcccactacagattaacttacgccttgccaagttttcttttatttttctagtgggatttatttcagtcaactaatctccctcctccctacattcaatcccttatcatctcctgttggttcttgtatctctcaattccttcccatgaaattgaagatgttttccattttcagtgtcatctctagtccaagctaccatcatatctggcatcacagagtatggcagtatgactaagtttaccaggtaaaatacagatgcccagttaaatttgaagtttaaacaataaataattttttagtataagtatgttccaaatattgcgtgggacatacttgtactaaaaatatttttatttatctgacattcacatttaactgggaatcctgtattttattagctatgtttggtaattttatatatgtgagggagaagaggttatttattacacagagtggtcagggaaggctgccctccaacctcactgggcaggctggttggagtttctccaaggaccccctcccacctggctgactcattcctccctctaaaaaagtacatctaattgccattacattaaggataaggatgaagactgatctcaacttcttcctgctgacaggggttgctgttttggggaaacggaagtcggagctccttcagaggcctatctaagggttcctagcagaaggggccattgtcagaggctccagttgcatgaccatttggagtttgatggcctgaaggcaagaacagacaaacccatttgttagaaaacacatatcaacatgaaacaaggggagggataaggacagctcaaaaattccaaggccttttaccagtttgcacagggagagggaggccaaacacccagctagcaaaaaaaaaaaaaaaaactttacccttttgctagtatgttgggcttctgggttccttttccctgagcccaatcctaaaccaactagttttaaggtttgggaaattaactctttctagtttgaaggatgcatctgaggggaccttcccatagtacagagacacaattacctatcagtgaagagaggacagatgagaagaaaggaaaataagagggcaccttttaaaggagtcccagggattcaggatgcatttgaaaggggtacagactaaagatgaatggctacccatctagaatgaggggagcaggcatgcctggttttcttctcttcctagcagatacgtggggtacatgagggagagagggaagaatgtcctctttccctcttccatccttgcatccccaagtcacagcgaccttggcagctgccgccatgagtgccaaagtgactttcacccataaaacaggaaggacctagagaataggaattatccactctcacctatgcctctatcctccaaactgtcagtagctttggagttccctacacctcatttatgccatggatattaatgtggccttcatccatgaaacaggaagctaggggttggcttaatcagcaggaatcagccacacatgctcacctgcactgtaccttttaacttccattattgtctgcctctggatccctaagatccatttttctatcctagggctttgaccagaagcttagaattgagtctgggatgaaaatttgtcttgagggagttgcatggactccttatcataagctgaatgctaagttaaaactgtggaactgagtcctcctccaacaagggaggggaaaggatgtcttgtgagacacccagataactggtagctatagttatgcttgctaagatttgggtgcatggtacttggctttggttagctttcttggtcttactttcccaaaaaggaaacctccgagtggtgggtatcctatttatcccaactgcctggcaggatttgcaggataattgctcagaactagaatattgatccagatttctacattacccatcccttttgttctttctgagctgcagctggagactgctggttggttcacaggaacaagcagggttagcctaaaatgtaagcgaaaacttaaaaacaactagtgagtttagaatttaatgacaaatatatgatacgttttgaaacatgatttctctctctccagtcctcatttttattaaaaaacaaatcatcataggactgagtggtttgcaaaatagactttacttttatacttggcctgattatttgcaaaaatacagcaagtataattatttttacataggttttttggattggctttgatggaactctgttccccaaggaatctcagataagatcttttaaagctgagcccagccatgggtttatcctcaaatacctgtaagttgagtgatcctctcctcttaaggtcccataataaacttggagctcctagatctgttagaaagtgacattctttactgaccacaggtcaggaaccctgtacaggaactgtgtagacaagggtatgaggcaactgggcttctatcatccctgcaagttgagattgactccttaaagggaagcatacccttccagtctaagccttggtaaaacaaccactttctccaattgtgtcctgccacaaaagaaaaatggattcttattccactgatgcaaacggctatattaccataagttgaggatactcactgagagtttccaaattctataggaaccaggaagagagaaacaaacgtgctacaaattttgttcataggagtataccttactcaattattaaaggccgtaaaaggttcaaaataaatttcttcgactatgaaaacccaaacaaggatcagcaatattccaaccaaaagtcaaataagttgcttcagctttctgagttcagtccatttagttaactcttgttttgcttgatattcgtgaatgtttcagcttttcatgagtcctgtactattttcctttattccaaaggttacaatttctaaagctatcataaacctatatttcagagcacctgttacagttctatagcttattagaaaccatcttttgaaaaggattaaaataggacaacaattgtctgtgaatagcaaaatgtccagggtaattacagttagaaacacaattgacaaaaaagtttggttatctccctaatggtttacagtaacttaaaatagcaactaaggactaagctctgatttttatcttgcccagattcctttctaaggagtctggggagtcatgccctacaaaccataaattctcatcagatgggttttatttaaccctgtatattgtgacttactttccaatctgactgtggcataacaaggaagaaaattacaatgttttaccccaaagtatatttccttgccataccttgaaattgccctgcaaaatctcttgtgggaaaagtccacattctatagaaaattctttctcctttgttttctttcctttgtttccagatccaagagataatcaactaacagccaggtacccttttaggtctgataaacattttacaactctgcaatctgagagattcctctgcacaataaaacttggtctccacaatcctttatcttagcctgaacattcttttccattgatcccaggtcttcagataaactcaaccaattgtcaaccagaaaatgtttaaatttacctatagtctggaagcaccacccccgccccccactttaagttgtcccacctttctgaaccaaaccaatgtatttcttaaatgtatttgattgatgtctcatgcctctctaaaaatatataaaaccaagctgtacccctaccaccttgggcacatgttctcaagacctcctgagggctgtgtcacaggccacggtcactcatatttggctgagaataaatctctgaaaatattttatggaatttgactcttttcatcgacagtagtttcaattatgtgttataatagtaattcctagcatctttaactttaagataaaacttggtaagttgctttgtgtgctaactgcagccaaggtttgctttcttcattaagggcctggttattccatatgtccccaggccttaatagttgtgaagccagcaagtcaaatagttctcaaaacccaaaaagcagtttgtaaccttaaaacacttagcaaaccttgcatctgatctgcagtttaccaataatctctaaggcttttttaatttctcaaagattaaagtcatgtgaactaaaaggtactacagattttatattccctttaaaaaatatttgatctaagcacttgtctttctttaggccaaattaattagagctcttttgacaggcattaaacacagtacatagacatgcagaagaaaacccagtcgctgggtggggccctttaaaggacaggcctgggaaaacatgcagatatcaaaccagaaagaaacttattccctaaggcaggattgctaaacaaagccttgccaagcagttacaggccatgcccccaggatgtaaaacaagatgaggcttgcagcacaaaccacacagacatgcaaagcacaccagattggccacagcccaagactagccccacaaatcctgtttcacaattaagctttacagaaaaaataaacagtgatggttgggggatctggcctagcaaagggggaaaatatctttaaggcttaactgctgatggagtggagaggaggaaagaaaaaacattttttaatgcttgaggaagaacctcttattcttatacaactgattcctccaccagggagaaaagattaagcttaattactgtccaaaagagttaaacccgttagccagggaagaggaaggctgtggcagcagtctgtggctgggaaccagtcagctggctgtgggggacttttgagccatgcgtcctagcactgcgtagggtgtggggatcggcatggagctgctgctcaccagtctgtcctgaaaaaggaaaaaaaaggccatgaaaagtctcccgaccccaaggagcgacagagggtggtggggtggtttcccataagctcagaagtccaaggacgaaaaggcttagaaagccacagtgagaggttttgtgttctcatttcactcaccacttcttgagctcccacattgaacaccaaaaatgtcgcaggacttttccttagtgcagctaaagatggtgttctttgtcccatggccatgaaaattcaggcttgcagacaatttgaatggtgagtaagacagggttttattgggtgaaaaggaaggaaaggcagaaacagggactctgtctaggccagagtccctgctagagcacttcccgccagactgttcaaatctcatgttccacacaggaagaggaagggccagggtcctccccactgcaaagagtgtgagcttcccaaggctccacctcagtgggcgggctggttggagtttctccagggaccccctcccacttggctgtctcgttaatattttttgggtgaatgacttttttctatttaatattatatctgtgagatttatctagttgttgcatgtatcaatagttcattcttttttatggctatacagtttttcattgtatatgccacaatttaattatcttgctccttcttgttgataaacattttggttgtttctggttttagactattatgtgtaacgctgccattaatattcttgtctaaaagggccatctacacttattttttggtactcctttctcctggttcattgaattttcaagtcatacagttcatatatatttagctttagtaaatactgccaaacagttttctaaagtgtactaatttccattctcataagcaatgtagaagaggttttgttgctccacatcctcatcaacgcttgactgccatgaatattcttgcctaaaagggccattacacccattttggggcactcctttctcttgcttcattgaattttcaagtcatacagttcatatatatttagctttagtaaatactgccaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggtgcctgtagtcccagctactctggaggctgaggcaggagaatggcgtgaacccgggaggcggagcttgcagtgagccgagattgcgccactgcagtccgcagtccggcctgggcgacagagcgagactccgtctcaaaaaaaaaaaaaaaaaaaaaaaaaaaatactgccaaacagttttctgaagtgtactaatttccactcctacaagcaatgtagaatagtttttgttgctccatatcctcatcaacacttggcatcttcagtgctttaattttagccatttagtgatatctcactgtggtttcactttgcatttccttgataactaatgatgttgagcaccttctcatatgtgggttgaacatttggatattctcttttttgaagtgtttaaatctttttgcacatttttagaataagattttcaagctttttttgttattgatttctgagagttcattgtatattctagaaatgatactttattgcatatttggactggaggtaacttctcctaatttatggcttgactttttactcttttagtgttgccttttgagtaaagatgttaattttaatgaagttcaacttagcaatctcttcttttgtgattaatggtttctgtgttcttttcaagacatctttgctatcccaagttcatgaagactttgttgtcttgtggatgctttactgttttacctttcatatttatttctatgattatctttagttagtttttgtgcatggtgtgaaataaggttcaacattcagtgtttttctgtatggatattctgttgacccagcaccgtttagtaaaatgaccatccatttcccactgaatcaagtggcctttctgtggtaaataaggagaccatacgttttgggttatgtttgtgtttttccatatgtgtaccaaccccacagtataaaaaaatttatatctgatagtttaaagttctctagcttattcttctttaattttgccttttactattttagcttgttttctgtagtttcatgtaaatttgagaatcagcttgtcagttttacacacacacacacacacacacacacacaccccatactgttgggattttaattggcattgctctgaatctagagataaaaccaagaactaacatcttaacaattttaagtcttgcattctaagcattttgtttatcccttcagttatttaggtctttaatttctctcaggcatgttttatagattttagtgttcagatcttgaatgaggtgcttgggttttataaaagtgactattaatccgaatcattaattggtaatgtttacaaaatctctaataattttactattatttagagcctgcaattgtattaagagttctgagatagcaattttccatattagctaagtaatatctaaaagtactcagtgctataatttcacttactttacaaattgtgttcaaaatgttttttgcagtatatttgcttcttatttttaaatttgattaagtggtagcattatttagaatctgatttattttctggttaaatatattaagatgataccctctcaccatgcctgaggtctgtgatatatttgttaaatgaagggggaactggtgaatcggcaatttcaatttggttttaagtagtttatctcctctctatattaaaaacttcttagttattaaacccaaacatcaattttagacatagagaattaaagttgtgattgcatgatgccaaaatatttaatcaatttagtttaaaatgttaaactaatggtcttaactgtccagttgtacagttatcttggcacaattcaaaaattggctgtaattttgtctgaattaactgaattagcctgattcaatttaaacatgtcctaagacgttgaaaaattggtgtgtgcatatccattactgtattagtgtgtagtggtagtattaaacatgtacattcactgagttgagactatcttttatttctttgaatatcactaagtgctgtagcacataagtacactttctcaatgattttatttctttttttaaaattataggccacttttgtatggtagagatctttgctttttaaattttattttagtaacttccatatatgttgcctttagtttttaaagtttcatatcagccaacaccaaaacttgaattaaagttgtgataaaatatagtagtagttcacttgttttactattgtactttgaatacgaaagtttaacgatgttaaaactagcttatttccaaatgtcaaggatacataaagtgttcaaataatagttataataataatggctaacactaacaagtattcactgtgaaccaagcagtgttcttagcactctacataagtaaccacatgtaaccctcacaaaaacactgaggtggttaatgttcttatcctcattttacagaaatttaataaatggtttaatttatttccattttatcttaagtttctgattgtactgtgtaattaaaattcatacataatgcaaatcctctatgctttttttctttttaaatagaagagtcatgccctatcctgagaatagagggacatcagctgacatatgacaacataaacaaacttgaagtttcaggtaggcaatataatcctttgcaaagtaatattttatgtaaaattatcaccaaatgctagatatggaatacattataggtgaatctttgatactgcaatttaagatcatagcattaacgtgaaaattttaagaattctttttaatttttttttttttttttgagacagggtctcactctgtcactcaggctggagtgcagtggtgtgatctcagcttgctgcaacctccacctcctgggtacgagcaattctcctgcctcagcctcccaagtagctgggactacaggcacatggctattttttgtatttttggtagagatggggttttaccatgttagccaggctggtctcgagctcctggcctcaagtgatccatctgccttggcctcccacagtgctgggattgcaggcgtgagccaccatgcccgacccataaaaatttaaggtagatgatgtagaaaaaattccgaaagcagggttctatatgtttaatctgtgatcaacaatacctcaacctcttggagaaaaaaaaacttatttaaaattataaaagtgtccattgtagaaattttggaagaagaaaaaaaaatttgtgagaaggaagatgtcaccacccagataaagacaagattaccattttggtaatccttgttatctttccttttggtaatctttcttatctttctttctccttcttttcctcctccttctcttctctctctcccacataaatgctaatgagtgtgtgacacacacacagttataattcttatattacatttcatgtgtatgcatttcctgtcatcaatacacatttctttaaagcataattttgtaaaaggctgcttagatttaaactgaatggctgtactatttttaatctaattttctaactttagacatgagagctgctgcaatgagttactctaatttttacttaagataattcctaggtcaaaggaaattaaaattgagtttttttgaaatatattcatgatttttttctagaaaaatggctacacgttctatatgcaaagtgaatttcattctcttttaccctaaaaggagaaaaataaaatcaagaaattttgctgatcccaagcagcaagatttcgtttgaagtgaatcaattaatagataagggcaacacaaaattctgtttagaaattaacatttctattagtttattaaattgaatcatctgttacattttacaggttttgatctaggagacagcttttctctaagacgtgcattttgtgaaagtgataaaacctgtttcaaattgggaagtgcacttcttattagagacactatgtaagtaaaaaattattttctttatgtttaataatacttcataaattattttctaaagagatttcaaataatttgttttaaaaataaagtttctcaatagcatcatcctcactggaatgcagtggtaaacgtgttgttaatgtatttgttgtttataaaaatcattgcaatctaatcttggctctacagtgtaaatatcatttatatgtacagaaaaaggcacgatcattagagaacagtaattaaatccatttctgaagaaatattgtttatgtttaaagtagacataaccaatattaggtttttcaaggtaaacattaaaacataaggcactatatagattcagagccaaaagactgatatttattgtataaatttttagattttctatgcttcttaagttaaaataaaagaatttagctcttaggtgttcatcttatctattgtatagagtacatagtaaataaaaagctgttttgtgcttttatttttggtcttgatactcatttaattttaaaatagatttaccaaagttttcccttactttttctttcttttttctacagatacacttagagttacaaaaaaaaaatcactttccattcaaatagtgacaattggtcagcaaccatacagggcaacaatgatttaccatatagttggcaataattaaaggatgacttcatagtaattcagaaagctgagttatcaggcaggcaggtagcacatatggtcaggataattattcctggagtccaagatgaatattcgcatgtatgaatataccgcaataaaaaccctcaaaattctacttagcttcatatgcaacacaaatgtttttgtgtgaaaatatgtatgtatgttttcccttcctgggcagtagcctaatatttaagacagacaagattgtggagaatctcaaaatttgaattcttaaagggaaatagcattaatcatctcattgcccttgctcagacgttctgtgtaaatgaggttcataacctacactttttccctgagaaaagtttcttttaaacctattttgtgatacttttggtaattttcatttaatgactgaaatggctccttaaaagtaaactgctcaatacttggtaagaaacaagaatattaaggaaggaatttcaaatcaggggatataatgggtggttgttaggtgggacacttcagcagatgtaactgtatggacccacgctacagctgccgctgtttgggtggtctcataagtaggcattaaattctcagggtacagcagttccatgcttaggtatgcataagccataaagaaaagatgagaggcgcaatatttctcacatgtatatatttagatgtttcttaactaggagtagataactttaattaataaatttaagaaaggcaatacattctgtttaaaaattaagatgcattttctctccccatcttctttcggatttaaacccctgtaatgctggccagatggcaaaaggattttggcaaaaggagtgaaaccttttaaaattcattggattacatgtgagaagacttagctaattttacgtagctacactggaaaacttgctgcgacatttagacaatgctatttctttttaaatttatgtgattataaatattaggcaagacttggaatttgttttctgaattttgggttctaaatcactgcccaatccatgggtaatcaatgtaagtgaattctctggttctgtggagcagaacctggtacctccactataggaaaccgggggtatctggttgagctgcccagtgagtatcaagtagcttggctcatttccacttacatttcacttgttgagccaagtatgctaggatgcttctcttgcatgatgccattttgatttttcaatgagactggagtaaagttgtagctatttatatatttgtaaataagctgctttgcagagtcagcatgggaaaaggcagattctattttatatggaaaatggggatgctttctgtgcctgagcttccttttattgttctggcatatcccaggtgaggttcgtgagaggagagacctaatgagtatgttggtctgatacctgttaggcatattcaatgccttgagccttgcttaatgtaaaactcccaaagaccgcttttgcaggggccttccagatagacatctgtcaggtccacaacccaggtactaacaagggtaaatcgtgagtctcaggcaaaatacaagtcaccttttatctctggataacaacgcagtaaccaagagcttctgccctgggcaatagtatcacaccttatcagttgcccatggttcttttgggtcctgtacctgtgctaaagttatagggaagcttatgagaggccacacagacagcatatatgttccctggaggagggtcccttccctggccattcccctaccaacggttaattgtggaggccacactttaaatttccaaggagtaacttggaaattatactgcactctcacgccagggggccacaatagccaaccatctacggtgaggggcttggagggtccatggccaacaccaggtttttttgttattgttcccctacttttaggggtgttggggcaggcaataacagattactgttcatccccgtacctggctggagaaggtcatccttcctgtcatagatctggccacatggcctggccctacatgggtcagtgactaactagctaattctataactttcaggtaatgaaccacaaggtttagccttgataaactgcccagcatcggttcagattaccacaggtgtcacctctttggtgatcactatctacactgccttgagttcaacttattaactactttatctacacctggttttaaaccatatgttgtcagtgttaggctggactgcggcagcaatcaaggcagcagcagtcctctggctagacctatctgtataccatgccccatcaggagtggtgggggtgcctcaggctccatggccttatcttgcattaggcctataggcttcaagacctcttgtaaatctgtgctaagggacttgtactcagcatacttcactgctgcaagtaggggccccacttcgctaaagtggatgtctgcaccttccctatccagggggttgttacccatgaatgtacctaccacactgttgggtacactctgcatgatgactatatcccaatctgccatgcttttatgagcctgaagggcagcatacgcacttactaactgcttcccagtccggggggttgttatccataaatgcacccatcctgctattactaactgcttttctatcaaggaataccagagctcagctcccttccatagctgggaccaaaagcctactgatattctcaggtgctccgtgcactgccataggccctaactgaaactatctgtggtcacatgcacatctagcttaaatgggcacctcttgtcaactacctgtagggcttatgcctgctaattagcctgcttggctaccaggaagactgtctcagcagcatcataccaatcctaggcaaggggagcattgccgcttctaaatctgcaagagaatcagaggttaacataacatcattaataagatcatgacacatggtggggctatgtatatagccccgcagcaacactgtgaaagtccattgtcaacctcccatcaaggcaaactgatggccttctgcctccttgagggctgccatagcagtagtcacttcatgtaggcagtgccccacatatggggtgagaacagcagctagagagccaaaatcactcgggggcactgagcccagcacaagatccctcatgtgggagggaaagcgttcatcatctggcccccaggtattcagatcaaatggtctgctctatacccatcttccagagtatttgcacaaaatgagtatatgatcgccatttactcacagtttctagtatctctccagcatcattccaaacagtccatattgctgccattagccactcgattaatgtgtgttcaccatgcccttgtgccaaccatcggcacagatacagccactgacgaagggaggggtgagttgtgataaaagccagcttttccatctcagaggtggagcaagaaatgctgccagcctccttgtcccaaagacagagtggccaggcagggaggggcactgggtgctgctgacactgttacctaactctcacaactcagtgggtgtataagcactataagaggtgtgttccactactgtggggggttccagggctctccactgggttcccatcagatggtcatgttgtaccttttgacagatcatagggtgagcctgcagtggtggagccccctcctcctcaggatcagaccaaatgggactgtccagcctggaggacaggctcaaggtcaaacttacagctgttgctaactcttgttccaggctgtttatctgggcctccaagtgccctgcttgcacctgaaggtccctcacccccggttctgctacaagctgtgcacttgggtccctaggcacacggcttgtgctgggatgtcccttacctgtggcactgagcatgtatttcacacagtgcagtcagaaatgcccatccaactctgctggtggaggtgcgttccttctcggtgctgcgtgcttccagctgcctcggtgctttctccacactcacaggagacctatccactgcctcccacatttccattggggcccatccaagcagcaccactgacaccaggtaccacagcccatgctgcagccacagagccaacccgggagccttcaggggccaaagacccactcaccttatcctgccaactatgccaattgtcaggtccatgactacgccagatgttatgctggggtcaggttccagctcatgctgagatctgaagggagtgggtgggtgagcagagagctaaaagaacacttggagggctgtaggcaggtgaaaggtagttttattcagcagctctctcaacagcagcttacacacactaggtctctcaaactgttcgctctgtcttggctgcttcatccggtggctcccacacacagctacatggacagctctcccttcagggtcagcagcttaactgtttctctctctgggcatgagtgagctgagccgtgtcctggctccccgctgttcatctgcaaagatggacagctttgactctctgtttctctgggcgcaagtgcacttgtacagtgtcagcagggcaattatacctttcacagacaatagtggcgtagggccaagggatggccttcccatgttatggctacatggttttgataacaagaggagttatacgcctgtgctctaaactcactgagtcactctggatgtttacctcggcctatccttgaccaaagcacagccgtgttccttacaacatcattgtacacttagaggtggcacaggctcaggggatatttgaggggctttatgtgttttgttggctttaaattcatgtccattcttcagtatttatgggatagcaaatggtaagtatttgggggctttagaagattctgggtggcatgctacctagttctctagaattatttgtttagaggaaattttcttggcttcttatatctccaagtatccctagttatttaaaagagataattcattatttgtatacatattgagagctatagcaaagaagattatattttgattattttaaaattgtgttttggcagttatcaggggaaattggtaaaatactgagtaaaaacagataaaaacacacacaaacacacatactatagagtaccttattttcttggcataatgtagtctctatctagcttccattagttgcttcaatagaaaattcaaataaaatgtcttagtattgaatattttagatgaatgttgaatttctacatgctgttggttctgaaggagcaacacactcagcttgactggccgatgaagaaattgatttcaaatgtaccaaggaagtgagttttctgattcattgtttaattcaagtatggtaaagagccttatcccttaggctcttgatagctactggctgtctggaatgctatgttgagaaggattctggagccatagtgggtttaaagtgctgtgacccattaaaaaaaagagggagggaggagtgagcatatgtgttccatatctatagcctctctgaattaggatgatttctgtaagctggtggcttttgcaattgaagcagtgtctaagaatgaggggaaatgaggctacgtgtgaaaaaataacacagattaaatttaatacgatttatgagcttgaataatatagctagacacagtgacataaatgacatatatgatccccttagtatttgttacaaataaataaatctctagtgaaagggagtcttctttatctgtgtctctgtatctctctcattcaattggtgtctactttatgaaagtaaagataatttagtttcatagctttatgtgaaaataagaggtagctggtaggagctattctaaattatgtttatggatttacaaacataataatctttagcaagtaggaaacccaaactacaaatttggaagatgtgtaatgtttttcagaaatatttgaactctggactttaacagttcccttgaaaataatccaaaatatggacaaaactgtcatatgtgttgtaacatgatgtttaccttgtcttttctattgttgaatgatttatcccatgggactaccttttctacacggacctttacactatcttcagattattattattattatttttttttttttttttttttgagacggagtctccaaaaaaacagagtctccagctctgttgcccaggctggagtgcagtggcaccatctcggctcactgcaacctccacctcccggtttcaaacgattctcctgcctcagcctcctgagtagctgggattacaggtgcgtgccaccactcctggctaatttttgtatttttagtagagacagggtttcaccatgtcagccaggctggtctcaaactcctgacctcaggtgatccacccgcctcggccccccaaagtgctgggattacaggcatgagccactgcgcccggctgatttttatcattataaataacactacaacatacaagaaagttgtttttttctgtatttaggattattttcatacaattgacttttagaaataaaattacttgttcatatttagggatcttgatatatactactaattatgttcaatcattgttttctccatgtattctgcatattttccaatatcttctgtagcactaggaattatcatgttaagattttgtgttttatttaacttaaaacttgtgcagttacaaatagaagctgtagtttactgtataattttcacagaagttcctaaaatgtttctgttttgctaaagggtgaataagaggtagcattcggtaagtcactgaaatgaatgcagtctagtctagagcttatccttttactcagcaagcatttgttgagtgtcaccatgggccaggcactttgctaggttctgagcttacattgataaaagaatgtggatctagtctttccttcctggaacctgctagaaagatacacagtgcaaggaaaagctacacttcccccttgctttgccttcatagaaggcaactgagatgtattgccttctattgttcaagcttagactgcatgactcaaatttcaccccttataaaggctaaacttccttaagcatcatgcacaaggctaattttcaatgttttcattccttgcctcttaagggactattttgagggactattttgtaatgcatagttctcctttgagtcctctccaagttctcaaaacaaattcagaggctgaaaacttgttcagaactctgatatcgaagtgtctccttgctgagtgttttagaaggattactttacaattccattaagctctagagaatgcctatttatgcatcccttgggttttcatttggggcattccttcattgtgtagataggaattttcctatataaggataggtgacttagttacaaagttgtccagctgtttttatgagattgtatgactgttatacatgattatgtcatcactgtatttccttcattgcagtttggcataccaagaatctgaggttagtcattaagtcatactttttttaaatggaaagaacatatacaaatatttactactcaatagtcaaaagcacctattttattttttctagaaaattcagaattgttaataggcagcaataaatttcttagtatagaaatagctattaagatgtaatgtaatatgaaatattattagttcagtattgttatttactgattttggaaacatttgatgttatcattatcaaatttaagtaagttgtgattttgctctttcagatttcatataactcagtattgggaaaagtagaacatatcagtaattaatcatatgtgtataaattctacaacattcatatgacttaaagttttttcttggacttgaccattcatttattagccagagagaaataagtttgtttaaaaggtacagaaatgttttaagtttaatgtctatttgtggacattagtagataaaatcttataaaattaaaatatttttgtgtttcacatgagttaaaatggaaaaaccataaatctatttatacatttaagaaactaaagttcctatagtaagaaacaataatgtcactattattgccttcaaagaatgtattcttaacaattaaattacccaaaaaagcctcacataaaatggaatgaaagtgagaagctgcaattcatttacaaacttatccattttctagcctcaaatgtacataaactttctaaggaaaagagggtaggttctcatttctgaggaaaaaaggagtagtttttcacttgtcttgttgaaacacaggacagaacattagtaaagagtttgcagaaagaggtataagatacggttcttgcctctagggagtgtgtgatatctctcctcttaggggcaagaaatgaagacagacttaattataattataattataagcatacagttaatgctttaaatgttcaacggaacaaatataaagacaaaatctcttatatttgggatgataaaaaaatatcttgaagactatgggatttaaactaggctttgaaaactgaagagactactgagagtcagagatgaatcaagttctggggagaagaaagacatctaaggtgagggaaggccctaggaggttaagacatggaaaaatacaataaatataattacatgagataatttctatatgagtaaaacattgacaacccaatttatccatatccaaggtggcaggcagtttgattttctctgatgctcacaaacattacataagcccctggcaaaaattttgaagaactgatatacgattttccccaccacatccagatggcttaagttctaatgaaagtctacggtcattcaaaataggtaataggcctctcatatggtatcatataatcggaaaggtattatttttctttagactccattgctcacatcagaactcccattctttggccaggcaggaaattgttcagatatataagccttacagggtagagattacatccaactgattcatgtttgtgtccctcgtggtacctgacacacagtggtgtttagtgctagttgaattggtatgatcttaagtttaaattgaagggatatttgaaatttattggtacagctacttgcatattttaggcaaccaataatttcttttcaccagcacctcaaaaaataaggcaccttacttctaattcttgtactagatcttttcaccaaagaagacttaagaacaaggcacatgtgactacccagtttccaacaatgataatgattcttataataccaccttacatttatgaatgttatatgatttacaaagtaattttgccttcttgtatcaatggtaccacaatgacttctgtgatgtagtactttatcaccattttatagatgaaaaatgaggttgaatgacattaaggaattcacctaaaatttcaaaaataataaacagttgtgtctagaactcagttcttctgtctccaaatccagaattaatttctactttattatgactaattacatgtaaattatcttgttatgtctatatgccatttactttgatagtagtgaggtactagctaaatgtactacttaggagtcataataaagcaaatgttctcataaagtaatgaaactaaagtgttctattttgataattacttgggccagtctaataggcattgattaatctacctctattgttggattatatattagatttttttctttttccagtcattcttttatcctatgaatcaatcttgtaagggacagcagagcttttcgcctggtagggttgtgtgaatgtatctgtgcagtgtacactgcagattttcagagtgtacaaaagaaaggcatgtaagcatgtacttcagtcttatctttaatcttaatttggctcataaaaatgctatttgaggactaattagttattatccttaggtggttgcaaatgcgttgatttataatggttgtaaacctacaaataagcatggtcttaaatttatgaattagagaattgacctttaatagtgcttgatgctttgttatactagtgcttcagcatagctttataacaactctaaagatttttctgtaggctgattggactctgtgtatcacaaaatagcatcaaatagtctaatcctccttctcagacacagtcagactgtaggatataattataatttcaataataaactttgaaatctatgtcaaccaaggaagaataattgtgccaactgataaatcattactttattgtcatttcaattctttcaacttagccacaaatgctaattagaaaataaacatggtagcagaaaaactatgcttatgttattttatgtgattcctgtaagtttcctacatcttgttcattatctcatttaggtcagcacttatgtttcctaagacacttttttttcccccaaattaggtgacattttaataattttagactaaagtaataaaatattcaaataattgacttgattaattcctttcaccctggctatatctaagtaatttggaaacatcataagttcagtgaaaatgttaatatgaacacatgtggtgatgccatgcagaattaacatctggctggttgaatttgagactgagttgaccagatgttttgtgttcaagttatttttcttatttgaacaatctcaacttcttctctctacttcataatttcttaatttcagctgttctccctggaggcaaccccccttctttcaaaggttaaccccttcacttgtgctcttaatcctctcctagccagcctcctctaagaccttgatccacccatgatccccctgctcttgggtcttcagtgctcctctccacagtatcctggcctcttactctacaaatatatacttaatccttccctattacagaaacattttccctgggcagtcccctttactcacagacttcttaaaggaacaatgttactgtccacttttacttcttcacacatcccttagcccattaaaatctgactaggacttcttgaacactatggaaatttctgcctcatagttgccggtgacagctgtcctaattccaatgccagcgttgacctaggtgttgcactaaacttcctttgttaacccatttctgtctctctctgtcataccatgcccaccttttctgcccattggaatcctacatatcctagaaagcttagtacacatgctacattctacactaagccctcactaatgtccttcaagtttccttctttttttggtggtccaataccactttttccataattcttacataattctgatctcattctgacttgtgtaatctaaatgttctcaggcctcgttaatatgtggatttaaatgatattatattaacatcaatgcgtaaattgatattacttctactttctacatacatcactgcttaaaacctactgttgttatttctgggagcccgaaaagtgatgcacatgtgttcatgttcaaaagcagatatgcttttcttcttgttttctaattttcttatcaatgcgtgttgctattgccattgctgggagctctctccatgcaaatgctactctgtgagacccaaccaacctctgctcatggctgctcattcttggcccacaggtgccagaattaccctgtggcttatgactgtgtgaggtgtgcatgtgtgctttggaaggtggtggcagagatctaaagaccccttctctaactgtcccctgggccctgaggcagtgtatcttgggcacagagcctcacagagtgtttaataaatatagtcctatcaactcctggctcaccatcatttgtgagtctcaaaagccagtagaggccaggcacggtggctcacaccagtaatcctagcactttgggaggccaaggcaggcagatcgcttgagcccaggagttcgagatcagcttgagtaacatagcaaaaccctgtctctacaaaatacaaaaaagttagccaggtatggtggtgtatgcctgtagtcatagctactcaggagcctcaggtgggaggattgcttgagcccagggaggttgaggctgcagtgagccctgatcatgccactacactccagcctgagtgacagagtgagaccctgtctcaaaaaattaaaaaataaaaagtatgaatacgaggcaattctctctgttatcctcaagtttgcctctctcttctgatttacccacaataagaatgtaaagtttcttttggttaagagggctatattgagaaaaaatattttatgttatattgtcattattatttctaccttcagctttgatgccagtgaaagaataaatactaacaaagtatttcattcaattcccaaatgatagtaaatattatatgctaaaccctgagaatttaagggtgaatagaaacagtcccctccattgaattatttctgtttggaaggacaggccaaaaataagctgttatggcatataatagcaatttttagatatatgtatgataaactctgagagaacagatgaagccaggaaaagcttcatagaggaagtgaaaagttgagccttgaagtgtgaatttaccaggtgagccaaggggtcaatgtatgttgtggtagttagagggagcatcatggtagttttaaaggtcaaagcaatttgaggaatagtgagaaatcccatgtggttaatgaacacaggtgagaagaatgtctggaggtagagaagacttgaaagtgtgggctgttctgaaaggtcttacttgctggcatgaggggtttgaactttattcatattttaaaaaaaagtggaggtgtagtagcaatagcactacatgctagaaaaaaacagctgagcgcatatgccattgggaaaatctcagctttcaattaggtctaggacctcccaggctgatcctaaagcaacagttgagctctcggacccaaggatacttcagaatttagaggaccttttgcgggcagggttgggtttaatccagggttaaaaaaaaaaaaaccctttcctggctgagggacaccagaaaaaactaaccttcaatgtatcctcatttctaaagagcagactgtctaatttatccttggtttttgttatctggatggcatccagtagggggacttgttttcaatgggaagtcgtttacaatgccacattgaactagtgctaatcagatcaggcgtgagattgttagagggtcatccaagctttgttttcccattaacaacctatctgcctgaatcccctcagcaaacacaaaagggctaagatttcagagtctctgtggctgtggaactccaacatcatcaaccagcctgggaggaaggcatttcagacaaaccctctaggccctgctagccaaattgcttgtaactgacaggtgatggtgggtgtcagctgggaaagaaatgacttactataaactccaagcatctctcacttcactctcaggaaatgtaacttgtatcatatttctcttcctggaagatattcagcaagtcagaggcctcactgatacttgtaaatacggaagttcttcctaaaccctgcctcacacttactcggaatggcagaattaatttggaagccagttcttgatatttaaaaatcgatttttttccatttagccatttaattttataagcaaaattaaataaataaagcttggtcttgttaaacaaataaataaagcttagtcttttaaatatgatctggaaaattcactctagctctatcaaaatagcactttgctttcaaggcttatgctttgagctggttgaagaattacctccggaaccactgtaatcagtaattaaactttttaaacactttgctatgtgaatgtatctcacactcaatttttagaacatcatttatgaaatgaaatttctctagaataacaatgtcatcttgcttttcagttcatgagcactgaaattataaaagtttcttcatcttttttttatattttagttcttgtctcacattccttattatttatttaagcaaaagatcaaacaggaaactggtaatcatgaattttcttcctaatcctttcttgttctgtagcttggtttatcctttcctttttgtatatttgaaaccgaactgttactacacagagacgtaaccatattacaaactgtggttcttttaggaacactgaacaaaaacatcaaatttggacttgctatacaatgaaattgctaattacttaatatactaataagtaaacaaatttatgagcttcattattgtctttaagtttcttgacaacaacccaccagggcctagtcatggagaacaaatgcaacctactgtctgcttctatctccccataaaacaactgtcaataaatatgagcatgtactttaaaatagtgaattaattttaaaattttctgcttttccccaactttgtcatacttacaatgctaaccattggaagggagtctgaaaagcaaagtttatcctcttaaggcagtttttattggcttctcattaattggacagccgggaatgctcattatttgttcagttgataccctctgttgctgggagaccagatacttcaccttcattaagttaactttgtagataacaatggcaggccctgatttcacaattcagggaatgaatagaatgaaagtttactgtgtgccaggaaaaccataatgtaggattggtgcaaaagtttctctttctttccatcatcatttgagatagtcacatgatcattattttcacgtttgaataaattacttatcttttagttacgttaccattctactgttgttcttcccaaagtatgaaaatcccaatgtattacttttcattaggaaaataaatacagaggtactatttatcagaacacgttttacctttcttcacattacctagttactagtatacatactgttctcatgattttcactactacttcctgaaaattacactcatctcatctttttttttttttttttttttttagacagagtcttgctgtcgcccaggctggagtgcagtggcgcgatctcagctcactgcaagctctgcctcccaggttcacgccattctcctgcctcagcctcccaagtagctgggactacaggcatctgccaccatgcctggctaattttttgtattattagtagagatggggtttcaccgtgttagccaggatggtcttgatctcctgaccttgtgatctgcccgcctcggcctcccaaagtgcagggattacaggcgggagccaccgcgcccagctttaaattacactcatctttaaggaaatgcttggtgaaccatggcacatgtttacctatgtaacaaaactgtgcatgctgcacatgtaccccaggacttaaaataaaaatgaaaattaaaaagaaaagaaatgtttggtgaaaacttctaagttttctagaaaatgatctaaggaattagagagaaaatattcctgattttttttcatcttgtttagcatggctatcttttccaaaatccaataggcagtaatttctattttgaagtcataactgtgtgttttgtgatacttcctgatctatgctcaaaatatcattagaggaaggaactataataatttacctttcagggctactagccacgtaggatgtgcaaatgtcagaataaatactttgcttggagcccaaaatatgattcattgttgttgttaatattatagtgtgattgtaaacattttatttattcatttcttgaaattaatatatttacttatatccctccttaatacttatgaaaatagagacatttttcccctcatagtgccaaaatattacttttaagtcaggttggtaatgatgaggggaattttattcttaaccaaaaaagaaagctcaaaaagatacaagcaacttgatacattggaagaaactaaccttggaattaaaagtcataagttcaagttccaacctgacctctggcagagtaaaggtgaggtagttatttaacgtctgcagctttaatttctcatttatgaagtgagatgattgatctaaattactatcaaagtccctttcagctttaggagtatagaactacaggaaactatgatgtgtggtttcttatgaccaacacatttccaaggacttgaagacttctatgaagacacttttggtgaaatattggagcagctattatattttgcttcagcctgtagagattttaaacttctttttgaaattaagaaactgatgtgtttgttaaggacttctttttctatcaaagtttttgattaacctgctttagaatcacataggatttgacttttccatctgttgttttcctgatgaatgtgatatagcacagtctcataaggcctccacgttaaggccttatgcaagataacatagattttatgctgagcaacgtaagtgttaagcacttactaggactggttataggcatcattgtggattttcatgaatggaacaaatctttatggatgcttcctatatgcaaggtactagtctagatgcttgatttacagccacaagtcttacaggaccctgtttttgtggaaatcacattccacaaaacgggcaataaatatgtaaaccaataattcttaaaaagtcaggtaggcacaaacctatgaagaaaacagaacaaggtaatgtgttagatggtgactagggtgaggacaatcttagaccgttcaagggaagtgatatttgagctgagacctgaacagtaaggaaaagccatctaaatcaagggtgtcgaatcttttggcttccctgagccactttggaagaagaagaattgtcttggaccacacatgaaatatactaacagtaatgatagctgatgagctaaaaaaaaatcacaaaaaaatctcataatgttttaagaaagtttacaactttgtgtttgggctgcttcaaagccatcctgagctgcatgtggccagtgggcggtgagttgagtaatcttgatgtaaatgaagacctctgggaaagactgtcccaggagaggaaacaggaagtacaaaggcccaaggtctcaatgagcctagtgtgttcaaggaacaaaactcaagtcattgtgcctggagcctgggtgccacacagagactggaataggagatgatgtgtcagaggaaggcaggagtcagatcacatcataccttatgagtcatggtcagagaaatgcatcttattctaggaaccatgcaacacttttagaaggttataagtaagggagggacctggtctgattttaaaagctcattctagctgctatgtgcaggccagactgtaaggaaaggcaaagaaggaggacaatcaggacactataacaggagtcctggggagagatggtggccgcttgggatagcatggtgatagtggagatggagagaagtagccagagtcaagatctgttttggtgataaaaacagtaagggcttggggtggtggctcatgcctgtaatcccagaacttggggaggccaatgcagatgtatcgcttgaggccaggagtttgagacccgcctaggaaacatggcgaaattccatctctacaaaaaaataaaaaatacaaaaaattagccaggtatggctgcacgtgcctatggtcccagctacataggaggctgaagtgggaggatcacttgagcctgggaggttgaggctgcaatgaaccatgaccacacctctgcactcctgcctgggtgacagagtgagaccctgccgcaaaaaaataaacccataaaataaaacacaaaaaccagtaagacttgctgatgggttagataggatgggggataataaaggaaaggcaggaaaaaataataacttgcagggatttgggtggggcacctgagtgaatagccatgtcttttattgagatgtggaatccttgtggagggatgttctgacgcagcaatataaaacgttcaatttcagttatttaattacaatgcctttcccctccacgtggagatgcctactaaggacttaggtatgtaagtccagagcacaggagagagaaatagacaaggtttatcttggttgcatctcacatcccctcctttttggaactttcctcccaaactcccactgccttaaggtgacacatttgctgcccaagactcagcatctcatctctgtctgtctaactcaggagagcttccttctctggatttgttctctctctgtgtcttccctcttagaactttgcttcatagcagtccccacagatctctgctctgtgctttccaaggtgagaattaattattacatagtttgttagtaatgtgtgaccgactttttgggactatcttaatattaacagagcttgtgttttataaacacgaggattttccagacaggaagaaagctctaaaagtagataattaggtgttttggcttgttaatgaaagcacttcatagttaggaagaatgttgaatgtacaatctatttaataacaattatacaaatatagagtgatcaaatgcttcctctatctcatgccaagatcttttctgtaatacagaaaacttttaggttttattctgtttgtatttcctaatggttttaagtaaattttgaccagaaaaaaaattttcattaatcagataggaaaaaatctagagaatgaagttaatatggaatttggacaaatataattcattcttaaagtcctatacagtggaattgcttcagagttaataaaatgttattttttatccaactccatgtatattactactagtaactttgtaattagatattccattttaagtaaatgggtgaaatattgtcataggtatgtttttatttgaaagttttttgttttgctttttctcctaatgcttcagtgatttacttattataaaggctataggttgggagttctagacttttgcaacttaatttttacctaccaaaatagaaaaaataatatttgttagtgcccttttaggtgtgtgagggggtgcagtatgtgccaattctccctcatctctgtccttgaagaatatagggataatttataggtcacatcagaggttagggttatttttcccaagatgggaatagttgtaatttttaaaaacctgatcatcagcacaattcatgccccttgcaaaaactgagaaagtagagaaaatataaagaaaaaaataaaaatctttcttaatcttaacaccaagaaagaaacattttaatgttaagatttttatgaaataaatgttttattagggtcaaagcctcactggcagtggttctgacacctggacactgcttgtactatagttagtcatttttaaggagcgctatttctgatcccctggtcacttccccgaagtttcatatggttttcttccattttatgattaaacagggggctgctgtacatagagaatgtcagagagcagatgcaagctacattttatatttctgcaacattgaagtgaattacaagtttaaaggaatccaagatatatgaattacaaggcttcagagatactccagattacatctagagctggctccctccctcagaggccagtgtgaagtggactcccaggcagcaattttcccttgacatgcctggagcacttcgaccaactttagtttgactgtatgatgtttagttagccatattttgaaaatattgattttatattgaacattttgttaatctgatatacttgtgccctcataggcccatgaatatctagatgaccttaattaatgtgtagaaaagtagacaatttaaaaaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatatatatcatatatattcatatatatattcatatatatcatatatattcatagacatatcatatatattcatagacatatcatatatattcatagacatatcatatattcatatacatatatatcacatatgtatcacatatatatcacatatgtatcacgtatatattcatatacgtatcacatatattcatatatatatcacatatattcatatataatatatccatatgtattatatatccatatatgtcatatatcatatcatatatcatatatatcatatatcatatatcatatatatcatatatcatatatcatataatcatatatcatatatctatatatatcatatatcataatcatatatatcatatatatcatatatatcatatatatcatatatcatatatatcatatatcatatatatcatatatatcatatatatcatatatcatatatatcatatatattcatatattcatatatattcatatatattcatatatattcatatgtatattcatatatattcatgtatattcatatatattcatatatatattcgtatatattcatatatattcgcacatagattcgtatatgtatatagattcgtatacgtatatagattcgtatatattcgtatatagattcgtatatattcgtatgtagattcgtatatattcgtatgtagattcgtatatattcgtatgtagattcgtatatattcgtatgtagattcgtatatgtatattcgtatgtagattcgtatatgtatattcgtatgtagattcgtatatgtatattcgtatgtagattcgtatatatattcgtatgtagattcgtatatatatttatatgaatgaacttagcaagtaaggatcagcgatatttttcttactgggagtatcactgaataagcaatggataggatttcttataggaaattacactccattcaaaatattcaagcatggatatcttagacatagcaagctgtcattatatctctctggtaacccaatatggcctcttttataacagaaattttggcaagacccagagaaactattctgtgtcacgttaagtgtttgtgcttgtgtggtataaacaacaagcatagtttgtaagagtagatttttttttaatattttatttttaaaatgcagaagtttttcttcaaatagcataatcttggcaagcaaaatcatatttggtcttgaaagcacaatataaatttctgaaagggaaatatagtaattataaagattttcattcattataaacttagattaaaatcaattattccttaaatatagctaaatttatttcaatgtatattttaaaatataattgttatatataaatattgataatactcttatttttttgtcacagcagaaactactcatgagatgcaaaaatattttcagcttttgaactagattataaattatcgaaaaataattctatttaggtttttttttttttttttttttgatatggagtcttactctgtcacccaggctggaatgcagtggtgcaatctcggctcactgcaaccttcacctcctgggttcaaacaattctcctgcctcagccaactgagtagctgggattacaggcgcgtgccaccatgcctgactaatttttgtatttttagtagaaatggggtttcactatgttggccaggcaggtctcaaactcctgacctcaagtgatctgcccgcctcggcctcccaaagtgctggaattactggtgtgagccaccacacccgacctctatttagtttttgtttattaaacatcaaagtatcatatcaaaattcagtacatctctgtctttcatttgctggatcactcactcattcaacagataaagtgccctgttgggactgcacttaggctttgtgagtgatacaaagtatgttaaatgctgtgcttgctttcaaagagctttcagtcttaacaacagatggactggtgactgcatgactatcatcctaagtagaaaatgaagagaaaaaatgtttttattatcttttgctttgtaagaaaccactacaaaacttagtggctaaaaataacaatttgttatttctgaaggatttcagaaaacctactcctcaaaaaaagcaataagaacacaggcaaaatttgtcaaaatcaatatattcagaactttttaaggggctttcacaatctaatgagtgattattcaagaaaaactttgaatctcagtaagactagcaggctttatggcattttaacttgtcctattcatatccctctctctccaacacatggtaggcttgaaaaccagtagcttcagaatcacagtgaaaactagctgcctagcagctgctggaaagggaagaaagagtgtgaagttcattaaaagctccattttcagggaattgccattatttttcctgcctggtagttccctaaaaaccccaattcttagttggtctttatttgacctgatcagagcttgtaagaatagccctttcctgtggacattaattgaaaataatcagtggcaattgtttaatattgcagctgcctgaggcaggagttataactggaataaacaagaagctgatcaaaaaaatttttaaagaaaaaactggggaagaagacatccatagagggcactagaaagctccaacatatttgtaggactccagacacatatttctatgttacagggctgtgtgaaaactccggaaaggcctgaaaaggccttaaaatctttggcaaaactccaagctctgaacaagcagaacatgaaggctaaggtgatttataaactaccagcctgaacatttaaggtattttctgtcacacacataggccttcagcaaaggctgggatgcttttgggtaagggtgtttaactattcaatcattagttgactactaagctaaatgagcagaaacttcaggagtcaaacactttacagaatttgtccagaaaagtgactaagcaaataaaaagcagcaacaataaagacaacagacagcaccaacggcaaaccattgacaggtagagtctaatttccaatgttaccatattatattattttaaatgtcttcttttctttcttcttttaaattatactttaagttctagggtacatgtgcacaatgtgcaggtttgttacatatgtatacatgtgccatgttggtgagctgcacccattaactcgtcatttacattaggtacatctcctaatgctatccctcccccttccccccaccccatgacaggccccggtgtgtgatgttctccttcctgtgtccaagtgttctcattgttcaattcccgcctatgagtgagaatatgcagtgtttggttttttgttcttgtgatagtttgctgaaaatggtggtttccagcttcatccatgtccctacaaaggacatgaactcgtcattttttatggctgcatagtattccatggtgtatatgtgccacattttcttaatccagtctatcattgatggacacgtgggttggttccaagtctttgctattgtgaatagtgccgcaataaacatatgtgtgcatgtgactttatagcagaatgatttataatcctttgggtatatctgggtcaaatggtatttctagttctagatccctgaggaatcgccacactctcttccacaatggttgaactagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtctgttggccgcataaatgtcttcttttgagaagtgtctgttcacatcctttgcccactttttgatggggttgtttgctttttcttgtaaatttgtttgagttctttgtagattctggatattagccctttgttagatgagtagattgcaaaaattttctctgattctgtaggttgcctgttcactctgatggtagtttcttttgctgtgcagaagttctttagtttaattagatcccatttgtcaattttggcttttgttgccattgcttttggtgttttagacatgaagtctttgcccaagcctatgtcctgaatggtattgcctaggtttttttctagggtttttatggtttgaggtctaacatttaagtctttaatccatcttgaattaatttttgtataaggtgtaaggaagggatccagtttcagctttctacatatggcaagccagtattcccagcaccatttgttaaatagggtatcctttccccattgcttgtttttgtcaggtttctcaaagatcagatgtttgtagatgtgtggtattatttctgagggctctgttctgttccattggtctatatctctgttttgataccagtaccatgctgttttggttactgtagccttgtagtatagtttgaagtcaggtagtgtgatgcctccagcttttttcttttggcttaggattgacttggcaatgcgggctcttttttggttccatatgaactttaaagtagttttttccaattctgtgaagaaagtcattggtagcttgataaggatggcattgaatctataaattatcttgggcagtatggccattttcatgatattggttcttcctatccatgggcatggaatgttcttccatttgtttgtatcctcttttatttcattgagcagtggtttgtagttctccttgaagaggtccttcacatcccttgtaagttggatttctaggtattttattctctttgaagtaattgcaaatgggagttcactcatgatttggctctctgtttgtttgttattggtgtataagaatgcttgtgatttttgcacattgattttgtatcctgagactttgctgaagttgcttatcagctgaaggagattttgggctgagacgatggggttttctaaatatacaatcatgtcatctgcaaacagggacaatttgacttcctcttttcctaattgaataccctttatttctttctcctgcatgattgccctggccagaacttccaacactatgttgaataggagtggtgagagagggcatccctgtcttgtgccagttttcaaagggaatgcctccagtttttgccccttcagtattttattggctgtggtcttttcaattaacaattagaagatatgcaaaaagaaggtatgcaaaactatgtacagataaaagagtggccaatagaaactgtttctgaggaaacctagacattaaacttacttaacaataactttgtctgctattttaaatatacttaagtaactaaaggaaactgtaatgaactaaagaaaagtatgagaatgatgtcttaccaaatagagaatatcaataagtagaaattattaagaagcagcaaatcaaatttttgaatagaaaagtataaaacagaaatgaaaaatttacaggaggggttcaagaactgatctgaggtaggagaagaaagaatccaggaacttgaagatagttcaattagtctgcagatcgggggaaaaagaatgaagaaaaatgaacagttccaagactgtgtgataccagcaagcatgcataataggaattctaggagtggagagagagtaaagaaagactatttgaagaaataagcaatgcaaattcctcaaatttggtaaaaggtattaacttatacattcaggaagctcaacagactctaagaaggacaaactgaaagagatccacacttagtcacatgataaccaaactgccaaaagtcaaagagagaatttttacagcagcaagagagaagtagttaaccaaaacagaaaacaagaagttctcaatatgagtaagctgacttctcatcagaaaccatggagaccagaaggcagtgggatgacatagtcaacgttttgaaggaaaaagactgtaaatcaagaattctatatccagcaaaactatccttcaaaactgaaggtgaaattaaggattaaaaaaacccagaatttgagactagcacatctgccctataagaaataggaaggaaattcctttaggctgaatgaaaggaaactagacagtaactcaaatccaaacaatgacataaaaagcactggaatagttaattacatagataaatataaaagccagaataaatgtacttagtttgtgtttcttttattttcttatcagatttaaaatacagttgtataaatacatacatacataaagcaatattagaaatcttcattgatgggaatataaaatataaagatgtgatttatttgtatgacaatagcacaaagcaagaaaaagctaacaggtatatagaagcaaagtgaaaaataaagctaaaatatccatgttatatttagcatggtcttcagttgggactaagaaatcagtattaggaactcatttgcaagaatttaatatgaaaaagtttctttggaaaatatttgtttacttattactggtgttctttaaaattctctgtacctctctctactaacaaaatcaagtcataccattttatttccttgataaatctctactgtttgtcagactgcagtgaattctgagattttcttctgttcaatatcttgttgaataaggaaatgtcacaatttaatactgtaatctcttcactcatttttatacactccaaactttaacaacactgtaccagaagattttttaaaaggaaagagaaaagtgcataagttacacatttactgagaaaaatatgactgagatattgtgttacacagaactttatacctagattttattttcttgcaatctccagtttccccacaaaagttctttgttttcctcccacagtaagatatttcccaaaggccttcctgaggagtactcagtagctgccatgtttcgagtacgaagaaacgccaaaaaggaacggtggtttctgtggcaggttttaaaccagcagaatattccacaggtaaagtaccattagagttgtgctcattagttttccttgtgtaattaagccaggtgaattatttgaactggtgcacaaatttgcgagtagatctagtatccaaatgttctatcctttagagggatcatcaacaagaaaatgcaagtattctcgtagttaggatggccttgctgagatccataatatgagagtatagtggtaaacatagtgttagtttttgtttttattttacttctaggtccatattttgtttaaagatgtaaaactgccttctctttacaactgcttcattaactaattctttctaagtaacacattcttcatcttccttctgtcgtctctaatgttatatattatttttaaagcagtttatcatttcattggacaactcttggtgaataaagagttgagacttaaatatttatcccatcaataaaaatttatggaacacatactatatactaggtagtgacaagaaaagagatctgaaaaacagaatttgtattatcagggagcataaggcgtaaggagatgacatctaggagaacaacataatatagcataattatgttgaacaagtgcagtggtagagttaagcttagtgttgggtgtggacaatgggagcaccgaaagggcagctcatcggaattgggggatggagagagcaggaatctaggagagcatatagaagagatggcgtttgggctgcaaagaaggaatgctggcactccagcgaggggagaggaacctcaaaattacttgttggcaccatacattagtttttacttgtgtacatatccgttgaaatgttttaaatcatcactgatcttttaatctgttaatacagctacaattttatgatgagtagatcaaccaagagtatgtcctctataaaatgtgttttctctgtaccttgcaaagtatcaatggtgaaagaattgatcttagcttccctacttagggaaatgatcacattcttagtcttcttaaattggtaaccttaaattcctgtgttactaatacagagcaataatttatatatcttataaaattttatctatagtgtatataaattatgtatatataaacttataaatggtttatataaacatttaaaataactacacacacacacacacacacacacactcttagatgttctcttaggaaggagcatattacattcaccagaatgccccatttctaaaccatttttgtagtggtgtttgctgttcttttattttaacaaacctggtggacacaagtgtcatctaaaatattttactaagtgcctcagttatactaatatgcatcttgagcttttctttgtgtgctttaataattttgaacattgatttttaaaacatttaaagatactttacatttttgcagatttctatagtagttgatggtggaaagaaggtggtggaatttatgtttcaagccacagagggagatgtgttgaactacatttttagaaatcgagaactccgtcctttgtttgatcgtcagtggcacaaacttggcattagtatacaatcccaggtcatttcactttatatggattgtaatttaattgcgaggaggcagactgatgaaaaggacactgtggatttccatggacggacagttattgctacgcgagcttcagatggcaagcctgtggatgtaagttgtgatgttagttgtgaaagagaactaaaatttctaagtaaaaaaaaaatcttattaaaaacattcttcttttattactgtgtaatagattcccttctcatcaattttattaatttaattaatttgccgtcagatgtgtgaagaacagctatgttatttccaattgtattttcacatgtattattttcactccattttatacccattttctccagcctgggaatttaaaataattaggtcatgccttaaaaaattagattattaaaagtaaaaattgaaaatatgatacaaaatataaacttggtctaagttcatatgttttaaatagaaagggctggaaaaagctgaagttcaaattaaatggttccaggttatctgctattttcattcaagaacaatagactattcatccttacaatagcaattactttgtattgcagactattttttataagcgtataatggtttttcagggttctattgtacagaaaaattcactaaatgtattagtaggtcatttgaaagagaaaaattgcctagtaaaacccttttggataaaaagttactttaaatattacatttgaagctaacatgatatagatttattattgatttccctagagaacaaggtctgtaatcttaaaaaagttagatatatctaaatttgatggctgcacgttttcttagtttattatgtataaacagtttatagtttatttcttagagtttttgcaagaatgagatccagtcttggacctcaatctaagaagattgagtgttctatgtcctgtgtctcattaacttctcacccaaggatagaattgatcccgggctaggcgcagtggctcatgcctgtaatcccagcactttgggaggccgaggtgggcagatgacgaggtcaggagatcgagaccatcctggctaacatggtgaaaccctgtctctactaaaaatacaaaaaattagccagatgtggtggcacacgcctgtaatcccagctactcgggaggctgaggcaggagggggaggttacaatgagccaagatcatgccactgcactccagcttgagcgacagagcaagactttgtctcaaaaaacaaaaaacaaacaaacaaacaaaagaattgatcccacaatttgaggctaaagaatatcacgtgaatccttataaaaaggatataggtaaaaaccgtggtattacagtggtttcataatttcatgtggattcttggttcatttgaggataaacttgaaggcatgtcacaatgatgcaatatttttggagatagtcactgtttgagttaaacaaacaaaatacatatttttataaaagattcttggttctactgaaactttgaatggattaatttttcatcatctctgtacaagctctgtgattcataagatctgttatggtgtgaaaatgtgtttatttgggctgtgtgttattgaaaaaaattatcatgatttagttttatttcacctatcccacctgtgtatttttgtgagaaagtgacaaaactgatatgaagatttttttttaaatcaactcagcattttgacaagcatcagtacagatttagccttaagcattctccttctaaagcactatatcagtgaagcattctaaagtaatgaatgaataaacaaagcataaactattctgactgtcatttcaatgtcatggaactcaatcaggttgtaatcctttgaaaattgatcatctatctttagttaagtaaaacaattcataagcaggacctggtacaatggatggtacataataggatttcaatatttattgactattttgataacagtgataataaaaaagtttagttaagaacaatattaattaactagagttctcattcttcattctaaataattcatatgttactgctggtatttcattatactatgtaagacggtgtatttaaattttataaataaaaattaaccttaataaccttgcaaaaagttacagaacataaatcattacatttcatttagtctcatgattttgcattttctgcaaatcttaggctgctcatgaatctgtaagatgtctggagttgttaacgcattctatgaactgcattgattttgttcatctgaggcgaaaagtaaaagttatagatttttcccccctttttgcttttaaagttggagtagagattcacctctaatcacaaatgcctgctttctattattataagattaattattataagattagagttgggtctttctgtataaagtacttattgacctcaaaataatgcattatttaatacatttcagtgcttaaagaattcaaacagcctatttaagaatttattatattgctattttatcaataatcagtactatttactttttcttaggtgttgatttcatcttgcatttaaaggcatgattttactttccttgaactacagttaatttcatgtccaaatgccaaaaaaagagaaatctgctaagcaaatagaaggaatcaattatttttgtaaaaaggttgttagccctgcttagattataccaatataatataaaatcaataggttttaggcagaattcgtgaaatatagataaaaaattttttttccttgttggtaagtgaacacctatttcagtgcctcaaataggagtctggaagtacaaataaagcctttctcatcatgtgctcatatctttgattttaccttttctccaattttttttttattttgaaatggcctcattttgtgggcattctttactgtagtgtaaaacaatagcttttttaaaattaagtacttctattttattgtttgaaacagctagccaaggtttgcaattgctttcattacctgatttcctttatctatagatccatctctatatccaactctatgtctctcaagtagtccacaaaacaatgaatcctacatttaataaaaacattaaaatatccaccagtaatttatttatattagcttcctttttctttctgattaaattactgtagttcttaactgcctgaatgtgattccaaaaaactaaagatgtttcttattactaattttttcatagattgaacttcaccaacttaaaatctactgcagtgcaaacctcatagctcaagaaacatgttgtgaaatatcagatactaaggtaagttaattttctttgcatatgaagaatgaagaacgccaattatcttttagtggcatagtttgtagagtccaaatgtagggtagcactgagtgtgttctgttgaagccaggtgggtaatttattcctagtaaggaagcattcatagtgctttctcatggttactttcaacagttttaatcccagcatttcacccttaattttgagggtaatatatactcactttgaactcagtataacttaaagttatgcctttcttcctaaactatgttctgacagcagcatcatttccagttacagaagttttaaatctgtgatcatactttattctcactcattttccttttctaccctgtcacccatcctggctagctttcctttgacatagacttttcatccttatcttccattttcctgttactgccaaagtgtacatttacctcgtgtctgggatatcaatcattattggatcaactgccttccctatgtcctgcccctttgctttgcagcataaccagaataagtctgagtcactgctttgtatattcattcactctcttccagcaaacactttattcagaaacactgaccttctaaacactgtgctaaggaacagggctaacaaacatgattaaggcacattccctgccctctcttcatgtctttctcttaagtgactcctgttggaagtgaaatataaatgcagtttctcagcctctcattctaaatattcccaacctaaccatacaactgttacttacttataccaatctttcattacaagaaaaatactaaattcaatactttctgtatctctcagtgtaatggccgtgtgtgctatcttatattactaggtgtaactatatttgtttttaaattgatttaagtacaattcagactcagtaagggaagttttaccttgataaacttttttattcctaatgcttcatttggaaaaagtagacaatcattgtttgatttattgacttaccaattactaaaaaagataaatgggacagaaagatattcaaaggggactggttctaaaaaaaagtacagaaagagcatatgaaaagtgcaagtaaaaggtgaaaatgtcttttctttggatcttagatttcataaatgttctatacttgccatagaaaattatatgaaaattttatcaacaatttatgattcaaaaatatttttgacttttgtagctcactttgggtagtgaaataagaatgtgaccaaagcatagcttaaagcatagctttagtgacttaaagcatagctaagtctttcaagtattatatgttttgcttttgtaacttggctttataaagcatatctccaatccacttcatgtatctcattccaagtaaaatgccagccagccaaatatctttctataaatatctgaaaagataatttagaatgccaatctacagacttgaaatacctagacttcctggagctacacatttaaatcttaaagatgttaattcccccaaaattttgtttttaattatgcttttttgatgtcagagtttttaaagtaataactttctctggttgtaaagtaatataatgatattttgatatatctgaatattatataattagccagtaatcactgccctttatcattatattaatgtaatagaaactttccacctgatttatgaggaaattgtttaagaagtataggtgatgaattgggtggaatggttggtaattcaaagcagtgacatgatctcacacattatgaacaaaagatttttaaatcatattttgaaaagattatttgggagttagttttaaagaatagaacacaaggtaggaatttatctctgactatggaaaaaataaggaaagactgtatttttgctgacaattatttggaggggatatcaccattcatttaatgactaacaaaaaatagaaacatactacattttatgaataggaatgtacagttggaaggataaataattatataaaagccatttaaatgcatctgctctacttccaatacgaattgtatttattttcttttttgttgcaaaatgttttgaactcagaaatttttaatgtagttgcttaaatatctaattttgtcctggaatttcaaatcacacatgttttctggttgtcaatattttataaagcatttcaaaggcaacattttttaaagatcacctataaagatgcttctttgtttctattggattttcagtttctaaagtagttaagtttcatgactctagatataaaaagaatgaagaacaaatattaagagaaggatgaaatcagtaacatttgttgaaaataaatgagaaatgtggttaaatttttaagggctaatactgaatatgtgtcaaatcaaaaccagaggttttacgaggagaagagtccttacttgtatgtttggtgttgcctctaggcactttttgtggagtgtggacaggtttatggtgaagcctgagacatacttttaaagttatttaaatcctcaatttaatatagtgactcagttatccagagcagaattgtgaattctaagtgggtcttggttatctgactggaaagccatgaggtaagaactggctgaaacatcatatcaaatcaaatgagatgaatgaactgttttggtaataaccttgttccattcaaatatacaatagtttttagactttcaaatttgggaacttgttaggataaataatcctgaaatctggagagagtagatttgaaagaactagtggtggatacagtaaactagttgctgtatttctgggtgttggttttgttacagtttttattgtaattatcaaagaattcaactactaccaagtttttttttttatttcttatttccaacttttattttaagttcaggggtacatttgcaggatgtgcaggtttgttacataggtaaacgtgtgccatgatggtttcctgcacagatcatcaaaatgaatttttgttacaaaacttatctatgtttactggaaaatatagccaaatccataaaagaaaataaatatcaatcatgatttcaaccacagtagaaaaccacagataatattttagttttgtatcctgaaaatactttaccatgcatttataatttgtggtatacaaagtaatgtattaactctctcctagtgctttctcttcgtgaaattgcaaattcagagtggaaaactatggtgagaagtctggtacatgatgttgagaaaaaacaatgtgtttatcctcctcagattctccatttgggttaattttttaaaaaatgttcgttgctttgtaaccaaattgcacttcactttgtccagcatgctctgaacccactggataagtataaaatgcactacttgtctgttgtagtggagacctttttaatatctttaaggaacagtagactagaacaaagtatactttgatttaataaatgttgtctaagagtgtaaaaagaatttattttctactttatatgctttaataatcatcttgttgaaggaaaccatattttataggttcaaattacatgtttcaactttaatttttgttcccaaaagatgtattcacatgttgtttgtacaaattattttattgcaacaatacaattattataaatgtatgaaatttctgtacttatcaaaaagttacctaatgtaactttgtaattccttaccaagaccattattttaaatatttttcttgcatgttgtcagtataagaaaacccatgggctcaggcggaaagtgcaaaagtgtgataaacattctcacactggtgttaacttttggttagtaagaagcagttcttgcaggcaacctcagcaatccctagtttagtgggagccagtgtttggaacatgagaatgtttggaattgaccccatttcctaaagcctctttttggattttagtgcccagagcaggatggctttggaaatattgcatcatcatgggtaactgctcatgccagtaaaatgtcttcatatctgccagcaaagcaggaacttaaagaccagtgccagtgcattccaaacaaggtatgctagttttaattggtgcacactgaaagccactccagactatgagcccagctccttgaatgtggcctctgttcacagaatgtgtcttgccattcagtgtttgttgaagtaaatacctcagttactggggtgggttaagaaaaaggcattgaagataggacttcctggattcttacctggatagtttcaagcccatctgaacttccttccagggtgtgaactagaatgaatagaaaagtgaagggaggaactacctgtacaacaggcaagtactgagtacttagcatgtgccaggaataggctgaagttctgggaattcacagttgaagaaaacacagtgcctgctcttcaaaaacatacacaaaaatactctacattgtatttctttttctgtatagactgtgtttttccagcatccctaaattttcaactggctgtctccatccaccataagttattaggggaatatacagaggggctctgttgttactcaaataatttgtttcatctgcaccaatatgatcccctggtcaagaaggctgtgccatggacctttatgaacttcctttatggatgttaatggcagtaataaagcctgtgctaaaaggctgagtggtgtcttggtggctttttccagtgcccatacctgaggaaaggagaacttgccccagtttctagagcagagtgtgccctagcactgtgacttaaaacatgtcatcgacttactcatccaccaccacttcaactcctggctgagccagatggggatggggtgaaagtttaagggaaactttcattttttctagtggccaatattgcatagtaagctctacgagaaaggcaaggttcgggggtccatagagaaacagcttgtgttccagctcatggaaggtctggaggagatgatgctaaatggtgtttggaagagtgaggaacagtgaatggaattccattggcatgccctttttcccttgttcacgtggctcactattcctcactctaagcatcagctcagaggagaacaaagcgttatcttgctagtgccagcttcacatttataaaccatttggctttagatcaatgtgacagaatgtttgctaacacagatatgcatttttgctcagggagaagcaggattaccaggagctccgggttcacctgggcagaaagggcataaaggagagccggtaagaaaaaaacaaatactgatggagaaaacagggttttgttaaaaaatgacttaaaaatgtgttcatctcatttttctttattctgtacaaatatatgtttctataaaaggctatcaaagactatattaaaatgctgattactgaaatagagactatcagcattctagtcagcttttgaattcatattggtaggctggtgtgaactttggaaagatctggaactgcaagtctttgtacctataagctctagcaaaactgtgaagcagaaaagtctattttctagctgtgccctagccttctttagcattcccttccccaaatccctgttgaattcttgcttctcttgtcttttgatacatccccaccagagatttttctgtagctctctaccttttttttttaaacggccaactttttttgaatactttctgtgtatgaggtatgttgcttggtgttgtagagcacataaagacaaataggatatattccctgttctcaatgattttacatctagaaagagatcgtggaaaattacaaggccatatgtgttaggtgctgtaggagagttgcaagtgtcctggagaaatgatctggggagctagggaggatttaatggaggaatggccagtggactggacctctaagtgtgtaattctaggctatatcccatgcttagagatttgtctttcccttctcccatgactcaaaacttaactgtaatgtttctgactcttttgagtatatcttttgtcagctaatcaggtaaatgaatgagcactgttagaagttgattctgtttttattatctctccaaggtaaaatagattttaattcctttcctgccttaacttgggaagtccatgattctaaattatttgtataatctattgctccccccgctttaaaaagacaggagacggaagtctgagaaatgactgatccctcaaagcttcaacaaagctaaagtcatttgattcctgaaggaatgtattcccatgtaccttgcatgggaacttctgacaactcagcaggtgtttgaaaaagatttttgaggagggacaggccatttattattgctctttaaaatgcattgcttggggtacctttactttcaatatcattttatgaaaattcaaaataattgaacaatatctgattctaaagaccacttcaatcaaactaaacatacaaatcattataccaatagcaagtatttgtttcatggttacatgtaccagacactgagaagaatgttttagatatgttatcatacttgatccttacactcactcttcatgttagggattagtattagcattttacagatggaaaaactgaagcttaggggggttaaattattgcccagtgccacatagcttgtggccaaactgggatctgaaaccagtaggtctgttgactactcatgaccagtatccatttttaaggctgccactatgttctaaaagcaattcagtattatgtatctgtgttctttgatcaggtacttccacttgcgatattttactcttaaaacatcatttaaagatgccagcctagtgtctctatcctcattttacagctgagagccacacataggtaaattgatgtgcccaaggtaacacaattaagaggactcagaaagtggaaagatctctgagttaatcccaactcttctctggttagagggtgaatttggccaagccactcagactctccatacataagttttcttatctgcaacggaaggtgttctcacttatctgttatacctatactataaagtgacaccaaaatgccttgaaaaaaatgcatgtggcttaatttttggtgactgtgatttatacacgttcacatacacatttcttaacttgtcttttcacttctttgatttatcagttccttcatatttaagattgctggcacaggaagaaatttcatgtgttgcttttaggaaaaataccctgcccactgaaaaaaaaaaatctatgtcataagtacagtcctatttgaataattattttaaaaatcgttaaatctactttaaattcttttttaaagattaagtgcttagtcactgttgttagagcctataccttttaaggatgcattttccccctcgattccctttaatcataaatagacatctctcactttaacatttaaatatttatttttctttattcattcatccatcaacacctatttattgagctcctgctattataataaaaaatgtgccagactttggagccttagcagtaataataaaatacagggcctgctctcaccgagtttacaatcttgtgacagtttgttcacagaacattctctccttctatagaaactaaaaccagtagaaaagaactaggaaaaattaataaaaatggataaatattagccaatttattgtatgtcaaatctataaaatatacaaaaatgtatcttagagtaacaatgcattatatgacttctcatctgcagtatgttttaagaatattaacatttgttttaaattccatgataattcataatggcaagagattttagtggcaacgtaaaaacagctgcaataaaggaaatttataatctacacaacgaataactaatctgtgtatttcccttatcttttcaatacatgcacccacatttgcttaaaccaacatatgctctgccttgtaaaaatgacattagatgaccatgaccatgaatgcattcaaccttcctggcacttgaaataaacatggatgtattgtttcattttaaggaatggagggtgggtttatttctgctcctattgcactatgtgatcttgcaactttaatgtgcaataaataaagaaggctttccttcatttttgattctggcatgtaattgtcattattagagcaggtgcacaaaataatgcctacataacttgaagatcgaaagtcatttttgctctaaggcatattcagtagtaaattttgtgaaatgatcagaagtgcaatgttactaagggaatcagatgttgttctaaaggttttctttttgatctgtaagcccaagaaggaatatttagaggaggtagaacagtatgttggaaagagtaccactttggagcctgaaccacttaggattgaatcctctccacctcttacttgctttgaaaattatccttaataatacctagccagtggttgattgtgaagaaggaatacaatacaatatatacacagcacttagaaactggcatattatagatattcaacaaatatatgtttcccctgctttcttatccaccatataattgtccatatattgaaggagaggtggagataactattttaggttgagtttaatttcatttgtggcttgatgaagaacaaaggaatcttcatttgtgagatactgccttagaattttcaatttattagatgtaaaaatgttgagttatcatcacatgctacttgtggtaaatagtaataattgatcaatagttgatttcttcaaaagattactcaataagttgactatttcattcaactctgtatcttttatttccaatattatctgtatctgaccttctctggatacaatgtgctagttgctttttttttttttttttagacagagacttgctctgtcacccaggctggagtgcaatggtgcaatccctgttccctgcaacatccgcctcccgggttcaagcgattctcctgcctcagcctcctgagtagttgagattacaggcacccgccatcatgcctggctaatttttgtattttttggtagagatggggtttcaccatgttgaccaggctggtctcgaactcctgacctcaggtcatccacccacctcagcctcccaaagggctaggattacaggtgtgagccactgctctcagcacaatgtgctagtttttcaaatatgttccttgcattgttttacttagataatgtcgattagaagccatccagacacaattataacttactttttctcattaactgtataatattagtcttttggtgcattttacttttggcccaatgtaataaagtgagaaaagatttgagaatacaacttccacatctctttcaaattatatgtcactacattacagtatttctaaaggtgttaagatttttattaatatgttaattgacataacaattatacgtatttatggagtaaagtgtgatattttcattcatttatacaatctgtactaatcaaattgggataattaacatgtccatcacctcaaatattcattatttctttgtattgggaacattcaagattttctcttttagctatttgaaaatattcaataaattattgttaaccatagtcaccctacagtgctattgaacagaagagcttatttattctttatagctgtaattttgtatctgttaaccaacttctccctatccccactcccacccttcccagccccagtaaccattattctactctctacttctatgagattaactttttaaacttctacatataaaggagaacatgcagtatttatccttctgtgcctggcttatttcacttacaacaatgtcattctgactcgtccatgttgctgcaaatgatgggattttactcttttttatggcttaatgtcattccattgtgtgtatgtgtgtgtgtgtgtgtgtgtgtgtgtgtgtataaaacattttctttatccatttattaattgatagacacccattttgattccatgtattagcgattgtgagtagtgctgtaataaacacaggctttcagttatcttttcaccatacttatttcctttcctttggatacatatccccagtgggatttctggatcacatggtagttccatttttagttttttgaggcatttccatactgttctccataatagctatactaatttacattcccactaaaagggtgcaaaagttcccctttctccacaactttggtagcattttttttggtcatttagataatagccattctaaactagggtaagatgatatctcattttgattccaatttgctcctccctcatgattaatgttgagcattttttgatgtatttcttggccatttgtatgtcttcttttgagaagtgtctattcagatcattcacccattttaaaatcagattattggggtttttgtttgtttgttgctgttgagttgcttgagctccttgtatattgtggatattaatcccttgtcagatgaataccttgcaaacgtttactcccattctgcaggttgtctcttcattctcttgatggtttcctttgctgtacaaaagctttttattgcaatatggtcccatttgtctatttttgctttggttgcctgtgctcttgaggttgtagccacaaaatctttgcctagactaatgtaccaaagcattttccatacattttcccccagaagattcatagttttgggctctacatttaagttttcaatccattttgggttgatttttgcatatggtgagagataaggatctagtttattcttttgaatatagtttttccaacactgtttaacaaaaagactgtcctttcctcaatgcacgttcctggcacctctgtcaaaaatcagttggttgtaaatacatggatttatttatgggttctctagtgtgttccattggtctgtgtgactgttgatgacaatctaaggtgttatgctttgagcatccttactttaatgcagcaaattcatagagaaaaatgttactcttatttatacacatacattatgagttagacaattattccgaatagtcatgtaagcaaatcctgtcccacctgagccaaaacccactaatgacttcttgtctctcttaaggtaaaccccaaagctctaaccatgggctatgaggcttcacataatgtgtagagctctcccctacctgactcctcaatcccagattgtctcgtaccctcttcccttgttcacttttgctccaagtcctttgtaccagttatgtatgcctgaagtgtccttgtccacatccacttggctcgctctcttcttcacatcatttaggcccttgctcaaaaataactttaaaataaaaaggccttctggcatctctatataaaaagcatccttactcccacctctatcctcttactttgcttagcacttttactgccacctgacacattgtcatcacgcatctatttctttccctgttggaaaatgagttctgtgagcctatacatagaacaacacataaataataggagctaaaaatatgctgaatgcatgaatgaacactatacctcaaggaaagtttaaataatcaactcagctatttctagaaactgtaagttctccttcctaattgcccaggagactctgctgagcaaggcaaagattcaatttgcaaggaaagaattaaataatattatattgttaactattgttctactacagttttttcttttaaaaaacaaaaattcttttcacattgatttaatcaggtttagcttagtattgtctaggtaatgaagcatcaaaaatattttgcaaaaagccagaagttttggcaaaacttaatatgtatttttatttgcctattttcttatctactatgatggtttattaatatgatttactactttttctttttttataaaggtgatggtcacctctcatggaataatgcagttttaagtactactgcttgtatttaattatctagttgtgatcagcattctatatcagaacacctaatcaagcgattttaaccatgctctttaacactaaactctgtataacattatttgaagtaataattaatacttttctttcatttagactcaattgtaataattttctgaattttttaattcccttttgttagcaaatgtagttagcaacctaattccttagcaactgcattactttctcagttctttaagacccttgttaataccctcacccatttcagagctgaaattctctcagagttttataaaatattagctcaattttaatgttcttgaacctgaggggaagtgttatctgagctccattttgggaataattttccagtttatttttctattattatcttccatatctccagttaatttgccaaaatgtgttgactttatgaaatgattgctttgctgatatgctttgacagaaaatcaaaactgtttaaaatggaataagttagcttatttgacttcttagtcagaaactggtattgatttatttcaacttctcctgccctccaatcccactatagaggttttcattttgagtagtctaatatgctaacccagagatgatgagtaagtttcccctcattttctttccaatctgacattactcatatgcccattctgtaaccataccacaacaataaaaattaattaaaccaaaatacgttcataatttttaaaaataaggataccttctcttagtaataactttacagaagtaggatttaatattattcttttgacttcttttaatatgtcaatataagaaataataatgtttctttatcctttctaatcccatattgaatatattgaagtaattgacaagtcctttttttggatcagttttacccaatttgatataatctcatgtaatctacaggaattcacttgaaggtgaaatttacttgtgggtcttcatctgaaattaacagatagtatcattataataatggtattacatattcataaaattacaatatatttcttaatttctaccaagtgttagtgacagagaaactcattcaaaaagtgtatattattttccactgtttcgaggataaatttattagactgaatttgtgatagtgcttttaaggaagccatagatgatccatagacttccttgcacctgtttttccatccctgcttggcagttagacagaagagcaaggaagctgatcattggattgacccagctttggggtttttcctggaggatgtaaaggaaagtcaggcatactaaatgaaacaaataggaatatcttagaatctgaaatttcctgacctacttgaattgaaagcatcggataggatgtagcttttaactcatttaaactcatttatcatattaattgaagtaacagcaatagtattattccttacatttggtaaatgtacttttggtaaatattaaatcctacttctgtgaggttattactaagagaatgtatccttatttttaaaaattatgaacatattttggtttaactaatttttattgttgtggtatggctacagaatgggcatatgagtaatgtcagattggaaagaaaatgaggggaaacttacccatcatatctggattagcatattagactactcaaaatttggtaaattacaaagctgaattacatatttctgtgtgaatatgtctagttttagttatgattagcacttagatatttacgaattactgattttttacaatttattattttggcttgtgggcaatatgaggaaggaacttgaagcacaaactttggtgcaagcaaaagcaactcatctaggaagaggtagattcactttgacaacattagtaattaacgcaccccttaaaagtaatctcctaataagcatttctgtattttagggtgcagttggtaataaaggtgaatttggtgctcctggaattcctggggaaaagatatgatggtttactctttgatcaaaatttatggttattttataaagctgtatcagataggataggaaaatatacagaacaagtcctatagtttagaggtaatcaaactgtggccctatagtagggctgccagaaactctcactgtaggattttgtacataaagttttactggaacacagccacactcatttgtttttgtattacctaaggctgcctttgtgcttcatggccaagttaagtaattgtggcagagactgtatggcccacaaaatctaaaatatttactctctggccctttgttgaaaaagcttgctgatccctgctccggaacattggctgctattcttttagccccagggcttctcaaattcaccattttatatataatatggtgtcttaatatgtatttcactgcagacaaaaattaggcagtttatgtaaacattttataatatagactataagacatactataattaaaaatataagaaatatatttcagtgtatcaataaaatgctatactgtaggctatagctcataaaatgattgatttttatgtttttcctgtaataccacaaagatgattccaaacaataaattcactcacgagaagttactgttgcagtttagcatcttattcaacttcagtttttgtagaatatttaaaaaattgttgtatttgtatattaaactgcaatcaccttgtcgtatttttccctatatatgcctatattaatattaataactttgctaaatttttaaagttctcatatgttgatgctaagaaaattctcttctttatgaaaatatgcttagtataagtttttgtggcattctagctgcactgattatcaagtgagtccattgtgtcattatctagaaggccatgaccattgtggttttattcacctaaagttagcacagcaataactgaagctgaagcagtaggaggttcagaggttttcagacagatattttttcagaccttcataaatgtgtctctggtatctgatggcttcattgatgctactttttcctttcataaattattcagtctgatatgcaaattctttactcctataggaatgtaactgttaaactcagtaaagtccaacaaactctattgaaaaacaataccttgctgcaagttgatgtttatttgggctgctatcttcttgtataagcttactgatgacattaattgacgattcttcatcataaataaaagcttctttaaatacttgttcaaagttctaattctttaaaaatatcttttctctagagaatattacttgatcacctaaagagatgccccaatctaaatttaccttgtacccttattctaccaatctttttctaaaatgcatcacaataatctgattgtttagatttcagatcattaggagtttttgaattattctgaacatgggaatcttttttaaaacatttgcagaatcaccgaagcgcttgagctataaaatagattgtttgactttattgtgggatgtaacgtgagacttacgtacatttacacaataaattatggcatagcaggatagaattccctttgaatgctttaaaacagaatttatcaaggttggtataaaatagcattaattttaacactccaaaatgacagcccttggatccttatgtatgacaaccaggtgcaaactgctacttattggttgtggaacaggttctcaactcctgaaaaggtgatgtccacagactgacaatataaggactagatgaagcattcagtagaatcaatcctgtcaaaagctgatcaaatgaattgccatccagggccatgatagtaagaaaacaagtctagaaagttaagtatgcaagccaagaaattctctagaagaagagagagtttcttagaaaagagagggcatttagggcaacgtgaaggaactggagcaagtcagtatttcagagacaggcactactcagaactaaaaattttgtttcttttcccagaagtccacttttgtagaaagaatcttgtgtggtgattcatcctatatttcacttaaagtaaaacttcagtgaatataaaggaaaatactgataatctagttagatgaagtcattctgaaaaccaaaatcctcagcccttggtgcccatttggtcaaaatggtgactgagagagtcttgcaaaatcagttaatgagtgtgtctgtgtgaagacactgttcccagagaacttaagaagctaatatcataaagaagcagctgtttttatggtgttctaaaaccatggcaaaattgtcctggcaaatactctttcatgtttcctcaagcagttttcttctgggtctaatttacttgagttactcttaaagggtctcacagacagttagagaattcatgtaacttccagtggtgctaaatatggtaacagattacgtttaactcttggttcccggattcacacatcatcagagaccgtacttagtggttaatatccttccaatacctatagaagcactgagtctttgaccactttctcttcccaaggactcagtccctggtggtgccagctatgattctaacttgtcacttcatttagctgttaaaggggtgtgacactcttgagtgaaaaaatgccgcctcaatagtgttttctcgcttctataatccacaggttaccacttattgaaaataattctaaagaatgtatacaaaatgaaaacaagaaagttactagcgtattatctaacagtaggttaataaattgtaaaattttttttaaatttcaaaattttaaaatcatcctcatgaggtttatgtttggggtgaaatatttctgttattttacaagaaaaatggtttgttagatttttctaagtaaatttccagagaaaaattatcagttcttaacatgtgtgtcacctcagggctttgtatcccacatttgcttcaacgtgaaatatgtgcatcttccagagtaacttatccagcatccccttaactttgactctgcttgtcagcagttataattctttgttttgttttgctttgctttacatagaatcaggagtacttaagagtactgttaaaaaataaataactaggttgaattgtttaactgtttcacttggagcaaaaacatatgtacaataccatagaatatgtatctcaggtctaatattctcaaagtgaagatttttttctaaagttaacatttaagctaggaaactgatttatattaatggagtgaagcatattctgagcagtatgaagtattaatttgtacattaactatactttacacttacatcaatgtcatacttcaataaattaagtgatttgcatataaatcacattattctaaaataaacctacactttgaaatttagctaggtaatagcagtaaattcttttaagtcaagactctgaacaatgtattaatatactgtggtggcatttttcctctgacaccaaggataaaaatagtacactaaacaacacaattttataaaatgtatttatggaatgtggagtcatgaggactctaataaggatgaagtatagcatttagttatgttcttttgtaattgtaatacttatcacccagtacagacttgcagtagacattcttaatctaatattagttctaatctaataaagccttactgttaaacattgcataaaaataactgtcccctttacatttattcagaacagctatgattttgcctaagagattcggtaagtgttctgttatgagttcatttaagaaaatcagttctgtgtagcagtattattaggtagctggcgacttctggtaagcttggatggacagaaggctctgtcaatcaaaataagtaaactggatggttccatttccaagagaagtgaatgactcaaagcatgagatcacatgaatgcagccacacacacacacacacacacacacacacacacacacacacatgttcacaccttgcatcctcatggtatgaagtaggaaaatgagatgaggatttggacactatgagcaaattttgcccactttgcccccaaatataacactcaaatcatgtttgttttcattacctgaatacttcaaacaaaaaagtgcctcatttcatacttcacttatgtatttaaacataaaagatatatttctctagaagtggggatttttttctaagtaggaataattattgtccaataatcttatcctaataatgtgatagtaaaaattgaacaaatatagagcctaatttatgctaaaacccatattctatctactaaattactttaaatttgccctaaaatgtttattttaataggaaaacttttactaagttaattttgctccccatggagtaagtatgaagtaaatcatagccatcattactttactatgctaatattaaatactcagagttagactgcctgggtttgaattccagctcaaaatcttactctctaatttagagcatgacacttggtctctctaaatgtcagttttctcttttataaaacaggaattatattgcatctacttctagctttatcttaaggattaaataagattattcataaaagtgtcagcacctggtatgtaaatatttggtaaacaacagatataattttaacaataaacagtttgatgattctattattctagccttactgtgggaccagattagaacttatttgaaggaatgtatacacttcatcttagccaaaaggccaagaagcaaacacttgggggaatttatattagttattgaaaatatatttacaggaaaatgttaaagtcacatatcttatgtaaccttgacctcttaaaacaaactagatgtcagaaaaccagtgaattcctcacttattataaatatgtacaagaatataaacttttacaataataataataacagccatttactcaaaaagtgttatatgctaaatgctatcaggagccttcttcacattatttcattcactccttacaacacccctgtgaggtaagatttattgtcactatttcacagattaggaaacagatctagagagagagagggaaaaaaaattaaaaacttcccctaacttggtacggagaaaatagtagagtcaggatttgaacctctatccatggaaatccatagctcttgcccctttgccatattacctcatctggacagctcctcaaatattcagatttcatttacacaggcaggtctgaattagatcttaaatttgtttgcctgccagtttagtgagtgaactgcagtttgcttcggacatcctgctccaaggagggctgtgtcccttccctttaaatccaaggaccccttttaaactgtatctgaccctagggattctgactcccccaccttcataagattgtgttcacctattaagaatcattatgcatatggtttttcaccaaatgagagggttttgtctagctttaccttccaaaataagtatcatggaaaaaaatttgcttggtttccaagtacaggttacatttgaagtgtgttttcaaacattccgcgcttgactctctggagattcttaatctaccctgcatgcccacgtccaggcagctcaatcatgggcactctccagattaaccttaatgcaacacctaatgtagaaatttttctcttacattctccaccaaataaatatatataatttatttatcaaaaacaaaattgtttaacttagtaccatggctttataaaaatataaaataaatcaaccttctggaagtaaaaaaagctgtatatattaaagcacttaagaagtacatctgataacatgatgagagagtggccaagctgcatgtcttaaaaatagctggactaactatcatcattatatgaggatatgctttgtatgatgggtcttttcaccataaactctgaagccctcagcactgcagtgagatgagactgaatgaggcagatccattgttccctaacagtctttgtatttcttttctgctggaaaatgaaatgactatgatctttgaatcttgattttccctaaaaagacattttatgagaagactgcagcttcagaaaataaaggcagatgctgttacagtttatgtaagtgcagacaaggccaatcactgttgtgaattataatgaactttctaacagtgctggtccagatgtagcattaatgcttcagagactcagaaacttataggcaagtagtataaaagctagagaattttaagccatttggcttcctctctatatttctagcctcacctaatttttctgtgcttaattttagacttcctaagtttaaaacataatttaaaatgcctaatgcatgtgacaatttattatagaaattgaggccattaaatgaggaggaaaaaaaaagacaacttagctttattctatcaatggaatacttcctgcctatgaaattgttaggctttataaaacaagaatgttttccactttagagaaaaatacctcttaagcagagaatcacctgtatatctgtgtaatttagaaaattctctaatgagtgaaggtatagtcaaatctacacacaggattgaatttttaatcataattagtattcatagaaaaaaatgaccacaaagaaaacagttttgtaagcctacttgttggctttacttgttaaaggtaggagaataaaacttgaattatcagtgaaaaactattgctcttacatggaataactgtcatttaattgtcttatctatagacatatattgatacaatatagcactaaaataagcagaaacataagaaggacaaagtaatagaaggacaggaaaaagaaaaagaaacttgctcactctgcagctgattttatttcttaatggtttcttattcccttctaatgccttccactcacaccccaagtagagcagttggcagggaacacaacagatggatgacaagctcaccacatgccatgtatctggcacccaggcacttgacttttatttgctaaacagtcagatttcaagaacctagtctgctaatgttcctgtttggtttaatgtactaccagcttctagcacgtaaatattaaaatattgccataagaaagctcacacactctgtgtttctctgcatagttaagtggctaattattttattcttggtgtagatactgaacagtggatttaaacatataactggtattttataaagacatctatgattttagatattagagtttccttaaagtggctctatctaaaggagcttttagccagacacatcagggactgccaaagccggtgtaaggtattgaatgaacctgttagggaagactagaagatttgagcagatgatcacagatgattggtatctttcttttctatctccatcactgcattttcagattattaaactcaaaacacatgcatttttttcatgaattctcccaggccaccaggcaaaattacagcttatccactcagctcacatagcactttatttatatcaccaatgtagagtgtgtctatacaccctgctaaaatgtgagctcctggagtagaaggacttggggtctgtctcatctctaatcccagcaactgacccagcgtatggtacctggctggttctggataagtgtttgttgagttgttcagaattcgaggacttagccccaagccagaaatagagaagagaaatagagaatgactgttagaaaacttcgctgaggaaagatcggaaaagcaccccaatgccagcaacacttcagtgaaagtccttcgtactttctacagaagcataatttagggaaacaagggaatctcttctttgcacaacaaagtttacaggtattgcttcctagaattaaatataatagaagtgtgtgcatctccagaatttgctttccattttctcttggagaaagtatgctcttccctctctctcaaacacaaatattcaagttatattgctttctttttatccaaactagatttgaaaatctcctaactttcttacaacattgttagggtgtgttccttctccatatcttcataaccatttacttcagggctaaagataagtaaccaatggcttcagtacatttaaggtccagtagaagtaattgatatggaatagaactataaattactcatcacgaggaatactccaggcaggaaatagttttcagttactgctatatcattgtcctcaattaggagctgactgatgacactgtccttctctttatatcttaaatcatctttcacttgttagaattctgtattcagatgtcaatcactatacttcagatatttcagtagatgattcacattaaataagtatttctgtagtatttttatgaagttttaagtttggtttaaagactctcttacagttagtctcataataaagtgaaaagcccaaacatttgtgcctgacactttcaggaaatcatcacagttacataggagcccagattttgtagtgggttctacaacattgactaaggcttaattctctagctttgctatgtgtaggaagaaacttttacctctccaagacatttcaaaattacttgggttttctttttgtttttttatttgaataactcttagtacaacttgtatttaattaatttgaaaaaggattgtaaaataacatccctttgacaggaaaacttaaggattgtagttgactacaaatgtagcatatgtaaacaatttagttttaaaaagaagcacgttgtattaatagaagtacaaaactgtatagtagccacagcaaagtgtgtgtgtgtgtgtgtgtgtgtgtgtgtgtgtgtgtgtgtgtaagagagagaaagagagagagagagatggtcctgttctgtattctatgtgagtaagaccatttctggaatgatgtgctgagttctgagagccacattttaaaagacatgactgacccgtgtgtgcccagagaacagggaccatagtattaagagactccaaactatcatttgaaaaatgagtggtttactgaatagaaggcttgatagtggcacaaagggatgtcatgtataagacctataactttttttctgtgtaattgcagacagaagaaataagactgatgggcaaaatatggggaaggttaatttgggttcagaaagcatttattcagtaaccacacagtgaattttttttctttgctctccacaatgcaaattaagcagcaaaagtatttgactttaagaagctttcaatagagttggtgcctcatcagattctttggtggagttgttatacataaatgcatgaatttatatttgtccttaaatttaagaatgcccatcctgcttgttttctaggcacatgcacctgtatatacatacatacacacatatacatatacactcaggataatagattttaagagagtagatgttgttagctaccactaaccacccatacatacattaccatgatcaagacatgtattgacccataagaataaataataataggatctaattcatttaagattaaagtttcaaattggccttatcctgagcattaatgtgattaaaatatccctatgcattagccgcattaaggatccaaaaaatataaagaattcaaaaagtttgagattttaaattctttgctatatatatatttttaacttggtaatttatttcttagaatgaagtcccaaaatatagaaggaaaaaattctccccttgaaataaaagcattcagattggatatctgaaaaaaatttaaaaatataggtttttaaaaatttcctgaaacgtttaatggactgccaacagtttaagaaccataaaatatttcaatttctaaagattatggctgaataaagcaggactatagtcagtaatgtagaggtcaccttagtaatacacaaaatcaaaatcagatttacttttttctgcctattttattggttttagtcctagaatcctggcattccacttctgatatttcttctagttatttcatgcaatattcaacttaagtaaattttcttttaataaatatgaactaatgaatggggaagtatgatatatttcaagtggacactaaatttatatagaaggttatactcctagaaaaatatgctctaagtaaaatgataggtcaattttttcagtacagaaatgttataataggatctcggacattttaatcaaaggctgaatgtctaactgttaaaaaaaatcaccacaggatagtatgtaactttctactttctggatcaaatgctggttatttgcaatttttttgtttccctgcttgctttatctttatttgcttggtctcatttatactgggtttgcaaactatagccctagggaatgtgattttttttatcaaatgtccttcagacaatatatgtttcctgcacaataagaaatacattacttccaatgtcaaaagaatcaagaaaactaataatttatagtttatgaccagctatgcttactgttgaaaaatatgcagtgattacaaggacgtaaaattaaatccagtgatcagtttttcagaaagcaaccagctgaccctaaacatcacctaactttgtcccaaaaacttctcaaagaggttattttgaattttggaaagggtactttttgattgtcctgtgaagttaaagacatgctatgtgttatagtaataacccaggcaacgatactatcggcagcaacattagattttgcctgctttatattacacatatttattaacttatcttcctgtagtttgaatttgtacctgaaaaggaatacaagtcctttcatagaaaaccccgtaatgaaaaaaaaaccctcagaaataagttttgaaagttatggtttctatgggaatcatttattgtgattttctttcaataatgaactaaagtattgattggaagccaaagaagaagcatcttatttcttcttggactgaaattttgaggaaggagaggcagcaggagttcagaaaagaaaactaatgtgtaccttccagtaattttaggaggatatttattttatgaatagaattaaatttgccctcaaagtgcttgtggcacctagaactataaacctgggtgtcagagggagcataaagaaagacttcttctgttgacataaggtaggttttagataaacacatttcctatgagataatcagtgatgtccactgagttatcgttgagtctagaattatgtttataaaacacattcagtcaagaaagagcagagaccatttaatgctggccacaggaaaacacagtgttttaattacaacaatcataaaacctgtgtccattaaagacatattctcaatatcacagctctagagagttttggtacccaattaacagtgcatctgggtgtaatcctaacctgacatatggcaggctaggactttgggtgccagtacccagagcacctggtgcatgagtgggctgtgagcaaagaaaaaggggagatactatcacaaccttttttcccaaaaaagtatttttggcagtgtataccgtattggcgtactttaatggataatatgccatatctcatgatcgtatgtaactagtaatatgatataaaacattatactggatcaactgatgaaaataatctgctccttatggacaagtggacatacttctgtgatgagtaacaggagctccatttccatagactgtttcctggcaccaaatacttaatgtgttttcactatcactttatcaaatgatattggaagtttctaatagatttgtgtgatgcctgaggtctaaaactataacaatttgtttaatgatagaaatgtatttattatatagataagtagattatattttgttgattctgtaacatttaattacatttagcagcaaagttttactttagtgtttagtatatactgtgatgatagctgttttaccgtagaatactttgataatttaatctaatctaagaaaaacctcaatctttaaaataatatgtgtgcatgtatgtagcagacatctctggtaagaaccactaaaactgtccttaaaatgttttaattaatgaaataatgaaaaatttccttagatttagacagaatattgctattttaaagtttaaagatgtgacttttttcttcatagattttgaattttgcttaaataattcaaataaatgatagctaattgctttctagggaatgtttaaaaactgttatcttataaattaattgtaaatatttgatagaaataaagcagttccatgaaattgttagcgtattttgagctgtctaaacctggaaactcagaagccaaagtaaattcctataagcaggaaaattcctaaaactctattgagaatatgcacatcctctcaagagtatctcattctagcctgtgtgctgtttacaaaccagacttgtcaaagagatgaccccagaattccagcaatggaaactaaaagccatctgtctttttacccaagacagaaaccagatgaacaggaagaactaaaaagtcttccaagtaattgctttatattaaatggcattgggtatgtattcaaaattgatctaatggcaatcaccagatatgggtaataaagtaaacatgcttgtacatatataagaatacacacacacacacacatatatataatatatatagtgagaaaaaattccgattttaggcaagaagtcacttaaagccagaattaaatctttttccaaagacagtgtaggaaggcagctaggtatgcagagttgaagtgtttgggctcaaattccaagtctaccacctattactgtgcaatgacctgtaagaagttcattgaggcagtattatctgcctgatagttttgttgtcaaaacagcagtgcctggcccatagaaagcacgatgtcagacttcaatattattcccagaagtttcaaagagagaaaatgaaatgagatactaaataacatgtggaaaaacataggctgtaggagacctcagtcccaatcaggtaagttactagttaggtgacctttgacatgttaccaaacctctcggagcctccatttccctattttaaaaattgaggtgacagtcctggatttgagaaataaggaacagatggaaagtccctatgcatgatagatattcagtattaggctacctttccccacaacactagagctatttgttaaagaccacaaaaacgtctatgttcatatatctttatggatcataaacattattctgtgtacttcttttagggtgaaaatggtttacatggtgctccaggattccctggtcaaaaggtaaagagttcttgaatgtttcatctgagttaagaattttaacgtgttaaaaataaatttgcacataatattctgaaattgtatttgattaagctgaattcactcaaagacttttagaaagctatggatgtcttttcaaagagaacttgtggaagcaatcccctcttgaagggaccattctaggaggaagctttatcacagagctttagtaacatgctcctccaaagaactaaatggtagtagtgctttctggggtccgtgatagctgctctggaaacgtttctgcttttattagtcagagtctaaaatgtaaaatagaacaaactgtactccctttgactagttttgttacctcttgcttatcttcttttttgtatatcccagatagagctaaacataatagttagaatgacataaaatattatatattacaaagatgctgtagacaactacctcttcaaaaatatttttctttcagaacaagggattcctaataagcaaggagttttgcatgggccaggctgcctcttcctgtgcctagtatctttctctttaacaagatgaacttcctttgtgcccccacttttttttttttttttttttttttgagacggagtctcgctctgtctcccaggctggagtgcagtggcgcgatcttggctcactgcaagctctgcctccgttcacgccattctcctgcctcagcctcccgaggagctgggactacaggtgcccgccaccacagccggctaatttttttttgtatttttttagtagagatggggtttcaccatgttagccaggatggtctcgatctcctgacctcgtgatccacccgcctcggcctcccaaagtgctgggattacaggcgtgagccaccacacccggccagggctgctttcttcttctgggaagaagcatggttatctgtgacaagcattactaaaaacacagagaccattatattccagtttcttggagggacggggagccacttcaggtggggccagctgtcatgataccatccagataatcccgccgcaggagagagcattattgatgtaatattagatgcccaccaaagccaagcatatcatttctgtgctctggagatgttttactggttttggcaacaacatgtcagaagttactatgcatgtaggtttttctctatagctgaaaatatcttttaaaaagatatgcacttatttatagttacagattgtgttaaagaatttatttacttggcccaataaagataataagattgaactggcagcaatgaaacggcaagcttctgaatttcttcacagcagctctagacaaaacccattaatacagcatgtactgcatctgcgagtcaagttgcaagccaagggatgtgcagatttatctgctgggaaatagttttggactttccagcagctgtttgtggtggctgcatcatgctgacattgtggctgatgtactggaggcgtttagcagcttcaatgtcagcttgaattaacagatcaagttaaagtctatattttaggaaaaatggtagaaaaaaatatagaccatgcattcagtggtgaaaaacaatacctaacaactgacatatattctttcctggtaacttttagagggtagatgaagcaaaaataattatttaattacatgcatgtaacacacacacatatattatttaatcatctaattatattatctaattatgtatactatttaattatataatcataaacatatatgcaattatgtgggtatatatatataaaaaacatactcacaaactaaatatgtatgtatacatgcatgcatgtttctatatagttaaaagctggcattccctttcatataattagtataaattttatgtaccaagggtcaccttgttgaggcattacagaaaaaattctagagatcagaaaccctctatctcctgtctctgtgcactcaggaaatgcttgctgaatgcttcttatgctccaggccctccatgggtggagagatgcacatgacctgttcccaacattcacttgctagctatgttgtcatgagtgcctgacatgtaggaggcactcagtcaacttttgttgagtgtatgaatgaaacaccagttaaggggggagataagcttgtcagatcagagagggtgtagatgaagaaagggagatgtacaccttttagtataatcatggtgattgagagccagcagccctccaaccaccaatcttctttctgtgactgagccagcatagtggacaagaagaagcatagcactggtgtcgaaggtagagccagaacccaagggttcaaacctgaactcattcatcataagacacttaccagaatggtatgccatagaagtcagctttctaagaaggctgtttccactgaatctagtaaaataaatagtaattataagaagaatggctaacttagtctttgccatgaactatgaggatgaatcaaactctcaaaacaaaccattgaggaagatagtattatcatacttattttatacctgagaaaattcaggcttatcaagattaaattgccttggaagtggtgaagctgtaacttataccctagaaaattgttcctttagtatttagaaatatttaaatcttatgtaacaatattggtttagagcttacatgttagaaatggttatttacaattactgatttttcattgtttgaaacataatttttattgtaaaaattgcatgtgttataagtatcatttttattactatacacatcatattcctcttctacagggagagcaaggttttgaaggcagcaaaggagaaactggtgaaaaggtaaatatctctttttacattcacatctgtaaaaagaaattgttcttgaaaatgttttgaaataaaatatttaacttgttttgtgcattccctataagcaattcaataattttatagacataactaaaacatttgcttccattgaggtagaataaatatattaatgattgccagaaatctttcaaaacttatttggatggtattaatagttagatatttctagttaaatttgtttcattgacatggaaatgatttaaacatttataaagcattatatttttatattatgaaatcattcactcactaagtatccaattatttaaataaatgtttgtttttatgtacaactggtttatcagtggaatttttttcctgaaggagtaaataagaacaactaactgtaaaagtcaggatcccacagaaaagacttggcatactaaaactcgaataatttcaaagagtttaataaaggcatggtttaaaaagtacggacaaggtataagaaaaccatagggattgtgcagtatcccaggtcaggttacagcagacctcttaaaccccacataattaccagacccagagacagagaaaagtgtgtggccaaggctggagacaggagctgagggtagcagtcagcccaagataagcacataaaggggaaatcagggcaataaacacctccatcccactatcctctagccctcagctctcctactagcccgcaccagccaaaccaagttgagagccagtgagaatggaggaaacctataaggctcagcctcccaaagtccagagcaggtgtataagggtggacagtggatcatgagagaccaatggcagatgccagcccactaatctaagtgctgtcatttaaagtcaccttcttacaaaactaaattctgggtgcttaattttacatgttaatagagtgttttattataataaataactactgaaagtcatttgatagtgaaaatacttaagcaatcattgttttacaaatttacaactttctattgaaagtacagagaatagaatgcttggtcatccaaaattttccttcagataatcatttgaatcctttttcatttcaaaattcttgttttgtttttaaataaaacaaaaacagtaccattcttttgtttaataactcttgtgtacatcaaatgtatgtatggaattggatggccaggagagctagaaaggagaataatctcaaattggacagtcttgcctgtattttgctttcttgccagtgatcagttgtttgctttttcaataagtatttatagagagaatgagcatctattataattataagacaaagtacacatgttacaaactacatgataattacttttcctcacagaactcagaaagaaaaaagaatggccttataataaccatacttttggagatcatttcattaaatgatgactatttttaaggtgaatatcttttcttagaaatcccttgaacatttttgctttagaataacagccatttggaaggccatgtctttaaataaatgctttatttatacatattcctgatttattaagtgggattttacctgtaggaataagtagtgaataagcctgaacagatatattctctgtaatttaaagtcaccaatacactaaagtcttagtagttgttttgatagtttatatacatagctggtatagctcaataataaatagattctcacaggttataaggcattagaaaaccattcaccgtatttggcttcaaggattttccttgtggttccacatatctattaactgttgcattcaaatagtcaatttcaccacaaggtagaaatatgtttgtagaatgatttaaatatattagaaaaaaataaagcatcaaacagaaaagacaatatgtaccttgaatgagaatcccaatttagatgatttatagtcagatataagattcatgtaataaccgttatgttactttgattggtgcaaaagtaattacattacaccaaccaagtaaaaatgatgttctgctttattatttactgtatattaaatttttgagttttttcaatgttagcatgctacatattctgacccagaaccacatgtattttttcatgagataaataattgaggtcttgtagttcactttatttctagattaaacaagaaaagtctatgaaacattcacattggtgtgacaacagcatggattactcacaacataatttattttctgaacaaagtcaatctaccttggactttaattttttgtggaaaactgagtatataatcattttttaaaaacccactttcttctttaattaccctactgtggcctttactgtgtttaatttgactgtttgagtgacaagtcaccagttgcaaaatacaattcaggacattgttattggtcagagatgtcatatcttccagaaacacatagttacggtcaaaatataaaaattacatcaactgcaaaaggtaaaatactacctgatattttcaggtgacatttctataatgcagtggaaaccaactggagtaatctgcttcttcccattatggctaaaaaaaactagctttcaggccaaccgaactcactagactgacaaagtagctcctcaaagagttgaacactctctccttagtcctgagaaaaacctgtggcactagaacaagtataaaggacctcatttaaagtatatttctgaatctatagaaacttgtaacaacagggcagagcctcatacattcctgaacaaacacaattcagccaaattagtcctgaagtgaaagttattttaaggggtagtaagttctctcagaaaggttgttggtgctgacatgactctctcagatgacagctatttgcaggtttaccatgctgtggtttatcatgtagacctataggaatgaccccatcccacttcaccatccctagctggcaaagttaggtgtgtatcacccaaggatccttgggctctccaacagcatagctcatgaggcaggagggatgaaggaccctctccacagctgagagttgtattttggcttctctctctatataggagtagtcttctggggattttccttagattccttcagtactattattatagtgcaggctgctactacaaacaaaatacggagttcaatcctcagataacagttatccccatactatctgtcagccttcccagcaatgatttcatcaaactcttgttatgtaaccaaatgtaaatgcatgaactaagctcttacattacattagaagccgtccgggaggtggggggcagcccccgcccggccagctgccccgtgcgggaggtggggggcacctctgcccggccgccccgtctgggaagtgaggagcccctctgcccggccgccaccccgtctgggaggtgtacccaacagctcattgagaacgggccatgatgacgatggcggttttgtgaaatagaaaagggggaaatgtggggaaaagaaagagagatcagattgttgctgtgtctgtgtagaaagaagtagacataggagactccattttgttctgtactaagaaaaattcttctgccttgggatgctgttaattataaccttacccccaaccccgtgctctctgaaacatgtgctgtgtccactaagggttaaatggattaagggcggtgcaagatgtgctttgttaaacagatgcttgaaggcagcatgctcgttaagagtcatcaccactccctaatctcaagtacccagggacacaaacactgtggaaggcagcagggccctctgcctaggaaaaccagagacctttgttcacatgtttatctgctgaccttccctccactattgtcctatgaccccgccaaatccccctctctgagaaacacccaagaatgatcaataaatactaaaaaaattaaaaaaaaaaaaaagaaaaaggccatttagcaaggattcattcacgtgctcttcactccttaaccctgagctcaagtttttactttatgtccttgtgaaggtagaaatattacttggttacatttatgaaaagaaacagcaaatagacaatgaaatgtaaacatctgcctcattataccattcaatatttttaagtaattgcttcaaatcatgtaatttagtttgcttttaaaatgatgattattttatgttgtcactcaagttctaacttgaagtttgagaactaattttctcaaagttaaacttaactgcagaacctattgctaaatatcatttgattgtgagaaacatccagtggcaactgctacttataccttacttttcttgatttattacctaaaatgtagtcgacttggttcactgaatagtgatgtttaacttgggcatatatggtggcagattcttacctggatctaagatgcttctgctggtgtggaaattttccatttgggaaatgaaagttttctggtctcttgagggcctcttaagtttgataaaaagaaaaaaacaatcaaatgagcacttcttcgtgaatcataagactgaaggagaggtggagagcatcaaacatgtggcatattctgcagctgtgagagtccatggttgagcaagttcttgctttctcttgtttaggcttctgggcattatctactttgataatctttattgctgatcttttcttccattctgggttatactaataacaataaatgcaaacacaaaactaacaagttcatatggtccctgctttaactcatctcttaaaaccattgttggaaaactagttgtaaatttccagtgacttgtgattttttttattgtcttcttcttaccaaaatataatctaggtcctaaaatgccatatgagatatgtatttaaattagaaaactgtgtttaaatatttattactctggttttatagtggttgcaaatattttttaccagacagaatccactggaaaaacattccacagacccgtattcttagttgatttattgaactctatattgttataaaattccgtacaaaatataatattcaaatgaatacaattatttaaatgtctactataacgtagcgtaaagtacacgtagcgtaaagtacactttgctacccacaaactatctggggttatttataataaagtcatgcatcaaaacatttgtatttcttttatcaccagtcaacatcagctaattttcagatgacataattcaaatttttgtaagccagcctaaaatagaatatatttaggcttggtgctgattgtattagtattgattttattagcactaattttatatgccaccttttgccttcagtggttacttttgaagatgtgatgggggaatggaaaatgcttaatagaaaatgtcttcacttatctatttcataggttaatcattgatattgttttcttatcaaatgaatattaaaaatagcagcagtgaattcattcttgttattctgttgcttttttgttttcagcattaaaaatatatcagcaattatgatatgtctcatatagtcctaggctcataagcttgttggataatttatttggtagcattttgttcatttatttcagatagatagatttaacttttatatttaacttgtaacagcagaaattagataatcagactatttttatactagtaccacaaataaataatgtcacctgcaagcaactttctaaaatattgacttctagcattaaatgtcatgaaattatagtaactcagaaaatcaatagtgatcatttgctactagaaacaacagttatggctttaaataaatgaggatttttaccctgaaaaatctttttacttttgtcaatttctcattcagttgttatggtaattacatgcaggacatgagaatttgaatgagtggttgtgactttgggccacttaaaatttggtattgagtgagaaaaagcccaaataaggatgtttatataatatacgtaaacgattattcaggacattctggggcagcatctagatcactcaacaaggaatcaacattcttagtttctggagtaccactcctgaaagagcctagacttgatgtttattttgaaagtgatggtgacatatcgtaaaataaatggattcacatatttttgtgttctgtgttccagtccagctctgtaatggcagctgtgtgaacttggatatgttcctagctttctttatcatagtttcctcttttataaaataaagttaattactacctcacagaatgactgcaggaattaaatgagtgccggtgaataaaagatgttcaataaatgttaatatcctcagcagccaatatacaaaagtaatataaaatcttaatattttgacaaaaatttatttgacagaattattatatatctttatttgtgtaatattaattcctaatttttcttgtgaataagtaaataaaagacaggaggctatagtagttagctactgatatgtgacaaatcaccccaaaacgtagtgacttaaaacgttcatttatttagcttgtgattatatggtttagaaatttacactaggcttagctcagtgatttttttttgtcttagttgatcttatctacgttcattcatacaattcgcctgtgttatcggcaggttgtgcatccagggactatgcatctgtggattcacccaaccatgaatcaaaaataaatattgagaaataaaaattaaaaataacaatacaacaataacaaataatacaaataaaaaacaatataatctaacaactatttacatagcatttacattgtgttaggtattataagtaaactagagattatttaaagtatatgggaggatatatgcaaatactacttccttttttataagggacttgagcatccatggactttgttatcagcagggatcctggaaccaatccccagcagattctggggcaagagtgtgtatctcttctcagttgccaggttggctgagggtggctgggctagtttggcctctgctagacaacatgtctccactccagatgatctctcatcttccaacagttatcctggacttgtcctcaaggtgaaggcagggatccaaaaagaggaagcagaagcatataaagcctctttagcctccttgctcagaactagcttgcccccacctccatcaccaccatgttctactggccaaagccagtctcaaacccagcctagattcaaggagtaggaaaatagattccacctcctgatgagagaagctgcacggacacattgcctagggtgtaaatatatggagaggtgaaaaaaggggccattttataataaatctaacacaaatgatataaaattttattttaaattaacagtagagtagaaagattaaacagatttatcaactttacttcatttttttccttctcccatggcctaaaatataattcttaaagttaggtttatatagtgggacttgcagactgtgtcaaaacatattttgaatttgaaatggtagaaatactttatatgtaataggaaaatattattttaaaaatcttaattagaatgggaaaaaagaaacacaatatatcaaataattaaaccaaggaatggttttgtacttttacatagcaaaatgtacttattaactttatctaaactaaaactgatacaagaataaatggaaaaaacaagtcaaagttgaaatttttttttaggatttcatgattaaagcttcttggtgattatgcctattatttaaaactaatgcaagtatgttaaatactgctattataaatatagcactttcccttcatcactctaaagcaactgtctacatgttaccttacttcccgtgaattctgtcttggttcaccttgcagagttctactgaacatcagcgtgttatacaattgtttcctttaccctagtaacatgtaaactaaacttctacaatttttaggaaggacttacttgtttgatttgacagctgacttaaaaaataaagagaacagatggagcaaaataataactatgattttaaaaatcatagcaatttatctgtggccaatgataattggtatgggagtaaccatgccaactttcaattatccatggtagcaggcaattgggaaagagtgatggtaatcccacagccaagccagaggcttaatgctagtcattacagattgtgtattattttcctaattccttacagtgctcgtgaataactctaatttatgtgaaatatgtttaaccctctgttgttgcatcacttgctagtagttatagaaaaagtaaaatgtccagagagagagagaaagagagagaaataagaggagaataactataaagggctataatattttatgaacattagtcttttaaagtattattttaatgattgcataatatttcactatataaatacgtaatattttatgtgagcattcccttgttgttagaaatttaagaacatctgttaaatgtgttttcttatttgtgtcactggtgactttagcaaaataattttgatggaatagagagtagaagccaggttggagtttcctgaagagttaaattacaggtgaccgataaagaggccatgcagaaaaaccctcacgagaactagctgtgaagaggacaacagccataggacagtagctggagagggtgtgagtcatttaagaagactttattccaaaatccaaagccatcataaggtccttggcaggaaatattcttgaacaagttaggacccaaaagaaaaacacggactagttcactaatacagagaattccaaacgttttatacttcctaagaaatgtcagactttaggccatcatttttaaggaattcccactaaaatcaagactaagacaaaggtgtaactgctattatttaacaatattctggaatttctgaccaatgtcaattttacttccaaattatagtttaaatctgtctatttctctccatctaccccagtgtcaccaaaccgtaatcattagtcacctcctagttaatctccctgttctcactctttctcattcattttccaaattatggtcagatgcatctttacaaaactattcatgtggcttctattttaaaaacattttagttgtttcccattaggttaaaatcctgaatcccacaaggtcctgcaaagttggacgtagatgtgcttctcagaactcatctcttcccacattccccttttctgcttctattccagccacactgaccttctttcagttacttgaatgtgccaggcgctctcctgactcacagttgtccatcagtgtccccactgctttgaatattttccccttcatttagcttccctctatccacttagcacatcttaaaagtcattttcttggaggcttccttgactctccaatcaaaatctgctccttctgttataatttctcattgtacctttagcactatactgcacctgtatagcatttaccacaatttataattataaatatactggcatgaggattttgtttgtctgtttttctttctccaatagagtagaagcttcaagaaaacaacgaccatgtctgtctgtgtacgtttttatctctaacacctagttgaatgcctagcacacaaaagtattcaattaattcattctttactgtggggaagtattatagagaaagttaagtagtgtttcttttcagcctccagaagtatttaataattattatcttgatgcattcaattcagtatcaaccctatttttttcagactcctactattgaatttgtgagatatagctagggataaaaattaattttacatgtatggcccttagaattgtgtttaaaaagacaatatataaaatataaaacattaatatatttaatagtatgctaaaatttacacaggaaatattgtttaacctagtatatttccaatttttattatttgtgaatcacattgccttttggcaggcactatttagctcataattctataaaataaaatacagttcttttaataccagatattgcaatgtcttttgaatttagtagtaatgttaaaggttgtctactggctcctgtatcataattttactttccaattacagtggaattttgggctgttgactgtagtgaacctaggttagttttgttaaggaaatttattcactcaatattttatgtaatttaagtacaaataaatatgaaagtttggggtcacataagaaagaataaatagaaaaaccatgatcctcatttatgtaatgattaaggcaacttgacttttagtagtttctccttagtcagtgctgggtataaaagggtggttttacaatgtgcctacattttgcttttattttgacctttactccatttatcctatttcttcactccaggctctggagctgcctcaggtttctactcttagcttttggtcttccctttctcctttctcaggatctgcctgtgccatagactccacttcctctgctctctgctgggctccttgtcctcagctgctcattaatctcttcacccccactgctttctttttcatttgtttgacttacctcccatcaagcctgatttccacttcaggttactttctttcattttttcgcatatttttgtattcaaaaacaaggaatagatctcttaggcagtccctcaccacgactgaccctgagcatttctgaatgcagctgagtttaaattgagtaaaggcaactctcacatttgttatgaggtttatacacacagggtttttaatgtataaaaaaaagatgtgtttttttaaattaagaaaaacagaatagatttaaaaatcaagcaatttcttctgcttaatacaatcatcaaatatccataatttctaactgtttttagtaaatctcaattaataaatatgctttattaacaaaaatctcttttttggaagtacattccagatggtaaaaagataattaattcgatgtcaccaaatattacatgacaggtgtgttatttttattcaggagctaccggcatgtgaacttctttcacaatcaatgtaaaagcaattcactgtataggaattgctgaacaagtgtgtcctaccagaccgaaatagcagaattccactgcacagaaaacagaggtgttagtgcagctgctgttccaagtggatgttgtacagtgactagctgttttgtaagttattgtctaggcttatggtggtctattgcttcttagtctaatatcttaaaaaaaatcattggtttttattttccttgatatccttgatatttccttacaatctcctttaagaacctccccatcaatgatctgttctaatatcagtaaaggatcaatgaaacaagacagaaatcaaataatcaatttgctttgtcttttttcacttttccttattgttcctcattttctgctgctaatcattttgtgtaatcaaaactcaaggcaaaatggtaaagcgataatgctttgggcaaacattttgtggaatgttattttaattgcctgcacttgtccagccctggggaggagtgtggcaatgcagatggcttcagctggctgtattccaggaactcactgatagtgattctgcctcccacttaaggtttacttatgtgtacaaatgaatcatgcagttcatgtcttggtaagaactacaaggctggagcacatgatagcacccagtaatcacagagcgaatcaaggattcttccttaagttagtggaaagttaggaagttatctaaattgactttattcctttatccggattttgacaggtggcccaccattatcattaatgtttataacagacaattctaagttctttattttaagccaaaatttgttccgtattattttgaccaatctaatttatcccagttctaatctttcagaccagtgttttctctgattatatgttcttgcaaatgaatgactgaccatcttttggagagtttaagacagcttccttttttttttttttttttttttttgagacggagtcttgctctgttgcccaggctggagtgcagtggagcgatctaggctcactgcaagctccacctcccgagttcgcgccattttcctgcctcagcctcccgagtagctgggactacaggtgcctgccaccacacccggctaatttttttgtatttttagtggagacagggtttcaccatgctagccaggatggtgctgagctcctgacctcgtgatccacctgtctcggcctcccaaagtgctgggattataggcgtgagccaccgcacccagccaagacagcttcttaaactgtctcctaaacatgaagatgcattctcctgaacattttcatgtaagtatctcagttttgagcaagtgtttcactgtgcttcatggatcactgctaatggatcccttgtcttcctcataaccttcatcttgtaatgttataactcatcagtgtactgttagtgtaatgctcagacatggacagaattattctagcactttgagcagtcattcatataggcagtttaatataatgaaggcatttggattttgtggagctgagtcctcatcctggctcctggacagctcaagttatccatggctatttcaatgtcttcacctgtgaaagagacagtgaggctagattaggcctagaatcacacatgtttagagctagagtgaatctgagaatatatagagtttataatactgtcaggtggttgttttcttgagtcacaatataagcatttacatgtatacgtgctgcctttattctggggatttaagcctgatgtttctgtttgttaacgttaaacttttgattctggcaggtattacaatggtaaccttttatcagctctgtagacatgaattctaggtccttgaattttgtagatatgaattctaggccttgagtagctaatataaatattgaataagacatgaccagaacacagcactgtgacacaccactggagttctctttttaggggtgatggcctaatagaaatgaaggtagaatgagcgtatttatttaactacctattatttacctcactaaaatttaaccaacatttatcaaacacatcctaagaaactttattaaatgtcttactgaattaaataaaccaaactcataacacatggtttttgttttctgacatggtattgcctattgataatcatcttattcttaactaagagtttaaaaccaatttgtttaataattaaatctagaattttgctaggaatcagtatgaaacttactcatcattcatgtatattttttaaatgagcaagcattagtgtgtctaggcctttccttctccaagattctcagagattcatctcagtggctaatttccatgagctcttagttatctgcccttaatctgtcctctcctatcttaacgtctgtcttggtctcaagagtggttatctagaattaatgaattaaaaggccttcaatttattttcaaagtagtttgatgccgactataatccaatatgatactgtatccctttgaaacatatgctgggttttggaatatatttgtttattcaatcatccatttatttgatcatttaggacccattttttaccagatactgtgttcagcactagggtagcagatatgaaagagacaaaacatcctttcagagagtagatatgaaatgcttgatggtgttttgtataggacctgtgggaaggaagaggagtgagtacataacgctccctaggagaaggaggggagtttgattaagattctttagtgagtcctgaagcataggtaagagttctccagaacacggaagaggcaaatgaaacagttcattgtaaggtttagagtaagaacaaagtatgagatgtttaaggaaccacatggagtgtcttgagtgacaaaaagaaaaccagtgaccaccagagaaaaaaacaaaaggacttttaaaaaattcctgagtcatagtttcaggcaaaacactcaagggagacaattgccaggaaataacatcaagaggatgcctctgagcattcaggtgatgtcatgtttagctcactcttccctggtagggaataccacctgaccaaaagcttgagggaatcctcttactagaagacccatctgaagccgccagacaaaggattagaggctgatgtccctttgagtcagtgtggcgattcctcagggatctagaaccagaaataccgtttgacccagccatcccattactgggtatatactcaaaggattataaatcatgctgctataaagacacatgcgcacgtatgtttattgcggcactattcacaatagcaaacacttagaaccaacccaaatgtccaacaatgatagactggattaagaaaatgtagcgcatatacaccatgcaatactatgcagccataaaaaatgatgagttcatgtcctttgtagggacatggatgaagctggaaaccatcattctcagcaaactatctcaaggacaaaaagccaaacaccatatgttctcactcataggtgggagttgaacaatgagaacacatggacacagggaggggaacatcacacacccgggactgttgtggggtggggggaggggggaggggggagcgatagcattaggagatatacctgatgctaaatgacaagttaatgggtgcagcacaccaacatggcacatgtatacatatgtaacaaacctgcacattgtgcacatgtaccctaaaacttaaagtataataataataaacttaaaaaaaaaaaagaaaggttcaggctggcttaggtaacaatttaattaaactttttgcttggcatttcccaggaatttctgaaactttctatttttattattcttgcaatttatagaaactgaacatttcaatccagtggaggataatagatgtggcctctatctaggtttattttgctagttaagttcctgaagcaacttaatccaaatattttattttgtccttaattaagaaagaaaagaaagaacatgaaatgtagccatttctttcatgaatcaaacaagatttaatatttgatcatcaagaataagtggtaagtttcttgctttacctgctaataaatggccatggtcatattgaaaaaaaaaattttactgatctaaatttcaataatttactagccagaaacacagtctcttgctgtgatcttgctcctcaaattgtcacaagaatccccagagattctatatgtgttacctctgtgaactgatcagtatgtgagtcaacagcaggccttgctatcattccctcctgattcctgagaagaggagtaagaaatttcaggtataatttgagctggcacctgaaacttttgctatatctctagttaggttgaagtatagctgttgccagatacacgtatacatatagatacatatacatacatatatagagagagagaaagagagagaaagagagacagacacagagataaagagataatgttttgcattttatccaatagataattttttatacgttcatggaacagtttgaaaaatttatgattctttggacaaaaaaaataaaaaactcaccttaagttgaaaagtagacattttgtaagactcattccttgatataaagaataataaagaaaccaatacatgaagaaaacagtcctcaataaccccggaaccaaagagttaatgaaaaggaaaattcataaaaatcaatgcacaagaaaaatactttatataaaacatatggaccatatcaaaagctataatgaaggtgaaaatacatagtgtcaaatctggttattataaagaagaaaatataaaaataatgaaaatatgcttttatcttatataataataataaatagccccgaaacaaaatagtagatgggaattaataaatatggtcactaaaatcaatgaaacagaaaattttaaaaattgtagaagggacaaacaaatcaaacacctgatttaataaatgactaagaaaatgaatacacaaagaattaaattattctattaaggaaacagaaaatagaaaaaagacaagctagaaataagaaaaaaaaatgaccacagatagtagatggacttaaagaattctgagactattgttatatgtgtaatttgaaagaaacaaaaatttgatcacctagagaaaatggatgatttcctcaaaaaatataaaaaattgaccaagaataactggaaaatatgactacactaattactgtggaagaaattggagaggtgattcaaaatctaccattgaataaagcaccaggactaattgggtttttcagcagggttttatgtagccagtgttattttaactattctaggctaaaggaaagatccacagcctccaagaagtcagcataatgttaatactaaatctaattttttaaatataactatattttatttattgttatagatacaagtatttttaaataaatattaccaaacagaattcaaccattcagcaaaagaaaaatcaagtaggataatactatgaagtcaaggtggattcatgttaagaagttatatatatcaacataatacatcagccaattaaagcataaaagttaaatgattatatcagtagatgctgaagcttttgataatatgcaatattcattcctaataagatcttcaagtaaaataggaattgatgaaatatttttactaaaagccagcagcaaatactattcttaaaaagggcaaaaatagattagaaatgaaatatgcagaatttagacttaaggagataaaattgccataaccattacttcacaagaaaattaagtaacctatgtagcactagaaaaaagagataaactacctttttttactaatgagttgactctataggtagaaaatctaagagactttgggagaaaatttagaatttagataccagggatatatttaaaaaacaatagattttgtttattttagccttaaacatctaggaatgtaatgggaaatattccattaatataagtggtaaaagcaataagaattttggaaaaatatgaataagaaagggacaagatgtatacaaacaaaatcaaagggcgtaaaataaaatctaaatgaatgtatgtagatacaccattttctttaaaattataaccttaaaagttcagtaattcaaaattaatacgtaaatgtaatgcaatacaaacaggaattccaacatgttttaaattttgtcttgaagttggtaaaattttttaaagtttatatgaacaaataaataactaaaaatagtcaaaaattttttgagaaagagaaatgtagtaatttagaaatttagggtgaacttgctttaccagacatcataacattctataatgtcatagtaacaaaataaatattgcatcatgtagaataaagatagatagactaaacctgagaatctagaaactggcctcagaagttatgtgaagttaatttaataacttttgtatttttattcagttattcagttgaaaggatgggttattccacaggtgcattggcactaccgagtctatccacgaaaaactattttataccctatataaaaataaatgccagatagatgaaggacttatataaaaatcaaaacaaagcaataaatactttacatttgtgtaatccaggattaagtgtatatctaaccaagatttgaaacccagggactgtaaagtaaaagatagacatattagacatataaaaattaaatgtttcagtggtaaagtcataatcgaaatcaagtaggaaataattgttctgataaaatataattaataggtgaccagttaacatttgtacgttccaaagagtttttaaaagctgagaaaagacaactcaatatttgaaaatggacaaaatgtgtgaataggcagctcgctaaagagaaaaattctaatgctagtaaacatgtgtaaggctcagattcactggtagtcagtgatatgtaatgtaaagcaattatgagatttggctttacagccattagcctgccacctgttgctggatgtgattcaaggacaaaggcattcccatacattgctggtggtaagtgtagagctacagtctcttttagaaagcaactgggtaatatctattcaaaaatgaaaaaaatgcataatctttttacctagaaatcaccttcttgaaaatctgacttatataaatatattacatgcatgtgatggcctttattttttaagtggtataagctttaatacaactcctaacacaaattctgttaaattcaaacatttgctgggttcctagaacagtgctcacagagttggcacacaaatgttataacatagtattacttgttaggtatacaaaaaacaaaccatacagagtttttgccaatgtggaatataatggtgttttgtaggggcagaaaactggaactgagtgagtgtcattaacaagaaaacacctgaatacattatggaacatctatatcatagagtattatagaactactgaataaattaggattctgctgggtaatctaaattgatatgtagaatgtgatgatgagggagaaaataaaaaatgcagaaaaatgtatataatataaccaatttttaaaacaaaagtgattaaaatcctgattgtgcctgtatgtatgtgtgcatctattgtaacttatgatgacataagtttggagtaaaaatttggaaaaatacttacaaacttaaaagttaataacaaaagtctggcatccagaaaaggagtaaaagaaattaaaaagtgagaggagagtatgatttattgtcttacttcagaacttacattatattatatatattcttcatatttaaaaaaacatttaacattcataaattttgtatgtgttttatatttataaacttttaaatttataaatgttatattcataaaatataggtataaatatatatcacattacatacatagatacatgcattgcatatgttcccttgcccatgccaagtcttgcaaagaaaacattttaaaatctgtcctaaaatatatgtttcatgtatttaaggatttatataaaattacaaatatattttaggtaattttttaatttcaagaaaagcacaagagaaatggattaaagataggaaaagcagcaaagtagctgctacaataatacacaaatgaaatgaccaaggagcatgacaaacataatgccaggattgttgccatcattgttgccatcatagcaatgacaatgtgaggatcatggtggaagcagcagcaatttaagaacaaaaatgaagatatagaaagaaaaaaagagggggagttaagaagaataattctgttctgatgcattggtctatttgtctacacttttttatttttattttcattttttgagatggagtcttgctctgtctcccaggctggagtgcagtggcacagtctcagctcactgctacctctgtctcccaggctggagtgcagtggcacagtctcagctcactgctacctccgcctcccaggtcaagcgattttcctgcctcagcctccccagtagctaggattacaggcacctgccgccacacccgactaatttttgcatttttagtggagatggggtttcactatgttggccaggctggtcttgaactcctgacctcgtgatccacctgcctcggcctcccacagtgctgggattacaggggtgagccactgcacctggcctacacttttaacaatacaatattgccaaaatattatagctgatgtttatagtgagtatttagtagggaaaattcctcaccaggctctttaagattatcttgggtatcctagaaccttggcattttcatatcaattttaaaatcaacatgcccggccaggagcagtggctcacgcctgtaatcccagcactttgggaggccgagacgggcagatcacgacgtcaggagatcgagaccatcctagccaacacagtgaaaccccgtctctactaaaaatacaaaaaattagccgggcttggtggtgggcgcctgtagtcccagctactcaggaggctgaggcaggagaatggcgtgaacccgggaggcagagcttgcagtgagccaagatcttgccactgcaccccagcctgagcaacagagcgagactctgtctcaaaaataaataaataaataaataaataaataaataaataaataaataaatataaaataaaatcaacatgccaatttccacacttacatacacacaacttgctgagattttgaatgaattttctttcaatctatagatgtttgggaggaatttaccttgcaatagtatagagtcatccaatccataatatatctatttatttaggtttcctgtattgcctgtaagtaatgtattttaattttcactgtagagttcttacataattttcgttagatttatgactaggtatttgacgtttttgatgctattttgaatacttttaaattttaacttccaattgcttctagtatatcaaaatacattgatttttgtttattgacctgtgtctggccaccttgctttattaactaattaattctaatagttcacagactaccatgcaatttgtgaataaatttctacttctctttacaaatcttatttcttggattttttttcttgccatattttactgactaggacctccactacaatattgaaaagaagtggttatagtgtacattcttgttctttttctaaatttaaggggaaagaattcaatattttatcactaagtatgctgtaggcttttgtagagaccctttcttagaatatgaatattgagaatataatttgctgaattttctttgaatactattcaaatattgaacttaaaaatgctttttccacatctgatgagatggtaatataattttctttctattctgttaatgtggtgaattataatgattgattttcaaatgctaaactacccttggattcctagaataaaattcatttgttaagaatgcataattttttctgtgtataagtggattcaatttgctactatcatgattaggatttttgcacctatgtttataaaaatttaagatttttttttctggtcattttctggtcaaactttgctatcagagttatgctaggatcataaaatgagttgaatactgaataaccccttttcttgtttccagaaggagtatgtgtaatatctgtattaatgtttccttaagtgtttttaagaattcaccaaaaagccacagggtctgaaggtttctttgtgaaagatttttacattatgggtttaattatttattttgattgctttgtttatgtttctcctgaaaatttgaaatttttgctccagtggttataaggagaactacataaaatatagtgaagtttctatttctgcagtcagtgtctattgatttccttccctagaatggctgaattaacatatttccacttcttccatccctgccactctctgatgtcaatgaatgacatatttttagttttaccttggtattgttaatatgcttatctttgttacgtattttggttttaaaggcaacttaagttgattttaaagacaatcttttaacacctcactacaaaagataatggacttaaactacccattattgccaccctctttcctctccttccttctaatttttgtcagatatataattttagcattttttggtattcataatatttacatcctgttcttaagtcgcaagccctaatttttatcttatttttagtcttgtagctaaatgaaacctatgttcattgtcaatcttttgcctgaagtttctgtatcattctcttggttggctgatgtttgcctcctagttttttcacaaaaagttaatgagaaatatatatgcgaaggacatggaagtcccccaaactttgctttcactttatactttaatgacaatttagctgtgtttatagttcttgaaagattatttgtttccttggggacattttagccattagtcttctatcattgagtgtttgaatgttgctcgggagttatctgagattagccagcctaaaacctatttccataggagattgataattttcttcattttaaagaaataattaatgcaaatgtaataaccaaatgtgtaatttaagagctgcatttaagaactggtaacatttgaagaaaaaacattaggtttaatttgggtaggttcaaaatgtctccctacccacttgtagttgggatcagaatacaaagtacacctcaaaacatgtcttttaagggaagaattgtttccttgggtaagataaaacttgaaactgaattcctcactattgaaattttaatagtacaaggttaaaaatggcattcaatatgagttttgttgtgtgggatggttttggaatctttaactgaataattccatttgtttaagtagtgaggtactaactttcagaggaagagactttaagagaatcagttgaaaatgactaatgccaaacatgaaagcagcatcatcatttctttactcattcctcagaagagaaacacccttactgccatccagaggtctatggtccagtggcgagttcagcaacattagcaaagggggtgaaggatgagagatgactcagagacttttcagtcaggtctattgaagagatagcttaatcaggaaaattaggaccactttaaaatgagtatcaagagtggaaagtagagacatgctaataagaagataggacttctgaaaaaaaaagtagctgagtatatatgcaaacagccaggaccctggaacctaagtttccttcaccattactgaacgttttcaaaaattccttaaacttctatttctttgtctaaaaaactgtgaaaattttccttatttcaaaactttgctcagaaatgtctctcctgagagtctttgaaagtttagggcatttaaaaatgcatattattaattttactgagttaatagccattatagtctagtagtgtgtgtaatatatatcaggggacatcttaaaaggcatattatcataaaatgcatatttaaggactttccacctacataaattgaacttaatagattataacaagtctagtgggcccattagggtctttggaaaatacagttcagggccttgttaaaacatatattcttcatgtcatattctacttaaggagcttgcttcagtaacctagaatttgaatatgtttgtcttgcttagtcatgaaaaatgaaaataaagaactctttctttttcagtaagacagtctacaaagtcaggaagaaagcaaattttgccgctaattacattgtttttagtttcaaataacatacatagaaaagtgtcaattaaaataatagctgccagtaaaatgttaaatgacttacacgttttatatatatatatatatatatatatatatatacacacacacatatatatatattaatcctccttttataagtcagaaatgtgagggattatatgtttcagtttaagctgaggttattgattgttagttaccaatggatatacttcaatgagaagcattgggtataaattatgtccagtgtttctcataacgtgatctgaaaaaccacctacatcacaatctcgtgggtgcttaaaatgcctgtttctgagcctcattcctgatcccctggatcagaagtctaggcatgtgccttgggaatttgcattttaataaactctcttagagatggttgcataacaactaaagtttgagagcagttattttaatgtgcaaacctatacacataatgtactaaatatgtgaagccctatctagaacgaacttctgggcatatatactttgaccgcagagtttatactacaattccttaaactttcttcaagtaatgcttattttgaaaccagttctggtctccagtgcccaacttggtcttatttagaaagccactgagctttctggctctaagactgagacatggagctctaactttgtagctgcaattggaaaatgcattaataagatatttgagtgcaattgcccattagaaattctatttctaagattttggatactttttgtattttgtttcattttgtgttgtgttgtgttgtgttgtttgagacagtctcactctgtcacccgggctggagtgcagcagagaaaacacagctcactgcagccttgacctcttgggctcaagagatcctcccacctcagcctcccgagtagctgggactacaggcatgacttttgatattccttaaaaatctttttttgttgttgttcaaaatcaagaggcatcatcccaaaggtgtccactcaaggcctatggatattcagcaatgataactgactcttatctgcagcacatcactagctacaccaacacaaaacaaaacacagcaaaataaaatccttctgtcatgttcatttatcctacagtcttcctcaaagtggaattataaaaaatggaattttattatttactaataactctatgtctaaatttgtttttcctgttttctcattttacaagtgcaaacattatcctcttgactcagtgaaaattagacttattcttgacccagacatacggctatactgaaggaaaattcatcattggctactgagaaggatcaactctgatagctgaaataaatttgaaacaaatctcacactagagacttgaaagtccttaaaacgattgcttggtttcacaaacaacactgtgtttttaacatatagaatcggctagaggtccttatgtgcttgtgaaattttccaaatgtgaaagacataagcaccaccgtttgtatcacagctctttctttcactggcttctaggacttgaatctaacaaaatacctcccagctgtgcttaactgccttgtggggttggttcttgattgttggtaaggattccctgccatgcttacttgggagcctcctaacattcttccttctcctggagagagcccctaatggaatggagttcttaataccagaaaattgcctagaaaatttactcaagtagtgggctttctcaacccagggttacagtaaaagggaaatgtgaaaagtttagaattaagtatgaacatctagttctgacatgggaggaataaactgagtacagcatgtaagaaagataattatttggacccttaaagctttaaaccaaatactctgactcatacaggttctggaaaagactcaaaaatggttcactattgaccctgctgtaagaaacagatctttattttgttttttaaagaagttttaaacaccagattcgaaatgacttaaatatgcaaaagtgcagcattattaccattttctttccccattcttatatgttcattctctaactgcagcctcatcagtggtttactacaccaaaggcagtgaaaaggttacatgtcatttcctgtactcctcatattcactagatttgactataaattccatagtgaattacagcaccaccattattaaagtaatataggccaaaagataagcattacttagtgtgcttagtgcttaggattttgcatgaagtatctgaaaagggtcttctgccctccaccatatgtgggcttttaatagttggcttttccttattagttcccagatgagaaattaataaaacaaatgatcgttgctactgataaataaatgctataccggaatcatttgggaaatcactactgcttatgaaaagacttctagcacctcttatacctttccatgtatcagacaagaaagtttactgagttctgtgctagatgctctggtggaataaaaaggaactagaaaacaacacccacgtgttaagagactgataataccgttggagattcaaaacaaacctcttcccctcctccctcagcagtctcaacttgtcttatcagttcaatcatcatctctcaagaggatggttcctaaatctataacctaaacctgatatctttcctggagtctggtctactttacccaactacctgttagacatctcctcctggatgtcccatttattcctttggttcagcatgttcaaaacaaaacccttctgctttcctttcacatctgcttttcttcctgcatttgctcttttctatttgtgctgataacatcaccatccttctgggctttgcacaggtctgaaacctgtaatttttatgaactcttgcttctcccctcttttcctgtcacatctcatttctcatagccgcccttctttttcagccccatggcatttccctaagttctggctttccttgcctttgcctagattgttggaataggtttctaagtaaattacataccgctaagttttttacccactaattttttcctacataactagctccattactctccaaaaagtacaatgccggggttctactcaaaaagagtcagtgcctcctcaatggctaaaagagcatgtccagacatccctaacttgcccttcgtggtttctacaacctgattctgcctgcctttccaatttagtttcatagaattttcctttttcggaatcctgtgctttacctaaagcaagtaacttgctaatccatatatttgtgccttttcttttacttttcccttgttctagaataacgtccctctatttcttttgatgtagatcaagcttgtcccaaccacggcctagaacagctttgaatgtgactcaacacaaattcgtaaactaacataatgagagttttttacttttttttttttttttgctcatcagctattgttagtgttagtgtattttatgtgtggcccaagataattcttcttccaatgtggcccagggaaggcaaaagattggacaccactgatctagatcctacctaaaacatggaaacttgctcaatagccacagaattagactaaaatttaagagccaatttctagaacagaatggtctaggttcaaaccctggctctcccactttactatgtcaaaatactttaccttcctctactttagtttcctcatctctaaagcagagtagtagtacctaatccctagtgctatgatgaggtaaatgagttaaagctcttagactaatgtttcatgtctataagatcttatataaatgctagacttcaattgtgaatgagtaatttttgccttcatttctagagctttatcttgttaagaaaattctcattgcatatcaaaaagcttaataatgaatgtgtacaaatgatgtatctctttatttgtgagcatgtgaagtacccacttataaagactctggtcctaggcataataaaaaattgttagtatggacaatttcaaataaacacaaaagtgtgcagaataaaatattgaacacctgtatatacttcagctgtcttcaattcacagccaatcttgtttcacttagactccatcttgtattattttgaggcaatcccagtcagcatatgtttcagctattaacagttcagtctgtatctgtaaatgataaggcttttgtttttacataatcattatttcattataacacttaaaatttttaaacataactttttaatatcattaagtagtcatttggtgttcaaatttccaatagtatcataaaatcataattttcgttaacaatttgctgtagtcaggatccaaataagataggcacattctagttggttgctgtgcttttgatggtctcttgatctataattttcctccccctctctgtcattttgtttgttttattacattatttgttaaagaatcggggttgtttgtcctgaagaatcttccatagcctggatttgccaactgcagtttcatggtgtactttaatatgttcctctctcctctgtgtttcctttaaagggtggttagatcagtttaggtgtgatgtttttagcaagactacttcataaattgtatggtggtgtgtgccaagagccacataatgtctgaaaatctttctttttgtgatgattgcagccattgatcatcaatatctaggccaattaattcattcagggtcacaaaatggtgatttcttaaaaggatttattcaattttaactttttcttcctttttctgacttctattttaggtttggggggtacatggcaggtttgttacatgagtaaattgtgtgtcacaggggtttggtgtacagattattttgtgacccaggtaatcagcctaatacctgatagatagttttgttattctgatcctcctcccactctctatcctcaagtagaccttggtgtctgttattcccttttttgggtctatgtgtactcagtgtttggctcccactaataagtgagaatgtgcagtatttggttttatgttcctatgttaattcacttaggataatggactctagctccatccatgttgctgcaaagggcatgatctcattcttttttataactgtgtagtattccatggtgtgtatgtagctcattttctttatccagtccacttggatgggcagttaggttgattccatgtctttgctattgtgaatactgctgtgatgaatatatgcatgcatgtgtctttatgatagaataatttatattcctttaagtatatacccagtaatgagattgctgggtctaatggtagtttgtgttctctgagaaatctccaaactgcttttcacagtggctgaaatagtttacattcttaccagcagtgtataaacatttccttttatctgcaaccttgccaacatctgttattttttgacattttaataatagccatcctgattggtgtgagatggtttcttattatggttttgatttacatctctctgatgatgagtggtgttgagcattttttaatatgcttgttggcctcatgtatgtattcttttaagaagtgtcctgttcacgtcttttgcccattttttaatggggttatttggtatttacttgtccacttgtttaactttcttatagattccgggtcttagacttttgtcagctgcatagtttacaaatattttctcccattctgtatgttgtctgtttactctgtgaatagtattttttgtttgttttttgctgtgcagaggctgtttagtttaattagatcatatttgtcaatttctgttttcattacaattgcttttgtcatcttcatcatgaaatctttgccagggctgatgtctagaatggtattttctaggttatcttccagggtttttacagttttaggttttatatttaagtctttaattcatcttaagttgatttttatatatggtgaaaggaaagggtccagtttcaatcttctgcatatggctagccagttatgccagcatcatttattgaatgagtcctttccccattgcttgttttcgtaagccttgtcgaaaatcagatggttgtaggtatgcatctttatttctgggttctctaacctgttccgttggtctatgtgcttgtttttgtaccagtgccatactgaacttgtagtatagtttgaagtcaggaagtgtgatgcctccaactttgttctttttgcctaggattgctttggctaccaaggctcttttttggttccatatgaattttagaatgtttttctctaattctgtgaaaaatgttgttagtagtttcattttgcacttgtatacaagaacttaaagtaaaatttaaaaaaagaaaaaaaaatgttgttagtagtttgatagaaatagcattgaatctataaattgctttgggtaatatggctattttaacaatattgattttttctattcatgagcgtggaatgtttttccatttgtctgtgtcatctctaatttctttcagtagtgtttggtaattctcattgtagagatctttcacttccctggttggccctattcccaggtattttattctttttgttgctactctgaaagggacagtgttctcgatttggctctcagcttggacattgttgatctatgggaatgctactgatttttgtacattgattttgtatcctgaaactttactgaagttgtttctgagatctaggagcatttgggcagagattatggggttttctaggtaaaaaatcatatcttctgtggtgagagctagtttgacttcttctctttctatttggatgtattttatttctttctcttgcctgattgctctggctaggacttccaatactgcgttgaatgggagcgatgagagaggccatccttgtcttgttccagttctcaaggagaatgcttccagcttttgcccattcggtataatgttggctgtgggtttttgtcatagatgactcttattattttgaggtatgttccttaaatgcctagtttgttgaggattttaaacatgaagggaagtttaattttattataagcctttccttcatctattaagatgatcatgtggtttttgtgcttagtcctgtttatgtgatgaatcacatttagtgatttgcataggttgaaccaatcttgcttcccaggaataaagcctacttgatcatggatgattagctttttgatgtgctgttggatttggtttgctaatattttgttgagaatttttgtgtctatgttcttcaaggatattgacttgaaattttctttttaaattgtatctatgccaggttttggtatcaggatgatgctggcctcataggatgagttagggaggggtccctccaccttagttttttgaagtagtttcagtaggattggtaccaactcttctttatttgtctagtagaattggctgtggatctacctggcccagggcttttactagttggtaagcttttcattactgattccatttcagaactcattattggtctgttcagggtttcaatttctttctggttcaatcttgggaggttgtctgtttctaggagtttacctatttcttctagattttctagtttgtgtgcctagaggtgtttatagtagtctctgagggatttttgtatttctgtggagtcagtggttacgtcccttttgtcatttctgattgtttatttggatcttctctctttttttattagtctagctagtggtctatcaatcttatttattctttcaaaaagccagcttttggttttgttgatcttttgtatgtttttttttgcatctctatttcctttagttcatctcttattttggttatttcttgtcttctgctagctttggggttggactgctcttgtttttcaagttcctctaggtgtgatgtttgtttgttaatttgagatttttctagctttattatgtgggtatttagcactatacattttcccctttacaaaagtaaataacatatatggatagtttgtaaacatcttctcaggcagcaactcaaaataatgtggagatagatgataatgatattatgaagtcaagtttattaataaggaatctgaagctccaaaaagttgtgattttaatgatgttaaattcctagctcttttcatcttgttcactctaattgagtgagaatttttagaaagtttatagaagtattaatgcccaagcaaataaagaagaaaatgctctaatccatgtatcctggtcaaacaaggaacgagttaaagacagcaatgagagtagtgagtcattggacctagtggaggtttgcctatgacgcttgtggagaatttctttctagatctgtcattctcactggattcccaggcaacagctgtgacagactaaattgtctctctcagatgagtataaaatttcatcttccttcctcatcagcaaaatgaaatgaaatggagaattttggaaatggcctgaaatattattgcagacattgctataatttggaaattgtcacatgagtacacagaagatttggcagtttcaagaattcattctggatgtggcaccagttccaaatcagcctatgagaccattatttaaaatgccatcactgtattttaccccagatgattcctgatgatattttattcaggagacatttgtgggagatctgctgtgtgcctctatccatttgcatctgagaagaggaagaccagcctaatgattttcagaaatgagcctatgttagcatatctgaccctgcccacggtgtccccacatcctcagacatcaccttaggcctggcttcaccaaagaggcaccttctagttttatctctctacccaggactttttattcctttgtggactcccttcctttgaaaatcaaatgttctctctctcacatacacactctctctttctttctcttaagactcagctaatctgaaaataacttgccccattatttgtcattcgaaatgtagtacccacaagttaaacaaggtgggagggtgagttgtggcatgccaccttgccaacatgttccattgggaccatttctatggatgcattagtttactgccaggtgttagtatttatagaagttatggcaacagttctatgaatgtctcctttatccctctaccacaaaataagcttctaagaagtctggaaattctgagagtatattagccaatgtgagtgatcactatctaatagtatattttccaaaagcctagctttctaaaagagagtcttgaattttagactgtcatacaaatgtcagttaggtagctttcctgccatagcaattagccaagttaactaggtagccaagacaaggataacttgatgatagatggtttgatttaagtaaaaccgtgtgatttttttttttttttaccaaaagcatgctctgggtaagttagcaaatcaaagcaaagactatgtctttctatctggaattccaacaaccatctaaattctttaattatacagataattttgcatttaaaatttttgaagtagtggactattaactagatcttagaaatggtttgtgaaacttcaataaaagtgtttcttgaaagaagatttgattctcatatatgaaatatgaaccaagttaaatgtacaatctattgatacctacatttgtagttactaaagggaattgagataagctgattttatagagttatttcgttagattaagtcctttctctccttggagaaataacttaattaggtatatgtcacaaatgcaattaggtgaggaatcttggccctaattcatttagttgaaagaattacgaacaatttgtgacatagcaagtaggtttttatcaagacagtctttttgagatcagctattcaaaaagcaggggcactggactctgaacacaaatttatctcaaactttatctcgattcatctttgtggcctgatgaggtcatcatttgaaaagaatctaggtgaatataatttataatacagtaccttacctataaattcttctttatctcagtattgacacaatactattcaggtggctttaggagttatttgcttctatctgttaaaaatcacaaaggataataatagaaaaagacatgtatattcggacagctatagaggcagacatgtgattagaatcggacctcctgtttccaagcactagactcaggtcactagatcacaattacagctttatgctttggcttggcagttttgaaaagctcttatttttcttagccttatatttgactgccagagacataatcatttctttaccactcatcatgaacaacaaagcactaaattagtatctagtgttaagatggtaagctacaggtatatttaagttaggaaagaatttcttatttggaaaaagaagttatattttgtaacttcctttgtttaactaatttatataggcaggttagtagtacactatacatgtatttttttaatgtttaaatttaaaacatttaggcaaaggagttttgtctaaaataatattccttagcttactgattcttaataattaatcaaaaccaatatattttaatgatttacattactgaaaaactgtaacataagcttatttaaaacctttaaaaaactataacaagcttatttaaaacctttaaaaactacaacataagcttatttacaacctttaaatagagtctgtaaaacagtacattcagtgaaatctagttttattcctattcttctaccttgttagactgtacataatctctctctcaaaaagacttgtgtgtgtgtgtgtgtgtgtgtatatatatgtatgtacatatatagtatgtgtacatatatgtatgtgtacgtatgtgtgtgtgtgtttatatatacatatatatatatagagagagagagagagagagagaaagagaaccaaaagagaatctaacagagtagaaaaaggagaaggatcactgggaaacttaatgcatatgtgggggatatcaaataagcccagcaaaaagaaaaagcaaagaagccttgagaaaggactgcaacattgaatgccttctccaacccacccacagattgatcagaagtggatggaagccttatggacttgaggtgctatcacagcttctgtccaaacaactagacaatgattaggttatttggacacaggggtgatcccaacaaagccagtttaaaaataaaaataaagagaaaaatgggccggatgtggtggctcacgcctgtaatcccaacagaagctgactctgagagggccagggtctcagatactgaatttagcaaagactttacagaaatattgtaaatctgttcaaggaattagagaaaactctgttcaaataattaagtgaaaatatgacaattactcaatctcagtagagaaacagacatcataaaggaaccaaatggaaattctagagtttcagagtacaataatccaaatgaaaaatttactagctagactcacagtagatttgaggtggcagaaggaaaaatcagtgaacttaaatatggataaattgaaatgatctaaagaaagacgagaaagaaaaataataatgaaaaatgaacagagccacaacattctgtgagacgacatcaagcataccaacatgtatgtaatgggaatcccaggagaaaggaagagagagataaataagagagaagcaagagccaaacacttctgaaatttgatgaaaactattaatttatagatgaaactttagagaactccaagtagaataaacacaaagagaaccacgtttagacacatcataatcaaactgctaaaagccaaaaaaaacagtaaattttaaaagcaataacagaaaaacaattcatcatgtacgtgaaaacacaataagaatatagcaatttcagaaagaatggagacaaaaaggccttagaatgacatactcaaagtgcaaaaataaaaaagagattgtcaactatgaattctgtcttcaatgaaactatcaaagatgaaagcaaaaatgaagacattttgaagcaacaaagtataaaatgaattccttgctagcataaatgaactataagagttgctaaagaagtcccacatgcaaatacattataacagacaattttattttttgcaacacaatttatttatttatttatttattttcccctttccccacaatttattttttaatgttttcattatttcacatagaaacttcatccctttagccaggcttggtgtctcatgcctgcagttctagcactttgggaggccaaggtgggcggatcacctgagatcaggagttcgagaccagcctgaccaatggtgaaaccccatctctaataaaaattttaaaaaaactaaccgagcatgatggtgcatacctgtaatcccagcaactcaggaggctgcagcaggagaattgcatgaaccgggaagtggacgttgcagtaagccgagatcactccactgcactctattctgggtgacagaacgagactccctctcaaaaaaaaaaaaaaaaaaagacagaaaaaagaaatttcattcattagaaagtaattcatcattcctacctcctctcacaccttagttccctcattttattgtgaaaatattcaagcatatacagaaagattgaaagaattgtacagtgaacactcatatattcatcactattctacaatattttgctgtatttgttttatcacatccatacatctatccatctctttgttatgtacttcaaagttgcagacatgagtacgtttcacttctaaaatgttaacatgcataacattaattagagtttatgtttatctttttttttttgagactgagtctcactcatgattttggctcactgcaacctctgcctcccgggttcaagtgattctcctgtctcagcctcccgagtagctgggatcacaggtgcacaccaccacactcggataattgttctatttttagtagagatggggtttcaccatgttggtcaggctggtctcaaacacctgacctcatgatctgcccacctcggcctcccaaagtgctgggattacaggcgtgagccaccatgcccggccttcttttttaattgctaaaattaaaaagaccaggtgtagtggctcacgcctgtaatcccagcactttgggaggccaaggcaggaggccacttgaacccaggaattcaagacaaacctaggcatcaaggtgagaccctgtctctacaaaaaaattttttttaaatagctagatgtcatggtgcatgcctgtggtcccaactacttggaaggctgaggctgaagcatcacttgagcccaggaggtcaaggctgcagtgacctgtgatcgtatcattgcactccagcctgagcaacagagtgacaccctgtctcataaaaaaattttttttgattacatttaaaaacctttttagaaacagggtgtcattataacagacaataatttgaattaagaggaagggatggaatgaagaaataaagagcactgaaatttgtaaatacattgggtcaatataaagcattctacatcgtcatcaacaacaaagcactaaattagtatctaatgtaagctctgttaagatggtaagctacaggtatctttaagttagaaaagaatttcttatttggaaaagaacagttacgttgtgtaacttcctttgtttaactaatttatatatgcaggttagtagtacactatatatgtatttttttaattttaaaatttatttttaagttttacttaagtttcaggatacatgtacagtacagaatgtacaggtttgttacataggtatacgtgtgtcatggtggtttgctgcgcctactgacacatcctttaagttccctcccctcaccctccatccctcaacagcccctggccctggtgtgtgttgttcccctccctgtgtccattgttctcattgctcaactcccacttaggagtgagaacatgcagtgtttggttttctgttcctgtgttagtgtgctgagaatgatggtttccggcttcatccatgtccctgcaaaggacatgatctcattcctttttatggctgcatagtattccatggtgtatatgtacaacattttctttattcagtctatcattgatgggcatttgggttggttccatcactttgctactgtaagtagtgctgcaataaacatacgtgtacatgtgtctttatagcagaatgatttatattcctttgggtatatacccagtaatgggattgctgggtcaagtggtatttcttgttctagatccttgaggaaatgccacaccatcttccacaatggttgaactaatttacattcccaccaacagtgtaaaagcattcctatttctccacagcctcaccagcatctgatgtttcttgactttttaataattgccattctgactggcatgagatagtatctcattgtggttttgatttgcatttctctaatgatcggtgatgttgagcttttttcgtatgtttgttgcccacataaacgtcttcttttgagaagtgtctgttcatatcctttgcccactttttgatggggttgtttgctttttttcttgtatatttgtttaagttcattgtaaattctggatattagacctttgtcacatgggtagattgaaaaaattttctcccaactataggttgcctgttcactctgatgatagtttctctggctgtgcagaagctctttagtataattatatcccatttgttaattttggcttttgttgcaattgcttttggtgttttcatcatgaagtctttgcccatgcctatgtcctgaagggtactgcctaggttttcttctagggtttttatgtttttgggttttacatttaagtctttaatccatcttgagttaatttttgtataaggtgtaagaaaggggtccaatttcagttttctgggtatggctagccagttttcccagcatcatttattgaataggagattctttccccattacttgtttttgtcaagtttgtcgaagatcagattgttgtacatgtatggtcttatttctgaagtctctgttctgttccattagtctatatgtccgttttggtaccagtatcatgctgttttggttactgtagctttgtagtatagtttgaagtcaggtagcgtgatgcctccagctttgttctttttgcttaggattgtcttggctatatggggtattctttgattccataagaaatttaaaatagctttttctaattctgtgaagaatgtcaatggtagtttgataggaatagcgctggatctacaaattgttttggtcagtatggccattttcacgatattgattcttcctatccataagcatggaatgtttttccatttgtttgtgttgtctcttatttccttaagcagtggtttgtagttctccttgaagaggtcctttatatcccgttagctgtattcctaggtattttcttctctttgtaacgattgtgaatgggagttaattcatgatttggctctctacttgcctgttgttgttgtaaaggaatgcttgtgatttttgcacattgattttgtaccctgagaatttgctgaagtggcttattggcttaaggagtttttgcgctgagatgatggggttttctaaatatgaaatcatgtcatctgcaaacagaaaatttgacttcctctcttcctatttgaataccctttatttctttctgttgcctgattgccctggccaaaatttctgatactatgttgaataggagttgtgagagagggcatctgtgtcttgtgcctgttttcaaagggaatgcttccagcttttgcccattcattatgatattggatgtgggtttatcataaatagctcttattattttgaggtgtgttccatcaataactagtttattgagggtttttaacatgaaggatgttgaattttatcaaaagccatttctgcatatatagagataatcatgtggtttttgtctttggttctgtttatgtgatggatttcatttattgatttgcacatgttgaaccagccttgcatcccagggacgaagccaacttgatcatggtggatacgttttttgatgtgctgctggattcggtttgccagtattttgttgaggattttgacattgatgttcatcagggatattggccttaagttttctttttttgttgttgtgtctctgcccagttttggtatcaggaagatgctgacttcataaaatgagttagagaggagtccctctttttcagtttcagaaggaatggtaccagctcctccttatacccctggtagaatttagctgtgaatccgtctggtcctgggctttttttttggttggcaggctattaattactgcctcagtttcagaacttgttattggtctattcatggtctattcatcctggtttagtcttgaaagggtgttttttaaaatatatttatatatatatatatctatttcttctagattttctagtttatttgtgtagaggtgtttatagtattctctggtggtagtttgtatttctgtgggggtcagtggtgatatcccctttgtcactttttattgtgtctatttaattcttctctcttttcttctttattagtctagctagtgatctatccatgttgttgttggtttttttttttttttcctcaaaaaagcagcacctggattcattgattttttggagggtttttcgtgtctctatctccttcaattctgctctgattttagttatttcttgtcttctactagcttttggattagtttgcttttgcctctctagctcttttaattgtgatgttagggtgtcaatttgagatctttctagctgtcttatgtgagcattaggtgttatataaatttccctcttaacactattttagccgtgtcccatagattctggtaagttttctctttgtttttattggtttcaaagaacttgatttctgccttaatttcattatttacccagaagtcattcagaggaggttgttcaatttccatgtaattgtgtggttttgagtttcttaatcctgagttcaaacttgcttgcactgagagactgtttgttatgatttcagttcttttgcatttgctgaggagtgttttacttccaattatgtggttgattttagaataagtgccatgtggcactgagaagaaagtatattctgttgatttggggtggggagttctgtagatatctattaggtccacttgatccagagctgagttcaagtcctgaatatcctttttaatttcctgttttattgatctgtctaatattgacagtggggtgttaaagtctcccactattattgtgtgggagtctaagtctcttttgtatgtctctaagaactcgttttatgaatctgcgtgctcctgtattgggtgcatatatatttagaatagttagctcttcttgctgacttgttccctttgccattatgtaatgcccttctttgtcttttttttttaatcgtagttggtttaaagtctgttttgtcagactaggattgcaaccctttctttttgttgcttgccatttgcttagtaaattttcctccatcactttattttgagcctttgtgtatctttgcatgtgagatgggtctcctgaatacagcacagcaatgggtcttgactctatccaatttgccagtctgtgtcttttaattaggtcatttagcccctttacatttaacgttagtattgttatgtgtgaatttgattctttcatcatgatgctatctggttattttgcacattagttgatgcaatttcttcatagtgtcattggtctttatattttggtgtgtttttgcagtggctggtaccagattttcttttccatattcaatgcttctttcaggagctcttgcaaggcagacctggtggtaacacaatccctcagcatttgcttgtctgtacaggattttatttctccttcacttatgaagcttagtttggctggatatgaaattctaggttgaaaatcctttcttttaagaatgttgaatattggtccccattttcttctggcttgtacagtttctgctgaaaggtctgctgttagtctgatgggcttccctgcataggtgacctggccttctctctggctacccttaatattttcttccttaatttcaaccttggagaatctgataattatgtgtcttggggttgatcttctcaaggggtatcttagtggcattctctgtatttcctgaatctgcatgttggcctgtcttgctaggttgaggaagttctcctgtatagtattctgaagtgtgttttccagcttgtttccatgctcctcatcatcttcaggtactccaatcaatcgtagtttggtcttttttacaaagtcccatatttcttggaggctttgttcattccttttcattctttttctctaatcttatctgcatgccttatgttagcaaggtggtcttcaaactctgaaatcctttcttccacttcacaaagtgtaatgctctgtgtatgcttcatgaagtactattgctatgcttttcagctccatcaggtaatttatgttcctctctaaactggttattctagttagcagctcctcaaaccttttatcaaggtttttagcttgtttgcattgggctaaaacatgctcctttagctcagcgtactttttttttttttttgacggagtcttgctctgttgccgcccaagctggagtgcagtggctcgatctcggctcactgtaagctctgccccccgggttcatgccattctcctgcctcagcctcctgagtagctgggactacaggtgcctgccaccacacccagctaatattttgtatttttagtagtgatggggtttcactgtgttagccaggatggtctcgatctcctaacttcatgatgtgcccgccttggcctccctaagtgctgggattacagcatacttttttattatccatcttctgaagcctacttctgtcaattcttccatctcatcctccgtccagttctgtacccttgctggagagatgttacaatcatttggaggagaagagacactctggccttttgagttttcaacattttttcattgattgtttctcatcttcatgagtttgtctagttttgatctctgaggatgctgacctttggatggattttttttagggacttttgtttttcttgatactgttgttgttgctttctgtttgtttatttttctttcaatggtcaggtacctcttctgtagggctgctacggtttgctcggggttcacttcaggccctattcatctggtttgctcccacacctggagatgtcactcaaggagtctggagaacaacaaagatgggtgtctgctccttcttctgggatctctgacttcaaagggcaccaacctgatgccagtaggattgctcctgtatagggtgtctaacaacccctataggagggtctcacccagttgggtggcatcgggaacaggacctatttaatgaagcactttgtcccttggtggagggggtgtgctttgctagggggaaacccacttgtctgggctgcccagattcctcagaactaccaggaggaatggttaagtctgctggtccacagagactgtggtcactcgccccctgcccaggggctcatgcccagggagatccaggttctgtcccggagcctctggctggagttattggacttcctgcagggaagaactgcccagtgaggaaggatgagtcagagtcaggcctgaagaggctctctggctgcagtctgccacagccagtgtgtcaggctttgggggatacctattgggaccaagccattcagtctcccttgaaaagcacagactgaaaagcccttgaaaagggctttttcagtctcccttgaaaagcccttcccccacccaaggaacttagtgtgttaggcagttgtgagtcccagtgctggctgctaccccttcctcagggagctcaaatggcttagacagtaagccacagctgtggggctggttgcccctcaccctgggagctcagcaggcttaagcagattccagctgagagcctgttgagaatctgcgcagctctggggttgggaccctaagctctggtggtgtgagtttgcgagtgggattttcccatccatgggttgcacagttctgtgggaaaagcatggtttccctggctaggcagcatgctcactcaccacttcccttggctggggggtgagggctcccctggctctcaggtgggctgctgcaccacactgctcttccttcctctctatggatcatgccagtcacctagtcagttctgatgagagaatctggataccttggttgccggtgaaggattcacacgcttattatggttcttttctatgggagcctctgattgccgttgtttctagtcggccatcttggccccatccaaatttttaaatttaaaatatttagatagatgactataattgtatttgtcatgtcatatatttgcgtttgtatagtcatagatatatgactatatttgtatttttcttctaattttttaaaaaatataatgttaaagcaataactattacactacactgttacatttataggatatgaatatattatatatgatatcaatgatacaagaaaatggagaggaaatacatctaaactgaaatttgccatagttttctgaaattaagtcaatgttaactggaatagattatgataaagtaaagatgcatattgtataatcactttaaaaatttcaaaaaaagctaaaaatttatgaaaaactaaaatagcatgctaaaaatatttgttgaacaaaaatgaaggcaggagagaaagaacaggggagcaaaaatgattacacttatagaaataactaaataacaaaatagaaacctttacccaacccaatgttagaaaatatttttctatgttttgttctataatttttatagctttggaatttacatttgtgtccattgttcatttgagttaatttttgtgtagggtgtgatttatgaatcaaagttaattttttgcacatagatatttgccatatcaataattacattaaatgtgaacagaataaatacatcaaaaggtaaagaatgtcagattggattttacaaagcaatatccaactatatactatctacaagagatatggatgagattcaagatacaaacaggttgaaagttaaaggatatatacaaagatgtactatgtaaagagtaaccacaagaaatatggagtgagtataatagtattacacagactctatgacaagtgacattattggagacaggaaagaatattttatataatgataaaagggccaatatagcaggaagatatagcaattattattgtgtatgtacctaacagagcctcaaaatgcatgaagcagagacggacagaaatgaaagacaataggcaattagaaataaatagaaattagaaagaagcaattaacacaattatatttaaagatttcaatactcctctctcaataagaatatagtagacttgaataagcctacagtacactcatctgaactgacattcataaaacactccacccaacaataataaaatacacatttttccaagtgcatataaatcatttaccaagatagactatattctccattactaaatgaatcacaatacattttaaggattcaagttatataaagtatgtttttggtcacaatggaattaaattcgacatcaatattagaaaaaatctctattaaatcttcaaatgtttcaaaatgaaaaaatatgattctcaacaccctgtaggtcaaagaaggaatcaaaaggaaaatttgaaaacattttgagcttaataaaaataaaaacaagtttagttgtatagatttaaatgcttatattagaaaggaataaaaattgaatgttaataatctaagtatccacctccaagaatatggaaaaaagagcatatcaataaccaagtatgtagaaggcaggaacaataaaatcagagtggaaataaaataaaaatgggaaaaaaataactagaagaacaatacagaaaactaataccatcaaaagttggttctttgaaaagatcaacaaaattggtgaacttctagccagactgatcaggaaaaaaaaaggaaagaaaaaattaccagtaactacaatgagggaggggacaccactacagaccctacagaaactgaaaggcttacaagggaatattatcaatgagtttaggctaataaattctataatacagataaaatgtacaaattcttagaaagtcaaaaattaccaaaactgactcaagaacaaatagaagaattgtatagtcctatttcagttgtatacattgtaatagttaaaatcttgctattaaaaaaagcttagattcagatgtctttaattctatcagatgtcttcatctttatttgaaatgagaccaatcctacacataattttttcaaaaatcaaaaaggagggaactcttcctacttcattttatgaggccaatattactctgatactgcaagtcaaagacctcagaaaagtccataggccaatatctctcataaagagagatgcacacacacacacacatatacataaaaaaccacttaacaaatattagcaaactgaatccaataacatatagaaacaattataaaccttgaaagagtggtttaacatttgaaaatttgttgatgtcatgcaccatattaggaaataacaaaaccaatatgattacctcaatgaattcaggacaaaatattttttcaaaattcaatacccattcaacaaattaagaatagaagagcagtttgtcactctgataagagggatttgtgaaaacaaaaattgtgagtattatctttcacttaatggtgaaagactgaactctaagatcaggatcaatacaagaatatccactatcctcatttacattcaatattatcctggaggttctagccagtgtaatactgcaggaaaaagccattaaagacatataaaatggaagagaagaagaaagcccatctttattcttagatggtataatcttatatgtaaaaaattctgaagaatctacaataaaagattacaattcattagcaagtttagcaaggttgcaggaatcaaattgaatatacaaatttttatttgatttccgtatacaagcaacaatcaatcaaaaaaatgaaattttgaaaacaattttatttatggtgatgacctgtacacagatgactaaaaaacattgctaaaagcaattcaagaagacctaaataaatgtagagttgatttgtggtttggaagacccagtattattaaggtgacagttctttagatattgatctatagattcaaggaaatctcaatgaaaatctgaagcatttttgcaaatgcaacaaatttttctagccatcatgtgtaaatgcaaatgacctggtatagccaaaatgatttttaaaaaaataacaaaactgaaggactaatattacctgatttcaacatttatcataatgataatcaaggaagtgtggcatcagcttaaagatagacaaatagacaaatgggaaataatagagtcaaaatgtaaacccacatatatctagacaaatggctttcaacaggggtacaaaaataactcagctgataataaatagcttttttcaacaacccttttatatggttggatttgcatgtttaagaaaaagaaagacaagaacttcaacccatacctcccacattatagaaaacttacttaaaataggtaatagaaataaatgtaaaaaccaaaactgtaaattttttagaagaaaatacagaataaatactttgtgactttaggttaggcataggtttttaactatgacactaaaaagtcaatcaatgaaagaaatagttaaaaatatttcttctttgaaagacactgccaggagaataaaaagacaaagcacaccatgggagaaatattttcaaattacatatatgataaaatgacttttatccagaatatataaatagctctaaacaaacaatccaatttttaaaatgagtatgattgtaatagcactccacacgaaagatatatgaattgcaaataaactcatgaaaagttgttcaacatgattagtcattaggaaaatcaaaacaaaacaaagcaaacgagggaggagccaagatggccgaataggaacagctccggtctacagctcccagcgtgagcgacgcagaagacggtgatttctgcatttccatctgaggtaccgggttcatctcactagggagtgccagagagttggcgcaggccagtgtgtgtgcgcaccgtgcgcgagcggaagcagggcgaggcattgcctcacctgggaagcgcaaggggtcagggagttccctttccgagtcaaagaaaggggtgacggacgcacctggaaaatagggtcactcccacccgaatattgcgcttttcagaccggcttaagaaacggcgcaccacgagactatatcccacacctggctcggagggtcctacacccacggaatctcgctgattgctagcacagcagtctgagatcaaactgcaaggcggcaacgaggctgggggaggggcgcccgccattgcccaggcttgcttaggtaaacaaagcagccaggaagctcaaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctatgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccacaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtcacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacaaaataaaaaatgataaaggggatatcaccaccgatcccacagaaatacaaactaccatcagagaatactacaaacacctctacacaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaaccggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcacaagcatggcacatgtatacatatgtaactaacctgcacaatgtgcacatgtaccctaaaacttagagtataataaaaaaaaaaaaaaaaaacacatgaaaaaaaaaaaacaaaacaaaacaaagcaaacatggaaatgtttgttattttaattgttatgatggtttcatggctgtttgcatgtgtcaaaactcatcaaatttgtgtacgttaaatatgtgaaacttattgtatgctggttacacctcaataaagctgttaaatttttttaaatttaaaaatattatttcaagaataaaataaccaaaccatattctgggagcaagtatttgcaaattatatatctgataaatgacttgtatcaataatacataaagaacttttacaactcacaaataagaaggcaaactaaaaatggaaaaaagatttaaatagatgattcttcaaagaagatatgtgaatgtctaacaagcagaggaaatgatcattaatcattaagaaaatgcaaattaaagccacaatgaaatactatacatccactaaaatggctataatcaaaaagattgacaaaattggtgagaatatgtggaaatcaggaaccctaatacactgctgatgggaatgtaaaatggcactttggaaactggtttgggaatttcctagaaagttaaacacatacttacctattatgacctagcaattgaactcctgggtatttacctaagaaaagtaaaaatctgtgtccacaaaaagatgtttattttattgttcatggcagcattatttagaatatctaaaaataagaaactggtgaattaataaataaaatatggtgtacccacataaatgatactactcaaaaagaaacaaactacttagccatgcaacatgggtaaactcaaaagcataatgttgaatcaattaagctagacaaaaaaggctacatattgtataattctatttatatgaaatttctagaaaaaagcaaaactatagagacaaaaactatgtcagtagttttctgggactacaagagtgagaagcagttgactacaaatgggcacaaggaaacttttttaggtgatggaagtattttagtcttaggttgtggtgatgggtgcagacctatataaatttactaaaactattgcaccctacatgtacagtgtatcagtattatggcaagtaaatcataccttaataaaactgttagctaaacaataaaaaagatatctatgctggaagtaggaacatgagactcattagcatatagatgatcattgtagctgtaaaagtagagaaaacatctagggaaagtttgttgaaagggaaaacataagaagctgggacagatccctgtggagcagcaacacttagaggatctagcaaaaatgaaaatgagtaaatgcagctacagaggtagaataaaaatgaaggaaatatagtatcacagcaagtaagtatttctaggagggggcttgtcataaagatatcaaatgcttcagataggttaaggaagaaaaagactaaaaggtgtctgatggtggtcacccaagaccttggcatgagcagtttttgaggaccaaataaggtacaagtcaatctggagtgaactgcagagtgagtgggagtaatgaatgcaaacaggagtattgggagcctggctcaagaagtttatctgaaaaaggaaggatttccttccaggtgaagctggaaatgacaggatatagaagtgcaagattttgttttaacagaagattcaacagcatgtttcagtgtggttagaaagaagtgagggagaaaaggctgaagattcagaagagggccataatgagggagcagaaaaagataggattgaaaacacaggttgaaagattaccattaaacagtaaggaataattgttccatgtagaagagtaaagaatggttttaaaataagtgaatttgtagatttcatggcatcaaggaaaggcttgtatgatggcttcttttttcttggtagaaagcaaggtttttgagagtaaaagcagaagtcataataccaaggatttgaggggaatggcactctttaaggacctagaattaggttagtgatcatgaatttataataataccagtctacccaattgtatattttttctctaggaacaagaggtggacagtttgattcactggagttagctccatcagaaagctagtagagcaagggtgtttagagtggtggtaacaaaacacttggaatgacagatcatggatggacaaaagtgaaggcattgggggctgatagacattgtcttcacttgcattcccctgaaacaaggtccgagacaatgactttaggtcaggtagttgatttgagagggagctcaggatacaggagtgacggaatggggaaaataagtcaggaaacaagggaaagataattaaagggtgcatgttttgagctacgtatcattgtgggtaactgcagctgagtcctactggaaatcctctgaggaagcctgtagaatgtgcctggaaattatccctctgtagaacagaaagctgacacattaatccactaattcctgtcaccctttgctggagaattatttctagaagcattaactacccccatttttccaggataccttgccagggctgaacaaactctctggcttcagaaaaatcccagaggcagaaaatgaaaagtaatggggaggattgggcttgaggtgaaatattgacagcatccaaaactccacaggaattttctaccaccagcttcagctaaaagctgaagtagtcctaggggcatatggtagaagatgaaattgaaccagtttacaaaagtccctatgcagtcaaagtaattgaggaaataacttaggataatagatggagttctttgattgtatggaagttattgatatcctctgagctattgatttatcatctgtaaatggggatgagattacccactttgtgtggttactgctagaattaaaagtccttattatgtaaggtgcttagcacagggcctggcatgtagtaaggtatagagaacaaaagctactatattattgctattatctattgaaagattagtaatattaataactacctgcattatggataatagactaattcaaattttatgtataatatttttgaatattatattcaagttcactacttaacttgaaccagtaagttcactacttaagaatataatatttcatatgacaagacattgcagttttgtttggaagaacattaaattctggtactttttgaaattagttttatcatagaatggctattgggaaaatcataaatgtaatctaattcccatgcattctttttcctttggttaggatttcgttgaagtttttattagactagaatgatttattttatttgtaaagaaatcaccacagatgtattgttggttttgttttcaaatcttttctgcttttcaacttattcaaacacaagaaacaatctaaatgcattctactctctacaacctctgatgtcaaataagttttctttaattctagcttaaatctttaatgctgcagttttgtttttgcttattttcttctcagtggagaaaaaaggaacagctggttactattgtcaattttctattgtttggaatttattaaatatgcaacacttgtgaatacatagatatcaatacatatttccttccagatatagaactcctattgcttttctttcaagagtgatagaattttatatgggaaagctttagagttcttctagtcccagtatatagtctgattatttaatactagttaaaatattattaattgccatctagaatttcttgtggtaaattgcctgatgtgttctttgctcaactaccaattggactattattatatttcttatgaatatattgcaacgcaacacaaaatatctttgcatattgatgttaactattaaaccactacatgatattttcccccaatttgttatttgtcttttaattcagttgatagtatttttgccttacaggttcataatattttgtcagatatatatatttttctcttatgaatttctttttttggtttcatgcttagagatgccttactcaccatgagcttttatctaagttcacctatattttcttctggtcctttaatatttttatttttaagttggttttctaatccatccagaattaacttaaatgcaggattgcacatttgttcctaataaatttcaagttgtttattacagcatattgctttgatatgttgtaggattttatatcataaatctgttacatatatattcatgctatatatcagtggttctcaatcagaggtgattttgccctctaggaacatttggcaatgtctgcagacattttttattttccaggactaggggagaggctggctactggcttttagtgagcagagagcaaggatgatactaaccatcctacaatgtacaggactgcccccacaacaaagaattgtcaattgtactgagattaagggaccttaagagatgatagatggatggatgcatagttgatagatcaatagataaatgtatagaagatagatattcattgaataccatttttctgccagttacataccaatagtaatattttccagcctatatttttattctttacctatattctattctttaccctgaagggcattttaagagacattgactcctactttatggaaatccagatacattgaattgttggatatccctggtttgagcacataataaatattgaatgagcgttttataaaaatgacaacaataaatcaaataaattttaatgaaccttatttcactacagtaacttatttttatatgttaaaaagtatgctttttaaaatccattgcggagttttgctaggaatcaattttaagcagtatgtttcttctttagtcttctgccacatctgttattctcttgctatgcagcataaatttcatcagaatattaactctgttctctatattatttttatttagttttattaccactgtcaagcttgcagatttccttgtacacacacatctctttaatatgtagagttgcttattcttaccatctatgagaatcattacttttgcataaagactatatccatttttagttacattctgggagttaatattggtatccatggaattatatgtgtcttctgtgtcaaaaatttctattcactctaataacttatcctgaacatattttgtattggtattaacactttattgtttctgatccccttattagaaagatattttcttctgtgtatttgtgagccttttaattcttattttgcttcctgtcatatttgacatcctctacaacagcaatgtccaatggatggaatttatcgtgatgatggaaatgttctgatctgcacagtctaatatagtaggcatggttgagcacttgaaatgtagctagggcaactgaactgaggaactgaattttacatttaatttaatttagttttaattttagtagccacatgtggctagtggctgctgtatcggacagcacaattctatagagtaattccttacccttccatttttagcttaaaatcctcagctttattttaacttaaacctatttttactggttgtgtttgtatgcagttttgtttgttttgtatattgtatgcgtttcttatgtcccagtgattacgttattttttacttcatttcctatgctttccatacagtaataatacatatccttaggcaattgagagtgtgcaaaggtatttctgtaatgtattatctattaatatcaggtgcttgcttttctttacttttttgcaaataaaatgataatgttcattgtaggaaaaatgaaggaagaaaaacagaaaatataaagaagagaataaggcaaagattattactactactaacttcacagacacacacagacatacgcagagggatacacttggttgagtactttctatacatattcttttatttttaaacaccttactgattgtacagctaatacgtatttatcactagaaaaaaaatttaaaaacaggagtaaagtgaaggaaaaaaatcatctgtaatcacaatgcatagattaaccacttttattactttgatttgttttctcacagtgttgtttctaagacctgtgggtagatggtgtgcaggtaggtaggtagacagctggatatgtagaaaggcattttcaaaaattgtattatactatatgcagggtgggacaatagaagtatacacttttcaggtggcaagaaaacaaaattatatgtcactatgagtatgtatcatccacagtggtattagtgaccattctgaacatttgtaactttaatagaaatatatattggttaacatttatccactgggtttgtctatttattaactgtatcttgctttttatatcatgaacatttttctctagtataaaataaaattcacaaatgtgattttaatggctacgtcataatccattcgttgtctctatatcattaactagtttcctattattggacagttaggatgcttctctttttttactactataaatagcattacactctacatttagtgcctaaaatttttcatctctgattttttcatttctgattattttatctctgattatttcattagtatacatttttagaagtgaaatcactggcccaaatgaaatgaatggatatgagatccttggtatatattgtcaatccaaatcaccttccagaaagttctttgttgcttatagaagaaaatattcttgttccatttttatggtttaatcatttttatgcagctattttttttttttttttttgagatggagttttgctctcttacccaggctggagtgcaatggcatgatcttggctcactgcaacctccgcctcccaggttcaagcaattcttctgcctcagcctcctgagtagctgggactacaggcgcgtgccaccatgcctggctaattttttttgtatttttagtagggacaggtttcaccgtgttggtcaggctggtctcgaaatcctgacctcaactgatccaccggcctcggcctcccaaagtgctaggattacaggtgtgaaccactgcacctggctgcagcttttcttcgaacttttaaacttctgtttggttttacgactcaggattgttttttaataaacgtgcctttcaagggtttagcaaagtaatcatattgttataaatacccaaccaacataactttattttttgctagcaaaggttttcagatataagatttttcattgtataaattgtttctttttagggtgaacaaggagaaaaaggagatccagctctggctggccttaatggagaaaatgtaagcctaactcttttttctgatactctgtttacattttaccactaagatatgctatttaatgctattaagatttgcctatttttggcagagccagccagccatgatccaacaaaattaagaatcatggtgttctttcacatggctcagtagaggcccagtgtttttagtttcatttcattggctttatgtattttctacctgtgcttagccttaacaggcctttctccttgacgtttcttgcttgcaaattttctagtcttttttttctgtcttttttcatcttacatatcttctgccatggcttgtgctcttatcagtggttcacttttcatctcagtccaaatctccatctagtctatagatggcgtctgtattggtaggctttcagtgatgggaagaaagggcgaagtgaagggaaactaactccgtattgctcccctccatggcaccagttccacagcctcagggataacattgcctgtgatatcctaggaccccagtcatcttctccccttcccctcaggatggttatcctcccagaattgcactccagattttaggataaaatttgaaggatggcccaaatgtgggtttcactctgaaatgtaattttatttacatttactcaccatttactatagatttgttatctttactggtaggggaagtgtccaaaatgagaattagtttttccctcggcttccttttctcacttacataaatatgttttggaaaggacctgaagggccacatgacttataaaagaataaggaaaaactgtgagactatatctagctccctaatgccctagatgtgttcagaaacccattttgtatgcaggagatcattacagcggaagagaggctgaagaccaatctttccggcctgtggagaaagtcgtgtgtgtgtgtgtgtgtgtgtgtgtgtgtgtgggtgtgtgggtgtgtgtgtgtggagtctcccaaaaaagaaagaccctagtagtaatagtagttaatgtttctatgtatgttaactaaaataatagttgtttcaccatcattcttatttctctccctttgaagtgatttttctacaccagagaataggcactagccccagtggcttgtagctatgggagtctctgcatcttctttaccacctgtaatacatcaggacactgaatgtcacacatgtttaaatagagtaactgactcacctcttactcctgtcattggaggcacgtggtgaagtgggatgagttctggagtagaaagccagggtccagtttgtcttccagttctgtcacagaagagcagatcacttctcagagtctgtaaaagtgatggacttgggatagattcttttttttttttttttgagacggagtcttgctctttcccccaggctggagtgcagtggcagtggcatgatctcggctcactgcaacctccgcctcctgggttcacgccattctcctgcctcagccttccgagtagctgggactacaggtgcccgccactaggcctagctaattttttgtatttttagtagagacggggtttcaccgtgttagccaggatggtctcgatctcctgacctcgtgatccgcccgcgtcggcctcccaaagtgctgggattacaggcgtgagccaccgtgcccggcagacttgggatagattctaaagcccctatcgctattatgtgctatgattttatgcaaagagttattaagattataaacttgaaaagtctgacgaggcctgaagcattcattcaggttcattgagtgcctgctacatgtaaggcacagtgagaaaaacaaaacaggaagagatgaagccagagcataggaagtcctggatgtgaggatgcttgtccttcctcctcaggacaaaggggagatgtggcccacactttgtttaaatgaaaattccttttacagtggattctgaaatggatagaatttgggcctttgcctgtgttttctgttctttctattacactctccgtgaaagcaaagaccatgtgttggaatcctagtacttagcacatgtttggggtaagttccaaataactatttgctgaatgttagtttgaaaaactgagcggttattaatattatgacagagtaaaatataagtaattagagtctaagctagaataacagatgtggaagggaagatacagagaatgatgctaaagaggtaaaatacatatgatttggcacttgattggagttgaaaactcaaaaatagcccaacatgttgaccgttctgtgtgagaaggatactaacttgtgagaaatgtaggagtgttcaaacagattaattacagtgttccaaaaaataaccaaactacaagtatgtgggctctctgagatagaggagcaaaacagagtgtattacaagtgcataaaagtaatattggaattgaaatagaaagaggagtttttgaaatatttgaataaaactagaaagatatttgagaggttggaacctgaaatatattcacattaatttcaagatttgaaaatttttcttacattgtctgaaagtaaggtttttgggctttttaattaatcaactgatacatgcatatatttgagggcctactatattcccaaactctctgtcagccactgtgtgagttccaaatctgagtaacactaacttactgagagatcccaaaggcctagtgagcagtgtgaatgtctatccctttgaggaatcttgaaagagtccttcacatgccccaataacaggaggtcattcctttagcaccgttattgtctgatgtagctcattaagtacaaccataaagcatgacaaagcacattaacttttctcacttggttacttagttaataagtagatgatgttattttttccccttaattttgccaaagatattcaggagttatgactaaggagaaataacaaaaagtagtaagagttctcctctttcccctctatcactagtagtaaagaatcagctgcttggttattacactgttggagatggggggagtgttaatattgtgttatagttcataaactattttcacaaggaatttgaaatttgaccctcacccagcttaattggctagtagagtggggaatgatagtattcgtattttcagaagcaagaaattaaaggcttcagaaattaagcaactttcttttttaaaatactaaaattggcctttaactctaaatatttggctgaaaagtctgatcttcccagtaaatcctgccacacatcattgcttatttttcagtgctaaaaaaactgagtctgcaaactaaagtaattcagcgtttatgacagttcactctgactttcaataagcccaggtatacattcttaggaattgaaaggtattataatggctattttgatttgaattaaagtcaagccaatgatggaaatcataacttcagaaatattgtcttagaatgtatggtaaataaactcagtgagccaggtgactccagctactttctaagtcagagtatattggaatgctttaatatttctactaaatgaattccacagcctttttaatagtctttattgctgtgtattatatatgtatcttagtgtcaatgtatcttataataacttattttgtgccagctttctcacaaaatgggccagctcactttggaaagtgtaaactttaatttaaagggtagtatgtagcaattcagtctttctcaatgtggcactcttggcattttggcaagacagttctttttcaagtcagactgtcttgcaagagcagaatgtttagcatccttgaagctcaccaacctaatctaaatgccagtagcagcccctagtcattgggacaagaaaaaatgtgctgatatttttctaagtgtatcttaactgtgtgtgtgtgtgtgtgtgtgtttgtatgtgtgtgcatgcctaaacttttgtttgatgtctgtggtattactaaacaaatgcatgctcatatgtccattctagtttaaataatgcatacaaaacatatattaaaattttcaaaaatttgaattgctagaaaatttaaccttgaaaatatatgaccttgtctttacacacaatctagtgtataattaaataattttgattgtggcctaatacaagatatatttaacaaaggtatcttagaatagacttgagagagaataatataaagttgtaattgtgatctttaaagccagactatctgggttcacatcccagctctgccactaactagctgatgtactacttggtaaattacttagcctctctgtgcctcagtttctttatttgcaccatggaatgataatttcaatatcctctctgtgcctcagtttccttatttgcaccacggaatgataatttcaatagtacttactgtaggggaaaagataattttcccttcccctctgaggggttcagtcagctgaaatgaactgacaatggacagattaacaggagaaaaggcatacaaatatattaacgtgcatacagtgggagccataaaaaatacgagactcaaagaaaggccagatggttgaagcttaaatagaaccctctttataggaaagaaggagatggggaaatgtaggcaattttgagaggtagtaaactcttttttgaattgaatgggaccaagagctaacaatagcttgtggacaagttacagaaaggtgaaggctggacctccactgtgaacaaaagttgtcttgttttgcagataaagactcccagataatctctcagagctgccctcagaagaatagaccaagagtctgtctgggcatcgtgacaacttttagtttattctcttctccagagattaattttcctggttattctgttagattcctaggaagggggttttaagacaattgctttttttggaagaagatttctcagtctgataaagaaacttccagagagagctcctccctgtacttgaggaggggttggaggaaaaacaagagaaggttagaaagttcttggatctgaggcagcttctaaggcttttcaattccttttaattcaaaagtactcagcatgccaaagcaccacactttggggttatcactctctgtaccccaaaattacctcatggatttttttgtgaagattaaagggactatcatacagaaagcctttagaacagtgtccaacatagggcaagaactatataaacattcactattattagaaaccaagttaaataaaacacatttagctctaataggtacatgtttttatttatttgtttctgtggggttatacaatcttagaaaagtagacttaattgttgagttgtctctttttctgaatctatattatggtcttttaagtatcccttattagaattacagcatctgatgtttctaaaataatcatgttaatctccttataccaatgcaatctgtactagaggatacaaaaatattgaaatcacaaaaccagagataacagctggcaacagctgttgacattgctagggaataacattaagtcattgaaagcttgtgaaaagaattaattgatgggttaaaaatttttaacaaataatatttttatattatcttctgaattttaaagatatgatatcccatgagtagtactaggtactccaacaaaaattgattttatagtctacccgcttttataattctagttataatactgctcttcagcttttgtcttgcctttagataacggtttctgcctccacattacatgtagaatcaactactgtgcttttgggaatctttatgtacatgaatttgattgaaaaccttcataacagataccgatcttactcaatatttaattcagagtctattccatttggctctttatgcctatggtgagtgctgtgtcctttctccctagcactcaataaccattgataggagcaccagtgtgacacaaggagaaaaaccgcatttgagaaaagcattactgatgtgtttctcagaggctattacaatgccatggccttaacaacattgtactttgtcacaggaagacgtgagttacatgggcctactttaatggtcataaaagtagaagcttgacaaatgcagtacttctcaattgcattttatcctatgtgagttaaagcacagttgttacatatccatcaaactggtataaagctgaacaagaaagaactatcagttatcccttaaacttgaacttgaaaagtaaaaacaacatttattaagtgcctaccgtatgctaaatgtctctacaacatatgattctcagaacaacccttcaagaaaactattacttattatacctattttataggaaagcttacccaacttacccatgattatacataaaaggccattcgtcttctgactctgctgaaatccacatctgtgaagtcttggacaccccagtagaattaggcatctgtgggaaatgcttttgtcatacctgctatatacttcaatgataatactcaatattcacatcagcttgtaattggctacatcatcccttcccctcctccctgcccatagttgactgaaccagggagagttacctgattcaactgccaatacattgcttccctagaaattacaactgggattaatttgttggaattaatctttaaaacttttaatgtattattttatacctacaaaataatatatataacatatatgatggttataaatcatagttataatgaggaccccagtgtacccagaactcaatgtgagaactaagacgtcatcctccacttggaatctccctgtgtggttcactatatactgtcctccactccagagttaaccatttttctaaatgctgtacctaatgtttccttccatgcttaaaaattatgtttcacacttacacatttataaggagtatataatttagtcttacatgtttgcagacgttcaataatatttgttgagtaaatggatactcaaggtttttatcagtcatttctttttttgtgtttgtcttttctctgcatagttttacacaagcaaaaagagaaaacctttttttaataaatttctctgctcagtgaatgggataacttcctagccagttacttaagtcaaatgcaactcagcctggagactttccttcttcttctccacttctggcatatctgccagtcttgcttccagcatgtgccaactctgaccacttctcatcatctccactggcacaagcctgtcccagccatcctgctctctttcctggaaaagctgtcatagccccttttatgctcccactcttgctgcccataatttgtgttccacgttgctgccaaagtggtttgtggggatttttgtaaacatattcacatcatgtcattttcctgcttaaaacacttaagtggcttcccattgcatgtagaacaaaacccatcttcctcatcatggcctgcaattacttatgtaccatgacccctggcaaaccttgacttaaccccctactccttacctgtgtgctcatgacactccttttatcttagtgacctctgtgcttctttttccctctgcccccacacagatcattgcgtggctggatccttttttttttaatttgagcaaattcatgaggtacatgagaatttttttacacatgtataatacatagtgatcaaatcaggatgtttaggttgtccattttccaagtgcaatacattttttaaaagtatgcttatcctactctgctatcaaacattgaatttattccttctaccttactgtatgcttgtatctttttatccacttcttttcatcctcccttgccccctcactcaccctttccagtctttgttatctatttttacactttctacctccatgtgttcaaattttttttgctcccacatgtaagaaagaacatggaatatttgtctttttgtgcctggcttacttcacttaatataatgactttcagttccatccatgttgctgcaaatgacaggattttgttttcttatggcttaatagtactccgttgtgtatatataacaccttttctttatccattcatctgttgatggacacagaatgattccatatctttgctaggatccttctgaaacaacaaatgtcaccaccacacaaggaccatttctgacaccccccttgaagtagcaactctctcctctttcacttttatcacattcagcctgttgacctgtttattgtcagccactcacctcttattacatgagttccttgaggacgggaaccttcacctagttaaagaaaaaaatcgttgacacttgtttttaaaaagcgataaggaagacattttattccagactattgcaataggggaattgcaataagggagacagatcaggttcaactctaactacaacaaggacaggtggggatttatagccaatgagtagagggagggatgtcactggatagaaaattactaagaggagacatcaagggtagggtgattcttaccaaactgatctaagaagattcttgctgaagacaggccaaagacttagacatcaagttagaggatgaagaacttgatcttctcaaaagtaaggaatggagaagagattttaagggtgagagattctctctaaacatacttagcaagattcttgctataactgagctgggaagaccaaagacaggatgggggccatggtccaggtctagctgagaagagggctcagagaaccatgactaaaagtttggtgatggagagaatcttcattaatttcttgttcttttctgtatctctaaagtcgtactaatcaatagaaatataataagagctacaaattcaagatgaaggcaaatatattatttttttctagtaaccaaattaagcaaaataaaagggaacaggagaaaatacttttaataatatgttttatttaatgcaatatatccaactgttatcatttaagcatataataatttaaaaattattagtgagatattttacatttttttcttatactaaatattgtaaatctaacagtgttttatattcataatacacctcaattcagagtagtcacatttcaagagttcgaaagctacatgtggctgtggctaccagtacaggtctaaaggccagaagcaacttcacacaaggtatataataaatgtttattgaataaataagtgaaagaacaaatgaattaataataaatctattcacagaaatggcaaatttcttccttcaagtgtttacaatattctgtttccaagttctactctggaaacatgtataaatagagtatgcgttccttgatttgggaagaaatggatattgtaaataataagacaatactgtatcacatctcaaatatcatttaatttttcactcatcctttttctataaatattccaaggtaatgatggaaaaaataataactatgagttttatacgtgaaggcatttatgcaactagaagttttttttgccaattaggtattgttttcatccattaaaaatgtttttcttaaagtataatactacaattttcacacactgtctgcaacaggattattttaagtatctaattttcttttgtttctttcacttcatcactggtgtctatgttgagtacaggtgatggcatttggcattatttattcactacaaaatgtcagggcagtaatagccgggtctttcagctaggaacagtaagacacttagacttgctgtgcattgtgtggcttcagaatacttctttcttctattattgttcttccttcatccagtgtgttaaactaaggaaaaaagaagttttttttttctatttaccacgtagtcaggatgtgtctatctaactttctacgtacactgtgaattcatgcagctgtagagctgatctcctctggtacaatctattgtggaagtctcaaaagctgtcattgcttagtcagatcaactaaatacccattaaaacatccaacagtccagaggacttatgaaaatatttatctgttattctgtatatgtcatatatagtttcatttgacatctttataaatccaagtaaaaaggaattagagaactaaaatatactttaaaacaggcaagagattacattttagctccagttgtatgatagcaaaagaatacatctttcattccttttcccctcacaattagatttcttgatagagacataaaaatgtttttgattttactcttgaatttttttggcaagcttaacaaaggccaaatcaatgctaaatcagaggtatttacaacatccacaaatttaatccaaagtggatacttaaaagctcatatagatctaaatgatattctcccagatggtgaattaatgtaattttagcaggaagcaaagttgcacaaatatgcagtattgaggactcgcgctgatttaatgtatctgtgcccaccacggcacagatgttgcttatcattttagtgccagttgtctctatttctctctatactacaaaaggaagaatgagatttggaggttcagtaaattatgatttattttgttactaatgacttgttagaaattaaagctttctgtgaactgtgtattggttatattctttctacagggtttgaaaggtgacttgggtcctcatggtccacctggcccaaaaggagaaaaggtattgtgtttacccagccaagcccaacctttctttaagaaaactctgacaacctatgcagtgacttctcattgatactgtttatctcctaaaagcattctaaaattaaccaaaagctgttaccttaatagcatctgaataagaacagcctttttgttcatttaattagtttgaaaagactaaatgcacaattgctagttgacattagctggtatttataagatttcccttttctcacccttgcttaacagcatgaggtattcaatcatcaaattagcaagtgtgacctgtattggaaaactttgccaataacactgagctgctgccataatggtgaggcaagtggcttttggaaagaagctagttttgtatctcagtcttaatttaactattccattttctgccactttttctcataaaataagttatttcataatgacatgttggcaatgatcttgaaaaggaaattaagaaataggaaaaagcaagggttgttttgaataaagtagttgggtgatcccagtttgatgaaaattgtatgtatatgtgttttgcaatgcattttgttctccatttttagcacatttagaaatccttgtctatcttcaatatttatctctgtgttaaaggtgatcctgcaaatgagttcccagtgactgatttaagccacttcagtgttcccttagcaactgttggctattttaattcaattgttccaaaaaacaatgaatacacaatgctaagttttaacttctgaggtggctatattggttgagaaaagagaaagtcctaaagatactcattgtgagactacagcatcctggtaccccacgctatacagtacagggcttccataatgtgcagctaaataagaaccgtggaaaggatgcgtggtctttaatgtttgagagttcttaagaaataaataaagttcctgggaaagtaaacatgaaggtgacatagaaattggaaaatagtgaacttttagatgaaccattttttaaagatgttgaatagtttgttgatatatccacctggaaatttgtattcacatagatcagcaaagcaattttagcgttcagaaatacataaatataggcaaagcctcttacagttgatggcaaatgcaatgccaattcagcagagctttagaagaggccatgggactgcttcttgcagctgggaagcatgaaatggggagatccacttattatttctgctgatcttcatactaactttgtcagacaaattatctatcgccgtgacacttcccagctgcttcattggcaagtaaacatacttgaaaatatattatttctaattttggattagtagacaaaagaatagaaaattagattattttcgctttcaaaacaagtcctgctgttgcaaaaagcatagagtatacaaggtgatttttatatcatgaaagctaaaagggacatgatatattttctttatgcagagacttttatcaggatgaagttctatttttctattcttcaagatttatctctatatattgcttctatccacctagaaatttataaataatgtgcaaaaagggactagtggtaattgtagcttttctttaatctattttagggagatacaggacccccaggaccaccagccttacctgtaagtattcttgaaatcaaaattcaaaattgaaatccattattctgtttattatccatattacatcatgactaaaccagaatttaagtcacagagttaagaattgaaggtgacttcgagtacatgtagtcaaacctccacattttaaagatggggcatctgcccacaacagtgaaatatctgacccaaggtcatacaggtagttacaattaaagtctggaatcagtacctaccctgagcaatttcctctatcctccatatggctcataattttgtctcctaaatgtttgattatgcactcttaacatcaggtttaatgtaaatggaatcagatacagtcctacttgctttaaaaactgtaaaaggacaaaacaaactctaatcacccagtgaataaaaacagctacctatttaaactggtaattacattctcccaacactttccaaaatcattgttattttcctctatgatttgattctaaaatttgcagatgataaaattgcaatattttagtgacagatttatgagaaaagtttatagtgtgcacataatgagattgttctcaatcaaatggtacatcatgtattaagcactttataataaatatatgattctcttatattcagatacaatttactattacagacttttttcataggtgattaaagattcttatttaacttaaataagactctaagcctaatggaaaagaggacagttttgttttgttttttttaaaaaagatcttctatagcctgaagtcttttgaattttatgttgatgttacctagtgagataaattaagcatttaaatcagtagtattcgaagacctattctgattatagaaggtcagatttttaaaagtattctagtaatctgaatggagcccttcccataggtagaacataggaatctcaaaaactgtgtgattttgataatatttatatttatctttgtacttaaaaatcccattatgaaaaatacattaataatgtcttacacaaataattgttacaactcccacataaacaaatgttttttgatatgtggaaaacctaaggaactaaatagataacttacttggggataactcattcaatttgcagtggaagtttatgctttaagcttttattttaagcatgaaaagaaagactatttttttgagaggaggttttaagtgcatattattcagttttttatactttgtagaattttattttattttattttttgagacagagtcttgctctgtcacccaggctggagtacagtggcacgatctcggctcactgcaacctccgcctcccgggttcaagcgattctcctgcctcagcctcctgagtagctgggactacaggcacctgccaccatgcccggctaatttttgtatgtttagtagagacaggttttcaccatattgatcaggctggtctggaactcctgacctcaggtgatccgcccacttcggcctcccaaagtgctgggattacaggcttgagccactgtgcccagccttacactttgtagaattaaaaaaaaaaaattatttagcagtgatttagttaaacctgctctttttacttaggacagatgcctgtttctctttaactaagttacatgcagtcatttagttaaacctgctcattttatgtaagacacatgcctgtttttcttcaactaagttatatattcaactactcagttatctgatttcattgtcattttcaactcatgttggaagactgatatgcaatctacatatattatttcgcctgaaatacaattttggcttctcaatcagaaaattgtattggattacatatattttgtggatgtttaatagcagctagcttctttctgccaaggaacaccttgaagatacctctctgcaccaattcatctgtcaagcacttagagattacaagctaatttcatacttgtctaaaaatacgacaaggaaaaaacactatgaaatgaaatgttttatttcataaagtaaaatattcatattattggggtattactattttgtatgcttgacattactttctttattaatataaattatcaactcttccctacaaaatagggataaactaaaatgaataccaacttacaatacactaaatatttaattgatcttataatacaggttggtacattattagttgaaataatttataatagtctttgaggaagcccaaatgactaactgcgttatatttggattaaatgaggcagtgatatattggagtcaataaacagagttcatccataattgttctcaaaactagctccacgctaaaatctactgaagagttaaaaaacttaaccaatattggggctccacccccagaaattccaattcaatcaacctgatgtgggaccagtatattttaaaagctccccgagtggatctaaatatgcagcaagagttgagaaccattatttatgggaactagaatggaaaaagctttcttcctactcaaaaaaattatatcagattgttgaagaagtccaacttccatttgaaatccaacttaatacatagcgataaagaactatctctttccgttagggaggcatactagtaaaatgaagttaagattgaaccctgcttcattaaatggagagaattagggctaggaagatacctttaattacaaccttcatctaaatgtccatgtactcctgtggcttgggtgcctttcatgcttcttaaaatttaatgtatgtaggaacactcagggtcttgttcaaatgcatatttttattcctaagtctgaggtgagatctgagcttctacatttctagcaagccccaagggagtcagatactactggttgttgcactacactggtcacaaaggcttagcaccctcttcccagttagctgccttttcccatagatcaatggttctctgtcgcatcctggccaacatggtgaaaccctgtctctactaaaaattagctgggcatggtggtgtgtgcctgtagtctcagctacttgggaggctgagtcaggggaattgctcgaacccgggaggcggttgcagtgagccgagatcgcgccactgcactccagcccagctggagacagagcaagactccgtctgaaaaaaaaaaaaagattaatggttctctatcttgactgcacattggaattacccaaggtgctttaaaaattctaattcccagactgtaccacataccaataaagccagaatctccagggagggactcaggcaacagttgtttgagatttttcccaagcagttctaatgtgcaggcacgctcgagaactaaggctctgaaagcatgtctaatacttttctttacagctttctcttacagatcttgagcaaacattttggaattactcattacactagtatttatatcaaaaacacccaacctgattactttcaggagcttccaggagaggccagccttcctagtcatacctacaatttgcttcctgattacttcattatagaggatagatgaacgtccatctccacatttacaagctactagcaagtccaacagtaatccttcttgagaaggacaacaagcattgacaacttcaggacacagaattccagaaattctcaaagcacacacagctgaactgcccagaataactaagggcgaagagctgaacactttttccccctctaagccatacattctatatttgctttacttttattcatattttgtttaataagaaattaagagaaatagtaattgagcacactgtaatactgagtttactgatgcaggggcaatcctttatgatgtttttggggaagtattgtttttttttttttttcttttgagacagggtctcactctgttgcccaggctgaagtgcagtagccccatcacagctcactgcagccttgacctcatgggcttacgtgatccacccacttcagcctcccaagtagcagggactacagacggttggcactatgcccagctaattttttttttttttttaacaaagacaaagtcttgctatgttgcctaggctggtcttaaactcctgagctcaagtgatcctcctcccttggcctcccaaagtgttggaattataggcaggaaccactgagtccagctgggattatgtttattgctgttatttttgtgtccctgtggattcttgtgcttttggtacttaaattttttttaatcacatagaaccagttcatcaaaaaaaatctgatatgtaaaaccatctatttcattaaatgttacttttgttgcttatttatactttcttttataactcgttgagtctgtatataattgggtctcagtggaagagagagaataaagaagtgagggtgaccaagtttaaaaaggagtaggaaaggtaaaattgaggaaatggcgtgaaacacagactggagtcctagaaacagtttgatttgctaggttcagctacaatagcttttaccctttatttcacctctcccttcctatcacctgaaagtattcttactgccagtgaccagtgcttcctcactctctaatatataagaaacctattaataagaaagccaaccaaaatggtgctgcagtttcaaatgcagtttgcaatatacccctttattatttcaggaaatgggaccccattcaaaattccacagttgaatccctttgataacgtttgaatccttctatagattcatgttcacgggtcatatggaaaatactccaatgtgactgccttggagaaaagaaaaggaaaaaaaataataagagaaatctgaggcctgtaaaaatgtcatggagattaaagtgatatttatggcattaattgtcacttacatcctttaacctttaaatattctgtcaatctacttgacttgataaaaatagaattatactttttgatatgacgttaataaacttgcaaatcttattttgtagactttccagattattctaacaataaaagatattgaaattcaagaacaaatttgtgaatctgtaagtggaacatctggaaactattttgtaaaacagtgtccaagaggcttcccttaatactttttttaaacaaaatttcatatagagatacggaaaaaaagaaatgaaacactttcagcccagaaggtgggaatgtggttgaattacacacacaaaaaagaaagactaaaaatccatggttgccaccataaacccaccttcatgtatctcttgctaggaatattttcagcaaatacagctagttgaaaataaaaaatttaatgaaatatctgatttcttttcagccactttttggaagataccaaattcactaattagtttggtactaacaactattttgttaacacaataagccattatagaaacttataataattttaaagttctaaagaaataaatatgagattcttcaacttgatttaaattaattaactgattattccacccttatcctttttatatttcaaactgataaccattttaaaaatagcacatcttgttagattttaagtaataataatataaataataaatggtagacatttattcagtgctatgtattgtttaaaccaaaccttaaacaaccctgtgaggtataaaatgattattactacatcgtacataagggaactgaggatgggaatatctaagtaaattgtccaaggttcacagatgttacataacagagctaatattcaactgcccatttggctgactcttaaaacctaagctattaaattctgcaagcattatttaaatctagtttaaaaaattataaaaaaaacagaaatgttctaaactattgcaaaaattaaaatttttaaatcaggtcaggcatggtggctcatacctctaatcccagcactttgggaggccaaggcaggcagatcacttgaggtgaggagtttgagaccagcctggtcaacatggcaaaacctcatctctactacaaataaaaaaataaaagtaaaaaaaaaatagccggatttggtgatggatgcctgtaatcccagctactcagggaggctaagtgggagaattgcctaaacccaggaggaggttgcagtgagctgagattgcaccgctgcactccagcctaggtgacatagcaagactctgtctcaaataaaataaaataaaataaaattttatcttgaagccaaaattcagaaaaattcaagtgcctagcagagatggggtggaaatgtaaatgtgcgatgcagcccagtgtaagataatagagtgtgcttggggttagggaccaggatagctatgtttatctcaaagtatcaaattcgaattaaaaactacttagagattgcctaatgcagaatataggcatactttggagatattacaggttcggttccgtaccactgcaataaagcaagtcaccaattttttttgcttttccaatgtatataaaagttatgtttatattataccatgtcctataaaatgtgcaatttatattatgcaaaaacaattttacacattttaattaaaaaatactttattgctaaaaaatgctaatgatcatctgagccttcagtgagttgtaatctttttgctgtggagggtcttgcctccatattgatggctgctatctgatcagggtggtggttattgaaggttggggtggctgtggtaatttcctaaaataagacaaaaatgaagtttgccaccttaattgacttttcctttcatgaaagatttctctgtagcatgtgatgctgtttagtagcattttacccacagaacttcttttgaaattggagtcaatcctctcaaatgctgctgttactttatcaactaaatatatataatatttcaaatcttccttgtcatttcaacaatgtttgcagcattttcaccaggagtagatttcatctcagaaaaacattttctttgttcacccataagaagcaactcctcacttattcaagcttaccatgagagtgcagcaattcagccacatcttcaggcttcacttctaattctagttctcttgctatttctaccacatctgcagttacttcctccaattacatcttaaacccctcagagtcatccgtggggtttggaatcaacctcttccaaattcctgttaatgttgagattttgacctcctctgtgaatcacaaatgcctttaatggcatgtagaatgttgtttttcaatttattttgcccaggttcatcagaggaagcactatctatgcagctatagccttacaaaatgtatttcttcttcttttttttttttttttgagaaggagtctcgctctgtcgcccagactggagtgaagtggcgcgatctcggctcactgcaagctccgcctctcgggttcacgccattctcctgcctcagcctctggagtagctgggactacaggcgcccaccactatgcctggctaatttttttgtacttttagtagagacagggtttcaccatgttagccaggatggtctcgatctcctgacctcgtgatctgcccgtctcggcctcccaaagtgctgggattacaggcgtgagccaccgcgcccggccacaaaatgtatttcttaaataataagtcttgaaagtcaaaattactccttcacccatgggctgaagaatggatattgtgttagcaggcatgaaaacgacattcgtctccttgtacatcaccatcagagcccttgggttaccagatgcgttgtcaatgagcaggaatattttgaaagaaatatttttttctaagcagtggtatcaacagtgggcttcttcagtaaaccatgctataagcagatgtgctgtcatccaggctttgtcattccgcttatagagcacaggcagggtaaatgtagcataactcttaagggccctaggattttcagaatgaggattggctttaccttaaagtcacaaactgtattatcccctaactagagagttagtctttcctgtgaagctttgaagtcaggcattgacttttcctctccagctatgaaagtcttagatggcatcttaactgctttgttgacattgaaaactcgttgcgtggtgtggttaccttcattgaagatcttggataacttgctgcagcttctagatcagcacttaatgcttcactttgtacttttatattctggagacggcttctttccttaaacatcatgaaccaacttctgctagcttcaaacttttcttctgcagcttcctcacctctctcagccttcacagaattaagaggcaagggcttgctctggattaggctttgatttaagggaatgttgtggtttaagggaatttgtggctatttgggtcttttatccagatctttaagtctttcttcatatcagcaatatggctgttttgctttcttatcatttgtgtattcactatagtagcacatttaatttccttcaagaagtttttctttgcattcacaagttggttgtttgtctggagggacctggcttttgcattcacaactcggctgtttggctggagggacctagcttttggtgtatctcagctttcagtacactttcctcactaagtttaatcatttttagcttttaattgaaaatgagagatgcgcaactcttcctttcattcgaacacttgaggccattgtatggttattaattgacctaatttcaatattgttgttccttaggaaatagggttgcccaagtagagggagagagacagagaaatggctagtcagtggagcagtcagaacatacattctctctctcttccctttctgaaatgccagtggcagatatgttagatttttgataatgtccctcttgtccataaaactctgttcatttttttcccatctaattccatcttcttgggaatggatcatttccaataagcccttatcaatcttactcttgctttgttaatttccattctgctgttaagactatcatgtgaattttttagtatagatactatatttttaagctagtgaagtttattttatattaaatagtgtctatttctctgctgttatttcctatcttttcattcattatgagcatgttttccttcctgtccttgggaatacttttaatagctactttaaaatctttccaggcacggtggctcacacctgtaatcccagcactttaggaggccgaggtgggcggatcacctgaggttgggagtttgagaccagcctgaccaaaatggagaaatgccatctcaactaaaaatagaaaaattagccaggcatggtggtgcatgcctgtaaccctagctacttgggaggctgaggcaggagaatcacttgaaactgggaggtggaggttgtggtgagccaaaacataccatggcactccagcctgggcaacaagagcgagactctgtctcaaaaaaaaaaaaaaaaaaaaaaactttctccgatcattctgtcatctgagtaatatcaagtagttctttgttgattgtcttttctccttagaatgggttatgttttggtgcttacttgtatggcaagtaattttttattgtattttggatactatgaatggtaagttacaggaactctgaattccattttttctgaagagctttaatatatttttaaggcaggcagttaaattggcttgactcgcatagcaaactctgtttctcctacagctggcaacagctgaaatccgttttgttcttttaagctaagctgagctacttgcagtttgcactgtgtatgtttggttaggagtcagccagagatttggggagagcttatacgcagaattttggacttccttacttatttcaggatttgacaaaccaaccccactttactttacaggaattgcatttgccctaaactctgtcctcagatttttcaatccagcaagtctgtaggctttctatttagctaacccatgacccagacttgagcctgtcctcagactaaacatcttaaaaacagaaaactgactccatgctgtttaatttttccaaatgttgactcccctccagtatctgcctgcttttgatgagtttccagtgtcttcaggtagttgttctacatgttgttcagtatttatagttgctatctgtgagcatgttgatttaatataactactgggccatcctggaagcccatttttgtaatacaatgctgagtaacttataatttacttagatatcttgctcctgtaaacataagtgagttagccttcacatttctttacttattctattgaccttgccttcaaaaaatatctagaatctgaccaattctcacacctctgctattactacttggtcctagttaccattataaatctcttgattttttcagtagccaattaatggtctccctccttctccccttgctcttcttgcgtgatttacacaagaagccagaatgttccttgtcactcttcttttcggaatctccagtgtttccccaggtaattaaataaaacccaaattccatacaatggcctacaaagtcttacaggattcaactctcattgcatttctgacttcatctcattttcttctctttctttctgattttactccacaacaaagtaatttttccagaaaattatccaatattcaatttttttttaatgcagagtgctggccaattagaataaatggattgttctgattcagtgcactggtgctgtttgtattttcaggcttacagtgaagaatgaatgactattaagttttaattcctgtgatttgtctaatgattatgatacaaagtttaaattaaaatgtctttaatctatagttgtagattttaccatgtcttgccttattcattttttcatttctcagcaacttgttaaactcatagatggtaaaatttagcattctaatcataaaaatgtgaaataacttgctataaatttgagacttatggtttcaacagcacaaatgaagccaaatacagtcaaataatgcagtgattcagctgaaattctctaagcaactgggttattaacaacaaagaaaaattcccttataaatatgtttttcatatatatgtaccaactttttgaaattccacgttttaaaaatatcaccaaatcacattttttcaaaaggtatttgggttctaccacatctggaatggccatattgctaatatcattgtcacgtattgagttgcagtaatgatggattagaaaaggcacttttgaataacctgttaaagaataaaaattccttttctaaattatttaaaataaatatgttaacaaaactatattcagaatcagcattttttaagatactgtattctgattgtgagaaaactaaatacttaatgtcaagatgacacttaaccagtgagttactgataaacttaaattatctcttctgttgatatttgtaatttacaaggcagatatacgtgagctaaaaccaatgctgaataagaaaaatgtgtttatcataataagtatacacatttatttgatcaaatataatgtatccaaggtcataatgaaaatctgataaattattctgaaatatgaagatgttgacataaaaatcctctattaaaggtaaatatttcatggtttaatcatgttatttgaaaaattgcattttatattagcttttcctctcgtgttgaaatattagttgtaaatcattacattcaaatattcaagtacgataagcacaaattctttggttatatgtcatctgttgttaaaaccttaattttatataaatgtagtgtgtctttatatgtaacttcacaaattgtgtatgttctataaccttcctattacatactattgccagattctcctcaattaaataatataatcctgtttttacagtaaagttttactgaaatacattactaaggcttcagaagcaagacagggactatgagtgaaatgagacagttggctaacatctctatctccttttctcttccagtctttgcatgtcatgtcagaggagagacaggtgaaggaaggtagaacagtgctatttcatgtaatatatccactaattttagttcctaggaaaatggctgtgttgctctggccatgtctctttgggaagttattaaatactcatccagatggcaccaaatgtttatgcagaagccaaaggttaagtctgtcaacagcagaagtgccttagacatgcttactaaatgatacttaaataccagttccttggagcccacataaatccagcttcagtgagaaattacgcacagagagggtgcatagcttttactctaagaaaactaccttaaataccataagcaacggagagaaaatctcagctggtcatttataaatcaaatgacattcaattagcagatgcccctaatgcacaagagatcatatagtgttcacataagggaatttttgaaataattatttttctaagttggtatgtacaagaaacaaaaataactgctcagtaagtgatatggtccctttcctcccttcctcttttacccactcatttagttgaatgcttactgtgtgccagatactgtgttaagccctgcagacacagtaacaaacaacaatcattgtcgttgccttcagaaaacctacgtggtttaagaaaaagcaaccaattggttaaagttgatcatttttaaaatgatcgtttgtgaattgtgtataaaaagtttacaagtatttgtacaactgtagttgttcatattatacacagacatctagttatttcagagaaaattattttttaccagaattcttatgttgtaatttaaagttatttacttttggtttgttaaaatcagttaattggaattaatataattctaatcctttttagagaccaatcgttttttagttccatttaatatatcaatataaggcattaccacaaagatttttaaatgcttagaatagaattgaattaaactaattttaatgtagatttatgactgaaataaatacgtgctttgctgcatataatttttcaaaggcttacccattttataattttctgatggcatttagaaaggttcttgttgtatgcccaaagagcgtaattcctctttccattctgactagaattaatatgttctgtagcatatatgtattataaatatttatatgtacatataaatgtatatattatagcatagtaattaacaggctattcaatttaagattattttaaattcctcacatatcaaaatctgagttatttagacactttatgagttgcctaaatttgaatcaacactattagttttctaaagttgcgtaatttgtatttaattcattgttagttttctgaaactagtaatccaacttagtattgggatttctgaggtcctaatctgccagtagaaagaaggcagttgaaatattttaaaaaatcaatccttttttttatttgtgggcaaaagacatgtaagtgaattagttgattaaaatataaggtatttttctacaatacaaagctatttttatctattctgtgaagaaatactggcgagttgatgcttaaagccctggaaatatttatgttttagcctcagggaagatttatgttttggaaaaacttacagttggctcgttcgacatggaggtgatttatatctctttcgttagatgattaatttgagaataactccttctgcccttttgtttatagtttgcttctgtttcaaaaggcattttaaattgttttcatcaaaagtccaaattatgcattttaaacctcaatcagtaaaactttctttcctaaaagtgctatgcattgacaatttgtgacttttacaaaagagttattttatttcatgttgaaatactcagcaatctagaaaaataaattaaaatgtattttaaatgccattagaaaattataagatgggtaagccttttgaaaaattatatgcagcaaagcacgtatttatttcagccataaatctacattaaaatcagtttaattcaattctattctaagcatttaaaaatctttgtggtaatgccttatattgatatattaaatggaactaaaaaatgattggtctctaaaaaggattcgaattatattaattccaattaactgattttaacaaaccaaaaacccatgcagcttagctcaggaattatacagatcaagggaccaggctacctgagtttgaacctaaccatgtttcttgacctttctgtgtcatctataaaatgtgatactaatatttcctattgtatagtgttgtagtgatgattaagtgagttaatatatgtaaagattttagaacaatgcctggcttctagtaaatactatttaactcttagctattgatgttattgttagttaatatgctaaatgtgaatggcaaaaatatcaatagcaatgagcctaaagttctttatgaaataattgctgacaaatgtttatagagaacttttataaaatcacaggatttttatgggtagaattccttcatcttaagaaaactattaactataaactgaattctaagtattccttttataaccagtgtaaacttcatgagaataagaaccttgtctatcttatttacaactgtatccccagagactaaaagtatttgatgtagtataggtactcaataaatatttcttcttcataggtagaggaaacaaatattttttactgacaaacaaattattaaagtaaaatatcacccaatcctacagtgaaaatatctacagaaaactataacatcacttacttggatatcataatgaggaggagattccctctttccagctaccaaacctaattaatttaggacaggtggtcaccttctcccatattaaaaattttcagcaataacaatattaatgtcacttactacccctgattatttttgatcaatttgaaagtcacgctttttgtgagaaacaggaattatctctttaagactcctattatctgttcattattctgcagacatgaacaaaagctttatatagcttaatccattactaaagtcatattttgcaaaatagagaaacactggatgtaaggccaggaaaccagattctatccttaaatatgaactattttgatttatttagttattttagcttgggcatatcacttagtaatatgtaagggtcaaacaggatgttgttaaggtcattttcaactctaaaattctgttattttctcttttacctttcctaaggaattcaatttcctttagctgtataccatctaatatctatctccttaataatattgttcttttccttaaatcccctctattttatcacattattttaaaaggatagagaataaatgtaaggaatatttaagtcagacacatgcccaatatagagaaaggattagacttaccagtgtcaagaactgtaaaagatatgagattttacccaacttgaataataacaacttagcctgccacagtttcatcaatcctggcagaagacatgaaacttctgagtcagagaaaaaggcattattactcatggcagcaagcagcatgagccttatgtttgttttggttgcccttgcccccaggtaccagaaacaacccaggtaggtgccacatattcagtgggtttgcatcacagcaaagtagggaaggcaaatttttaaaaaatggattgcaggcaaacttgccctttgccaaaagggagactttatctttaacattctaaacagtaagcaaatctatccttgctttgcggcataaacatcctttaaaagatagcccagaacaaaagggtggttagtacctccctcgtaagacatgcagaagcacaaaagcctcatggaaagacccattgtctctcaacaataccatttttcatttctatactgtcttggtgtctggcaaattttttatgagtataccactccattaacagctctgattaatattatcaatagagactgtgaccaaaactattcaatttgtctcatatagcatttaattaaaggctactgttaatagaacgccaagcaagtagatgaggccagcctgcactattgatctcaaccctgtcccccaggattgcaaactcaaacagccgaatagatcccataaatcatccaagtctatcttagaaagccagatgatttgctccctacgtttctgaattggcctttctgcttgatttgaggcattaattcaggaacatcaacaaagacaaggacattttttagaaaactgcaacagactcagtgtgtctccgactttggcccaagtgggcaaccataaggatactgagctaacagtgtactaaaccaagtagtctttatctttttttatttaggaccatgtcaaggaataagaatatccagctggcagagccagaattaagtttgaatcctctagattcccttttggctaggtttctaccctacaggtgtaaagatagttcagaacctagagcagttagtgcctcactcacaagataaatagaaatgcaaaagactcagagcattgttgccaacaaccagctcttgggcattgcatttgtttatgaacaaatattagcaaatgttgctcttttgtttaccacaccatggctaactataccgctgactcattcagcttacaatcagctctagtcccggagtatctttttttctggtgtttttctattcttacttctcttcagtctatactgttgatttttcattccatttcttgtagaatgctgtcctatttcacagccacttcttagtttcctatataatctattctggaaagtttaataccttcatgtatcaaaaatgtcaagggtcactctgtgtcttcactctgataatattgacctgaatccccagtaatggattaagataaagcacattcaaatatatcttattttctaaagatttatttggaagtgcaagtagaatatattagaagtagatagagtttgggggtcagacatacttgctttaagagctcagctccaccatttatttaccatgttatctttagagaattcatcttctcatctataaagggaatgcttctatttcttagagttgttaaaattaaataagatcatatattaaagtaactggtggaattccagacacactagcaggtatgcaatacatatcaattctctatccccttcttaatttactattgtgaatgtgtggaggccatcaaagaatgtattgaaatgatattgaaatgttgcactagggcttccacattttgcttctgtgcaaacatggaagtctttttgtatgttatgcattattattttacttactattatttgcttgttatggttctgtaatatgcactctatatctgagaatataatgaatctcaaattatcttgatttactcaaggacttttttagaaacttgaaaataacattctgattgctccatttcattgaaatattaaaacaccaattgtaatttactttcatgccaactttctagtgactggtaaattgaaaattagggtttttttctgactttgatagattcacaatctgattatttggaagtcacatactacccatgttaccaacccaatagactggaaagtgacactggaacaacctgagcatgtatgtaacacatcataactaatcttattaatgccattagtactgaattggagttacactgacacaaccttaccttatttagtccataaaattaggtagttcgaccgattaaccctgtttctaaaaggttatgtttaaagaaatatttgtatatagacttattttttcattgacctgcaatataattcccatagaaatgaagttagccctcagatgtatttagatatcatatttctaacatttttaacgttcagtcttttttgtcaatataaaaattgccagcatatatttttccatttaacacccacaaattgtgaataaataaacaatgcaactacatttcactttatttagtgcatgtattaccaaaattagccatattgttaattcttaattcatagggagggagatctcacagattttatgaatgaagaattaactataaatatttaaggatccactctggcattttttcaaatgttctgcagaattaacaagacttgttcaatttgtaacatcattctgcctgattctgtcaccaataagtacaaattgagtctaatgacaaaatgataaaaagatattttggccaggtgcagtggctcacgccttaatcccagcactttggaaggccgaggcaggtggattgcctgagatcaggagttcgagaccagcctggttaacctggcaaaactccgtctctactaaaaacacaaaatttagctgtgtgtgatggtgggcatctgtaatcccagctactcgggaggctgaggcaggagaatcacttgaacccaggaggcggaggttgcagtgagctggaattgcgccactgtactccagactgggtgacaagagcgaaactcctctcaaaaacaaacaaacaaaaaagatatttcacatgatatgaatagccattttttgtcatccaaattattaacaaatcactgcaatttcagaaaagcttctgttaacagtaatgacaacttatcatctttgtactttagaataagttgccaggtatgaaaattagggcaattccttactatttcaagtgctaaatttgaatctgtatgtaataagtaaactttgagtattagcttatttgccttaacttgtttaatgttttaaataaaattgtagtacttttcaagtaaattcatttacaggattaaagaatcaaacagtactgttaaaggcttataataaaaaataccatttcaataaatgcattggggacaactacatagcatttgggaaaacacaaatttgggtttgtacatgactactgtgacaatgtaaatatcagatggatcaagattttaaaggtgaaaactaaaccacaaaagtcctaaagaaaacataagaattttaaaaataattaagcataacttttaaaatatattttaaactggaggtataaatagaaaaaagatagtatattttactgcatgagcaaacaactcctatataggggaaaaaataccccactaaactaaatcaattggccagctgggaaaaaatatttacaactcacatcataacaaacaactacatatccaaatatagagagaaattcctccaaatcaatttttttaaatcccaagaagaaagaataatatggcttttaaacatatgaaatagacctaaattcactcatcatttaaaaaatataaagtaaaacacctctgtgatactagttttcgcttataagattggaagtggtcaaaaagtttgatagtacactatgttagcaaatgttgagaaacatacctatacattttagggcaagtaggtatggatataatctttatggagggcaatttgatactgtctgtcaaagtttcactctaggctcattcatttataaaattacacatgtaccaggttgttcatttccatattgcttgtaatagtaaaaaaaaaaaaatagagacaacctagatgtctagctacagatgaatggttaataaagttataaaactttttatttaaacaaatataaaatgttcacattttttggcgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaaaaaaaaaaaaaaaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttgattccactgccgcttgttttccttgtcatctccattcttggttttactccttcgtttatgtgaacatacctttatacaaattatggaaaaaatttgaaaggaaggtacgtcttctgggattttacacatctaaaaatgttttgttttgttttttcactttcacacttgattgatagtttatctgagcatagaattcttgcttgaaaattatttccctaagaattataaagatttttcttgagtgtcttctaacacatgttgctgctgagaagtctaatgcctatggattctttttcctcttgtgctcccaagaagagagaaaacaagaatactttcttctccagaaagtcttcattcaagaaagcagaagggagggacattttctacatttcctttctggttgagtagaactacacttacctctcctccttcacctgtgccgtgtgattcatgattgagccttatgatctatgagagcatctctatgtagtgatgaagcacttgatgtttagacattcttctcataatagagcctactttttcagaccattgtcttgtgtgaactcaacaatccttatactattgcaatcttaatcctcctaagaaaatggatgcttctggcagaaaggaggaaggccagtagaaagaagttaaaaagagacgatacttcaatctatatttttaaaacttaaaaaaaaattattacagcatggagcatttttctcctcttaaacgtttgattttcaacacctcactcaattgcaaattgagtgatattgtataaaccatcttcacagttatcagcattaaatacctaggtctttcatgtagtatgtgagtatttctgtactgatttattttttaagccaaaaattactagattaagtttcccatggtctagtcatttatgttgcataacccaaatgcaaaagttacccatgatattaaatttgaaattacatgtatatcatgctgcccattgttccaaaaacattggaagacattttaaaaccacatatgtatagattgttccttctgtctgcagtagaaccatgttcatgttttcacgtggccactgacctttggcaaagccaattcaaaaattcagactattatcatcatcagacaaatcattaaaatggagtcaatcatacacccacttgcataaatcattaagacagatgatacaaatggatttgacagaccatgacctaccaattttttacttgtcaacaaagcttagagttaactgaaataaaaccatttcatttagtaggttactgccaaaatataacaaatctatacaaagtttttcatagtcaagaataatttaaaagacaaaattaccaaaatatgaatgtgcttatgataaataagtgctagtaaacccagaataattaccaaagctaaaactacaccattaaaaatgatataagcattttaaataacttgattgtttctatttttagtagttaatggtttgtatagatactttaatctcttctgttcatgttgttttttcagaaaataagtacttaatcctaatcaatgtgagataaattaaggaacgcaggttatatttcttcttttaatgaagggcaaactcctccagatgtaagcatagcatctatttgcagtactgccacataagaagtaaaaatagcttggattattttggtatcaagtaggatttgtagatgaagaatattatctaaattggattttccatagctatggcagttaatattctaactgctgcagaagtaccaagagaaatgcaaagaatcagaatcttagcagtcattcatccattcgacacctactaactgcaaggcacactgctggataatatgcagtatggaaagtgaggacatacacaacttaaaaaatggaaagtctcataataggagcaaaaattattgttagaagagtgcttatgagaagtacagatatcacaacatcattccagattcacagactctatgttctattattcaattaaaaatgtttttagctttattggcttaaacaatagcgacagagaacaagttatttcaggacctatataataaaaagataagttttctgagttcaaaaaacatgggaaaagattatgattaaaatatattcctgcaaccacatggaacgatcatatttcattgtgtcccatgtctgaaatgattccaggtctccatatgaaattgttaagttttaaaagcactatgtgtaacctctaatttttaaatttttgaaggcaggataaaattgttcacccagttagggaactggtttactacaattggtaatgattgaatcattcttgtccaccctaatatttcacgagattttctttctagcacagctcttcctattctctcttatcagtgcttccggggagatttgtcaaggcctttattagtgtgtggaagagacgctagtgttccttgtttcacagatatctatttcctagtacacactgactactgattttgataaaatgataggcttttatacaaacatagaattccttttctaaacacttgtgcacccttaggaaaatttttttcttatgataattggataaaataacataacataaagctggtcaccctctaatttattaacataaacattcttaaattctacttctcagaactaatgtaaaagtcacttcctttctggctgctctagaggttaaaaaaaattatggcactaatagagaagtgaggaaagttaaaattaaaaaaaagaaaaattacttcttgagagtggactatatattatatttttacttatttgcttttttcttttataaaactcatttcctatcctagaacaattcattttcaagagaagaaagtgcacgtataaaacaaaatttcattccgatgtccccaacttaaaactttattcctgttattcccatgttaaaggcacaaaattttctgtaaaaacagataaattctgttttccattttattttcatacattctatttgaaacacagaaaatcccctagtagtagtttagaatttatgcagattctagttaatcttatgtttcaagtctatgaagcatattctaaagcaataatcataacacttaaaatacacttgcataacatttttgttgaagtgggtattaggtatcatatgcactgcaacattcctggcaagggagtgcatgtaatactttaaaatgaaacttccctttttcacttcagctccttttcttgattaagaagctgtaaatgtatcttgcctcttttcacaaatgaaaatgtgttcaaacgtaattaatctaccctattaactctacaaaacatctgctatatttgttaaacacttcaaacttctgttctgaaccagttaattctaagtaatttctcagttaaatatttacatgggcttccatgatgataagctctagcttgtcttaaataatcagcagattgtccagagagagctgtgtgaaatgtaacacattgtaatagctatccactggaacttaaaatggttagctggcttggactattttttgcttatttttatcttagccaaaagaggtaacagccttatgaattccattctttgtcaatatttttaatgtccagaattgtgttaaacggaaaatgaatacctatgtagacctatgcagatgtttaccttgtgaaaatgctaaatccaatctcaaatgtctctttcagaaaagtgataaatctgtatgtgtgcaaaattttagaaataactcaatttacagttatttttatagcagactaagtaaattaaaaagtagaaaacattgataggcatttttcatcagcaaattaaattgaagaagaaaaaaaatccacaggctatgcaaatgtgtggtgtgtacaaagataattaagactatgattctctaactgcacaaattatataaatctgtaaaatatcaggttttggtcaaaaattggaataagttccacaacagagatgctgttacaatggtaaatgattaatttgtaaatgaactataaggcaatttttctcatagacatcagagaatagaatgatcacttcagactgaggaagacagacaagattgaaagttctccaatgtggtaattaagtccaagttttgaaaataaaaatgattatataaagagcagatgccagttctccaacaccaacactcagtattgttctaactaggtgttttcttctttacaatatgccaaatgtttattgagttccttctataagtattgtagaggttagaaaaaaatgagcctgtatcctctacagcaggggtccccaacccccgggaaaaggaccagtaccagttcgcagcctgttaggaaccggaccacatagcaggaggtgagtggtgggcaagtgagcaagcttcatctgtatctacagccactccccattgctcacgttactgcctgagctccacctcctgtcagatcagtggctgcattagattctcataagagcatgaaccctattgtgaactgtgcacatgagggatctaggttgcgtgctgcttatgagaatctactgcctgatgatctgtcactgtctcccatcacccctagaagggaccgtctagttgcaggaaaacaagctcaggactctcactgattccacattacggtgagtgtataattatttcattatatattacagtgtaataataatagaaataaagtgcacaaaaaaatataatgtgcttgaatcatcctgaaaccatgcccccatcagggttcatggaaaaattgtcttccacaaaacttgtccttggtgctgaaaaggttggggaccgatgctctagagctcacggtcaactaaaaggataaatgaagcacacacataatgacctttacaaaaccagaataaggaagaactgtgggagggattctgagacaaatgctgagctctatccaagttcaatttacataaactggaggttaagtatgtctgtaattttcataataagtgatcgataaatccactgtttgactttactaaacgggaggaacagtgtcctggatcattataaataatcctcccagaattttaatttgttagtttgggaatagatattatttttctacagttgattgatctgtgttttactaatgataatattaaaattatttttgctttgtcaatttcaactaatgttcaatactcttctcaaaatgttctgaagattaggagagcatggctagaattacaaattggtcttggatcattcaaagagtgaatgattcatcaaggattaaaaaagaatttcctcaacttctaatcaaacccatagctgggtcctagacttagcaaaagtgtggaggaggagatcagagtcatggtaacatctaggaggcccgtaagtgatttatgtatgtgagtttgtaccatatcttagtacttgagtctcgcatacaaaagattatcataaatattttttgcgtttgttaaatacattccaaatcaaatattatatccttgcattaggtagactttgctacataatttctttaaatagtaaagggagtagatttttgattatatgtgtctcagaattaagtgaactccctgatgtgtatgttttagtaactcatgtttaaaaacactgaatgagctgtcagcatttggatgaatatcaaaaatgttatatattagtttgactattcatgaaattataatagttttcctaaggataagagagaagagtttaatctagagccaagatcgtgtcaggcttataaaaaaatgacacaacctccctgcaattatattgtaattaatacttgttatatttgaatttcaaaatttgtttttcttataaacactaggaatttgccattttaaagttggcctaattatccaacattacttgattatatatcatttggcaggttttgttgtttttttgtttttaactacaaacagaactgattagtttttttcccttttttttcctacctaaatcaataaaacatagactccatatgcccctgtaacattaaattgctcccaaagtagataaaagaaatgagagtgataaatacataaatttcattcaactgttgtggagaaggagtaacaaagatttgggggaacagtgagaactgatgacatatgcagaattttttgtactaacactttaaaaaaattagttacaataatttatactgaactctgagaatattaatcaaatgaaagccatctgatttaaaaattaaaatacgtatattacttttttattcaaaataaaattagatggtgaaattaagcatgtatgacattcatgaaaatttagtaataaaataatttacagacaggcaaatgctgagagattttgtcaccaccaggcctgccctacaagagctcctgaaggaagcactaaacatggaaaggaacaactggtaacggccactgcaaaaacatgccaaattgtaaagaccatcaagtctaggaagaaactgcatcaactaacgagcaaaataaccagctaacatcataatgacaggatcaaattcacacgtaacaatattaaccttaaatgtaaatggcctaaatgctccaattaaaagacacagactggcaaattggataaagagtcaagacccatcagtgtgctgtattcaggaaacctatctcatctgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagccttagactcccatacagtaataatgggagactttaacaccccactgtcaacattagacagatgaatgagacagaaagttaacaaggatatccagaaattgaattcagctctgcaccaagcagacctaatacacatctacagaactctccaccccaaatcaacagaatatacatttttttcagcaccacactgcacctattccaaaattgaccacatagttggaagtaaagcactcctcagcaaatgtaaaagaacagaaatcacaacaaactgtctctcagaccacagtgcaatcaaactagaactcaggattaagaaactcactcaaaaccgctcaactacatggaaactgaacaacctgctcctgaatgactgctgggtacataatgaaatgaagacagaaataaagatgttctttgaaaccaacgagaacaaagacacaacataccagaatctctgggacacatttaaagcagtgtgtagagggaaatttatagcactaaatgcccacaagagaaagcaggaaagatctaaaattgacaccccaacatcgcaattaaaagaactagagaagcaagagcaaacacattcaaaagctagcagaaggcaagaaataactaagatcagagcagaactgaaggagatagagacacaaaaaacccttcaaaaaattaatgaatccaggagctggttttttgaaaagatcaacagaattgatagaccgctagcaagactaataaagaagagagaagaatcaaatagatgcaataaaaaatgataaaggggatatcaccactgatcccacagaaatacaaactaccataagagaatactataaacacctctatggaaataaactagaaaatctagaagaaatggataaactcctcgacacatacaccctcccaagactaaaccaggaagaagttgaatctcttaatagaccaataataggctctgaaattgaggcaataattaatagcttaccaaccaaaaagagtccaggaccagatggattcacagccgaattctaccagaggtacaaggaggagctggtaccattccttctgaaactactccaatcaatagaaaaagagagaatcctccctaactcattttatgaggacagcatcatcctgataccaaagcctggcagagacacaacaaaaaaagagaattttagaccaatatcccagatgaacatcaatgccaaaatcctcaataaagtactggaaaaccgaatccagcagcacatcaaaaagcttatccaccatgatcaagtgggcttcatccctgggatgcaaggctggtttaacacacacaaatcatataaacagaaccaaagacaaaaaccacatgattatctcaacagatgcagaaaaggcctttgacaaaattcaacagcccttcatgctaaaaactctcaataaattaggtattgatgggacgtatctcaaaataataagagctatttatgacaaacccacagccaatatcatactggatgggcaaaaactggaagcattccctttgaaaactggcacaagacagggatgccctccttcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcagcccaaaatctccttaagttgataagcaacttcagcaaagtctcaggatacaaaatgtgcaaaaatcacaagcattcttatacaccaataacaaacaaacagagagccaaatcatgagtgaactcccattcacaattgcttcaaacagaataaaatacctaggaatccaacttacaagggatgtgaaggacctcttcaaggagaactacaaaccactgctcaacgaaataaaagaggacacaaacaaatgggagaacattcaatgctcatggagaggaagaatcaatatcatgaaaatggccatactgcccaaggtaatttatagattcaatgcaatctccatcaagctaccaatgagtttcttcacagaattggaaaaaactactttaaagttcgtatggaaccaaaaaagagccagcattgccaagtcaatcctaagccaaaagaacaaagctggaggcatcatgctacctaacttcagactctactacaaggctacagtaaccaaaacagcatgatactggtaccaaaacagagatatagaccaacggaacagaacagagccctcagaaataataccacacatctacaactatctgatctttgacaaacctgacaaaaacaagaaatggggaaaggattccctatttaacaaatggtgctgggaaaacgggctagccgtatgtagaaagctgaaactgggtcccttccttacaccttacataaaaattaattcaagatggattaaagacttaaatgttagacctaaaaccataaaaaccctagaagaaaacctaggcaataccattcaggatataggcatgggcaaggacttcatgtctaaaacaccaaaagcaatggcaacaaaagccaaaattgacaaatgggatctaattaaactaaagagcttctgcacagcaaaagaaactgccatcagagtgaacaggcaacctacagaatgggagaaaatttttgcagtctacttatctgacaaagggctaatatccagaatctacaaagaactcaaacaaatttacaagaaaaaaacaaacaaccccatcaaaaagtgggcaaagggtatgtacagacacttctcaaaagaagatatttatgcagccaacagacacatgaaaaaatgctcatcatcactggccatcagagaaatgcaaatcaaaaccacaatgagatattatctcacaccagttagaatggcaatcattaaaaagtcaggtgctggagaggatgtggagaaataggaacacttttacactgttggtgggactgtaaactagttcaaccattgtggaagacaatgcagcgattcctcagggatctagaactagaaataccatttgacccagccataccattactgggtatatacccaaaggaatataattcatgctgctataaagacacatgcacacgtatgtttattgcagcactgctcacaatagcaaagacttggaaccaacccaaatgtccaacagtgatagactggattaagaaaatgtggcacatatacaccatggaatactatgcagccataaaaaaggatgagttcatgtcctttgtagggatatggatgaagctggaaaccatcattctcagcaaactatcacaaggacaaaaaaacaaacaccacatgttctcactcataggtgggaattgagcaatgagaacacatggacacaggaaggggaacatcacacctgggtcctgttgtggggtggggggagtggggagggatagcattgggagatatacctaatgtaaataatgagttaatgggtgcagcacaccaacatggcacatgtatacatatgtaacaaacctgcacgttgtgcacatgtaccctagaacttaaagtataataaaactatatatatataaaagaaaatttagtttatatgaaaaaaattaaaaatgaatatatacataataagtaactatggatcatgataagtacatctggccttttagtttcaacgtagccatcactttttagaaaaaggtcatattataaaaatgaatgttaattatttttaaattagataacaaaagaatttcttctggaataaggggaataaatttacatttatttgcatttgtattatcagatttttcatttatttcaaaccatttaaggcatttaatagatgatgggtgaattataaatatttggaaaactttttgaaaattactgcctttatccaaaaacttttattggagtggatgagttccccatgtgaattgtcatttggccagtaacaggcacataccgtgatgaataaaatatagattctgttatagattagagcctggtgagagtaacaaatcattacatgaataatcacttaaatgaattagtggtaagtacttgagagaaaaagtgcaaggcactaggagactgaaacaaggcattgtctccaagtggtacatcagggaagatcaagcctggttttcttaagatcagtttggctgtgatgtgaatggatggaggaatgtgtagcttcaactaggaagctcttacagatgagcaagaatatgggagcagcaggagtggagagaaatggatgaatccaaacgtatcttgtagataaagccaacaagattttgtaactgtatgtgagagagaagtttaagagagttgaatgtggagaatgagttctagatttctggcatgagcatgaagagagtgtggtatggatttattgatttggggcatggtggaagaggatccagttctggagggaggatcctgagttcagcatttgatggggtaaactgtggatgcctgtgaggtagcagtggttccatcaagcacgtcgtgggtctgaatgcagctcagagataaactggagttgtagatctgggaattgctggtctagagaatccaaagcccacagatgtgtgagatcaatgtgagagaatgtggactgagaagaaaatgagacaaaaatctcccgcatttaatggttgattagggaagaaagaagcagcaggaaagaagtagtcataactgctgaagttttttttgaatggcaatatcatcatttttaatttcatgtggagtaagaatttctgtctaaaataagaatcaggagacttgactttcagattaatacctgggatttcctaggactttgttatgatctgaaaaaaaaagaatgtttattttccctaccactttatattattacaagaaagcagtaaataatatttttaatattaaaagttcaatgttatgagtaggcatgtttgaagccaacaccataatcatgcatttccttagaatatactttaaaagctactctcaaccaaaaatataattttatttatagagtttaaatgtataaagaggtatctttttctgcttgcaaatattgttaccacttatttatggtggtttgttgaaacatggttccaatcatatgagattcttcactggcggtgaacatttggtctcacacctggtgtgggtctgcctttttttctttctggagttagctacaaagaagccagtcaaagaagggcaattcatcattattaatatattatatagttcaaccttgaaagagctcaaattactttaaaagtttgttttaatcaacaaaataattattaattttcacaacattctttgtgaggcaggtgtacttgaaacagtgtattaacatgtgtctctttttcctcatagggttccctggggatacaaggcccccaaggtccacctggaaaagagggtcagagggtaagtaaagctggaacaactggtgggcattactaacttaggggatacttatttgggaacactaatgaaaatgaaaccgaaatagagcaagcagatgggcatatggagagtatcaattatccaaaggctgaaatttgagattcgagattttgacagaggttttgcaattcagaaaattctatatttttcaagattggcagcacaagtgtagagatattgtttggataaaatgaattagccctaatttgatctacactactttggtcatacttttagtttttgaattaagttgatgagtatctttgtggaggtctagcctatttattaattccataaaggttgtggatattaactacattctttatccaaattaaattattgacttcactggcttttcataactctcctttcattgccatttattgcctttaactgagacaaaatagtaagcaaataaatcatcgttggaattggtagtagagcaataacctcctatttctagtgcagttcaatttcatcattccacagtaaaacgaagccctgcagtgttatgacaactggtcagcttcatatgagcagtggggaccccattcttgtgttttactgttattattatcattttcaaaccattttaaagtctcaaaaaatcttgtgtgttctttctcatgtgcttatttatggcagtctttgtactaaatagtacaggtactgtcaacttctgttcccttgttgatgagcattccatgacttagagtttagatgatgtgcctaaacttgagcttctgactgtagtcctacgttctcttttattattaaccccaaatatgtttcttagacattctcatttattattcccagttctgccttctgtaaaataagtctctttcctcaactacaaatatttgagggtcagtggtgtattgtactaaggtttaccttttatcaagttaataaaattccaattctcttaacttgttctcttatcgtatggattctggactctccaacatgccaataatctttgtcagaaaacactcattggctttccagagttgtcgagaatgagactggatacatgtggtcttacttagggcagagtaaaatgaggcaagtacgccccataccacagacaacatgctactattatggcctaagattgagccaatgctcctttgtctggtattgtacttttgacttgtactacatgtggtcaattaaatgctcctccctttttattttaatgaaaactgctaagtcaggtcttcacccagcccgttgttgtacagttacctttttgaatcacagagtaggaactgatccttgttgttaaatttcatctttattgattttaatccctaatagcattctattctttgggggctttttgcttttaaaaaatgatttgaatcctgttttccagtgaaatatccctcagccttatgctactttaaaatttgataagcctaccttctgtcttcatttaaatcgttaataaatcctgaacagaacagggcctgacaaccctgtgtaacaccagcctaggctaccatcttttccaccattgatgtccttaaagtgtgacaatcaaatcatgtacaaatgtatttgaaccctaccaccttcccacccacatttcttgatttggcttgtaagataattatgacagacttgttagatactgggtgaactgaaaaaatatttaaatgaggctttttagaaataataatgcttcaaattaaaattgtaccctatcaaagcttgcatttcataagaaagtagattaaagaataaattaaacatgtattttccatgataataaagaaggaaatcagttaaattgtaaagttcaaccactattttatgtaaatttactccatttataaatgcgtatagtccagataattttatattacttttatcttctatcaagagtaacataatgtcagaaactaaaaaatgtaatagaacttatagacacttttaggcatagttcgtcattattgctactgctctttcccaaatgccctatttatcaaaagaagtagctagagcaggtattattgacattatccacatttacaaataattatatgcatttggattatatccatatatgctcagtgatttattctactttataagctacttgaatgggaaacaaatgaattttaaaaatgagcgttcttacatatttacatttaggtccaactgagtgccaccatttcttctcagctcaatagttaaggagtactcagctctttcagacatataaatgtatttgtacatgtatgcctgtgtatatacatatgtgtgtatacatacagatgcacattctgaaagctaagaccaataatttttctatttcactaaagtttgcagtagaaaacaatagtgagaaaaatctaggaatttaaaatcatttttatttacccaatgttaaaaacctcttgtattttaattgagtggttgaccaagaaggtattgactatcattaaggctatttaaatgaaacataaaatatgtgaagttttatgtactttattcctagacataatgactttaattaaagcagaacatttaattttaaacaaatcattaacttgttggttttcatcaatgattaaatacgtagtagctactactctaccaatatctcacaattatggtgagtttcaaacatgggtgtcacatttaaacatgctttgaaaaatatcaaacattatagaaacatgttaatattgctattattattatgaaagacataggattctgatcaatgaattctttttctttttctctaactctttgtgtagtttcctataagcataatagcaacactatttttgcaagtaccacgccaaggttctgtttgaaattttgattagttgattttatttttttaattatcatttaagctgctaaatcttagtttataaagtgttcatttaataaaatgtagaagtaatgtgcttcttacacttaaaagctattcttaacaatgttctgtgacaatatgtatctgaaatttatgggctgttttatttctcaacttcctgattttcattttttggatcttttatatgccattatttatttatttactttgtcttcttgaagccctgcaagcaaaatatttggttgacatattttttagtcttacatcctttatggattcacacagtttttagaattcaatgaatgttgaatattgatcctaagctacagatgagaatgtttcagatcacgatgagggagaacagaatggcattgggggttgggggccttcctggaagttaagagggggtttaatccatcatgaggcagaaaaaggccgtacagaaccaagaagtcaacagaagagcggttctagattcttgaagggttcagcagaattaaaatttggaacaaagtaagtggagggatgctggataagagaagtggctggaattggtgccaggggagagaagttcggttgagtagtgaggagggcactggaaacaaaaatctcaagaaaatgtgtaaggaaattagggcatgagttgtgaggtaggagaggcaaacaatggagattgtggtggagggaaaaggacaggaactggatggaaacccagagaagtatctttgtgaaaagtggaatatttcaggtagcagatcatgttcatggatattaatgagaaacattgcaaaagaactggcattataaaaattccatttaagatgtaggttccttgcaggatttcttagtattcctaacaaacagactctccccaaaaataatgaaaacaataatttttatgtaaccttgaattttcattttatagtcacattaaatgcacatctgaataatctcaaggttagcgtgaagctaccctggtctttttaaaagaagttcctctaggtctctgaaaaaagacatttactggtgaatcaactagttactgccgcaaacagaagtttgtgtggttggaccaagatgacacctcactcttgcactctgttgctggatcctaattttgatcctgaacagaaactttatgttttaaattccctgtaacttacccctctatcctgccctgtcttgctctcaatttatcctctctgcctgtgcctgtcctttttcccctctctgggcaaccatcctcttgattgcctccttgcaacatttttgtgcaggttttactttcccttgaagtgcttgctccaagctggctttgaagctgtgtctggagtcaggattccttgcattctaaacagcacagagaacatcaacctacctacccctgcccccgtcaagatgtgtttctttgcaccagcccacacttgatggcaaaggggctgggtcacatttcctccatgagctgggagcctacaaaagtacaggagggcagggcaagcaacatgtccactttcatcttatggtgcaagcaacttggaatttagcatacaggttgcaccacagactttggggccagattgcctgaattttatttatttatttatttatttatttatttatttatttattattgagagagagttttgctcttgttgcccaggctgcagtgcagtggtgcagtcttggctcactacaacctccacctccccagttcaagtgattctcctgcctcaccctcccaagtagctgggattacaggcatgcaccaccatgcttggtgaatttttgtatttttagtagagatggggtttcaccatgttggtcaggctggtctcaaactcctgacctcaggtgatccacgctccttggcctaccaaagttctgggattacaggcctgagccacagcgcctggcccagattgcctgaatttaaatcccagctttactgcttatgagctttgtgatcttgtgtgaattcctcagccactctgcacctcacatgcctcttttagaaaatggagatgctaataacgcctaccccacagggctgtgatgaggagtaatgccatgtcggtgttagcctagtgatctcaagatgtttatagaagggaatgtaggtatacagcttcagaatattagtacttgattaaggagaatgtctaattgatcaagaaaaaatatttaagataaaatgacttttttcactactactctgttgaatctattttatttaaattttacctgaatcttactttacctagatgtccatgcccattttctaatgccccagaagcttgaggcccagtgttgatctaacttgataataaaattaagtatgtaaaaatgtctgcaaggtagagtagactattgccttttccttaaagaaagatatgaagattggtgtcatcactgtggagtagctgagacctcaaaatttgtttgatgaacaaattgtgctgatcatgtgtaaatttactgggattttcatgtaaaatttacacttggtttttcttttggtttgattctgaactggttgatatactttacctaagacagcacaagtaatgaattatgttattaataagtactggggtatattgatctcattaggtaaaaggacatcaaagtcattgcttctatgaaatcaacacatacaacaggactcacttaagcaaaattttccttaagcttatttgtttttacagggcttgggatatttttcaagtgaaattgtgccctcatagtctagccatgctctatgaaaactttgtagaacacagcaagacagtaatgcaggtcagacctgcctcacagtaaagtaaaaaaataataataatagtgtttcattgggcgcggtggctcatgtctgtaatcccagcactttggaaggccaagacgggcggatcacttgagatcagaagttcaagaccagcctggccaacatggtgaaaccctgtctctactaaaaatacaaaaattagctgggcatggtggtgggtgccagtaatctcagctactcgggagactgaggcaggagaatcgcttgaacccaggaggtggaagttgcagtgagccgagattgtgccactatactccagcctgggtgacagagcaagactccacctcaaaaaaaaaaaaaaaaaaagagagagaaagagtatttcttcttactttaagatagcttattccaagttaccaacttcacagctacaaagtgatctcattgttccaatgaaatgatttcagggtctggtagaaaccactaacaattgtctgcagttgcacatccttacacaggcttgaattttagagaggagtcttatagagaaaagaatggataattatgaatttataggaagtaattttgttagtttcacattataacaggtgatatgattgtcttcttatctttatgtgtcaaaactgacaatgacctttaaaatgcacgatgagtgtttcataattctgctctcactaaaacgatgactggtgtccttccaccaggaatttgtattactagcaagaaaaagtcaaaaattactttaaataatagttttaactctggtcgtaggtagaaaaaaagcatcttttttgcttggattcatctataaatataaacgtataccttaaaaataacacgttaaatgttctgtattctacaactattggttcatgcttattacttgttagaaaattcttggcatacagataacatcgtattttatttacttgctatgacatttcttcagaatgtctccatgaggattatcttgggagtttgcaagagataccatccttaattctgtctgacatttctagatgaataacagggaaattgggtaccctattcaggtccaagcaacaagtgcagagctttctccaacacattgtttgaatttacaaaaccaaatatgaaactcggtggataaaaataagcaaatctgcatttatccctgcatctctgtttgcagagctccatggtggactttggccgcttggtgtctcctaaaattggatcaaatatagttactgaagcaatgtagtaagacaggaaaaagggggaaaggctaatatatgttcatgtcaaacaaatgccttcaagggcgtagttgtgcagcgaggatagtcctttacttttgcctcatattctcttactggtgggaaagataaatcaaggaaaaagatgttggaaaacaacttctagcacaggctaattaaaatcagatgaacaagagatgtagcccagactttgtgatcacaggccatcccttagataaggttaaacagcacagctagttactgacagtgtgcctgtgtctccttgtggtaaatttcactctaactagtggtctctgcagtgcacttgagatagaagagacaaaacgccctggaaaggctgtcaatgagaaaaaaaaaaattgtaagcaatgattttgttccaataatacttatatcaatagtaaagcaacagtgagctgaggtccttacattcacttaaatgaagagctgaatgacattatttgtattgtaacaaaataacataataagttttctcttttatatggattagtaaaggaaaaatgttttgtattttcaaataggaccctgagtctgaatggtttatttatttatgtgaatagacccaagagctgttctctgatgtggaagaggcacatcatctaatggggactccttcaaactggagagattcagcctctgagccgagtggctgagagcttcagaaagaagcctggagaggtgagggtggacccatttcaggaacatcaaatcatcacattttctagctaaaggggtactatagtatcattccagcccaccaaataagaaaacagagacccagaaaacattggcaattctccaaggctgcagggctatttattctaactgttctgcataatatacacccattgtctattttgtggtatcacactgaaacccagatttgcatgttttaaaatagggatattgagaatttaaccaaatcactaacttttaaaaaagttacttaaaaatcactaacttaatttttctaattaaagccacacactagaagggacaaatataggtaggtacagctgatccctttatggtctccacacattgtgatgagcacacattctgtccctataacctgcaccaacatttgggaaccagcaatgcctggccagtgagggaccagggggagagtcagaactgctctttttttctcaggagagcaattggatcaatttgtgacttcagccaaatcactcaagactctagtctaaatttatctgttttatcataacttagccctcaggtatattatgggattaagccggaagcactttaaatgcactctggtgacaggtgttctatgaaggagtcttataaatattacctacttagccacagaaacacttaaagagaatggaaaaggagaaggcacattctgccaaagtggcgatatgctaatacacctgcatcaggatctttattcagaacattacactgaacacgttagtaactatttcatatgtttaccattggaaatgtcaagtagaaagttatttatccatttgggatggagcgaatatatgtgtggatggctgccaaaaccaagaattaatcacaagttattaatcaatttggaaaatataaacagataaattttcagaaatgcaaaacattcggagcatgaaacatttttatggcctaatgactttgaaagccagcaaattatgtttccaataaataagccctcaactttgtaaaactctatagtattttgagttaccttaggtaatggcacataattctcaaagcaactttaattttatagcacttttgtttttcttatacattatattttaattatcaagagagaagctattgcaaagtaaatgtgatgccataattctttaaaaagttgaaaatttatcttttatatgatgtacgtagattgtactgtgtttttatttctaaatttcttggaatggtagtattgagagtcgctcttgaattcttcagaaataccttagaaactactttttctcattttcctcaaaaccagtaaacttttacttggactttttttgtgtgaattattgtagattaatttgatatttatttgatatctctaatatgtccaacacaaacatatacatatatgtatgtacatgtatgtaagcattatccattgtgttttctaaattcacaacagtatacaacgtatgttgtgaccactgtattatggtgtcatttttggctctcaaatcactagacaatgcacttcttgaacactagaaaggactgttgtttgtatttcttatgtgagagatgttaacaatgtgtctatgcaaccgtgagaaagatgactgcagagtatctacaagtatatttaataccttgaatgtgcataaaattcaataatgtaaacacaatttatgtgcattcaatatttttattcattaataatgccactttaagaaaatcagtcttagaacatacaatgaaaagagcaagatatcattggaaaaaatctacaccttttgttctgccatattgaaggccgttgcttcacactctccattggccatgtgttttatgcagtcttccaaatcttttgcagaaacatttccatagctttgtgcatttattcaatcatgtttatagtttatttgtcttcgaaagtatttgagggtcttataaatgcaatcaaataaaaatctctacactgagagaaaaagacaagagctaatgaatagagagtaggaaagagaagaaaataagcaaaaacacctatactgagtgaggcaactgcatttgaacaaaaagcctctctgaaagatctgagggcctatttatttactcaagaaacatttgagtgcctgttttgtgtgacataccatggaagttggcttaagtcaggcttccctaaaagcagagcctaagatgggattcttgtataagcgatttacagaagaaacctgtaacagagtgagggaagcagacaagagaagagaagaatgcaggcaaaatgtggtttcaggagcatcaagtctctccctgatctcacaagacactctggagcacgacagaatttctcctgccttgaagcaaggggcgaggcttgccctcacagggtggggagatgggcagtaacttcccagtatctccaggccaggtagatcctgtagactaaggtaaccctccaggaatgggtgtagatagaagcttgtagcagccaacacccatggcaactgagcccaccctagcctggcaccaactgcacctgtacagaggtgaaataaaacacaatccttaacatcactgacacagaatccttgatggcttttgagtgaaagtgaagacatgattttaaaaagaactttgataatattaacctcacaggccgggttcagtggctcacacctgtaatcccagcactttgggaggccgaggcgggcaggtaacttgaggtcaggagttcgataccagcctggccaacatggtgaaactctgtctctactaaaaatacaaaaattagctgggcatggtggtgtgcacctctaatctcagctatgtgggaggctgaggcaggagaatctcttaatcccaggagacagaggcttcagtgagccgagctcacatcactgcactccagtgtgggcgacaaaggagactctatctcaaagaaaagaaaactattcttgtagtctaatcaataagtaataaagggcatgattataaaaaccagtgaaatggctgatgggagtgacatcaaggagattgaatgaacacagaacaggcaaaggacttaagtttcagaagtgattgctgacgtatcaagtctgaaatgatagtgcctttaaatgaagtagaaaacacttgaagaaaacattcttttagaagagatgagtcagtttgaagcctacagcattagggctacggaaagaatctgcaatcaaaagccccttaagatgtgagctgagtagaagaaccaagtttactgttagcaagtcatcagtttaagggtgataactaaagccatcacaatggggtgagggggcagtgtgcaagggagaaactagaaagaaaagaactgaaagtagaaccttgaaatttgggtaaacctatatataggaatggggtggagagatgaactagaaagtttaaagtatagaaaagtgggagaataagaagaaagttttgaaagggaggagactgcgaactgataggaaattcttcagaggtatcggaggatggaggttgagaaaaagccattggtgatcttgaaggaagctggtttcttagcatgtctgtgttgcacagaggcagacatgacactgcacggatctcaagagtgtagtagatattgagaaagtcaggggattatgaactattattctcaaaagctgaggtgtaaagagagatggcataagactacattgggagaggtcaaggaaaatctttgtttctttttttctcataagtgtatatatatatatgtgaatactcaactacgattacaaactgaagcaaagaagtctgtaaatagggagaaactgaagatgcaagcacaacaaacaataataaattatccagacataccggaagaggccaaaagggaaggcacaggtataaacatgggtcagcatctttaccttgaggacacaggaaaaggaaaggaggggcatggacactcactttgaggacaaagtagaaataaaggcttattgcatattcacattgcatatgcatattcttctcatatagaaagaattttttagtgtagatatgatttagtaaaacatttgctgtttataagaggcattaatcacaagattgttttcaggccaatagatacacctactactttcttccctcatgaacagcgagcccaacttaggtaaaagtagagagaaatatagaagtagaggaagtcaaactaaacgatggtgaaaggggcaggccttgggataagaaaaagtctattattgcaatttcagtttaatttcagttttgctaggtttttcaagctgctggggaaaatgtgggcatttcattttatcccttttatctaagactcctttcctttgtaaattaccagtggtatcttacaagagcatttctgttatcagacatttgtctgaattcatttattttgtttcacaaattcattttgtcagaacacagttctaactccttggaaaactttgttttattggtataatataaatgaggtcagggtaaaatattgtcaaaattaaattgttcttatctttattgcttttggcaactttcacgttttatgtctctgtgcacattctgtaaactgtcatttattttttctcaaatggtataaaatttctgaagcatgctaattatgtatcgtttccaagcgaggaaatgccaagggactggcttaccatatgaagagtcctgcctgtgttttatcagtaagtccttgtggttatggtgatacatttttgtatactctactggtaacttactatgggcttaaaaacctttttcactgggagcttatgcaagtgaatgtggtgtgtttctttgcagctgttgccatagaaataaagaccttttcaaagtaaaatgaggatggcataagaattacaaattcaaaagaagttacgcttctaatttaatatcaaaaatggtgcactattccctttctttttaattttgtcaaaattgcatgacctgagtgcgtctaatatacttttattagataatttctagtatcagaaaagctaaagccgaaaaaatggaatagatgaattccccacagcattcagtaggatgggctttaatctttaatcttttattcttaagacttataatatttctaattgtcttctgcatgctctacctccatactactttctatcttattttccatttaaatctaattacctataatgggctttcttaaaaacaaaccatttattttgctttctttctttaccacatcattttcaacaacaaggcacattttctagcattaacacacacagaaggatgaacaaatctataaaactttctcagattttattactgttcatgttcagactttgaaagccttgtagacttcttttgaaaatgaaaaaaaaacctgaagcagttacacaaattaaagtttataccagaatgtaaatcaacacacagctcccttcattgagaaattcttgctaaaaagaaatgtcagcagacctaaacaataggcttaatgacatggcaaaaattgtgaatttgtaaagattaatatgttaatttggagattattttattttgagataatgtggaaaatgaccatgcatgctgaggtatgatggttattgaggagaaaaattttatcaaaaatattaggattatagaattaattcattgtttctgcaagttaagaaaccagtttattcttacttttttaaaaataaaatttgaatagttttatagacttgcttatttgtctgttatcatcagtattttaaataatgtcaatatttctatgcaaagaaagaatgtaatgtgttttttaatggtaggaaaaaataaaagagtgaacactgaagtttctagagattgttacaatattattctcatagctttacaacagttatcaaagaaacaagtgatgttcttgatattctacatcagtgaaaagttatcttcaaatatttaacaagtttgataaaacatttcaaattttattttccaccaaaagaagatgcatatataggaattctagaatgttgaatttatttatttcattgagaggttgtttaactttaataaataatttatagggtgatttgctttaactgactactgatgaagaattgaagattaattttcaaaatacagcatcacttgctccatttttaaataaaagttgtaaataatattctgagagtctaaaattacttcaaaatttcttcttccatttccttcaaaatatctttgttaaaatgatttctatcttaatgtcattaaaacaaaataatgaagcacttttttaattaattaattaatttctgagacagagtctcactctgtcttccccaggctggagtgcagtggtgcgatcttggctcactgcaacctccacctcccgggttcaagcgattctcctgtctcagcctcccaagtagctgggactagaggtgtgtgccaccacacctggctaattttgtatttttagtagagacgggtttcaccatgttggcctggccggtctcgaactcctgacctcaggtgatccatctgccttggcctcccaaagtgctgggattacaggtgtgagccaccacgcccagccaatgaagcacttagataaaagttatcctctaaaacaatgatccccaaccttttttggcaccagggatgggttttctggaagatttttcaaggactggggttgaagatagggtttcagggtgaaactgttccacctcaatcatcaggtctagtttgattctcataaggagcgtgtagcctagattcttcgccatgagtggttcacaatagggttcatactcctatgagaatctaatgcccccactgatgtgacaggaggcagagttcatgcggtaatgctcgcccgccactcacctcctgctgtgcagcccggttcctaacagtccacagaccggtaccagcctggggcctgggggttggggacccctgccctataagaaatgtcaattcaacttgaagtagatatgttaacaagcaaaaagcaggatcatgtcttacattaaaaactatataatagtgtttatttcttcaaagagtgcatataggtactttgtatgggaaatcactatttcactcatgattttttgtttcattgtaattacaaaatgataaaaagttaatgagtgccatagggaatctttatgtgccttatacacactttaaataaagtgtacagttttgtaatttttttcatttttccctaatttttaaaaattttatttttaaggcataattttttgtttgttgaattcagtaatatacactggaatttatacttcatatgtgtttatttcatttttttctagcaattcagctttgttatgttttataaaagtactgattcatgacagattggatattttaaaaaccagtcctttcccatagaattagagaagtgctgatttagtaggttgcattgattataggctaaaactgaaacaacaaaaactttatcaccagcagaaggaattcattttactgaagtatgattagttaagctttttaaaacagtttagccttgtaataattaagagaaatgtgcacttagccaggtcaattctgaaaattaaccagcaaaatatacaatgaattctcagctatgcaacatatgttaccaggacttagaacccaggcagccatattctatataaagcaaggataacatgtttcactgtctgttctgttttattcctggctacctggactagttctgctggagtccatatgcagggcaagacaaccagtagggctaaaactgattatataaatagaatttctgaaaaagtattataagaggaaagagcagtttcctccctcaactctttcaaccttttttccccccggaaaaaagataaaatgaagttaatggacaatttgtgaagaatagtccaacttacctttttaaaattggaagatcccttttacacaaagatttaaacagataatctattatatgaccacttatagctaaaacaccctcaagtttaacaaaaaggacagttatttgatagatttaggtatgtggacagccaaacaagcagaaaccatttaagataagataatccaggtaacggttggtgaagataactaactttaggatcgagtttagacttaatgttgactggcacgaggatgctgagatttaaagaagttaatatgacttgttcagagtcacaaagccagaaattggtagtcatgttcaagtctatggccgaattctgctccctcaatagccatatttttcaacccatgagttgtgatccatgagcaagtcagaaatcaacttagtgggtgacaatcagattttctttgaaatattaacaaatggccagaatacaatagaatatacaaaatggtttaaccaatgtagaggaaaatcagtgtcgtcagagagaagcctgatactgacacagaagtttctctgcctattttcctctgctcagcccgttttctgtctggaggctgccttgattcattcccctactaatcactttgattttccttctcttccagatgtacagcttgtgcagatgaatattaggtggtgggtagagatgctccctctgctgtagagtggctttggtgaagccaaccaacccacagaccttacctctataaggagggctgtttgttgtttgattagtttatgcctctgatgtatatctggttccttgaaatttttattaataaaatgtaaccctctgtataacctcaccaaagtaaaatctcaaaaggcattaattctggagtcttgcaaactcctgggtgagccctgcctgtgtgacccagggaatactacttagcctctctgagtctcagttcttcagttatacaaccgaaataatactaatggtacctaacccgaagttgatgattagaaaaatatatgtgtaaagtagccaatacagggcctatcacatgctaggtattcaataattgctaattattatatcatagttataatattaatttctaagtatttgaacataataaaatcctctagcactaaaaccatggaaaagatttagtgtttcttttggaatccgaagacttttctggatttgttgctagcacagttgcccaggaagaagtgtgactagccagtgggtgtttgggggtgaaatccagcctgtgccctgctaactactaacactgtacctcagtgtagagctgcagctaatagggaaagcactgtatctgctaaatggagctctgtctcctgagtcattaagccagttagcactgtcctacagaagcttggaagtgccagttagtagacttttccatttagtaaagtgctgaataaataaacttttactacaactggtttctttaaagtgtttgtacttctaatgatattctagaacagttttgaatttttttctctttgtcatcacatagatgcttgtaaaaccagccgaatatcaggaataaactatttataacataggttgacatggtactatttgaaatgttttgtggactgcagatgtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctattagagaaaagtcccatatgatacccaatttgtattttgaaattcagctggataaattgaaatgctgaaagtgagttatgctattgcaacactcaccatatattaataactgaactgatatttgcgggataaggtttttctatcagagaaaaataaaatgatgttaaactgctagattccttggatggttagttcttttctggggtgaaagacttgagcaacactagaccccagtatacacaacctcaaaaactaattgaggctttgccctataatataataaatggccctatacttttcgtatttctatattttactactctagaaatatttccatttggaaatgttacctatccacaacagaattcagcattcacagcagttaaatataacaaactatacacacccctgccccacccccctgacacacacacaccaaggataaatcttaaaaacaataatattgaatacaagaaaaaatacataagtacatatatttcttttttaagagtacatgaaacagaaagataatgtaaactcgtgagagtagttatcccaagaggaaggtgagggaaaaaggactacagatggtcaaaaagtatttccatttaatctatgatattttgttgattaaaaaattcttgaagaaaatatctcaaactgttactagttgttaatgctgtgctgtgggaaaataatcatttgttatgttactctttttacatatctgcattttaaaactatctcaacaaaataatttcaaattttttacaaaggttttatctcatgttatctacagcaaaaacaaaaataaaaacaaaaacatcaccagatcttaaagaactttcaaggcataattagtttcatggttttgatgtcgatgctcatctcaaagtatagtaatgaatgcgatcacactttttctcattagtacaaactcctcatttgtctagtacctttcaaaaagttacgtttacttccattttcattgttagctcagtccaaaaacaagaacaaatatttattgagcacctattgtttgccagaaactgctgtaggcagaggataaaccaatggacacaatagactgggaatcagcagactacagcccttgggccaaatctggtgtaccatgtgtttttttttaaataaagttttattggaacacattcatgcccatttgcttacatattgcctttgggtgcttacaatagcagagttgagtagttgtgacaaagactatatgtctcacaaagcctaaaatatttactttaaatatttcttacttttcacaggaaaagtttagtaacacctaaaatagtcaaaaacctctgccctcatggaacttacattctattatggagacagatggccacaaaataaataagttttagtgtggttgatggtgatacatgcaaccaagattaagaaagcagaggaaggggatatgcagtgttgtgtggaagtcagagaaagccttgctgccaagctgaccgtggagcaaagatctaaaatagatgagggccatgtgaaaagctgagggaagctctttctaggtaggggaagcagcaggtgcaaaggtctgaggcagaaatttcaaggaactttaggaggtcggtatggctagaatggtgaaggaagatgagaggaggtcagagagtccacacggaaaggcagagcacagccttgcaggtcattcattataaggagttcagcttttactctgagtaagggccctcatttgtctgttgtaaaatctagactgttcatttcatttagaaacagaggccaaagctatagatactgactccttaggtcaaatgctattcaagtctgaaaacttcaattctaacctcgccagcaatggtaaggatcgccacactgccagttcttaccagtgctaccaggggaagaaagcaagaaaactggtgactatatgttgccacaatttgaaaaacatttctgtgacacatctatcccataagttatccatgatgacacactagtgtcggcactagagagcacatgctatgtaaggttttatttcaggccagtaggttggcctcaataacattaaatttcaaactgaggatttggggtatatttttcttagatatttgccaagaatgtaattgatcactggctctacatctgaatgtgttcagccaccttctacgtgcccctaggcagtttaattcctctgggaatgcttgggaccttctgcacagaagaatgggtagacctttcacagagagttcattccgtggcagctaccatacctgccctccagaatttatagtctaatcatgaggaaaagatcatagaaagcccctttcaaatgtatatatttctcttaaatgcctctcagatcttcatatattctagcccactatctttaggcaggtatgtttttattccttttttttccctaaggtagaaattgctcaggctgagagattatgtgactttttcagattcacttaattaataaatgaaagaggatgtactagtggtcaggtatctggcttctcatacaatgcacattttttttctatcctgttttttaagtcaatgatcaatttgtgtcataaatatatgagttagaatctgtatcacctcaatataatatacacccttctaaaatataaagcatgactatgggtaacaagtattgaaagtatgccaaaatagaaatattgctgctccaatcatccaaagccactatgtccacgtttaatgcagacttataattcttgaaaatactggtgaactactattctcttttgtggatctatttaaatagccttatttttttgtgcagaacaaaacttatattgaggaaagaagagaaatattctaataccagactatgagctcctcgagggcaagatctgtgtataatttttctctttactctccaacatccagcatataataaacacttaataaatatacaaatgcttatcattgatacaagactgtctttatttttcccattcatttgtgttcctaagtggcagttgatttctcattaaagtagtaaaaaatctgtaacttcgattgtttccaacattagctcctgtagttttagttattgttgatttttgaaagatttaaattaagggtctgtcttcaggagctcaaacatctaaatgaacgtatgaatattgccatgtaattttatgtttgaatcccatagacaagtgactggatttttctctttgcctctggagatcttgacatcaaatagatttcacctacatgtgttttctcttttgaatggatttaaatcatatttcttcaatttgactttttccaaataatcatctggtaaaaatactttattatgtgtaagaaaaagatcaatataactttacttaaatgtatagttttttctcagttgttggtttgtcagccatgatccaagataagggctttttttctttcattaacccctcaaggctctcatttgcaaagtcaatgggacagttaggcatgtattttttagggcatctttgtagctttgattctatattttaaaagatgcccaaactatggcattatttcccataagatctctaagttattggttgatcaaaatataaatgagacaataaactacatttgcatatttctgtggatgagtttaaacatccttgtttctcctgcaaggtctttcacttgagttaggccagccaactgacatattgctcattaatcatacatattaactggagtagttaatgcttcaaaatccaacttaccattctgtccacagggactggtttgtgttttctaaatgtgatgacatatgcttcagacactgctaattaggcctttcccttgaaaattcatcctgacatgtttcaagaacacttttctcccttgagtacaagttcattaaattattaatatccttttataagtcttgtaggactacttacacaatgcagctttctctgttttcaaaactatagtttataatgaaggatgaaatagatctcacttccttatactgtatatctttttttccagtcaaaaacaatgggctgggtaaatatcagagaataatagatactatattcagttacataaaatgttaatgtaagattaaaaatattttttagcctgggcaacatagagacacccatctctacaaaaaaattaacaatttgctaagtatggtggcacatacctgtagtcccagctacttgggaggctgaggcaggaggatacttaagcccacgaggttgaggctgctgtgagcaatgatcacaccactttacttcagcctgggtgacagagcaagactcttatctcaaaaaaaaaaaagatttgcacatggaaatggaaatggaaatgttatacggtcagctgtttgtatctgtgggttttacatccgtggattcaaccaaccatggattgaaaatatttgaaaagaaaatatggttacatcttactgaacatgtacagacatttttttggtcattattccccaaacattacaatataacaactatttacatggcattttcattgtacgtattataagtaatctaaagatgatttaatgtatatgagagggtgtgtgtagcttatatgcagattctataccattttatataagatacttgaatggctatgaattttggtattggacagtggggatctggaacaaatctcccacagataccaagagatgactgtacatataatcgactctacacacctgtaaggaagtgttataagcaatctaaaacagataacctaaaattagttctattgagcttctgtattaaatgatgaatttggtggcaattttaccttctggcctattatctacctaagcaggtgcttataccaacctatataatatgacctttttaagacgaaactcctaacggcttcacatcacaatcacagtaatgaaactcagagcactcaccataatctacaaggcccagcctaatctggcctgcctgccacccaaccacacacttgctcttctctagcaacctgtgtttctttctattccttgaagaatttgttcttgctgttccctctactggacagctttccctggatgcacctggatgctctttctcagaccttgcatgatccttggactcactttgttcacatttctgctgagggcttccctgatttttctatctaaaacagcacaccttcctgtataactctgtactgccttaccctgctttatttttctgtatttcctatcactatccaaaattcgtatctttatttatttagttcttagagatgcaataagtatagcctagtggtaatggtcagagatgatacagccaagttgcctggattcgagtcttaactctggtgtttactggccccataaccttgggcaagttatgttgtcactaatttgcctcacccttaaaatgggaatacctcaaatatattttgaggattaaatgaataaatatgtgtaagtttctttgaatgatatttggcatctattactattattgtccccactggtatataagctctattgagacagaattcaaggtatttccagagcatggtaaagcatctaacccacaatagggacttcgtaaatacttcttaaattaatttatgaacaattctgggcacatgccagctgaaagtggggaaaatatcttataaaaacacagcgaaaagccagcaggtgaacaaatagagtttaaaagtcataatggaaattttatgtagttgagaaagctgagttggttatgtgagttttgtaaatgtaaatgcatatgtactagatgtagcaggaatgaggggaacaagatgtatttagggtttctgcctttaggatacttccctagaggtgaacagagaaaaagtcaaagaacataaaaagaatctggcgactgaccaacaattgctgccggcaggaccaactgggtcaccagctttcccaggaaaccctaaccttactttgggaaatgttggatctgatgggagctgagggaaggtaaattgtaaagcacagacttcaaattacttttacccagttacagcttcaggtgacattggatgttaagtttaaggaagcgaaaagtagtattcaaataaagaaaaatactctcggttttgtacaatagtatgtcccaagtgttcagtttttaaaggtcatcgatacattttccaaatatttaaatcaatcatgcaagaaaaagaagtggtgagctgggaaatgccgtctgaacacacttgatctaaagcctggggataagtatcagaagagaagagaaccgaagagcgcacacacgtctaagacaggttaccgcaggtgcatccagggaaagctgtccctgtttgaggacttttcaggggatataatgtcccaggttgttgctgaggttatgtaaatgactttttctacccacattttcctcctatccccatgatccctccactccagagggaaactggagtgctgaggtcatctataaccaaatgaacaagtctgtctaaatgcctgttgcaaataattgtcccttctcttccaccatgaaggcaagctctaggtcttaatcatcttaatatattttccccaacacagcaggtaaaacagacagtaaatttctgccaaataaaacttactcacatctttttgatagggtttttttctgaaatcagcacttaagtatcaaaatgcaatttaatccattaaattcacttcaattaatagagaattacataaggaaaatttttccatttcaaaattgggtgacctttatagttccacctcactgatcctctagagttctcttcatttgtcagacagttattgaatgactgcaaaatgtagttctgtgaacttattttgtactagtcaattcaatcctggacactgaatatgtagctctaaaattctaccccttgagtatatcttttagattatgtaactcagaaatactgaaactatgtcctgtcactttaccttaattgaaatcaagatatccaaatattactaatgattatttgttccaatgctcactggtgatgctgagcttgttcctgtttcacgggcttagcctctgacctgtctgaagtttgtagatgaacttcactacactgtttttattttaacatttctattaaataagacttatcattttatatgcattatttgtccctctgcatgtcaattttgttgactctaaacctacaaacataacagttcccataataaaagtgaaggagaaaagtcttcattcatgaggcattgtgaaagtggaatgttttagagatgtggaagcctggcagcataattctcagacaggaaggcaatgtatataaaggccaaattccccttctccagtatgggagtgtgctgcctgtgaacatccaaatatggaggaaagaacgttttcacaatgagctttcagcttccaccagcttcatgtggcaccaagatgttaaaatacatcacagtatattcaggaaattgtttagccataccctaccactgccccatccatgatactagaccaatgaagtggcttggcaaatattggcaatgacaggcctagaaaacagagccagaagttgggccttagagagttggtggtgtggcaaggcagttaggcattccaacaaatctaaatggaaggtttgggttggcctcagaatcagggtagagagacgtgagggcaagcagaaatcaggcaagcagaggagaactaggaagatccacgttccaaagggaaaagcagcaagtaaatgggacatttacaaaatctgacttggtagtgagaagaagagaagctcaaaaattataacagcaaaataacctaaattgtgaatgatcgggatactcacatcaaggaaacgttaatcctgttttaatgttttaatgaatcatttattcagattatcatttattgaactgtagctcaagaggtttagataatgatgtcacaacttctaacttgttttgaaaagccacattagttacagatagagtccatctaaggggggataaaaggaaaggggcagagagatgagtaaatactggaatgaagtaatttaaaaatgttaagatcccagcctcaataatgttcatctttccttagctctgaacctatttcaagtcatttgttcatgctgaattgcattttcttctcatgtccttacgagagtcacttgtcagatccctgaagtaatgagacctttatgactagtgttgttactgtcatagatacattttaaaatatctattaagaaataaaatgtacttaacatattatgtcttcctcagtaagtattccattctcatttttacacatatcattgagttcaaaatgtaattctttacatcaggcataaatcttatttcctttcatgaagttaaaaaagaaaactaaacttcccagatagtctgtaatgttttcctgtgtaattaacacctcattcacagttgtgtgtgccagtcaaggccctgtctcctctttcctaacatttccttaataccttgttcaggctgagctgatgcctaacagtgtgcaaaatacacatatggaaacaggggaatgttagagagaagtcagctgaattaccgtgacctgccagtttaaagagagtacttagacacaggtttcattttgtgggtttggggtctgtgtgccatcccttaagtccaattactgctgtaacctcatcttcttcatcatcatcctcatcaacaataaaaaccatctgtcaaatgaataccaatagtccattatttgcattcttctcttcttaatgcttctaagagggccaaatgtttataaatcaagtgtctaatttaagatacacgttctctgacactgcaagtcatcctggaagcattaggttatttttactgttgaaaatttgtagatgtcattgatttaaatagccttgtatctttttttcttgctgttaatagtgaccctctgtgtccttgtgcacagaaaatgcaagtggaatcaagctttagatcattcaaataaaatcattccattgtgggaatctcctggcttcatttttaaaagttatattgaaatttaacatacattaagaaaaatgtgaatgtcataagggtacagcttgatgcttttttataaaatggacatacttatgcaaccaccacatagtccaagcaacagaacatcatcaccccaagaaactcctctcatgctttctttcagtcactttccactctcacatgggtaacccgttataacttctaataggatagattaggtttgcccattttgttctttgtatgatttgatcaacattatgtttatgagaaacatttatattgttgcatgtagttcaatttcattcattttcattgctatcaaatatatacttttccattgtatgaataaaccacattttttttatttctacctctaatgggtatcttgattgttattttagattttttaaaaaactcatatccacagttaaaaggtgattacacttttctaaaggatgcacactacatattttggaggttttcctagagacattatctaacatttttatataaaaatggagaattggagagagggtagtagaagggcaatgaggaaaggaactaatatttattagaactaccatgtactggacattttggtaaaaatagttgttttcttttgaattgtggtaaaaaatatataacataaaatgtaccatccttaccacttttaagtatacacttcagtagtgtcaagtatattcacattgttgtgaaacagatctccagaacattttcatcgtgcaaaactgaaactctataaacattaaacaactccttttttttcctcttccttttcttcagtcactggtaacccccattctattttctgtcctatgaatttggcttctttagatacttcatataaatggaatcatagagtatttggttttctgtgactggtttatttcacttagtataatgtcctcaaggttcctccatgttgttgcatgtgacaggattttcttcccttttaaggctgaaaatattccattgtatgtttgtacaacattttatttatccattcatccattggttgacatttgggttagttccacctcttgtctattgagaataatactgctatgaacatgggtatgcaaatatcttttcttaaaactgtttccaattgttggagtatataaccagaaatgggattgctagatcatacggtaactctatttttttttttttttgagagagggtctcactctgtcacccaggcatgagtgcagtggtgccttctcagcttactgcgccctccacctcctgggctggagtgatcctcccacctcagcctcctcagtagttgggactacaggcatatgccatatgccaccatgcccagctaatttttgtatttttttttttttagaaacggggttttgccatggtgcccaggctggtctcaaacttctggcctcaggcaatccaccctcctcggcctcccaaagtgctaggattacaattttacaatcccatcaaccttgcacaagtgttccaatttctccatgtcctcaccaacacttgttttcagatttgttgatagtagccatcctactgggtgtatgcagtaggaattttaccagtgatctttttattcctttaacaaagttgttgcaaagtataagtaccattttacatcaatgaaatcttagcacaaaaggattctataagagaaaaaatggggcacagggattttccagtccaggtgctcttgaacttgacaatgagcattttattctcaaagttccacataatcacaaaacaaattgaattcttttgttctgagctgcaagatataaggtgctctacaggattgcctgactttaaatatgaaataacagctttagttttagagtagtggttctcataacatggtccccagaccagcagcatcagcattactgcaaacttggtagaaatgcagattctcagatctcaccccagacctactgaatccagaactctgaacagccaagcaggtggcacacacctgtaatcccagctactcagaagaggggctagctctattaccgtgacctgacagtttagagaaagtacttaaatacatgtttcatttgtgggtttggggtctgcatatcatcctttaagtccaattactgctctaacttcatcatcatcatcctcatcaacaacaaaaaccatctgtcaaataagtaccaatagtctattatttgtattcttccctttttagtactcctaagagggccaggtgtttataaatcaaaagtctaatttaagataaatgttctctcacactgcaagtcatcctggaagcatcaagttaaaaaaaagagctttttaaagctattttttattgagacaggatccatgctggtcttgaactcctgggctcaaatgatcctcctgaggtttcctatgactgatttattttacttagtataatgtccttgaggttcatccatgctgttgcatgggccaggattgtcttcctttttaaggctgaaaatattccactgtatgtttgtaccacattttgtttatccattcatccattcatggacatttgggttacttccacttcttgatcctgaggaggattgtttgagaccagcatggatcctgtctcaaaaaaaaaaaaattctgcgagtgaggctcagcaatctattttaaaacagccctccaggtgacactcatgcatgctcaggtttgagccctcctgggtttagatcattaggcagatatctaaattattgtctaataatctccacactgttgccaaacagaaaactgacatattgagcactttcaggtttccagggcaacttaatagagtaaatctgtgttttgctctttataccacagttttcaggaaaatgttggattagcccagttataataatgctggaacactagatctctatccatctgaaagttcacccaaacactaatttatcagagttgcttctgaacaaatggccacctgagaatagccaccctaaccaggaagacttattccggctcagcagatatctgacttatctccaggattttcactccacccacacccaagtccccaccttttgtctcacttttgggtctagagagagccttgtaatgaatggaccaaaacagccagagatagaagtgaaagcaaacatgcaaacattcctcccattggcatcaggagccttcttcctgtacctactaccaaccgccgcaggccctggccccagctatcctcaaccacttccccagagccctgcaaagaaaataacaaagattcacagattagactttcctctgaaaagtgggggaatctgattttagtcctaggaagggagttgtggtttatgccttttttcttggcctaattattaataaaatactcccccaaagtatcctagcttaaggagtaaaattcaccctaccaaaaatctacagttagctccttttttaaaaaacagaacatttattgtgtgactaatcattgaaattcttaagataaactggatgctacaacagctgccctcttgggtttagatgttgttccttctcagaatccacgcctgaatctgcggtatacaatattcaggtgcctcattcgaccagtcctggtattatttcatctttaagccttggcacttcagttatacttcctcttgcacttagcagggtagccacatttgccacaggatgacttctgaaggtggcaggccttagagccacagtggtggcacaatgtgtgcgtcttactgcaacacttttcaaacgatggcgttcccttcagtatcttgcttctgtggccaagaccaaagagtgttgttagctcttaggtaggcttttgcctttccctaatgcttttaagtagaagatagatgatccttcagaggaacaggagacagtgcggctgtattcggtgcagcttggggccttgaaggagggaaacaagacaagggagttaattcctaggggtccttggagagaagaacaatgatgtctgggagtaggcatggactattgtgttgatagaaattgcagcccctaagaaaggtgccatggctcacacctgtaatcccaacactttgggaggaggccagagccggagaatcacttcagtccaggagttcgagaccagcctgggcaacatagtgagaccctgtctctaaaaaaaaaaaaaaaaaaaaaaaaaaattgagaaaaaaagagattgtgccctgcctggacccatagctctgttatgctctaaagcttccacccacatttctcatccatccacccctctcctctatcctccacaagtcactgatacttgagacttaagtctcaagagtttttcctaaggtgaatcttgtttctagtacagattgagcatccctaatctgaaaattcgaaatctgaaatgctccaaaatccaaaactttttgagcaacaacatggcaccacaagtggaaaattctacacctgacctcacatgacaggttgcagccaaaacacagtcacaattttgttttatgcacaaaattatttaaaatagtgcataaaattactttcagactatgtggataaggtatatatgaaacataaatgaattttatgtttagacttggggcccatccccaagatatatcattatgtatatgcaaatattccaaaacaaaaaaaaaattacaaaacacttctggttccaagcactttgggacagatgataatcaacctgtatgtatttggtggtaagcctaacaaaaaggtaactgcactgctttgtatagcacatctttaaaaattgttcaaatctgatttaaggtgctaatagaaattcaagcctagaaactacatttaatgtgaaaatatgtgctggccaaagttgtgtgcacacaatatgttccaattacttagcaacccccaaaaatattttacctgcatgtccactcggcaaaatcagccttctctctgccctcttccagcatgcacactgacactctgacactctgacaatggcaaggctggctgaaatcagcagtgaagtgcaggaatctggatgcttgccctcaccatatcctgaatcttggatgctttttactcctcatcttaacacatgccaatgttatgttacaatatctgacatttggtttgtttcaacattaactctgcgataaaagttaatcaacagtcagcttcattttccccgcttcctgcccaaatcaatatacatgactcctttgaagaaaggggaatgtaaactaaagttgatcctatggttttaacttacctcaacctaatgtatgcttaaggaaagaaccaatcacttacctagataccattgatttagtttctttgtgttgttgtgaattaataaattacagtgtttccactttctaagtaaactttttatcattgattagtcctcagaggcgaatttacttatatttactaaaagaccaaatatactgattttcagaaaatgtaaactgcaagactagaacatggtgtacatgtgtataacttgttttaagtatagagaatattaaattatatgttcatttcaatcttacaatcctccaaaagaactgcatggtttagatctataaaatgaaagataagagaaaacactactattaataattatatttgtgtttttaattttttttttttttttttttgagacagagtctctgtctcccaggctggagtgcaattctcccgtgttcaagcaattctgcctccagagtggctgggattacaggcacataccaccatgcctggctaattttttttgtatttttagtagaaatgaggtttctccatgttggcctgacctcaggtgatccgcctgcctcggcctcccaaagtgctgggattacagttgtgagccaccatgcctagcctatgtttttaatttttaaaaaattttaaatctgttctgtagatgttaactagggctatttatagaaaaggctgctgttttcatataaagtctttgatggtatcacctaatttcccttcaggaacaatggacacatttctcatccaatcccagcattgtatttgcttgtttatctctgaaaacttactctactgtttcaactggcatttagacctcctaccccacttcaagactagatgaaaatcagaggaatcaggcaactttgcctgacattttcagagcaagaaaattggtgaataaaatgggcctttctgtgcctacacttataattctcccccaaaaaagcattgaaaagatcaacctaatatctttactttataagtatcaataaggcttaatatgtacagacagtttaccaatgtgataatcaaatagaattgttagtaacaatgaaatagagtgaccatatttagaaaacatatgctcataaatgcttctcattcaaaatgtatgctttcaatacctaagctcacttccctcttttaaaaatttaaaaaataaaaaatgtttaagaaaataattttataataaataatgaaatgctttttaaatgttattagattcacgggtacttagagaggttagcacaacatcttgcgattggaatttagctagttgtgaacttgggagagttaatatttggttgtaatcatgaagattaacatgcaagaattatacattttacttcacttataaaaacagcttaaccatctaaagggaagaaaagagctaatgtgcttcattcagtatatgtaattacaatagggcttagggcagtgctttccaaattttagtgagcataaaaattatctgaagtagttttaaaaatgcagattcgtggctccgacccccgggattctaaaccgtgaattctaggatgaagtccaggaatatgcatgtttaacacccaaactcaccctcaaataactcatacaaaattagaattcagacccctcttggacaacaccaacataagatgacagatgtacttgttattgcatccgaaaccacagaatcatcagataaaatacccatcttagaccatctttcatatactttatattactttgctaaagaaccaaggtagatagcatttaaagggctgctgataaaagttaaggtttattcatttcaggtactatacttctcattatggtccttaaaaattggcccacagcttttaaaattgatatttaaaagtcatgtggaattggaattgtttcttaactttctgttcatttttactgtcttcaatattcccatttaatattgtttgatattaaaatataatggagtcacagtatttatcatctattcttctttggtttcaagggaagacgagggaaaacaggacctcccggaaaaccaggacccccaggaccacctgtgagtaaacaatacaatgactgtccctttaaagagtctgtctttatgtctgtgtgtttacctaaggattattttactcccctgtagataatgatttcctttattctactgtttagaatgactggtttcagcatttggatgagtagttcatactctctatattcctaactccatcatcaccacaaaccaagagatgagggaggctggtaattgtccatacacctcacccacttctttattacacaaatggcaataacagtagtgtctgcttgaacatcccaagccaagtgtccagatagatgaatcctgttctgaacctacctgaacaccatcttctagatttcttaacatccaggctgttagaaaatcagacatctggggaagcatatccacttttcttgatatgaaactattttgttagtataatttcatgatttggtaaaaagtgctataaagatcatctaaccagttagcttatctggatcctttaccccaagcttctagaaaaaaaaaatattcaatttcttgtagttctggtaactctgcagcctatgagagtctggtttgtgtccaagctgctccactgacactgcactctctgtggtcaccaacaatctctgcattgcagattccctgagcacttttcaggcttcttcttactttactgctacacagaaatgtatactattgactgctctctccttgaaactccctattctgttggtttagcaacattgggtttttttctcctatgcctggggccatctttttgtctccattaacagcttttcttctaccccctacatgttggatggattaatgaatgccagttttttatttcaacccagacattgttgctgagtcccaggctggtacattcctttattttttagtatctccacttggaagtctcctagctaccacaaaagtataatgtccaaaactaatctctaaaaataatcctagatttttttgttcttcatcctcttcatctaaacagtctctaaatcatatcagttctacatcccagtagcccacaaatcctctccgtcttcactgtcaacggccttagtttagacctctgtcaatttgaacctatatttttgaagtcatctgagagctggtctcattgcctctaccttctccaagtggagcaaaacctctaaatcatgacagcatctaggtgggcttggatggcttaaaattctctaaaagcttaaaactatttgattttaaattcctcaatcgcttcttttttcttcaagaaagatggattccacatcctctacatgccattctgggcccttcatggtttgccttttacctgccttggcctatcctcctctatgcccttccttcttttgtaatcagtaatcttcgcttactatttcaaaaatgccatcacttgcaaatgttctccagtaggcctatatatgcttctctctatcttcatgactcagctcaaacatttctcctatagaagctttgccagtgctctcagcatttgaggtttcctcccatggtcctgtatcttacacctcggacagacacggcatgttactttggactcttattttcctcatctgtctgaccactgcactgtgacttttttgaacctctattttctcaccattgcttagaacagtctctagcctatagcatgtgattattgtttatttaatgactgagtaacaaatgaatatattttgtagacgaaaaaattaaaaccaggtaagtgacctaaagaccaaaaacaccctgcaccaccactagagggcctcaacccagtaccctaggaatctcttaggatgtgctcacctgccaaaaatgaacatgattgctgtcctgtcattgatttcatttcactttagccattctagtggattgtcctattaacaatgcattggtgccaattgatatttgttatataaaagcacattgggggaatgagggggtgaggaagcatgagctgggtgtctgcattagtccattctcatactgctatgaagaactacctgagactgggtaacttataaagaaaagaggcttaattgactcacagttccacaggttgttcaggaggcatgactgggaaggtctcaggaaacttacagtcatggcagaagggagaaggggaagcaagcacatcttcacatggcagcaggaaagagcgagtgtgaagcgggaagtgcacttttaagcaacctaatctcgtgagaactcactcacaagacagcactagggggatagtgctaaaccattagaaaccaccctcttgacccaatcacctcccaccaggttcctcccccagcactgaagactacaatttaacatgagatttggttggggacgcagagccaaaccatatcagtatgctagaatctagtcttttaaaggcatcagttttgttgatttttatttcaaagttttaggcaaaacagagaacacattgtaagatctttaaaataattgtttcatgctttaaagaagaaaagctggtgaatgctaacaggcaagattagaccttcgtgtagttttctaaacctatgatgctgcttttaagacaggctaattgttgtctcaaaggaggaatttgaatgttgaaggcctttatgacaagcttgccaaatgtgtaggagagaagaggattacaccgaattctggaatgagttctcaactatagatcaaatgagtttactgaagaattcagaagattaaaaaacatgtgactgtatgataggatttataatattcaattccgcagactttagtttgttgccagagtgtttgggggagagaggtgcttatttttatttcaaatatagatttagaacttaaactcagctatgggtctgacacacagtgttcattaaatcctgggaacataatatttgaaaaaaatggtttattaactttttaaatataataaaatacccaatttgttagaaaaattaggaaaaaatctatgcagaagacaaagtgtttactttggtggcatgatctcggctcactgcaccctctgcctcccagattcaagcaattctccagcctcagcctcccgagtagctgggactacagctgcgcaccaccacgcccagccaatttttgtatttttagtagagacagggttttaccatgttggccaggatggtctcgatctcttgacctcgtgatccactcgcctcagcctcccaaagtgctgggattacaggtgtgagccaccgtgcctggccagtattcactatttttaaagtatcagcagagcacttgttatctcttaggatttcccagggagctatttgtattttattacaatttacaaatagcttaagagatgttcccccttaattgtggacatttttagatcaaaacattattgtttttcatttatatttcttttccaacattgaaccctttatgacatgcatcttactttatagcaagaaggaagtcaagaagagaacaagagacgggttggtaggatctacagtttttctaattgttactggagttagtatatacctcgccccagtggccagtatgtgagaatcctgaagcatgtgttagaatatcttatgaaaatgtgaaatgtattttttaaaaaattttaattttgtctcttgtcaaacagtaattaaatactatgtaatatccctcaaataagtgaatattttatatcatttaaacattatgtttgagcaattagtctttaggaaagttggagggagactttattctagtcagcatgattgtctgcaaagaacaaaggaataggaattaccaggaggcatgatttttttatttttttaataacagcatactttataagaaaatgttcttccctttgggggtttaagatgtttctgaaatcaaacatagtgttgttattcgggggagtgtcagtgaagactttaaaaatcttgaattgaagggactctaagtccccaatggcctgaagcaattcaaataaagtgttttaaccagtccttctacttgattatttgttctgaagccaaattagtatattctcagtttcttacaaaatgtttgtaccaaaaggacaacttgtttaccaaaataatttctgacaaatagctaagtgtgtgcgtgtgtgtgtgtgtgtgtgtgtgtgtgtgtgtaagaggacaacgttttgtcccctgagacattatatctcctagggaaaaaagatttctaataatggaaaatttactaacactagttttattaaactaacattattaaattatctttgtgaatcagtgtttcatggaaagtcatgtatatcactccaatttagcttaactattattcaatagcaactttttgtgtctttaggacttatttgaaatttatacacatgcaatatgcatataatgaaactattcttaatcagagtgcttgtcattgaacagtgactaacctggttaacagagctagctacaatgtatttttgtaaagtatttgtccaattccttgttaaaaaccagagctgatcttacctatacaaaggaaaaagctcccaaagtgtcccatgtaacttctgctatcttgtcctaagcgaatattcttcattggagggaaactattacatagagatctcttggatttatttcaatacataaagattacgactgagaacagtttttcagtatgagagggctaagcatctccctcgggaaggaaatagcactaactcctgaggaaacaggttcagaggaaagagggatgaagcagaccaggagaatgtattaccatcacgagctctgcattaagtactgtatttccagtgtcttagggaatccttacaactatcttgaaaagtagaaattatcttcattttataatggggtaaatgatacttggaaatgtcaagtaacttacccaagatgacacaagcagtgaagacagaactgaaacacaggaactgatccctaaacctttattctgccagacttcaggtgtgaaagacaagcttctagtttacagttcaactaagattattcttcctcaaacatcatacctagaacaatgtttgagttttccgttgcaatcaatggcactatcctgactccagacagcgagatggtataggatagcataggatggcggtgaggaacttagtccttctcctcactagcttgtcctggaacaattttcttaatgtttccttgtctccattttcttttctgtaaatttgaaataatagcacctaccccacctactttttcccacagtggctacaagagcccaatgtcattgatatgaaagaactttcttctaaatgtaaagctctatctaaatgtatcttagttccactgttattattctgaacacccattcacactgtagagagaagagattgtcttcaatcagtaattaaaccaacacttcttttctctctttacagttctccaaaaatctagttaacagaaatttgaatgtctatcaatgaattgctgaaataaaagatcactttgcatatgtcacacttattctagatacgtcatgaagagatccaaaagttattcccaattaggtaacaataacaaccaggtctaaagagtcagtgatgttttttctcccgagatttacagcctcttccttgcttgtggggcttgttcctttaccatctgagctgttgcattttattagttgtgatgttctctaagtctcaactgtccttcctcacactccaataaaagcttgtcttttttaaaaaccttccagttatctgagtagcataagcagtggaaagtaatagacttatgttatgataatgagacttggaaagtctcaagacttggaatgcctttgtttatttcaaagtattctggttttcagttcctttagaaaagagaggaaagcagctggaaatgaggcggagcaggagagaaagtaggagaatttaactaatgagccattaaaggaagtaggtattagcccatccatttgacattaactttacttctcattcatcattactggaaaaagcgtttattaaaaaccacactaatttaaaattgtgttattatttcttctgctacaggcaagactttttattttctttctttttttcttctggtattgtttttatgcattgtttcattattgcagtatgagaattgagcagtgggctccatttgtcacatttgtgtgcatagcaatttcagttgaaaacagaaattcaaaaaattttgtaacatggggcaacagctccatctactgtttccataggaaaagctctagtcaaagaatgacaatagctctttgaaggatgtcagaggaatggaaatttttcgatgtttgaagcttataaatccatatgatttttaaaaaattattttcaggattttgttacatttatgcttaccttgaaatttaaatataagtgctatttcatcagcagtcattttcaatgtcaacttgatgctcttttgaggtaaaaatccatacctacttcatggatctctaaaatgcccttctattgtacaataccaataaaactctgcagcattaatttttgggagcttactccaacaaaacatatgcttcttttctaaaacaagtctgatttgaaacatgtacattcatgtttctattttaattttaacttcagtgtagaacttcttctacctttaaagcatgaatcattgcacagtcctgaaagttacaattatacatcagtttgcacaattaaaagagtaaatttagggtgtaaaatttaatttatttactaaacaaatacttatggcctatctactatgtgttaatcactattacaaacattgaatatacagtggttaaaaacacaaagcaacaacaaactacagataaggtctctacctttctttataacttactgtctgtggtgaggcagtacaccaatggttaataagcagttaaataaatagacaaaacaatttcggtttagagtgaggtgctatggggggaataaactgggtaatgtgataatgatttggaaggaggagatgttcttctcattaccatctaattgaggtggtccagggaggtgtctctgagcagaagacattccttgagaaggagctggccatgtaagggccagagcaagaactttccaaacagaaatatcaggacttgcaaagagcttcaggtggggaaaagcttgatgtattcaataaacataaaggagctaagaaaagaatagtgccagaaaagatttgggagctgaatggcttcatcatatagggccttataagaatggaaaagaagggttggggggcaagtggagagatacacgtagccatgaaataaccagttacatctccgttttgtaagtgtgtgtgtgtgtgtgtgtgtgtgtgtgtgtgtgtgtgtgtatctgcagcggtttgatttttttatgtgatgaaattactgttcctactgattcaaataaattattctgaaggtaatattgtttttagcccattatctttagtctttgagtggacggggaataggcttgtttgctgaaagaaaacaaaattgacaaaggtttgattgtagcccatttaatttcagtcttgtctgaatccactggatatcactttggtcattagagatggagaatttcatcacatctaagtcttttctttttccccacagctaaatctgatgtttcctttctgataggctataggttgagtcagttgaacagttggggcaatgaaaatacataccctcaaaacgccatagaactaagtgccttccggcacttgtgcccccttatccatcgctgttctcaacttgagtatcttccgtctccaactttatttactatgcactgaaaactgaaaggaaagttattattttcagcatatagcaggacccacctctaaaacaatttagtgtcccaaaacacatttttggactgctgaataaagcagatgacaaaaactgtctcagtgaaacatttgatcacttgttaaaataccctcagaataccttgaatgtgactacatgcattttgaagctcatcatgtatcaatgggaatccaattcaaattcttaacatcccttctagaagcttgaactgatcagggcttagtcatgttgctcagttttcctttcagcaagagaaccacaatctcttctgttaaatgactaaagtctgtgcaatgtaatatcttcagagaaaatgaacctaacaatttatttgagtcaatgggaataggaatttcatttcttaaaaaaaagtaagatgacactttctcagatttaaaaatatagacacataagacctataaaatggagacatggctagttaatcatgtttattgccacttgtccctcatgggggtaatggtcccagacaaaacagctgttcccaacattgctaaaattccagtgtcaccttgtgtgaccacagaatacatagacatgcatgtgaggcagctggggatatcaggttgagattttgaaaactggctctcaggttttattttctaattatttctctttttctctccctacggacagcagcagtaggacattattagtcactttctgacttcctgtgttttttactaatagtggtaacattatggtggaaaaaatattatatttgtacagccactgactgcttgtttcatcttgtattatgttcttgaaaccaactattaagacatctggactgacatgtgttatttacagcaacgatgagacagactatttgaaatccttgatctgtggtcaccaaacttgtaattagttgtgatggtgcctggattcaacatcatttctttgtgttgggtaaacattaagatttgagaagtcaaaggccagtcagatttattagaaccttaattttcagaacgggatatttgtttcctaaataatcttatagtttgcatttgatgatatagtttccaagaggatctccatactgtatgtaattttactgctgtatatctttgtgaggtaggcaagaaaagattattttcatttaataagaatattctaggtcctgatgaataaggagctcagctcaatttttgcagtcagttttctctgcacatcagtaactatagcttagtatgatcaaagtaaagactgaaggaaattatataactagagaagcaacaagttttcagcattgtctaggggacctaaaacatggaagaaaagttggcagaaaataagatttgaagggtcttcagctatgtctgtaatgaattcattaaaaagtagaaagacccaaagcaaatatcgcaaaattgttaatatttgacaacataggattttggactcattgcaatttatattattttctgtacttttcagcatgcttagaatagttcaaattcattttaagaagcaggaaaaacattctatgggattagtaacagttaatatcactgattacttcttcactggctgatatcatcagtatcttctcctttgactgaaatcctttgtggaatggggccacgtgttttaaaactaaaattattaactattttttagaactttcctgagcacactgtctataaccatggtgttcagctgagccaagaattgtcatttgtagatttatcattagcacaacctatagataagggagagaccttaacatcacacatttgagttgaaagtgaggaccacaatcacccaattattccagagctgcccagaatgtccccagctattcaaattgtgcacatgctcttggcctctatgtaacttggcagtgtataagctagtgccaccagcctggttatcttaagtcccagcagtgtgccttgaaacttgcattttcttaactcaggaagagttgtcattctaccaacacttttaaagagaatgaatgttatcacctaattacagtaaatggaaactcaaagcattcataggtgtgggctgcctgtggggtccatgtaagccatctttcctccagattttggtggcatattgaaaaattcctgaggtcaaacaaggggatggaggcacagttgttcctaaggtatggtttttgttggtggtgatcttttgaggacaccactggatacaaataatttgtttcacacattcccctccttgctagttttcatgcccctgtggcttttatcaccttgtactgggtcattgatgttgcatctgtgggtggcaaggcactctaaagattcctgctgctccttatattgcaggacactgacaaataatatttttcctttttcaggacatactggggagagatgagtatgaaacattttatggatggataagcagaatagcagcattaggggaggaatctttttttttctaactatcatgccatggagatcagtcaaaatgtcccactctatcaataaggcagtgggctttacaccaattaggttgatatctggggaaataagtacctttaaatatatttttttctgccttagaaaacaaagtgttaaaaaatctacaagcttcctagcataatttagaaaatctgcttttatgaaatgggttaattatgcccattgaatgcattcactgtcacagtctcatcctcccacttctgttccaaaatgacaagtgaaaccagggactgtgcaattttggaagacaatcagatcacatattgagtattttgcttattcatacaaccataaacggcctatgcttgagttccctcaattacacagctcagtatgcaggccagaagcagacaagcccagctcaagtgaacactttcctggaatacacgggggaacgagtttgaaaaatgtccaaagtggcagatgtgaaaaattctcattcaacatccagagctgcctttgctgcaatccttcacctgttaatcgcactgcctctgaacttgtgaaccagggatgctagcgatatcttagactgagacacttaggagctatagatctttcaaggtatggtgccagtatatgccaaggtgggggaaaagctagcgagacaagacaagatcatggatcacagcactgctcagaattttcagacattcaccaagaataagcatgtcgctgccagcttccaactaaactgttattatcttttgtaggggaaattcccaaaagatgtccttgataaatgcttaaaccattgtactgtatcacttaaattcttcagactcctgcaatgctaatacacaatctctcctccacaacagaatacaatggcactattgtagtcttaagtgaaggatatttcattttccctgagtgagacaactttcccacaactgttatccactgcaatttcatgctccttggagtttctgtgcaccaaaatcatccccaagcaatatactctcttgattagctagtattttattccacctcctttgactatatttattttttcttttcttccaccatcttataagcgcgaaggctccttgcccttcatttggcattattgaaacctcaaaagttatttaagatgctggttgagattgttaacttccttccttttccatctcagcctaactctgatctttctttctcctgctctctttctagtagaagccctccatgattttgaacttccttgtgtctctgtgttgttcctctctcttatccttacccctctcccattctggtcactttcctcttgactcttcttgtcatccaagtctttctttttttttttttttttttttttttggagatggagtcttgctctgtcactcaggctggagtgtagtggcgtgatctcagctaactgcaacctctgccttctgggttcaagcaattctcctgcctcagcttcccaagtagctgggactacaggtgcacgctaacatgccctgctaattttttgtattttagtagagacagagtttcaccatgttgcccaagctggtctcgaactcctgagctcaagcaatctgcccgtcttggcctcccaaagtgctagcattgtgggtgttagccactgtgcccagccctttcaaaaggcatgtctacaccaagtctcagaccattcttttcttggcccttagtgattgtatacctcattaatcctgtgatctttcaccacacgatgccctgctcgattgtttaaaaaccagctttaagatgattggtattttattttcccatcatccttctcactgtgaggtggtttaggggaaagagttaaaagatcaaggcagtggggtcagacagacctgagttgaaacctagctcttgtctactatttatatgaccttgagtcagatatttagtcttttgttatgtgtaaaataaggaaacaccacctcactgggctgctgtaagagctaaatgcaataatgcatgtacctcacacagttgtcactttcaaagggtaactattgttatttattaatatttttgttatcattatcctcatttaatcattatttgccatcttctcattatttttgtctttctttcccaggatttaggaactgacatttccaaagcaaaagggttgatattttttctcttttattatcacctgcatgtaaatttttcttctatctgcttggctcccctccttcctattttcctctgttaaagtctttatagagaaacttcatccatctaagaatgttggcctaaatatatgcatatacatattcatcatctggaaaaactcattagattctattttcaatgtgaacaaacacacttgaaaacatctcttttaaattgagagcatttaagtttcataactgtattcttttgtattgaccaatgaatgaaacaggtccatcagattagcactgaaacatgaattttccctgagcttatttccatttgagtccccaccacttacaatccaagttaacctgaagacttggctcacaagtcatttctcaaagcctctttccagaaagtgaaagccctcagcctaacggtggtggaggcagagatgcagtctgcagagtcctcagcctccctttcctacttggtactgtcttctcctgtccttagcccccaagggccatccctttattcttctcctttcctgtcctacccgccttgctcttgggaaatatgtaatgaacaattcacatgaatctattagaatggaatgattttggacttggttctaccattcatgtggtttggggaaaaatctcttggttttcccatctgttaaatggaaaatataatactacccacttcagttggttattataagaatcaaataagataatgcattttacagtcacattaccctaccacccaagaaaatataagtgaaaatacttttagaattatccagagctgtgaaaacatgaacctttagtattatatctcccaggaacatttgcatttgatctggcagtaaaacctaacatcaaaaaaaataagacttttgttaggacattttgggcataacctggagagcaggcaagatatttgaaggaaaaagacctcctcccaggaacctttaaatttcacctatatgtggcccatgttctctagggtgacccatttaatcccaagtatgagagcttgaggtctctatattgaaatgtaagaataatataaatactcactgaatctgctcttggctttaggaatcacattttatagttcaagagtttctagcagttgttgttttttttgttttgttttttggtgttttgtttttttttttttttttggtggggagaaggtgttggtatccctttagtcactaaaaattctcaacagaagcattctcagaaaaaaaatccattacaattataactgcttaatttatgtaattaaaccccaagagacactgaaaaaaatttcattttgagtaaatattaagacagagaaaaggatgtgtgtcttttttaaaaaaagaaattgagtcccccaatattttctatctaaagaacattattgattttttcccccagaattactttacaacttatatgttgtaattctggtccaaaaatccatccatgagctcttttctacttaactggagctcactataactatgctttcaattaactagccacattcttaggttaatctaaatctgttggtcttgtcttttataaatttggaagaagcaagccctttgctctgtttgataccatttctaactaaaaccaaaaccaacaaacaaaaaaatggctttctccacagactttttcttataaaagcaatgattctaccgaattcaacaaacattgggtgctggtgatgggagacagatactgcagactgtagtgtgctgagtttaaaaggatcaaaactccttgccctcacaaagtttttgttgcaactgggaatacaaacatgtacataagccactatactcaatgtaaatgtgctttactaagttatgtataatgtgttatagatggaaacataaatgagagaaaaactcatttgacattaccttttccaaccattattattttttcatctcaccattcctatgtctgaatttaggcttcctaatgactgtttttttttcttgaatacaaagggaaaaataattactgatctctacttttttacaagccattagaacactggaaatgtttcttgaaaattagtccaaaggactttccaacaagcattctatctgttcttacagaaaagcgattttttagcacttttgaagagagttggttagtacaacttccttcacagaggtttttggtatttcaaagattgttcttgaatttaactgaaaacccacagggccaaaagcagctgtgtgtaacctgaaaacatgtaattttgaatccagaaaaaagcttccaataggagattgaagagctatggtgcataagtggcatctggatggctcaaggagactcagtcaacagagatgaagaggtacagggtacttttagagaaaagggagaaaggaaaatagttcaagattgaggatcagagagtgagcaggcgatttgactaaggagccacagagctcctgattcacaatgtgcagagtgtgctaaagctggatcagaaggctcaagctctgacttgcacagacagcttatggcaaagaacagtcagggaaaaaaaggcaaaaatattgctctttaggctaagtataccgggtgaattggctaaaaagtgaaaatgcagctaagactaggactaaggactatggtttttaacagagaactcttcccaacttttaaactttgggaatgtgcagccaaaactgaaatctactaagggaatgataatgcaaatagctcatcatttttacactacgtgtctgacaagtccggtggcagacatcatggtatttctgttttccacctccagcaagatttaagccaaaaactatttaaaagctgctagaactattgctgagagtatatacttcccaaattgaatatagctttaattcactttatcacacctgctgtagttctttgcagtaagaaacgacatcaggatctctatccacaccaggtttataggcctctcagataattatgaatcagtacagttaggttcagaacagttgtttctccctggagttcattagcatattttagctgctctgtaattgtatactcaccacattaatccagatgtcctatatctcccaatcccatacaaatagagtgaagcaaatctccgtaaaaaacagacattgtataggcatgacttgtgtacaatcatgttgtgggtcactgttataagcaagatattgggacatttttcctttccataaacctttaaccacttttcctagcagagctcctaagagcataagccaaggctgacatgccctctgcagttggcctctcttcaccactggacctgggtcatctaagtgtcttttgatgggtccttgtaaatgcaaacctcagagaaagggttctgtcaactgccctagagcatctacaccaccatgtgatgccgagagatctgtcacttaccacaagtctttaacttctttcttggagttgattggtagtctgcaggatagacaactcttgctaaacttggcgacaactccttggatcttctccagccatatttcataccagaatagaagatagaaaaatagcacatctcttgggatgtggctggtaggatagccaccaattctgaaaccccaaggttgtgttccaactgtaaacagagttgcttttgcaatttaaatgcttatagcttattaatgaccactatctttgacagtgttagagcaaccaagtgagacactgcctcactgactatagtcagagtagagggggacttccagaagactctaattggcatctctttctagtctctgaagggttccttcggaccgctaggagagtttgtataaagtattgcctgcagggtagacggttggctgtaaatttctgtcacattaaacttgcaatttgtggtacccaaactatcccagtgactaaaaaagtgagaaagaaaatgtcatcataaatactcatgatgagattaagtggtagaacctaaaacttcagatcaaacccatttcgagtactactttgaagataagacattttgtgacaaaagcagaacatatgaaaatgtagaagtaatttttatgggtttattaatcttgtggatatttgaataataacgttcaaccttttctgtagcctcattgctcttggcattgtttttagtgagttgtgcccttgcctttgtttttagagggagcagctgcactgagccgtgcatattctcccaccccacccccagtggtaagctcagcagcagccagatcaggatcctgcatgagaagtatatactttgcttatgaaatacagctatcttctgtgtgcatatgaccagtctgtaaaggatcatatcccatttcacccaattttttacaaatcattatcattctattgttttttactgttctcacttacactgctacctgttttattctgtgcaaaccctacaacacatttgctttcttgcttcttttccttactgcctcccagaaccctttgggaggcttcacacttcttgtatctcagaccacctgctctcccaacctctacaaacaaagataggatacatttgaatacagtcacagactaggagaaatgttttgtaatattcagggataatctccctaacatgggttaagagactgtatgaacatagatgggagatacaaggagtagataaagaggcctctctcaactacacggtatgactacagctaaaggtaatgtgttcactttcccgcctcctgcaccaagcactgtgaagtacctggcagaagtgctacgtagaagttttgttgattttttttcaatttcagtaaagtaaatagaacatagaagagtgatcacccagtattctctagggtacacacatcatcatgataagaaaattactgcaaaagtgatttttggctgagtttgcctttaagttaagatagtagagtagacgagaactggctttgggcccaatgctaatgttaaatattagccctgccacttaccagtggtgtgaccttggaccagttaaacatttccaaccctcattttctttatctttgaatcagagagaatgatgggacattcctcctgtcattgtaaggactaaattagttaattcctgctgtaatgcctagcacataataagcactatataaatgtttgctattggccgggcccgctggctcacgcctgtaataccagcactttgggaagccaaggcaggtggatcacttgaggtcaggagttcaagaccagcctggccaacatggcgaaaccctacctctactaaaaatacaaaaattagccaggcatggtggcacatgcctgtagtcccagctactcaggagactaaggcacaagaatcccttgaacctgggaggcagaggttgcagtgagctgagatcgtgccactgcactccagcctgggtgacagagtgagactctgtctcaaaaaacaacaacaaaaagagtttgctattattatttgactgattctgctactctatttgggagactgtattattaatttttatgctatatttaagagttctaataattaagaccctctcttttaactagattgaatatgtatgaagttaaatttacctacttcatcactgttctttgatctaatcagccttgtcatcaacacacactcactgaatgcctactatacatatacccctaagccacctcttaatgctactacatatggtgtctaaaattcctccttgcctcattatatgtttgcagaaggatcaacatgtatggaacttcatgtctcctgactttcaagaataagatcttaacttgcatgttcttggctagatactttgtgtaacaacccccccactcaatgattgctttctttctttacttcctctaactgacctagaattctttacacaatgctggctgctgaaaagttgcatgaaaaatatataatgccataagaattctcttcttacaatagctccgttattgtttcagcatggtaacagcatcgtttgtctttccaatcataggcaacaccattacttgtgaggcccattattttctcaagaattataccagcctgcttctaagtatccatcacctcattcttgtgccctttatgtttagtggcacaatgcaaaggttttatattagaagagatcttcagtcacaagctgctcataagaaacacctggtgtaaatgttaaccaacattaatcttttctgtatacctaaggtgttacctgcatcagtgagtgcagctaacgattgcttcttaaaatttttctccacttttcaaagctttcattccctttgaaaaatattaatctttgtataatggtgctgtttgattttggctaatcatcttccttctgtgtcttatcttataaggtaacatgttaagaacttggtctctataatattttctctcctcctagcttttgagttctggatgaaatgtgcaatctcttttctgagatagttgaacctatttgacttgaattacttaatctaaaataatgctaatctttgtgtttttttatggccctcaccccaaaatgtaatccctgaaaaacctggaaaagtcttctttcctttcttcctagaagctttagggacagccaaatgtatttgcttctttcctatccactccaagcccagcatagtgcttactgaattatttccaggtcaactgaaaactatcaatatttaaatttcttaagcctgagattttatagcacacatcttttttctggcccaaaagtccatgtgcatcccattttcttacaactaattcaaaaaagtaaagcaatagaaaaacattttttcccaatttactaagttaataacatgtgggaacacacagttctatagtacattgatcaaaatcctgtgagaagtgccaaaaataaactgaagagttataccctcttctctgggagggtcttatgggtataattcctttcaataaagaatatgctgagggctgaccttctggtaaaatgttacatgctcccacttaggacctctttttggattcatgcaggatttaacctagaaatatcttaggaacctgatgataagttaatgcccgtgtatttctctattaatcagaatatttgactaaatagacaagtcctttttcttcactatatgatttcaagagttcttagatatgttatttaaatattcattgttttggtaaatgtgtatatatttgtctttgatttgtttataatacagggacctcctggaatacaaggaatacaccaaactcttggtggatattataacaaggataacaaggtatggcttcttttttcccataatttataatacatagaaattttatatgattgtatttttgaaaaaaaacttattaattcctaacttctcagacttttatacatgatcacatgtatttaaacatctttccatactgaaagctatgttttcaaaaacaaaaataaaaaaagtattctgttcagtatcttacaaatctagggttttatcctaataagttttttaaaaattttgttcaaagattgttaatgcaaaacattgtgttccaccatcaataatatcatagatctagcctctctgagggcagaaagaaattatttgatactttgaagctctgggtagcacaacaggtgatagacttcttatcaaaaccaataggtgttgcgccaaaatctcaagcaaatatttgcatactacagttcaagaatgagagtccccacctttcatggggaattacattcaatttccccacggttttttttaaatcacatttgggataggcggaatgctgacgtggaagtatccaaatggcaaaagcaagggagttttgttccagattctacaaggagcataatagagtggcagccaagagaagatctaggtgagatcattgattgattcatcattcaatgacaaatatttggggtctgatcactttgtgtgaggcattctgtccactgattaggataccttgtatacataatggttcatcattgatttcttgcaccacagaaagaattggagacacttccctttatgtctttcttttccatgttcttactttcccttcctgtaattttttctgacagctgttactcctctttgtttagaaatcccaaagagaagtgtcaaaaaaatttgttaaatgactagctaattataaaatcccagtttctctctcttcagaacaaggtcaacataaagacttagataatttatggttgacaaatttaaaatcaaatatggaaagttttttatactttataaatttgatagtgatgctattttaaattatctcctttatttaggttttccagggagtattatattaggaagaatgtttgggatatatttcatgtttccttattaaacacttctttaatttctcaacctactcatctgacaaagggctaatatccagaatctacaatgaactcaaacaaatttataagaaaaaaacaaacaaccccatcaaaaagtgggtgaaggacatgaacagacacttctcaaaagaagacatttatgcagccaaaaaacatatgaaaaaatgctcaccatcactggccatcagagaaatgcaaatcaaaaccacagtgagataccatctcacaccagttagaatggcaatcattaaaaagtcaggaaacaacaggtgctagagaggatgtggagaaataggaacacttttacattgttggtgggactgtaaactagttcaaccattgtggaagtcagtgtggcgattcctcagggatctagaactagaaataccatttgatccagccatcccattactgggtatatacccaatggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgacttcatgtccttgttagggacatggatgaaattggaaatcatcattctcagtaaactatcgcaagaacaaaaaaccaaacaccacatattctcactcataggtgggaattgaacaatgagaacaacacatggacacaggaaggggaatatcacactctggggactgttgtggggtcgggggaggggggagggatagcattgggagatacacctaatgctagatgacgagttagtgggtgcagcacaccagcatggcacgtgtatacatatgtaactaacctgcaattgtgcacatgtaccctaaaacttaaagcataataataataaatttaaaaaaaaaactaaaaaaaaaagtggtttatatacacagtggaatattatttagccataaaaagaatgaaatcctgtcatttgcagcaacatggatggaactggagatcattaaaaaataaaataaaataaataaggaaaaaaaactgtactggctttttcaaaatattaaggcttagcacaagtgaaaaaaagaatgctgaagcatgtttaaatttaatcaatttaatgacacctgtaatgacacctgctgttataaaataggatttatcataaatgcttcaaaataatgagaataagttggctctgatgtcacagtgtcagctacaaaaacttaaagaacacactatattactatcgcccttggtataaaatatacctagttgctacttagctacttaaatatttgctatcccttgcaaaacttttaaagctcacatctttacaggtctcccaaccctacttctctatacagtttatcttgctgatgagtcagttttcccttaaatgaagatatatggagcatttatattttagagtctaaagttgagaatgtaaatttttaaactttaaggttatatttcaaaaaaaaaaaaaaaatgggcactgaccagagcagctgagtggaaaatcttgctagtaacaaaccagtactttgaacttaattattaactcacctaaaagaaccccagttattcttcttgccattacagaatagaggctcacaggtatttagtccacgtgttctctaaatgtgactttaaagctggaatatgactggataaacagaaaggagtatagctgttatcccaaatgatgcactataaccatttagcattagaggctttagatccatctgtgaattaagagacaataacttaccaaacactttattctgtttcctttgggagtagttagagcccttacaccaaggccccaccaagaaggatggaggtggtgggacccactttcccagcacccacactgccccatgcttctgtattgtaaccacctcctcctcaccctcagcttcataagggaaaagccaaatgtgctatgatgagcacgatgcatgttttccattggcattgtctccaccacctacccctgtctgtttttggacactgagattgcaatttgtagtgtgccagatggtctgactgtagcaaataagcacagagaagtggggcctgagtgaaaccttcctagagattaaataatggaccatgtattgagacatagcaagtgacactccaaggttaaaataatcttcccttttaaattggcattgatttatgtgatgtctgcactggagccctagacctcagctcttcaactcacagtggcttcaacagtcacacagcccagattctgctgaagcaactacccatgggagaatgagtaacagactactcataaactgcccctcctcattccgagctcagagagcccatggttcattttccggtcccaggatcctcacttgccctctggcccccatataggaactgatcttttcctctgctattttccttatgtcatctggagggagaagctcaggtatgagaaaccctctctcctcacagcacaaatccaaaaagggatggagaaggaaaaaaaaagcaaatgaggaagaaaaaaaaagcaaatgaggaatagagagacagcctaaggagtgaggtcaggaagatggatatgagtgtgtttatgtggatttttgcatgcctacttatggatgcaaagaataaaaggtagatttctctctctatcacaaaaataatgtgcaaaacagctgctcccattctgcaagattgttcgcaaagaagcaacaatgctgagcatattcttcccctcaaggaaaatctgctcatgttccagtaaactgcacttcattgtttccagctctgggggttttaataaaaatttgataggctctgtcaactactgaagccatcagacccacagttccttactacactttaaatggagaaaaaaaaatacgttttatctgcggaggccaagtgctggtggattttatatttgatgttgtttttaaagctccatattgaaaatgcagagttgtgttatcttacatcaccacactcggtctcagctgttggagatttatgctgtgcctcccagcaaccaattcttgtattcatttctccaaattattgatccaaaaaaaaaaaaaccaatttgctagcaaaataatctatttttcttttcacatattaaatcataacttcactttaatatccacagactagaaaggacagaaagcctttatccaaaatccaatagacaaggcctttccaagcagtgagttaaacccaacgatggcatataaagtgtaggctcccttggagacactgcaggcaaccttcctgggcccagaagattgagaaataaagtttaggttctaacttcattgctctccttctctgtgccccaggctccactggctttgaggaacgttgtggacttaggcacagacatatggactttcagatgttggtttgattacagacagccccccaactcacctgagtcttcccttcctttcatgaccctccacacttgcggctggtgaaatggttttttgcagataactaagaggttcggctttgagccagccttaggccttattttcaagtgagcacagctttcctagcccacatattatgttttaacttgctagggctgccacaacaaaatatcacaaactgagtggcctaaacaacacaaatatatcatctcacagttctgggggccagaagtcaagatgaaggcgttgtcaggaccacgttatctccaaaggcactagggaggaatatcttccaggtctctctcctagcctctggtggttccttggccatcttcacttcaaactatagcaatagtgatctgaatgggtacctctgtatattttgttgtctaaatatttctgtaccttttaagttttctatcagcacatgtatttttaatcagaaaaataaacttaatggaaaaaccacatgattagagattactggctcatttgcccaacagatatttattgaatgccaggggaggctttcatgaatggcatttcataatagttgagacttgattaatgactagtttctggccagacaaaaaggtgagggcaaagagtggtgatctggaggctgagatgggaatgaccttggtcagtttagggagctgaaaaaagaccatgacagctgaaacttctgaggaagaagagtgaccaacatgatgctggagagggaaatgagttcaggtcatgcagagatttgaaggtgatattaaagttttgagaaatggaggccagaatgtcttttgaaggtatttctctgatcttatgtagagaatatgtgtgtcaggaaagcaagagtggattgtaaaaggccagttagagactcactgcaatcctggcaagacatgatggtgggctgcctgggtataggcaggttgactctgtctcttaagagaagagaaaacatttggggagacagagtcaaccaaactggatgactgatcatatacaaggaataaggatgagggtgattatattagtctgttttcatgctgctgataaagacataccctagactgggcaatttacaaaaggaaaacgtttcatggactcacaattccatgtagctggggaggcctcataatcatggtggaaggtgaaaggcacgtctaacatggtggcagacatcagaagagtttgtgcagggaaacttccctttataaaagcatcagatctcatgagacttattcactatcatgagaatagcacaggaaagactcacacccatgattcaattacttcccactgggtccctcccacaacatgtgggaattgtgggagctacaattctagatgagatttgggtggggacacagccgaatcaagtggtattgagaatgacactcagagaggaagagttcaggttttctttctttccttaattgttttcaattgtagaatggaattcctgctcaatttaacaagaaaaactccagagatacattagaaaaaactgattctttttctcccatttctgtactaaacaatgttagcagcgtgatgtaactctattttgttctctcatatgtgtatttgttgcattttttgtttcagttttaaacttgttgactatgaattgcttctagaatttacaagtacatacatcaagtagaaaattagatatatgggtctaaaattcctaagggaagtatatgcggggaatataaattagatatatgggtctaaaactcagaagggaagtatatgctgggtttataaatttggctgtgtaaatattacctaagccacaaaggtaaataagagtgctggggagaaagtgttgagtcacaaagaagaaaatcctgaggaaatccaacctctaacagatgagggaagacgaagtcacagagataggaagaaaccaggagagtaagctatcatacaagccaagagagtgacaagtgtagcaagaaggtcgattactgaagagtccattagagtaagcagcaaagatattattattaacattagagggccacatcagtggactgatcggggccagtgtcaaatacatatgtgtttaggagtaaacaggagttacataagtggtgtcaaataaaaaattgcacctgacaaagttaaacaggcaaggaagacattattcaaggctattgcaataggagagagaaggtagacttagtctgagctcaattccactgaaacaaagttcaggagagtttttaagtattgatgtaagaaagagaacacacttccttgtgtttgctaattggctttacccaaaggaagagtaaactttctcatatctttgtgacaggaagaaggtttacaacttggcacaaggctgaagttaggctcctaccctcccacagagcctggaagatagtggcactatcttctccatgattacattttaaagggatggctcccagatccttgagaaagacgttcccagattgtaaaactaacaggaggcttttagaaagatttacatctcaaagggatagtgaaagaacttacaaatacagattttctaaagcgattggtctagaaaaagagagatcagggtatggaattaggaacaagcctgtccaaagttgattccagctgagggaaacattaaggctgtcttggtcagtggacgcaaaaagcactaactacccttttgagaaaattgtccagaaatgggaggaaagagagtaacttaagggaaatgtgtgctggggaactatatgctctttgtgtgttaagtttaaagaaggtagaataggtaggtagtcagagagagaaagagaagtgttaaagaaattggccaattttagctacattttacttaactttaccaaattggccaatttcacctgatagcaataggtaacattaataaggaaaatctcctaagaaggcagaaggcatgggaatcagaggatttatagaggaaacagccatgataagagatgagacagctcattaactacacccagatgtgcatgcacatgggttggtacattcattagcaggaattagaagtggtgactgaagcctggcgcagtcgctcatgcctgcaatcccagctcttacggaggcagaggcaggaggatagcttgagcccaggagttcaagacctgcctgggcaatatactgagacaccattctccacaaaaaggaaaaaaataaaataaaataagtggtgcctgagaacttgcatttttttcagtgtagttacaggcaaggtcacttgcccaaggactgtagagtctaatgtagtggtctgagaacaataaagaagacttgagaatagggagagcagatcagagatgctcagatacatggagaggccagttgaagtggccagatgtggatttggagtagtgagtatttatccccagaggtgtgatgtttctccagaagcaatctccttaagaagtcacaaagaagatgcatggggtgtccaaagctggaattatttagaagaatatttaacaggaatatttaacaacaggcgagagagacaaagatgtctgcacaaatgacctagtatccataaaaagcggttacagaactattatctgactgcttatactgttacagattgaatgtgttaaaaattagcggatttttcttttgtattttaaattgtttttcacccctagggaaatgatgaacatgaagctggaggcctgaaaggagacaaggtaatcagattttttttttttagatggagtcttgctctgttgcccaggctggagtgcagtggcacaatcttggctcactataacctccacctcccaggttcaagtgattctcctgcctcagcctcccaagtagctgggattacaggcatgtgccacctctcccggctaattattgtatttttagtagagacagagtttcaccatgttggccaggttggtcttggactcctgacctcaggtgatccacctgcctcagcctcccaaagttatgggattacaggcttgagccactgcacccggcagtaatcagattttcaaagtgaatagaagggcccagtattttatacggacttacacattcccacgtagggggcagccccctggcagcagttgggttgcatctctgggagggtgtccagcctgcagtgggcaggggcctccgcctgcctcctgaccaggcagtaggattcgaatctgcttcagggtccagcaaggactgctgagtagcagttggctataagaaagagaacatatcaaggggaaattactgtaataagataaatgaaatcaggacacaagacttgttttgtaattaaatgtgaatccgtgtaggtggcaaaaacaatctgaagacccctttggcaaaatgcctcaagcccaggctcactattttgtgtcttcctaattaccaaaacataagctgccctggcagccatttttggtggggttttatactgtccagtagtggtttaaccaaataattatttcaaaatagttttaaaactaagacactgataaatttccgttgcattccccttgtcatttgcaggtttaattatcatagctgtaaagatgacagattcacttccccattcaataagatgtttcactcctgtttgattctgaaattgtaatgaccttggattccatgtgaatgtgccattgtcagaaaaaaaatgcacattaaatctacaggcagagatgagtagtttgaaaatactctgagggaatgtggcctgtgagtgctactttcattcattcacctgtaaaaattctctagattgagggcaggggattttgacatgaatccaagaaaatatgacttctgtgtcttataaatcagtgcaaccaatccattcaaaaagtcgtacacccatcaccagaagttactgctaaaagatagtctcaccagaaactaggagcttcttacagattgatgattgaaaatgaaattttctgctaaataaataaataaaggcttgacattctgaaaaagacatccaaaaattgattatacagcaatgataagtcatttgtgtgagttagattttattgctagtacattaacattatttcctgtaacctaatagctaacagaaaccatacgccaccataaccaacgcattacattttaagcaatgacttctggacatatgcaggctaaggggaaaaaaaaggaaaagaaagccacaaagcttgtcacataggacagctgagcaaagaagagtgttgtgacttttaaagtatttaaatgatgattcatttcttgaaacaaaacagctgggttctgttttgctgtgttcattaggaaacatatgttacttagacattcttaagacctcactgatgagaaatttgattctgtaaaacaggtgtgtttcaaactctaaggaccttttctattgctcaaaatcttttctaattgcttcagaatcttaagtagaattaggaaaagccagtggcataactgttccctcctctcactcaaataaataacacagaaaagtctacagggaacttgatgcagtacatgatataaagagacacataaaaaaacttttaaaaagcgtgattaacaggaaattgccaataaacaatgcataaaataaacaaaaattacaggtggtagctcgcacctgtaatcacagcactttgggaggccaaggcaggaagaacctttgagcccagaatttagaccggcctggacaatatagtgataccccatccctacaaaaattaaaaatattagctgggcatgctggcaaacacctgtggtcccagcttcccagggaggctgaggcaagaggatcacttggagccaggaggtagaggctgcagtcagctataatcacaccactgcaccccaacctgagcaacagagcaagaccttgtctcaaaacaaccaaccaaacacaaacatgagcatagcagttgctggaagggtgaaatcaactctacctatgtaagtctacttagtatctcttctgaatcaatacattagtttttaaaattataatgtaatttaatgtaatgtaagtcaccacagtgaaaatttaaagctccatcaagctgttctcagagatctctgttgcacctgtggcgaaccccagtgcttctgaatcctggctgcacattggaatcacgtggaaagctttgacaaaatacccacactcaggctccatccacagagactccgatttagggtaggggtcttatctctatttagaagtgtttcagatgactctaatacacaaccagggctaagaaccactgagtaataggaagagcatgagctttgggacaaaaagttgattgtggcattaacagctaggtcaccttgggaaggccacttcatttctctaagcatgcatttcctcattcacaccatgggcagaattgtatctacacaaagagttgatagaaggattaaaattaaataagaggaagttactcaaaagcgcaataactaaaacacatataaagccctcactaaagatttgttcttttctattcacccatctcaatctttccttcctctcatgaggtctcatttagcacttttgaggattaattgttgttctcattcttagcacctggtcttgctcatctttgtatctcccaccataattttgacaaagaagggactcagtttgtgctgtagaataaaatatttaaccagaagaataattaaacacataagtgattcaccattcctttataatatgctacttctcaatgcactgaccagcaaaatagaattactaaaagagccaaccctttggaacccgacactacaatgaagcaccaggacaagcacaaatagcactggaatatacacaccagtcacccctggtttagcagccacatcctgtatcaagaacactacgatacagggagaaccacgacttgcagtaaatggccatggagaccatccacatgaccagtctaccagtgtggaaatgaacgatccctgctctgtggcttgactgagactgacaggatgtggtgaagggataatgtacttgcaagttacttgaggagaactgctgctttatagagacagtagaacaaaatatcagaatatcttagccctcctgagaaaatagcaggtgtcttgtgaggaagactgtcagggaaaaggtggagtcactacagcaccaagctaatagcatcgaaagtgtcaaactgaaggagagtctttcctaatgcaaagtaacttcatcacttgtgtttcaactcatctctacagtgataaatcactgaacattcaatttaaataaaaaatacaaacccatatgtgtctaaggttcaggtagaaaatgcttttgcttgcagaattttatgaggaaagaggtctctaagatttccttccagcccaatgtcatccaacgactatgtggaaagatggactgcaaccccttttttgtcctgcccctgtttacctgtagagcagctatgaatatacttacttttatttcaccatgtacattgtcctccccttcccctttgatattggcagatttgatttttacaagcaattgctagactccttctcagctttctacttttattttattaggcaagtctaactagtaggcatatttttccttcacacctatacaatggaaactgtagcacctaccagatgggtaacacgaaggtcactctgtacaccctaatgcctatacaagtctaattgtttattttctctatcaaaccaacaacaatttgttcctaaatgtatcccccaacttctcccttgccttaccttgaatataatttactatgtctaggaaaaaaaatggcttctcttataatgtggtaagaataagactgatgatacacaggatgtttagatactaccatagaaaaaaacaatacttacgtagcttcctctgaattaggaaaaagcctgtatacagcacactaaactttaaatttgatggatattgcttcaaaaggcacattgaatatttaaattaagaacgtgagtgaattcagagaaaaaataagctacatatatataggtggtatgtagacatagcgaatattacacagttgggatgcggatgactgaactttgggaaacactgctgtagaatatttgtactgacaggtctgcaagttggcttcttatccatttggttccttggctctccaacagggccttactattactagctgaaagcctaatggtataaaaaattagtactgaggtgagtcagaaaagcaaacacttctttcctagtatcaactctcacagcacaaaatacttctatgaccaaatacatgaatttttcacacacagcaagcaagcaatcagttttgcaacagacaccagctgattgtcttctaattccattcaattctgacactatttacctggtggtagcaacagatcccacagattgagggctcaatcccacaatgctgccttccacttcatatgccaatcgaaagccccgtgttgttttatctgtgcttttgaccaactggctataaatcggggtccttatgaccccgtccgcggcactaatttgctggaatggctcacagaactcagggagatatttacttacgctcaccagtttattataaaggatgttacaaagtttacagatgaagaactgcataaggcaaggtatgtgggaaggggtgccaaggttccaagcttccatgccctccctggtcatgccaccctccaggaacctctaaacttcagctctacagaagctctctgaacccagtccttgtggtttttatggaagcttcattatgtaggcgtgattgattaaatcatttgtcactggtgaccaagttaaccttcagtctctctcccctccccagaggttggaggtgaggctgaaaagactgtaatcaagccttggtccttctggtgaccagcccaatcccgaagctacctaggggctgccagctaccagtcaactcattagcatacaaaaagacgcttattgctttggggattccaaggattctacgagttgtatgccaggaaactgggaggaagaccaaatatgtattttacaatattgttatcaagcagatgggctcactgcccactgtgcaccgaagccaataactatggcaccagcttttcagaaaagaaagattgtattgcaaaatcagccagcaaagagaccggaattgggcttaaatttgcctcctggatttggggattggggcaagttttaagggatcagagggcaagggacgggatttagggatgttagtttggcagaatctgattggacagcttcaaatttgaccatttatggtaaggtatgttgaggcagatttttgccctggatattccaggctaatggacttccatgcttctgaaagagttcaggttctggtcatgtcccggtcttcttggttccacccagggggtggaattgttggttccagctgttgttacaagtcaaagctttttctgttatgcgtgcctaggctgcatgacttgcagttttgggctctgttataccttaaaggtaacttgacattttgttatcaacagagtaggccctgtttgggctggttccacagttatactatcacatgaggttttaaaattttagtaaaattaagattaaattaaacaaaacgtattccataaatctagaagactaattaatacaaacatgatcttgtctatccattacagaaaatcacaagacatggattaggatatacatataaaaataagccaaagattttagggctgtagtaaatttatacttgaagcactttttggtagctgtttgaggcttcaaaatgaacaattaggcacatccacaggggtcaggattagagatgttcactgcagccttgtttataatagagaaaagctgattacaatcaaagtgcccatcggtggggctgagataaacgctggtttattaacatgttagaatgctactcatctgttataatgaatgaatgagatcatatgtatcaatagagatggatattaaaaacaatgctgagtggaaaaaacaagtcatagtatgttatttatgagataaagctatttatggaatttgtttcaaatattcaataatatattgtttatgattccacatatgcagtaaaagtacaataatataaactgaaaatataaatactaaattcttgagagtggctccctctgggtggaaataggaaatataggggatttcttctttgtaaattttttaatttctttcattttgggtacctggtacatgaaggcttggtgtattctactttattatgttttctgtatttattcttttgaagtaaaaaaataggccaggtaggcaaaaacggtatatgctcagaaatgtaatggtgaacatcattttgcaaaaatgctcttgaagttagggaaaaaaaatcagcattacatatcttctagagactatgtttaatttaagaattgtgtaggtattcagagatcttggtaaacactaaaaggatgcacaatgctgagactcctctgaagtctcattagtgatataactcctttcttaagtattacttctcaaattatattttccaaaaacactctttatatgtcacatacagatctctcttcaaggtttttgaccagaacctcttagacatttctaagctactgctgtcaccacatctacaagaatgccttatttgcccacagccaatcatctaagtagcattataaaccctggaaacagctgagagactcgttttgcttcatataactgctgactctgcccacctaaacaaagaaaaaagtgcctgaaataaaatgagtctggattattgtgccagttaaacagtctgatgtctttgagatcacacacaaaaaaaattggttttggcacaccagaacaaaattataatttttctcctctagatagatattctttcctggaaaaataattaactttgtttcacattacatttaagtatcataatgaaatatatggatttctaaaagacataaagccattgtgaagtactgacaaacacattatcataaaaatagcctaagtagattcagaactttgcattgtctgttggatgctaatagataaattgtatagttagcaggagagcaagcaatcattctgtatctgacagtcacaataatgcttctctaaccatctgcaaaatctctcttctgctttgtcttgaaagggtgaaactggactaccaggatttccagggtctgttggccctaaaggacaaaaaggagaacctgtaagtattttagctttgaggacagaggaagaatatctaaaaaacgggattaaaaatacgtttccaaatcagccccaattccacgtgccttggttgatcctgtcatgggaaacaacagatcagatcttcaagcaagtactagctacgctatgcactaagtctcttacatgtatttacacacttaatccataaaaagtttccataaggtcatctattatcacctgcatacttcaaatgatgaaagtaaggcataaagaggttaaaaaactttgcccaaagtcacacagtactaagcattggagctgtgaatcacacctaggtgagttgattctagaacctaaagtttaaaatcacaaagctcctctggtataactaaacactgcagctaaaataataaaatcaatgtatcaaaagactagtacaaatttatccaaaagaaattggaaacacatctttctgctcaaacaactgttctcagtgtaccttctgaagttatttttctttcttgatttttgtatgatcaaagtggcttcccaaccactttttggtattactgtggccagtttctttcaaaatgtagttctttttgtggggaaaaagagaaaaaccctacagtatcatttatattcaaataggaccacctaaagtgattagagaaatcataggtacaaaaaatgacttgttttaatgcttcttttaaaaaagcagttttcaagaatcagtgagaatcaggcttaacaaatgtttcatctttgtttaaagaaaagtaatacatcttattaaaccactctacccctttctttacgagactgaataaaggatattggtttatcaggggataaaacatgaagaggtcactaaattgcctgcatgacaaacaggaacattatttaaagtattcagtgttacaaagccaaattttccctatgcttcagctttaaaaaattaacaatgacagtaatttttgcagctttagaatcagtctgtggcctatgtaccccagttcttctaccttcaggagtcgtgcttgcccttagtattcagttcaagccttcttacacaactacaggatttggcagtctttaatgaggttctccaactgagtatttgcaataatgtctggaaaatctcatgtctcagaaatccagcctggtgcatgcccctggtacctgccaactctctaggtgctccacacttggaggttcctcttaccatctcttagctgcttctctaggtctccactgtcttccctccaaacctgaacactgacaccaaccttctcttaatttccacatgatgcatggaggaccctgcagtaagattaataaaaattttactggaaaatcgaggatttttagagcagaaaggagaaactttcagtgagttagagcggtgcttctcaaatgtgaacatgcacttgaatcccactgattctaagtcagtaggtttggaagcaggaccagagagtctgtgtttctcataagctctcagtaatgctggtgttattggtccatggaccacactttaagcagcaagggttgaaggagttcatagttcctaggagtcataggccttttcctcctgcagggatttcctctggctttctttctggctaactttcaagggcagtccatgtatctcatgaggactgcctttagccctgttttccttaaatagagcttcttttcctcctaactcttctccataccaggtccctattcatcccttaattatcccaccaccccatacatctttacttgccaccttcctctacccctacattaaaacaacgcaaattttacattattacggagagcagtttagctttttatggtctcaaactttctcttccagaacaggatgtagactttactttgcataataatcagaaggcccaaacagaagagtagtattcattcaaaggtaaattctgaaccactgatcccgaatggtaactaaaatggcaaattttcccccaccataggacattcagaatatggtttgatgtgtaacacatcagagctaaaatatacttaagatcacctagttgaaccccatgattttatagataaagaaaggggagctctaaaagattaagtgacttgcctcaaatagtagccattggagccaggactaaatatcaagtatctagacaactaggctcccgggtttttctctttttttttttttcttttataaccagttactttagtcaatgtggccactaaactttacagtggctgtaaataagcaatgacatgagcagtgtcatataagcaaaaacaagcagggaaataagaatataaataaagccttgatctaatatatagaaatcaaccactattaagatagttcatcatgttgggtagatatgggtatatagttgtcccttggtatctgtgggggatgggttccaggactctcagaggataccaaaatctgaggatgctcaagtccctaatataaaatggcctatttttatttgcatatcacctatgcattctcctgtatacttcaaatcatttccagattacttataatatatattacaatgtaagtgctatgtaaatagttgttatactgtattatttttaaaatttgtataatttttattgctgtattattttttattgtttttctttttcaaatattttttatccacaattgcttgaatccatggacacagaacttacagatatggttaacctcttcaagtcattttcattaaagtaaaaataaaaactaggaaactatttttaaaataatgagtttgtatatttaagcacacaattaaccaactggaagaattcaagtgaatgtctttcccttcaacgtttttatcaatttcttgctgtcattcccatttcacattcaattggatgtgtgtgtgtgatcgttttctatgtggactaggcaataggaagctttggccttgggcagcattccaatttgtcagccacttgggattttataaatgatgttagaatgattaactcattgttcatttgggaatataaaggagtttttaaattaattatcatatatttcctttaagctgcaaagacagactgtgtgacactctgggtatttttggaggtctgtttgcaatgggaatctgagtttggcctatagggtttatccacaccccggtttggagagtttatttctaagagcgtttaattctattttctaccccttctccttagggagagccttttacaaaaggagaaaaaggagatagagtaagtagatattttatcactaccttgggttttctacttcattgatttgtttctctctgattttctggtatgtttactttggagtctaatagatttgattaaataaggtccatgagcattttactttttcctctgtgatttttaactcttttattttgataaataagaaattttaagccttgttaactgttgtcatgcaaggagacttcaacattggtttgagttttctaatacattgtttaaccagttactaatagtgattggacatgaatgttatacaagacatccatgtaggatatcaaaaatataaaattaaaataaaagatacatttttttccaaaaattctgttaatggcacaaagtggatttatcaaatatattaataagtcacagaaaatttaaaaagcaaacttattatagccagtatcatcctcttttgtataaccttaattttgttgtgatttttttcattaagcacatataactaaccattaagcacatataactaaaagtagaatcaccaacacatattaccttaaattctactctccctcattctttctctgaagttttaattctctgggacatgagattagttggtgtcaaattataactatgtcagctaagtagagaatgcagtgattgctaatgggacatgataattagtgtcaaaaatggcattgggggaaaaattattataatgaagaaatcaagaaagtattatttattagtagtaagtattttgaatcatgttttagaatgaactctccttgattttattgtgtcttccataatttccctttttattgtatgttaattagtagaaattcaattaaagtatcagagatgtccatttccatctgaatttaagcattacccttatagtaattattttatttacagggagaacctggggtaataggatcacagggagtaaaggtaatttcctggcattcttcaatttcctctccaaccttaatgagattatgaaaattaaagaaacattgatctttccttccccccacgtgtttagggtgaacctggagatcccggaccccctggtttaataggaagcccaggactaaaggtatataagaaataactaagatttcttgggaaataatttgggaattgtagccattctgtgtaaaacatggtgctttggtatgccactcattttcttcacaaatgctctccaagactttatcctgtttccatggtgattttccccactggctgcatttattacacgcatagtaactgtcttttggttttcacaataggatttctatactctttttcagagcatattcacaatagcatccctaaaagccttaagagtaaacaatgtgagctaaatctacgaccttgagctatattctaaaaggaacagaattcaagtttcagtttctaaaccaaaattatgcaacgttgagttgcttgagtttcccaagtgggattccacaggagtgtcccaagagagcagcttttggaaaatgcaggagaaattaatgtggtgtactcccagacaatgggtagggcaagttaccaggtatcacctgctggtgagaacacataaattaaaagtatctggaaactatcttggtaatcacaaagcacatttcagtattatacagataaagtgggaaagtgggatggtggaaagttggtcttcctatacatgaagatcacactattctttacaaatactcaggtacaatctatctttttttttcttttttagcaaagctaaagtatataccaccttttattttagggtcagcaaggatctgcaggctccatgggacccagaggaccgccaggagatgttgtatgtataatgtctttgatatttctggaattgaaattgagactaggacatgtttttaaaaacatcaacatgtgttcaagtaactgagttatccctcatttcccaaagacatgggtcatctatgccacaaaaactgatcatacctaatgtcaggagctattgggaagactagacccttcatataatcatgtgaggtccttttgagtatcattagcctaataaattggtttttggagctcaagttaatcaaattgtcattttggacatgcttgtcagtgctgtaccagcagtagaggagattggaaatgtcaaaagaaataaagaacaccaaaagagaaagcaaacattttcaatattcacagtttttagttcaagtctccatctaaggaagacatttcgaaagcttctatcattttctagcaaaagccttccaaaaaaagcaagtcttttggctaaaagtatgtctggaggaagatcgacagattgcattataacctagctttagtggacttaaaatactcaatacacctttctattcattatccggatcagctttttgttccttggacaactttctagccttctgacaacttgggagctgcgagctctccatcagttcacacttgagcaaaataagaaaaatccttggccataactccttggagactgatcactatctgactatgattagagttccctccaggcaactcttaggatctctccttttttcatgccctgggaacagccccttaacctcacattctattctccatgctcaccgcttgagcctctcctgtctactagtcggtgcacatattctgcttggtactttgaacacccagtttatagagcaaagcttttgatcactcccctatgccaagtaatgggccactgtagataaacctagtggacagatcttatgaaaagagagataatcctggtggcacaagtggagccacaatgctcaaaaactgagactaagtgatagtggccagagctataaaaagaacaaaatctaaagggaaagagccactgtttctaaaacatagtaaaaatatatttttctagttgccctagagttctttggaatcattatgtgatgctgccaaccaccatccttcctcgatggcaataatatgggtgagacgttcggttcaattcgactttagtttctttcctatggcatccaggtggcttcacttgaaacaacaaaccacgtagaatcactaatatttttccaggtcttaaaggccaaaatcaatccaactccttctattaataggttatatgttaaaattctgttctcttgacagagattcacagatatagggaaatgttattgtaagagatgttctcattactctttcctattaactctgagttttctagggattgccaggagaacatggtatcccaggaaaacaaggcattaaaggagaaaaggtatagtttacattttcctcattttatatgttaagtagataggaggaagagacagaggatcataagggagatgaaaggacagcccagggcttctgggattgtacagattgtgcacattaactacaatgtaaatggcaccccctagagttgtgcatttggcagccctggttctggcacaggaatgccatgtgacaaaatgaactgacagatgaagatatcaggagtctgaaagtcaagctcagttaccaatcctggtataaacctaagaagtctcttaatcttgcaggatctgtttcttgatatctacatggaaacagtgcattaacgttgaaccattattggagaataacttaaagaaaacataaagatcgtctatagaaatttattaatagatatgcccttttgtgcatacacatgcatatgtttcatgatactgctaacataactaactgcaaaatctaaatgcactgaacaggcatgaattaggtactcaataaatattattgagtgagttggtgagtgagtgagtgagtgagtgaatgaatgaagtttgactggctatgatgacaacttaaaacaatggaaaccactacctcctcacttcccaccatgaacctgagcatcaaagtaagaatcttaccttgttttctacagggagatccgggtgggatcataggccctcccgggcttccaggtccaaaaggtgaggctggtcctccagggaaaagcctgccaggggaaccagtaagtattagcccttttgttaatatttttcttgcaagttcattaattactacttgtgggttcctagtttcagatcacaagtatgggaataagtttaggtctgcaaaaaaaggaaaaaagaacttaaaacagaactaccatttgacctagcaatcccactactgggtttcttttcccaaaagaaaataaatagttctacaaaaaagacagatgtattcgtatgttcattgcaactctattcatagtagcaatgagatggattcaacctacatgcccatctacaatagactagataaagaaaatgtgatacatacaaccatggaatactatgcagccataaaaaggacaaaatcatgtcctttgcagcaacatggatatagctagaggccattatcctaagcaaattaatgcagaaacagaaaacgaaatactacatgtcctcacttataagtgggagctaaacattggttgcacaccaacatagtagagatgggagcaaaagacatgggggactactgatgggggagagttgaagggaggcaaggttgaaaaactgtcaggcactatgcttacttccttgggtagtgggatcattcacacaataaacctgagcaacatgcaatttactcatgtaataaacctgtacatatacccctgaacctaaaataaaagtcaggggaaaaaagaaatattcatctattcatcttattgtttcttttttttttttttttgagacagggtcttaatctgtcacccaggctagagtgcagtggtacaattatggatcactgcagcctccacctccgggattcaagtgatcctcccaccccagcctcctgaatagtggtgacaacaggcacacaccaccaagcctggctgatttttatattttttgtatagatggggtttcaccatgttgtccatgctggtcttgaactcctgagctcaagtgatctacccatctcggcctcccaaagtgctgggattacagacatcttactctataaatcagagataaaacctcttaaaagtttgataagcaaagggctttcttctgaagaaaatatacatgcatacaacattttgcatatgattttggaagattcctaggtcccctgaatcctaggcatgaattctgtagagatctatggatcccagtcaggtacactggttttaaaacataaacgttcctagggcagtattgtaaaacagaaaaactacctgaaatttctcttccagaggttttgcagatatcatcatggtttgtcatttgcagaaaatgtctttgtgacccagactattcccaggacattgaaaactggactgccggaaaatctaaataaccaatgtttttaaaatatgttttatatgcctttgtttttcatctcctttgaactttttatgtattaaataataataatatttctcaatatcaggtgcctcattttataaataaaaatattttatattttaaagcaactatacaaaatctataacatattgaaatttttactccccgttccttattcttttatagaaaaagatttattcaagcaagatgaagagtgatgaaacatattttagttataacttctaatgtgtttataacttttctagaagaagatatgtattcatactttttttcttttagggattagatggaaatcctggagcacctggtccacgtgggccaaaggtatacaaatattatagttaatttttaaggaatgaataattaacaaaatacagcagaaaaatgtatgtctcttgagccttgcagtaacagaagcctttcatttcacagggtgaaagaggacttccaggtgttcacggttccccaggggacataggcccacaagggataggaattcctggcagaacagtaagtgaaattcattcgagtccttgttgattccaacattgtgaaacaaaatccagtgtcaaattttaacaaggagaaaagaatagaaaggtcagagacggaaatacaaataaacactatccagagatgactgatcagcattgaggttgtatcacttaagcacagagacagtacccactgtttgtttattaacttacagatgctggtcacacatacactaagtttggattagaagcagtcatttaacccttatacctctattctatatattaaaaagcacaaatacatgtttgtaagatagtaagaatgcctaatattaggtcaatatatattacagcttgtttttaattaagttaaaacaagaaattaatatttaaactggatggagtatgcataagtgaaatgacaccaaaaaggtctgagtaacgtcttcagagtgaagagatgatgttttcaatggtaaaaataaataatgagaagtttttaaagtatttaaactataaggacagagcctagaacagcccctattaataatgaccactatatccacacttgtagatcaaataatagtaaatgtacaatttttatttactatggaaagacataaaacgtttttgaacaagaaaagtggaaataaatggttattctaatgacattaatttagaaaattggtctgtgtggtgtaatacaaaaacaaactaattgttttcatattatgctcttaacattcaacataaatacaattctgacaccagctgtgtggggttttttttcccctactcatcaattccccaatggacatcaactgaatgttctattagtcaattcatgtctgacactatctacctggattaagagtcagatcccacaggttaagggctcagtcccacaaaactgacccctacttcagaggccaactgcatatctggaccttcatgacttctgtccaaccagctataaactgggagcttccatgacccccacctcaggttctatagtttgctagagtggtccacagaatcaagtaacgctttcttacgtttactggtttatgatatcagtaaaggatatgataaacgatacagttgaacagtcagaagagatacaaagggagaggtctggaagggtccctgagtgtaggagcttcagtccccacggagttggggtgtgtcactctcctggcacatgggtgttttcgccagcctggaagctctctaaactccatattttgggattttatagaggcttcatcatgtcagcaagattgataattaactatatttccagcccctctcccctcttcagagaacgcggggtgggctgaaaggcaagcttctaactgtggcttggtctttctggtgatcagctcctatccaggagcccaccgagagtcacctcattggaacaaaaggctctcctatcacccaagaaacccaagggattaggagctctgtgtcaggaaccagggtcaaaaaacaagtattagaacaggactttatgttagcaacctattgttaaggaatttacgagggttttaggagctctgtgccaggaactgggggcagagaacacatattattttatcacaatatcacatccttatattgaagttatcatgaaaagttaaaagaaagcataagcagtgaagggttatgttgtgaatgagggttgtctgatttgccagggcaagaatgtaaaagaacattggagatggaaattaagccaagtaaaaacttgtatcagaaaattattagaggctgggcctggtggctcacacctgtaatcccagcactttgggaggccaaggcaggtggatcacttgaggtcaggagtttgagaccagtctggccaacacagtgaaaccccatctctgctaaacatacaaaaattagccaaacgtggtggtgggtgcctgtaataccagctactcaagagactgaggcaggagaatcgcttgaacccgggaggcggaggttgcagtgagctgagattgcaccactgtacttcagcctgggtgacagagtgagactccatctaaaaaaaaaaaaagaaaagaaaattattagggaagtgatggtggttgaggaaaaaatcactcagggacacaggataaataggaagggaggaaaaagtagctttggcaagagcagtgatatgaatatttatttatttaaataagaaaagaaaaatcagtgagcagttactgaagtcaactgctaagaaaccagctcttgacttacttaggtgaacattcctcatgcagaagttcatggttacctaagagcggtacaactaccatcgttaagttccctgataatctcccagcctcattttatttatccgaaattctaattttctaaaagtagaaaaaaaaatcattgattagtgttttacctcctactcctgtcactgaacactgtttctggtgatttattccaagagataaatgactcaaagttgaaagcagaaaagaatccctgagccagttacccctgtgggtggtcagtttctgacaggtggaatttggatgcattctttgtgccctcatgaatgtgcagtgacagattatggtaatgatatagatgtcccaagtccctgagcaaaatcatgttgatgtttccagcaacaggtatctgattaagtattcacctacgacctgaaagtcttggccgactttgcagttttccacgtgtgtacggtggcaaaccctgttgttcctctaagtaaactacaatgcttagtcttttatgtcacttggataatttatggacattcttggtggaattttaataataaaatctcatttgtactcagggcgcccaaggaccagctggagagccaggtattcaggtaagctatttaactaattttttagcacagcaaagccagcttgcttacttgggggaaatgactgaaagaccatcctcataagtaactgtttttatttccctccttttccagggtcctcgaggtctccctgggttgccaggaactccagggactccagggaatgatgtaaggactttctttatctaccctcccccattttaatctgcacctgtgccacgtgcaaagattgaacatggatacctctgttttcagggagttccagggagagatggaaagccaggcctgccaggccccccaggtgacccggtatgtagacaaaccttgtctgatttatgtatcttaaatgcacccagaagccaaacagcctaccaagcaagttttgctgtccaaactaattagaatgctcggtgactgcttggtgattttgtttatccccattattttgtcgagtgaaaaaaaattcaggctggatcagcatttctgtgtgtgtgatgaatacttatttcctaagggcataattcaactgtacaattttgccccaggctgagccttggcatataatgtctcaatcccattgaaaattgagataaaatatattgccacgatttctattttttctaatgctagtggctaaatgaatttcatttttctaaatgaaattttgcaggtaagttgcctacaatatggtatagatccattgattctgtagctttaaaatgttgcgatgattaaattatgaaaactggcttgagtaggctcttagaaaaagggttaggcacaaatgtgtgtttcaaagttttattttaggttaaaccttgctttgagcaacagtgaaacccctttaaatagcctcagactcggcagttataatttgagaggccatatggtacatgacattgtattaagagtcttgtataataaaatccaaatctggcttctcagttctaagcctcacaaatcctttctacctcccacagtgtttgggccttatgtgcctttataagctatgtgtggaggcatattttggcattactttaacgccactgttgagtgaatcacttgtgcatttttctgggaatcttgcaaaaatgttacttgggtttacaccgtgtctctctgaaagaacatctcaagacgtgtggccaaaaggtagcccaagttccttcagtgtttgtcttgcctatcacttaagccaactgtaggttctttgaacttccatgagaaataactttaaggcaaacttatctggtacttttcatatttctcaacagcctgatagtgtgttcgccagaggaatgatttccttttaataaataatttatctttatgtattatttaaaaccaatgatataccagggacagcataaaggttgccatgaaaatataaaatagggatgcacagtcaaaactatgatatgtgtgtttgcacattcaagagagaagaatagtgaacatttttcaaaatttgttctgaattctatcagtgccatgtgcacatttctttatacgaaacataatgttaagccagtgattctaaagtgagacaccagaagcttcatggcattttgaggaaaaatgtctacattatactgtatgtttatattgtattgtgttcatatataaatgcatgtatttggttttatcttcttaaccacagattgcacttcctctcttgggagacatcggtgctttgctcaaggtactctattgctatgtaagaaattatgtgttaatttccaggaaaaattagaaagaaaaatatttagcagaaattgagtcaattgcttagctggaactaaaattcaatttttaaatggcaggacatctttaagataggaaaataaacatgtatcttatatatcttgtgccatttatcctaattctttcactctcttcttctttaccagcctctcattttgggtggggcaggggtggagggcagctggtaggatagttatgaattggctacagggaaggaattatgtcattagcactctggagtagattattctctcctctggaggaacatctttctcttaatgggtgttgactcaccctggctcactactgtgaaacctaatctttctcgctatatctggcctggtcagtcccaagatgaaaatcagtgctgctctataaatagccacttacaaggctgaattttgatgtcataggattttacaaaattccacagttgacaagtgccctaatacctgttactctgttcaataaaaatcacctctacctattatcgtctcagggaattaatcttgctacctcttttttttttttatctctaacacttccctgtattttatcagtaaaacaggtagggggggatgataatggcacatatgtaagggtatgtatttgcatgtttctgcctgatatgctaagattgagtgaggccacatgaaaatcaggcccttgacttcatactcaaacacagtgtgttgtatctgtctttgtatgaatggacgttgtgtatgtgtacacacacacacgcacacacacacagactacagttatatatatataatttagtttgtatttctagcatttagcccagtgatttacacaattatttgcacaatagtaagcaggcagaaatatttgtttaattgaattcaaaagactcgagttccggcatatacatttgtaaggtagagttttgagaatagatatataaacataagtgtaaatatgaatataaatataaaaatatattaaaggagtttctaagacctccaaaaccagcagtttttataagccagagaagaatatttgtggggatttcaggaaaatcttatatttattgagttaaaattacatgccactcaatatgccactttacttatatcatcttatttaatttccttaataatcttatgagttcaggctgttgcgcattcccactctatagatgagagaccagaagttctcagcagttaagtaactttttcagtcatagagcaagtaaatgtaacattaacacaggaacataggtcctcagacattaagtcctagattctttacaagacagtggtgctggaaatagcaggattgccggagttatatcatttcagaatacttagggttctttaaggatgagaaacttgtatgctttagtagaaatgaatatactggtagaatatgggatctcacagaacagataaaaggaccatgaataggctctgacgggaagtggaaccagggctctcagaagtggaactaattgacaatctcgcccgggaatcatccctctaatgagtgtgctctgccattgcaccaatccctgcatcatttcactaaggttctgagtccataacgagcaggacatcttgactgatagtctccacaaactgtatacaatagaagaaaggggaggtatgtagttccccgaacaaaatccaaatacaggaatttagactgtgggttggatctgtcatgccaatgtaataacatcatgttaaatcctgatcttgttaccctatatgttaacactatctctctctgccttgagtctttagacaatttgatcatcctgctttctgttcgcaaaaatatctttgattaaagtattaaaaagaactggcataattacaggcaccttcaaaggccttcttctagattaatcagcatatcaatccctctttgaacgactttgtgtattggttaataattgatgcatctttattctttccatgagaaaatcttaagacatttttccaagaatgttaacaaaactcagttatttaaatttgccattctggtaaccctaacccaaagaaaatgaagtcagtttcaaatgactcttaaaaattatgtttatcataatgattatcattttttaatgtttcacttaaacagtctattgaataatctattctaaaatgttgctccatattgatatgccaaggttttgctccatattgagatgccatgtttgtgtctgcagataattatctttttcatactttttgaaatatggaaatcattttgtttttcttaagttctcaagtgtctctttatcttcatagtttttcaggtgtcagtaatagttctataaatatatatatttaactcccctgccaacacattaccacctgtgaaataatccaggtggtaaaattcatctgggaaacattgcatataaccctagttcccttttatatattcagactctaagaaagaccaccatgaagagagctttttcacccagcattttttttatgtactttaagttctggggtacatgtgcagaacgtgcagctttgttacatagttatacacgtgccatggtggtttgctgcacccatcaacccgtcatctacattaggtatttctcctaatgctatccctcccctaccccccccaaccccccacaggccccagtgtgtgatgttcccctccctgtgtccatgtgttctcattgttcagctcccacttatgagtgagaacatacggtgtttggttttctattcttgtcttagtttgctgagaatgatggtttccagcttcatccatgtccctgcaaaggacatgaactcatccttttttatggctgcatagttttccatggtgtatatgtgccacattttctttatccagtctatcattgatgggcttttgggttggttccaagtctttgctgttgtgaacagtgctgcaataaacatacgtgtgcatgtgtctttatagtagaatgatttataatcctttgggtatatacccagtaatgggattgctgtaacccagcatttttgagatgatttgcctcatgtattcatcagggttctctagagggacagaactaatagtatatatgtatatatgaaaggaagcttattaaggagaattgactcatgtgattacaaggtaaagtctgacaataggctgtctgcaagtcgaagagcaaggaagccagtagcagatcagtccaagtctcaaaacctcaaaagtagggaagctgacagcgcagccttcagtctgtggccgaaggcctgagagcccctggcaaaccactagtgtaagtctgagagtccaaagctgaagaatttggagtcttatgtttgagggcaggaagcatccagcacaggagaaagatgaaagccagaagactcagcaagtcaaccccttccaccttctgcctgctttattctagccgagctggcacctgattagatggtgctcacccagattgagggtaggtctgcctctcccagtccaccaactcaaatgttaatctcctttggcaacaccctcacagatgcacctgggaacaatactttgcatccttcaatccaatcaagttgacactcagtattaaccatcacaccttgtaagcttttcagtatcgtgcaaaattagtgttccaaggagcccatgtttgaaaatcagatttacattgctattcattaggtcaaaaatattgaatttgaatagccatgggctttcttgccagcttcttatcaataacaagcttcacttctttttcatgtttaaagattcttccctttagggaaaaggatggaagaatggaaacttaagttgtcctaccttctgtcaactgttaaactatctcccccactcagtggcccttattctgtgcctttcttggtcatattcttattccaacaatttatttaaaaataagcctatatagagcttttcacacacactttctttagctgtgtgatgagagttatgtttatcttatgagctcagacacttgaagtcaagccttcccagatcaactaaaggttgcagagaaggcaatggaaaggtcatttcacttagatttcctattgtcacttggatatgacctaggagtcaagtttatgtcagtcaagtaattatttctctcgagtgcctccactgacaaaatgttagtaaactgtatgtagttggagaactaattttgctcccagaagaacaaatcctttcttcacaattttttctgttgtttttaaaatggtttatgctataggttgtttgaattctgtaatcttgctgggttttctaaactttattaccactcccttttaaaacattctgctaaacaattgagcctcagtttttgttcttgacttatgtgtcttttccttatttatttggaattttctatttaagtgtcattggagacctgttttaaaaataaaagttcatcaatatcataaacagatatcactgatgagctttgtaaacagtttttgcctcacaaaaattaatgtttttaaattggatacatcaagtgtctgaaagcagaatgacctatctatatcactcatctccagaggttccaaaaaaacttcacatcacatgaaacctcacctttatagacggcttttatgactccctcagtaaccttatctttatactcattagaatttctgtggcaactgccaagccagtgtcccagggctgaaaagcaacaaaggagaagaaggaggtgctggtgagcctggaaagtatgattccatggcccggaaggtgagaagcctggctgaatgtttacgatccctgtgggttacatgtagtgcatcctctcagttctgttcttcctctgtcttctagggtgatatagggccacggggtcctccaggaatcccaggaagagagggaccaaaggtaagaaattctctcctccactttcccctgtgggaacctcaatttagtatgaaaaaaagaacccgatttgaaaatagacaacttttaaaatacatactatatatatatatgtatgtatgtatatggagagagagagagagagagaaagtgatgtaaaagtcacttgcaaatgttgccatttatttgttccctgaccctgtccaaattacatgccccaagtgttcttagaagagatttttttcatttccaaaagataagaaaaatgattgcatgtgctagctgaatgtattgtctttttagggaagcaaaggagagcggggctaccctgggatacctggggagaaaggcgatgaggtaacagattcttttctgattatatagtcctaatattgattctctttacgtggctcaacagagtaaaaatgttaatttttctatagctcagatctgatgctataaccaataaaaacaaagaccacttagagcttttaaaatgctgacagattttaaataacatatttatgtttattaccaagggtccggttttagagacaaggaaattaaggcacaaagttaatatgtcagttataatttttctgttttcatttaacagataataattccagctctctcaaaataaaagtaagggaaaggaggaagggaaaatttactcaaaagaattccaaggtagctaagagatttaaaggaatagtagttggacaaccagcctagcagtaagggcagctcaagaacccagcagagcttccctgggtaccactaaactctgattaaacttcagcaaccttggattgtctgtgtctttgctcagctttcaaattcttgggagaaaaaaaaactgtcagaaaaatcttcttgttctagtttacatcagctgctcacccgttggactaaggttccaagtccaatgtgcttttgagataatggtataattttctgactgtaagccatggtgatgctcaggacatcatttttttcttacataattcacattaactcttagaaaaaccaattagaatgatgaattgctgttagtttaaacagttttgatactactaattcttaatgaaagtaagtaagccatctggcatatattaaccttgatgttattgtagaaaatcataactatataaagaaaatctatttttctaggtggagttatattttacattaccagtaatcatcatgtactattgtttctaattaatattgcttgtaatctagaaaactttgaggtttgattttttcccaagttaaaaattgaataccaagtatattcaatatttattttcatccataaataaaacattatcttcaaaataagttattgtgcttttgcttcctcatgttccacagaaggttttactaaagtacaagcacaataactgattttcatagtccaacagctttgaactacctccacccaaaaggtaggctttagaggcaattgagaaggtaataacaaaaagatcaggaaataattggaattcaggttttgtataagtaactctaagttaaagtcactagaagttaattttcattgattctacagggcacttttctctcttggtgaactgaaatccattgctaatattcctccacactttagcgggctttttcttcggtacccctcataaattctgtaacacagttcacaaaattgtacacaattctcattacatggggagttccagcaagttcaggagattcttttccattgtttcttcacactacgtgaataatatgaataaatctgaagtaaactattgactcctttaggccttgtagggggaataaggtggtgcagctttttctttagcagatgggaaataacggatataatcttgtcttctacttggtctcagatattatttgaaattacaatttgttgatttgtcaaagtgaataaaactttgaccaaaaacaagtgcatttccaactggccaatgaactataccatttcaacatacagtatggacttgagatctaatcttatgaaatctcaaatgtctattgtactctaagtggaaaagatacagagggacaccccatctctttgagacttctaattattatgtctttcatctgtttggaaaatgagagagaggagttgcctgcttgtttgttactcttagaaaagcaacattttcttccacatttttcacagacgttgttgcacagctcaaggtagcaacttggaagatgctaatagaacacatgctaacctttgatggagtgatttcttgcttgaaatgcaggtcttcctataatatcttgggataataattgataaattagacatgaaaaatatcatcagccagatattatagcaacagaaaatattcttggtagcaactgggctaggatttgcaaaatgaaatatcagagcagggtaagaacatagctccaatggtctccaaatatctctgcaataaattttaatttgtattttagtttggcactgtatgttaaattgactgtcctactctttaatatgtatttgtcttctttaatgatcatcttgtcttctaaaattatcttattgccctttatgcatccatagtaactttcacttttactacagaatttcagctttttcagagaaaggctgatgggaatgattttttatttatggactgaggtttattttaaagtttaatgtggtcatcaaaggttaatgaatcccaagcttataaattagactatctaaaaactcactcaacatctctggactgattcagtgttgagactaaaagtagcaaaaaaaaaaaaggaatacatatatacgtatattttatgcatgtacatatagaaagaattttatggaaatatgggtattttgaggtaaagaaatttatggtataacatttataatctccagtcatttagaggtgccattatcaatgaaaatttttttactttgcatctataaacctgcatacaagttaatgttaggggaataaaaagaatgagtaccacataccgatatgtagagcctgcacatgcacacatgcccatgtatacacacatacacatacacacacacacacacacagcactgccaatgagattgataaaattttgaagaaaaatatgtcaacattctttaacaccaatacacacaagatttggcccaagacttatgaggaattctagcatgttcaagtagaatttttaagcccttcttcatatcatatcacatgaatagacctgaagtaacacatgatgccatttggcattgaatggacaaacctagaagaacttggtccttgatcccactgatgcaaagaaacttgatccagctcacagtcctatagaatgctgataatcaatatgcagtaatgtttccatggccacatcatctaatatttataaagtatatgaaaatgcatatatcataatagtaaaaggtaaaggaattgtatgatgacaaagaatggtatggcaatccagaaagaatattttactcagtaaaggagactaaatcctgaaagaatggaatcattcagtctagaacttgatgtatcacatggttatctgaaataacaaaagcatattttaaaatagttttttctcataatagaagtgatctcagtccactattgaaaattgggaaaatacaaaaatgcactaaaagataaaatttctccctattcccactacccaggagggacttctggcaatagtaatgtcatggtccacaactctattagtccattttcacactgctataaagaactttcctgagactgggtaatttataaaagaaagaggtttaattgacccacagctccacgtggctggggaggcctcaggaaacttacaatcatgacagaaggtgaagaggaggcaagcacctttacgaggcagcaggagagagagcaaaggaggaacttccaaacacttacaaaaccatcagatctcctgagaacttactcactatcatgagaacagcatggggaaaaccacccccatgatccaatcacctccctccctctacatgtggggattacagtttgagatgagatttgggtagagactcagagccaaatcatatcaacaacacctcatctataaattccaaaaccaaagcctctgaaaaccctggaaatgtttcccaagtttggctttgtttcccaagcaaattcatttggcagcccaatctggcctaactcacacggagcttgtctattccactctgtcagaatatcatgttttgccacagaaatatttgtgtgtttattagagggcactgcctcaggcaccactgcagtgtgatataatattcagtatgtatatcatgttacctgtgaaatgaagtgataatccagaattctaaaacacatctaacactaaagtttctgataaaacttatctatttgtcgtgataaaataataaaagcctgtatgtatcattcccatcttttaggaagtacatttaaaattgtttaaaaatttagaccctgtgctatataagatttgtgactttatttttacatgttttctaacttttttaaaacatgattttaataattgcaaaatatttcatgttataaattgtatgtaatttatctaacaatattctgttgttggcaaatgtatcaaagtaacaaaactaattacataagttagctaatcttaccatttcttccttgatatataaatgtatcagcatcttaaatcctatccggtataattagtgctattctacaaatctaaggaggggagggaggggaaatctattcattattatgcttaagccattaaagcgttccaaatttaaattcaccagtgagccaaatttcttcttataataaactgacaagctaaaataaatattatatcataaaacatattccatttttccctagctgaatggagcttaagtgtaatcatctatttcttcaatggcattctgccaatctaaaatttgtatttccatgttttaccagtacgagattcttagatactactgctgacggagtggccctataaaataagaaatgctctatgaatcaccagattaaattatgtttgcttcagattccatgtcatggcattttagctcacccttcttactctttaaaactgagtattcacacatattcttacttataagtgagggctaagctatgagtacgcaaaagcatacagagtgatataatggacgttggaggcccagaagtgaggagtataggcgaggtgtgaaggatgaaaaactacctattgggtacagtgtacactacttgggtgatgggtgcactaaaatcgcagacttcaccattatacaatttatccacataaccgaaaatcacttgcacccctaaagaaaaatttttatttttgaaattaaaaaattagaattaaaaaagtatatttgtatatgacaaacattatgtttctcgattagctaaataagtgtttaatgttcaatggtcaaaatatttgattaactaaaatgccttcttcccaatgatataacagattttatgatgggaactatcttttccagggtcttcaaggaattccaggcattccaggtgctccaggcccgactggaccccctgtaagtatttgttaaaacgattgcactcacagcttatatctgctggtttgatgcaaggtgaattaattttcttcattgccttttgttctctgtgcctctatgtagattgtccagatattgcctggaaaagtagcctcatccaagctctcagattttcatttagtattacttaaggctactcagtgtcctggggacttgcctcagaattccaccagaccagaaagcagtctgcgattaagctagtgtgtttgaaatagaaattgcatataaaagagcattctattttttatttataattttttggcactaacctttagaagagatagtcaaatggcaccacaaactgagaatttattttctaaaggaaaaaaaagtgtgctaaggattatcagatttcatttatttttgttcctatgtataaaataaaatacctctattttagtcaaggctttcactgcccctcaaacacaccatcaaagccttcgtgtctttcactgtcttgttttcctagaacagaatctcttttgctttatacttgccaaacccaatctctcattcaaacagtttaattctagagtcatcagataaaatatagtgcatgcagttaaatttgaatttcagataaacaaataattgtttaatataagttcatcccaaatattgtgtttttatttgctaaatctggcaacccagcacatgcttcaacttctccacctcatcctttcttagagttcctatgccaatagagtctttaccacaccagtaggaatgtaattatatattttaatgttctgaaataaggattttccataattaaagttgtgtcatttatgcttccgccacagttatacagaacaaacctggctttaaattgttcactaaaattaaaaacgatgaaaaagagttgtgaaagaaaccatgaaaattatagctaactctgttcccaaaggattaaaattaaattttatttttcagtggtaaaatgcagatcatagaactcaatatgcacactgttaattctgccgccttgaagtatttaaaatgttgatccctaccaaaactatagctcatttagaaaggcataatgttatgtaaattgccatttaaacagcaagactagattcttaagtgtatcaaaaggttccaattaaggtcattaaatgtggttgacgaaggtgaaaaagcgaccacaaatacaaattttacccttccaagggcttatcagcaggatacagctgctgtatcagccagaagaaacataagcttctagggcttatttaattaggatcaaatgaccttcaaaatgtgtaagttttagtaaccaacttccaataccctttggccatttaattgttgtttctgtaacaaacttagttttgtgttttacagggcttaatgggaagaactggacatcctggtcccacaggagcaaaaggtgaaaaggtacaaaggaaaagcctcacttaccatccaaactggggcttggagtgggagcaggatgagactcttcacagagagagccataaaatcaagcaaagcctaaaagtagaaatgatggtagaaagtacctattcttgtagtggatttggaagaacacaggtccaaaggttattctaaacacgggagatattttcctaggagaaaggataaatagaatattggttccataaaacaaaagttcaggctggattcagaatcctgggcaaccatctatgtggaaggattgggtgggggagcctcctggaaggatgcaagtaatgtggtgtctaccagggagttccagccacaggggctgtcagttttctatgacaaaataccatagacggagtggcttataaacaacaaacatttatgcatatttctctcagttctggagtgtgggaagtccaagatcaaggtgctggcagaatcggtgtctgacagagtctgccttcttgttcatagatgtcacctactagctgtgtcctcacatagtagaagggtgaccaagctcccttgggcctcctttataagggcactaatcctattcatgaaggctccaccctcatgacctaatcacctcccaaaggccccacctccaaaagctccagacagcagactggctctcaggaccaagattctggtaaccaaagagcttgcagagacagtcgagaagttctgtccctagacggtcatgggggaaatttactgaagaaccaggatagcttgtttcctggggagatcagttattggacagatgggttgccatggtcagaaaggaggaccagcattagatgagtctcagacaggacaccacacagttttacatgtttaccccatttaagatctaaactggctctattgtactagtccaggcagatccagcaagtaagtggaataagcctagctatttagatcggggaagtaagaatcaagagtccacatgagccactcaagcagcttccacccactcgtcaggacacaagttccctgaccaacgtggaacataatgacatcaaggagcaaaggaatcccaacacattttgaaggaaacaatgactttattctagatagtctctgcacatttttttctgattttatcccaaggagcttgcccaaccccactagccttttttctctgttctctatggaaattattcagtcatagacttgcctttgaagttaatgggaattccacactgagatgagctttggggcacaaatgagagtgaatatatgacttttaattgtgccgggggaaaaaaaagacttttcagtaggcacatatttttccttgtttgttgactcattagaactatgacataattctttgaaggacactgccagttgtcagcagaatgtgacatgtcttagagagatagccacatcaaagcagtttgggaaaagaaacaatatgcttgttctttgttatatattctcaggcagaagcattgcaagaaaaactttacagtttatttttattgataaacatgaacaaaagattttatgatactttcgttacaaaaaatggcagggtattggaatgaagtccttgattacatttatgggaatggactaaaatccctcaaaattcttggacattgtgagtagaaattttactctatctgaattcttttttaattaaccatgtcttgccatttcccctgctatagagggacttaagagattttatgaggctattattctgagagaaaagcagagttataggaagaactgctgagagacaccagagggacttcaatagctctgcttattatggaccgataaacatctatggtttataaaaatagaagtgaaatacatttttcaactttcaacttgaattcattttcacaaattctattttcagtctgcttctcctgtaagtctaagactgtttaaattgtagtgactatttgctttaaacagtactataccacagttgcttctgctcaggaagatgtgtctgacttgggtgtaaagtcagatattaacgtaggaaatggaagatgaagtttccctcctgcagacacaacacaggttgtgatttttttactttcgtcaaattatgtggatgtcccctctggttcccaaaagatgaaggtggtagaaatgaggctcaaagtgaaggctgactcagagccacaatcccagagcccactgcctgcttgtaggagagttccacattgggagagttcctccagctgcactggaagtccaggacatgagcacctgggttgtctggctccatctaaaaataagcttcgtttctagagctcacacagtgagagtcagaatgggtatgggaaaagacctttacctgtcctgcggtctagaaatgtatttcctgggtaaaggagagcccagctgaataagactacaaggctgaaacaacatggcaagtcatatcgatttcagaagatggctctgtgattaatttcagaagatagtttgtaaacctggggtagaaacgtctacgccgctgatatgtctatatatcccttgcagggcagcgacggaccccctgggaaacccggaccacctggaccacctgtgagttgttctaggcttaaaatttaaaattcatgtgtttacttaagacttttataactcagaggtaagactacatttagatgttttcaaagataaaattcttctgaatttcgtgtataaatataaatgatagccaatgtagctttaaagagacctgatttgttctccttttggttcagcctcaatgtgcaatgctcagattggcatactgcgggtctccccatcttggatttaggaatctgggtttgtgctccgactctccacttcctggctcggggcccctgggaaagtcatttaaccttaatgtgcttcattcacagaaaggagaagggccagaaaaatagatcctttccgctgatgcgagttggtagaaaatcggatattatgctatatgtgttcattcccattcatgatgtctgagatgcaaggaaactctatttatgtagctcttagtgaacaaaaagtacaagaggcatcgatgttttcattattgtgattgagacagatgcacgctccgtcagggaaacggtggagaggagaggagcctctctccgtggcaagtctgccctcatgtggggccacgctcgaatcgcagccgagccgagctgagatatcacgcaaaacacccttttctaccccacctcacaggaatactttaagaaaccaaactcaccatagaaagggcagaattgaccgtgactttccgaagacaatgaggattattatcagtctgcgtgcagttgcatgctttgtacacgtaaatgaagagattagcactctatttcctaaacttgtttcctaaatctgttcatctgtgttactgaccttttcccttgacaagaaagcaggacggaaagtattagggttcaaatcctaaaattcactccttcccccgtgggcagaacagcaaatataacatgagttcatgaaagggacctataattttataatgcacttaagatgtctttgtcttccctctgaattctccaaaaccatccatccttcaaaacacagtttaaatgttttcttccctgggaaacctcctttggaaatctcagatgaaaatatcctttgtctctccaggacgtagcacactaaaatatggcagacattcagtcgctgtcagataaatgagttaaataatagagtaataaatggatggagcgtttgtcttccatcactagtgtttggaagatgcatgcaaattgtcttcacagaacactactggccaccatcatacagaaacaatgaaacagtgacttcttcaactctgcaactgatatgtgaaaactgcagaaaggaaaaggcagatttgactattgattctatacaaatgtttaaaaagaaagacaaaagattctaactaaaatttttatatggaaatttttcctaaatgctaaaatgtatgatttttttaaactatagaataagttctcctttaagtgttggttactctaggacatgtcaatttttttcaagatgttcttattctcttttatcctaaagaatttatttttgtagaaacatccacacagggttgtggataatgtcatctccccatttaccttaattttctatttggtatgaaaagactgtggaaaaaaattacttttcagtagccaaattgttccctattcacatcttcatcagcactatggcattatagcctgcaggttagcaggctgtaaacagttagtataaattgacaattcagaaactgaattttaatgagcaaatattttcctccaaatgcattagtgtctcatctgtcaaacctgaacattaattaaaccccaactgaaagtatccgtgtgcttcaggtgtagctcacactcccttttcatttccctgcatttgctttggaaaagctaaaaattaaaatgtattattttacttagagtattaaattccctttgtaaaatagaatagaaaaaagtaaaaaatagaataggaatagtatcatttggtaaaatgataaaatgtagagatgcaaagtattaacttccaagaataattctgtatctcacctctttcctaagggtattccatttaatgaacgaaacggcatgagcagtttatataaaattaaggtatttatatttgtaattatttaaaatccagttatagactgctgtaaattcgtctcatctttctctttttcttttcttttcattttcttttgaagggaggtgtgaatgttcccagttacccagggccacccggtcctcctgtaagtacagttgtttatcatcaaacacactttagctgaacaaccacaatgaaaaacaaacaataaaaacctcttaagttcactgaaaaacgcatgttatgaatacagccaaattttacagcagaaggaaataagtaaaaccaattataataaaattgagaaaatgtatgcagccaaaataatggaaaacagcatttttcatggtggtgtcacttttttcattgcaaatctaagaactaagtcaatgtccaagcaatcatttttatgaaatttccatcaagttatatttattcatcttattcttcaaattcaaactgtaattaaagcaaaacttgctaatattcgtatgtgtattaaggcaaattggacaacagtgtttcttattctgtaactgctttggtcattatttgaaaaatgactttccatgtttctcttacagggcccaaaaggcgatcctggcccagtggtatgaatgttcccatgttttgtgtcatttagaatattggtctttgttaaattttgaaagaaaagcatcgggcaaaatggcctgccttcttaggtgttcatcaattaacatgctggtggtgacaagcaggccacaatataaatgccagcaatatgttctctgtttctgagatgcattagtcctgatgttgtcactgcccttgaggtttgtctctttccgtcagtgtgtttttaaaatcatcctgtgatggaggaagacacatataaactctgataaatggggcactttcttctaatagccctcttctgataattgattcaattttaagtagattgtggaagagaaatacttactggaaagaaatcccttaatatatctgccatctccccaacaaaaaaaaaggaactgtttatttgctttaaacgtcttaggcaattattttgcaggagatatgttttgtcataaggctgcttattaggaggaatgtatcaggaggttatgctcagcatggaaggagatcatgtcctccagccgcctaaaggacgataattgttctcagcatctttctgaaccatggagcctctgtaaaagttctgccaaattcaattagatgccctttattgctgggcattttctcctgtcatgtctttttcaagcatatccttcatgtttcatttgtatatattttaacctttgggtatatacttgaaactcaaatgtacctaaagctgaaataaattttcaaaacactttccattgccatgtgaaaaaaaatttaaagccttttcattatagtacagtttgttaaaactcaatgaataaattttaaaccagcaaagggacaagtcataacaagtaatgtttttatgtctaaaaacatattttaaagagatgcattaaagagctgtttgattttgttattgggcaatatatattaaaagccaaattgttatcccctgaaagcattgtttcaactagttaggatcatattctgtaattcagtttcctttgttttactattcattcaccctgtctaccctatctttacctgaaaccaactatacgcttcattctaattttaattttcttacatcttgttgataaaaatttcctcctggtctttccctctcatactcatacacacaaaacagcttctctgaatcatttaaaagcacctaggcttctcactgactttttgggaacattctttgaagttcttgcattaataactgcagattaagataagaactttttaagtattataataaaggataaattataatttactggcattgaaaaggggctggcaacaaaaatgtagacctatttgagtagaatttgaagagattagtcttcaaatttcttagctacaacaaaggatgaagaataaaaactgattgaagtgtgttccttgcttttagagatgtgaattgagtgagtgaagcacagaaacagaaaaatgcaatcatgaaatgaaatacacatttagtgtacacattcagcctcatcctggatgaaactttgaagttactcttttgggttctctgtcagcaccaccctgcaactctcatcatctcccaccagctgtcctgtagggaaaaataatagttcctgccatagaaataatccaggaatgatagaattgtagatcacagagcaaaaacttgagaagtctttttgaggttggaaatttactcttccaacattcttcaaatcccatgacaatagacctgcctcactatttctaatcttctccataaacctttctagaggaatattacccttaattgaatttattatcttctgaggcgctccatttcattcctttggtattcagtttataaatgatgtttaattaaatatttaattattgctactttcaacaaatgttgattgattgagcacctctgtcttaaggactgttgagaatgtaaacaaggagaatcaaagagtgtgtttcctttgtcagcaacctagggcctcttatacagaactttatgcagaacagaatctgaacttttttttttgatcagttgtcaagttacatattaggggacattttaaaagatttctgaaacatagaaagcatatcagttcatatgctcactcactaagtattctgtaataagggcaatgttataaataataatgaagttatatccctggtaatatttttgaagcagattggaattatgtatgcaaaaacacacttacagagaacacaatttgaaagctcttgtttctttgtgattatgtctaaagcatccggtgtcctaagaaaatatttgcagtgaacattaatttattaacaagaaggcatcaaacaactccccactttatctcttttttaacttaaagccctaatgcaagcttgtccaacccatggcccatgggctgcatgcagctcaggaaagctttgaatatggccaacacaaatttgtaaactttcttaaaacattaggagatctttttgtgtgtgattattttagctcatcagctatcgttagtgttagtgtattttattggaagacaattctttttcttccaatgtggcccagggaagccaaaatattgaacaccccttccctaatgctttttttgttcagagttagcaacttccttcaccacagcttttcccaaagtgtttcttgaggatctacaggctccagctagcctgggaccatacactagaaaatgtaaagatttttaaaaatagaaaacactaatctacccccttccagtgactcatcaacttgagcaataacttttagtgttattggagataatgatcctggggtcaacttcttaagcattcacaattcttgtccagctgcagagaatacttaaagatgataaacactgctttgagtgctccatcttcatctactcttaaacagtttattcttattctctgaaaatctagcagcaccaggtagctcacaaattggcaaactttattaaagccccatctttcattctagttcttattgaaattggagttatcactgagtagagggattcattctgattagattctcaatcagaatgaaaatgattaatcagaaaatatacctctctggagaatagcttttattctcaaactattttcaaacatcaaatgcaataatacattacttaaaaatagggcatatcatttccttgctaaattacacatcaatgtttggggtgggaaggttaagcaaaaaaatctttgctttggaaaccaatgcttaaaaacattttgattattgctcctgcatttcttatgttcatatttaacagggagagcctggtgcaatggggttgccaggattagaaggatttccaggtgtaaaggtaagcacagaagttagaaatgtgttcatttattcaacattcaaaattgtttactgagcacctaatgtgccaaaaactgttttaggttagggatatataaaggaacaaaacagacaaaaatgtatgtactcatgggacttacattctagcaaaaggatatagaaactaaaagaataaacattttaaaattacatcttattgttggggctatggaaagaaagaaaaagtagaatgggttaaggaggatcaggaatgctgacggggtaggagggcagtatctgagcaaagacctgaaggaggtgagagggagagccaagtcccctccagtctggaggaataatgttccaggaagaggaaacagcaggtctaaagagtctgagacataagatttcctgatgtatccaaagagaccaggggagggagtgaggagatagtcgtaggagatgaggtcagagaggtgggggtggaggtgggaagtggccttgtcatatagagcagtactactcaatgtatagccagtggagaaccagtgccagtctgcagaccctttgttatgggttcagtggcaaggttattacagagactgagagtaagcacctaaaaacatgtccagtaatttgtctaaaattgtctagcaagcatgtgatggtagaattatctttgttcatgatatgttagaaaataaataaaagattgctcttttaccacaggaagtttgagaaacactaataaaaaggcttaacagctattgtaaggcctttatctttcaatctttgtaaaatgcagagccatcggtgatttctgagtagtggcatgagggaacttgcagccagagagttgcaagggtggaagtagggaagccagttagaagatatccagtaatccaggtgccaggtgatgctggctcagatcagagcagaaacagtggagatagtgagaatgcctggatttggatatattttgaaggtagcactgataggattttcagattgattgcattattagagaataaagaggagtcaaacacgaacttcagttttatgacctgagcagtttgcaaaatagggcggacatcatctgaaatgaggacagctatgagcaaggcctattttgaaggggtggaattatcaggagtttaattttgtacgtgagaccaaatttggagatatctgttagacagcaaagtgaaggtattgagtaggcagtctgatataaaagtaaggaatgtggaaaagaagtctaagtggagatataaatttggctgttctaagcatagagatgctgttgtaaagcggaagactggataagattaccaagggaatgccaatagagtttttagaaacagaagagtcaaggattgagccccaaggccctccagtattaggagatcaagaaaaggagcaaagagcaaggaagactaagaagtaaccagcgaggtaggaggaaaacttggtatcctacaatccaagagagaataatgaatcaaagggaaaggagtgatctcctgtctcaaatactgcaaataggtcaagtacaatggagatggggccaggtagaatggtcaagtattgaacattggatttagcaatgtagaggtcatggatgaccttgaccagagaaattattatttcactatatggtaggaacaaccgtggacttgaatgggtttaagagagaacgaggaaaaaaaatagagtcagcaagtcagtataaataatgctgacagagttttgctgcaaacggtagcgaataaataggccagaggctgctagaggaagtagggtcgaggttttataagatagattttgaagataataaaaatatcagactgcttatatgctaaaggaatgactcagtagagagggggaagatggggatgatgatgctggagagaaaggagagagtgctgggccaatgtctttaagtagcctagagggaaggggacctagtgcatatgtggagggtttggcttcagagaggatagtttatctacagtaaaaggggagaaagcagagtatggggacagaggctgataggtgggaagatgtattggatggagtctacaaaagttgttttctgattgcttaaattttctcagataaagaggaagcaaggccattaatctgagagcaaggtagggtaagaggttggggagaaggtccatagttcagggaccacagaagtgtgatgactgctcagccctagggaccctcttgaggttcatggtcatgaactgaagtgagacctctcaacaagactatgtgtgctggcaaggcacagtggctcacgcctgtaatcccagcactttgggaggccaaggcgggcagatcacctgaggtcaggagttcaagaccagcctggccaacgtggtgacaccccatctccaccaaaaattagccaagcgtggtggcaggcacctgtaatcctagctactcaggaggctgaggcagaagaatcacttgaacccaggaggcagaggttgcagtgagccgagatcgtgccattgtactccagcctgggtgatagagccagactccgtctcaaaaaaaaaaaacaaaaaaaacaggactacatgtgcttttccagccatgttcagacattcaggtaaagacacagaataggaggggagttggatttcaacaatgttctgcttttgacggtgagtactggacggaagaatgggaaaagacccttactggcttactggtatacacaagggaatgattctaacaagtaaccatggaattttaactaggcaagagagagggagaggccattgagggagtgaaagataacaaatttgtaccatcaatggattagggtttaggggttcaaggtactcaaagagtgaattagaatgatgtggaatggtggtccaaagttggaacgcatgaaattgagattatggatgggcagcaaatatttttactgacaaagtgtcaggtgtaactatgaaaataagaggtaagttcattcgagaatagtggttaaggaatgagaggcatgagacatgcaaatatttcattgaatgaaaagttctagtatattaattttaaaaatgaaaattttgtaattcaaaaggaacagagggaaattgatgtgtattgcctgtttatgtcctttacccatttttctatcagttatttttttctttttgatgatggctatgctccatacgttaaagacattacttctatctcatgtgttggagttttcatcctagttgatctttgcctttcatttttacgtttaatcttattgtaaatataaccttaatgtagtcaaatctaacactatatttctttatgatttcttgttttggttttatgcacaaaatgacttctacttttattttcaaccaaaatcagaatgtcactaatatattctttgagctcttttataatgtatattattttatttttatataaatctatgtggaattcatatgggatataatgtaaagagaagaagcaaacttttttcaatgaaattatccaattattagaactgtttgttaaataaaatcctattataaatgccggtctgtttctgatatttctgttatagtattttgatatgctgcttaatcttatgccaatattccattatagctttatttattatatgtttaaatgttggtattactagtatctctttattattattcttttaatttttttatcctctcagttattatcccaagtaaactttagtatcatttgatcacactgcaattttgtaagaattgcattaaatttataaattagtttagttagcaatgacacctttacaacattgtcttgctctccaagaacagagcatatctcgtcattcattaaatcaagccttttatgtccctgagtaaagttttttaaattcagtttctgcccccaaaaattgccattttattatcccatatatatagtcgttagtatttttagcattgtcagctttatctaaaatatcacattggctcttaaaaaggagttgagtcactctgttgttcagagcaattcaagggatcttctaattggccaaatgagaactacaaatcattagttgtagatcattttattctaactctatatccaatgagacaaggataggaaaagctttttggaagacactcaaagtgcttaatcttttaagcaagagtaatgatcttttgaacatgtagaataaaaatattgactaatttaactataagtatgtaaggggacattaaaataggtcacagaaatgattatgcttgctttcattaaaactattatttactttagttttatggaaaataaaaaagctgtaacgagttcagttgtcaattagctactcagtttgctatttttccatctacacactagcttcaccccatctaatatcaataacacttatcagatccaaaggaaagctttaccaaatccaaattattatttgagaattaatttcataactaaagacttcattgatgtcattaaagtagcaatgtttttaaatcccaacagggagatcgaggcccagcaggtcccccaggaatagcagggatgtcggtgagttcagattacttcacatcattttcacaggtaaacggttctatctccatgatacacctgtggccagggatcaagacaggcaggagagcataccataactcccatggcattaggttcctgacaattctagtttcataaataatgccacctgtattttccacctccacaatcctctatttcttttgttttgttttgttttttgtcctcttttattttcttcccaagtcactttcatggaggggagaggaaacacagttactatacattaatttatgagcacagctttggaaagtttattgtgtttctctattcttgtcatatttcaaggtttctcagtcttcaaaagacagagttcttatcctcaggcatgtacttcaagttccttgtattaatgcaatctgcctgagttattccttagcccagtgttattagcagagctttattgctgctaatgtttcctcataaactagcccttcaatcctctcaatcatttttgttgctctctggtgtcaaatgttttaatctcatcaaggccttttcaaatgaataggaagtgttccaggaaaggttgaaattatttctctgagccctagagatcattctgatcttcattcatgatgctctaattaaaattttgtggtcacgctttatgaataagaggccatttatcctcttgctaggtgctcctgcagggcaggtccaggataacattacaggaaagtcaatggaaaccatgggcttgtatcacaagaatataagaaagataagataagataaaggccctacaatcaccacccacagtcacccaccgagatctactgacacccaacaccacccaaagccctgctcatctcccactgccatcccacaaagtgctcagagccactctacttcactccattaacttctaacaacacaaaatagagccccatccatcatctgcatccttcgtagatgatgacattcccttacttagccattatagatcaagtcaaatattcgtatgactgtaaaagtagcatgaaaatatcttctttggaaagctcttccaaattttttataaaaggaagtattcttgaaagttgactacacacttaattctattccctcactactgccccactcacagccattcccagcaacatatttggaaatcagtttctggaagtgtccttagagaacctttacaacctgttcctcttatactcacatcctgtgatttgaatttttgtttccttgtgataaaataaagtctagtttttttcattgtgttcacccaggtgtgtctacaaattacattttgctattaccctaaattaagcttatcttctaggaaaaaatactggccaccattgcaagtatttaaaagatgtgcaacagtggccacaggcaatccaaatgagaaattccaaatatgtttttcaaagaggaagcattattgagataaggggctagcctgccacttagttggatgtctaagatctgatatatttactaaaaaagcagttttcatatgtcataattaaaaacattaactggctaggcatagtggactcacacatgtaatcccagcactctgggaggccaagatgggcagaacacttgagcccaggagttagagaccaacctgggaaacatggcaaaactcttgtctctgcaaaaagtgcaaaaattagctgggcacctttagtcccaactgcttggaggctgaggtgggaggatcacttgagcatgggaggcaaaggttgcagtgagctgagatcgtgtcactgcactccaaactgggcaacagagcaagaccctgtctcaaaaaataaaataaaataaaagcactgactgacaattacataaataagaaagggtaaaaaatttacatactacaaacatgttcagttaaagatgcatgttagatttttataactggcccttctgcggctcagaagataaaatagttaaaagaatctagaaatagacaatggtgatggctagatgacagtgtgaatgcacttagtgccacttaagtgtgcacttaaaaatggtttagagggtaaactttaggttatgtatattttaccatgataaaaattttttttcgaaaaatggtgattgttctagttgaagcagggctggggcctgcccacacagagacactggtaactcagctgattaccaaggggacccaatcctgctcttcctagaacggaccggtctatccctttcctgtatattcagggctaaccagggatttcccctagagcttctttctttgccttactctgaggaaagcgtgtgggtttacaggaagaagtgcctgtgagtgctggtcgtggggtggggcctccggtcagcatgctctcccccggatgctctgagttctccactggtcctacctgaccttaggaatgacttccatcaatgtcccttatctctttgtctcagatctcaaggcccgagccctctatacccgccatgtcccacaataagacccttcaggtcattggccttctcagctctaacacatcttcccactcaggcccctaacaacttcagcacaggcaagctgtggggacccagggatgctctctctaacttctgcctgcctagctttgccattcagcaccgtatctctacctatggagggatctccttccggaattctaagcagcaagttgaaaaaagcccatttcttttcatatttctccaaaacctacttggctttttcaggtctcagccccaccacacctacatcccacgtcgtctatctttcccagccacattagaccaagggacaggaggtggttccttctcagaggcaaccaagccttgcctgcacactcaggccttgtgtgcttccagtctccactggaccgtctgcccctctcgtccctcgctgtggtctgtctgctccaggatcggtcatccaagccatggtgtagtgacacaaacttatctgtttcttttcctgtcaacaaaacatggcttttcaaatcaaacatgattttttcaggttgtcatactatgaacttaaaagccctcttgtgaatctcaaagcctagaaaaaaacttatttgatgctttgtgcccatttctccactcccaaagtaaagaagagctgccaggaaaataagcacaagagggatgtccaataatgatgatactttgggctaatattttcaaaaatattctcctctcctactctccaccatccacacaaatatatattcgaagaactgcaccccagtctgaaacttatggcctgcggagttgactatatgttccccagtctctgtccccttagaaatgccactttatttatttatttatttatttattgagatggagtctcactccgtcacccaggctggagtgaaatgtcatgatctcagctcactgcaacctccgcctcctgggttcaagtgattctcctgcctcgggctcccgagtagctgggattacaggcacgtcccaccatgcctgggtaatttttgtattatttttagtagagacagggtttcgccacgttggccaggctagtcttgaactcctgacctcaagtgatccatccacctcagcgtcccaaagtgctgggattccagacatgagccaccacacctggccagaaatgccactggagagcatcacccttgggagcactataaactcaattggggttgggggaagagaagcatatggtgtcgttcagcaatttggctcctaacatttctcttcaatttgccttgccagggaaaacctggtgccccagggcctccaggagttccaggggaaccggtgagttggcagttactttcatgacagttgtacttgtgttgtacttgcatgcagttttaaaacatttgttggcaattaatttgtgtctgtggatgtgtttatagggtgagagaggacctgttggagatataggtttccctggaccagaaggaccctcaggaaagccagtaagtacttcttactacttaaaatatgccacctagagaaatgctctaacattatctcctcatctaccacctcagaaattctgagatttgaataagcagtttccaaggagtaagaagaatgcacagatggatttttgatggcaagggcaggagttcttattgagttccctagatctgtgtgtggtatctttatgtcttaaacagtgttgaaaatggtgagagttttaagtgtcaggaaatctgactcatcatttcttaagcctaatgttctcaacagacttaaagaaaatataatggcctgtcatgtcctaaagtataaagaaaccaaagacttatagatataatacctgtatgttaaaccaaatcctaaagtagaagttattttctcaaatttcctcctttgtatacaggccttgttttcttacactttcataaatcactactggtgaatgtctcatccccttgtgtcctaaaagagctcttggttactgatctgtggtattgatgtgacattgtaacaatcattctgactaatccagttccacataaattcatctagtcactgctgtttgctaagaatgtgctgggcccttagggaggggatctaagatgaataagacagatctcactctcagagttatcctttacagaaggtcactgctgatttgtttgctgtggtgtgtatgggaaagaagtcgaggtgaacaaacagtgcaaaattcaggaagccagtttggcacctctgtgaaaccttcagggttggtggccaccatttcctcagagaagacatgaaaaaaatgtaatttagagtcaggaagatctgggtctgaattatggttgaaaggattttatgagtcacttaagtgccatgacatatggaaagcatttccagtgcctggctatgggaggtactcaataatattagtttcattccctgcctcctcttacctcctcattcccatcccctgcaaggcatatcattaaagcctgccactgagttcccaggagattatgcaaaaagcaatttgttcatcaccaaatatttcttgagcacctcctacatgctaggcactgttctaggtggtaacaactcatagcttttgcattctaatataggaaaacagataaaaacaacacacacacacacacacacacacagagtttcaagtagaagaaggtataagtagagtaaagctctggaatattattcaaatagtgggctcagagaaaatttgcctgcaatttgagcagaaacctgcataaagtgagaagtcaagccatgggaaggtcagaggaccattgtttcaggaaaaagaaatggctaggagagaagtgagcccgatggggtccaggacctcatcaaaaggcatgaagtcaagaatgaacgaagtgaaggaagagttggaaagatacggagggagatgtaggcagtggccagaccatgaagaacttccaagccagggaatgaagtttggatttcatttgaaatatgatggaaatccactggagcttttgtagcaaataatgaaaatgattgaacattttgaggatcactctgatattgtgtggagagtaggctgtagggagtggggtagaggaagacagaacagtaagaaaacatcaccatcatctccacgagaagtaatgacagtggaaacagccatgagtagaggaacttaggatgtacattgaagagagagccagcaagcaacaaaacttgctgatggactaatctagagaagtgtgagggaaagagaccaatcacagctgtggtgtagggtctgagcaactatgtgagagtgctgctgtttggtgaaatggggcagactgaaggtaggtggatttgggagggagagccaagagttctgtttgacatgttcatgatggagcactagcaggtattcaggtggagatgtcaagtacacagtggagacttaggagaggccaagattggtgagaccaattagggtatctaaacctgagcctggaaaagtggagtcactgtggataggaagggaagagagtgcttcaactgttaggaagacaacccaacaaagaaggctgtgaaactgcagccagagagacaggaagaaaatcgggcaagtgaggtttccttgatgtcaagtgaactgttttaagagaaaggagaaagcagtaaggagtgatcaacatacaggtaagtaatatgaggggtaataattctctactgcatcagaaacgtagaggtcattggtgggagagatcaccacatgttagtatcttggtaagaatgatccagttgagagaggaaaatttgatgacacaggagagtgaagactactttgagtagaactggtatactcacaagtgggaattggtcttaactaggaacaggggcagttcacccttcctaactgtggagtgtgggggtgccaaagttggggtgcaaatccatgaagattgacgcaactggtggagggatggtgagaggggtctcttttgtttgttagtgaaagaagaatggaggttgtccaagtgtgaggagtggggaggtgatgctgaagtttggaagagacaggaaaatgtgtgaaagagtacttttggagagatagaaagggagtcaaattgggaaatacagagggatggcctggtaatgctgagggtgctgcttgccatctgctgttgaacatttgggttggaacaagcgagcaaagatacgtggttttcttcagccaatcagctgctcagatgcagatgtgaggtaggcagaatgtacccaggaaaggggctctgccaggtgaatgagatgagggtagagaggagcaaatacatatgagttattgtaaaaatctctgaaagcagggctgccctgtggatagaaagtaacaccttcctatacaaaagagaacactgatgatagtctttgataaattactggagataaaaaacaggttatagggttacgtattttcttatattgttaccaaaaacatgaactacacttttactctagatttatcttctcttattcaagtgacacagctgtttctttcacatcctctcctaatcagctttatccttgttccttgtgtgtctgaatgtaataaattctttgaaccatacacttcaggtaacatgttcttatttaacgtactctcaataattcccaggatgtttcagaaaggttggcgaactatggttgggttgtcaactgtgacagatttcagcataatttatagcagtgaaaacacgcagttctttgcagttccatcccacagaatccattccagcacaataaaagtcccttgggcttttagaggagcaagtccatgcaattgcctgctggctaagaaatcatattcctcaccttgatcttcctcttcaaatcagatctctaaaacacacttgctgttgggccctgggtatttgatttgacctcgaatacttttccttcttatatctcccagccaatagttctctcagtcttataaatctttaagcaggactaggcttcgttatcacttctagaactcccttttaaagttcaagaaacttccagttttctaataaaaagtgactaatactgtcaaaaaccatgattatacatttcttgcttttctttcatatttccaactgaaaaataacaattgttctctgactgacactttatttcatagtaggatcatgctctggccatgttatgaaatttccccagcagcaactgagaccatttactgagaatgatactctgtgctggaaaacctgttagaaggtaacaaaaatgccatactccagccacctatgccatgaggcaccttcttatttctcaggatgacctaatagaagaataagaaaggaaaataatctttgttgactatttatagaggaccatgcatttttcatgttatttcacttaattcttagttttgaggttatttattttcctcactagtgaagagattgatgctattgaggttaagtaaattgcccaaaaaggttaatgggactagtaagtgacagtgtcagaatccgaactcaggactgtcagattctatttatttgttttccattttaccacctttctttaccaagctctcagtagaaatatgattaaggaactgtcctcgaaaccttatgcttttgttgtgtttaactatgttaatgcagagttagaaatattaatcctttttttctttatagggaataaatggaaaagatggaataccaggtgctcaggtatgggaaatatgatttaaaataaaagttataatgcatactgcatccagaatacctaccaacatttacatcaatcagactgatgaaaaatcttggcaaggagtgattttcatgttgacatctgtttttcagggcatcatgggtaagcctggagacagaggccccaaaggagaacgtgtatgtatattactattgtgattgttattcaagtctgtctgttacaactgtcccatcatttgagttacacaattatgtgtgtagacccctgcaaatcaccaaatctataaaggctagggtgtaggcgatcaaagatctctaccagacattaaatatgacaacggactcagagcaagttatatggtacatctatgtagttggcctttgtacacagccaagtatactttgctgtttaaatttgggaagcttttattatcctcctgtcttagacatatatctctactataaccatcacccatgttctttttatctagagtaaggtttctcaacctcagcactgtgattattcaggggcagataattgttgtggttggctgtttgggaattgtaaaatgcttagcagcatctctggccttcatccactagatgcagtagcgccaccatccctccaattgtgacaaccaaaagtgtctccagacatcaccaaatgtctcctgggaagcaaaatcactgcaattgagaactactgacatgcagaaaaactaagtagagtaaagaaggtggtgtgaggggttagagaaatggaaagtgtaactgaaagtatagtgaagttactagtaatgccaattatgttatatggttttgtgttgtttggagcgttaatgtcattattgcaatttctctttatttcctttaatgaacctcaacattttctagtagaattgatttctactagaattaacttctactagaattaatttccactagaattaatagaattaatttctagtagagtcatgccactgcaagaagttactcaaacattgttactcagtgtaattctattaagggttgctattgtatgtgagtgtgggcacatatgtttgtatactggtgtctagttcgctaacttttatttatcattatacaagtaatctataataactgaaggaaatgtgaaaatacagatgatgtaaatttaaaaggaaataaatctaccttaccccactacacagagataagcactgtgatatttgtacgtatttccatctctctcactctaatacataatatacacatatatttatatgtattaatataaacatatacttttccaaaaaggagcttatgctgtcttgtaagtgtcttttttcacctaacgatatatattgatcttttcttgtctgtaaatatagatctatatctaccttttaattgctatatgttattctactatttgaccataccttatttcacttacctagtccgctggacatttggattccttctagttgtcataataataaacatcactacaatgaacatctttgtacctaacttataaaataattttaatatgttaaagattgcatttatcttgcacatgatcagagtattaatcattgatcaaagtgtgctaatattttttcttgtcatctcagaaatttctccaaatgtgagctggagtgacagacctgtatgcagatatatttttataactaagacagtagcattgataccaggcctaagtgcttttatttctttctacatggcttatttccatatctgattctatgatcacacaaatctctgtaactgttcatttatttctgttaatttttaagtcaagagaaattgagtttgcccttctgcagagtagtcatagttaaaagaataatataatgagatacaggaccacttcaagcatcattccgtcatatttggtgtgaggatcacttcctggagttatgcaactgaatatttgaaaatttatgactgaagcaactgccatgatctctctctctctctctctctcattctctcttgcacaaacacatacagtagtagacacattccaggataaaaaacagcatcaagcaaacttcatatcacatttaggcacatctaatataatattttactaattaattatgacatcttattcaactgattcttgtttttttgttttgttttgttttgagacagagtttctctcttgttgcccaggctagagtgcaatggtgtgatctcaactcaccgcaacctccgcctcccgggttcaagcgattctcctgcctcagcctcctgagtagctgggattacaggcatgtgccaccacgcctggctaatttttttgtatttttagtagagacagggtttctccatgttggtcaggctggtctcgaactcctgacctcaggtgatctgcccacctcggcctcccaaagtgctgtgattacaggcgtgagccaccgcgcctggcccaactgattcttccatagttcatttatactattgagtaaatgatgtcagtgacatcctccccccagtcacctgctttgatcttttcaatggttctcccttctcaccatcccgtgggtatatatttagggcacagtgatcacactcaacgtgcacacacacatgcatacacgtgtaaagcacaaatacagaaaacaaacctgaagagtctaataaagcacaaacaaacaggggaaagccaggggtggggagagcacatgatttaggagagattttgaatgtcctaaagtttttttaagtgaaaagtctcagtaatgagatcctcttggcaatcttcctttatcattgcaaaggagacccagacctcaagtgacagctggtattgactcaaaactgccatcatcctagatgggcaacaaagcacacctaacattctctctatcttttatgtattaagtactgccaaggtgccaggcattgctctgagcactttacttgggttaattcatttagttctgaaaatcgccctatctaatggatactattaatatgcccactttgtaggagaggaggctaggacacagagagtttaagttatttatacaaggcccaacagctaataagtgccagtatgaatccagaacttttgctctcaactacagctgatgctagaagagattattctttgttattattttttccttaacagggtgatcaggggattccaggagacagaggctcacaaggtgaacggggaaaaccaggccttacaggcatgaagggggccatcggtcctatgggtccaccaggaaacaagggctccatgggatcccctggccaccaaggccctccaggctctccaggcatccctggcattccggtaagtagtgctaagacgctttagggctcctggcttgtaccgaccatgtatcccttttacaatgaaagcaatgatactgcctttcaaataaataaaacaaacctaaactggtccccgtgagggcaataatagctgtcatttaaagttatgtgccagatcctctactaagcacttactatacattacctcatttgatcttcacaatcattctggaaggattggtgtccttttcagcccagttttataaacgcataaaatgagcattaacttgcccaaggtcacagatttattaagtgggtcagacccaggtctggatggcttcaaacccacgcttttaacatacaggtactgtctctaatgtctccttacactacacagaaaccacatatgcctgtttcatattgctatgaaacatgtccatttcatactctattttgttgaatatcagaacaacaaatctgccatgagtagtgccttgaagtagaaaccacttaggccaagagtgtttagtaaaggaagcccatatctttattaatcctcaagaggagtggtgagtggctattctgcagagaaatttaatctgaaaatatccatgttaggaagaaaggagggtcttgaagtgaagtagggcagttaaagacacattctcctcagataatcaaccaataccagatataaagcaaaactgagcattcatgcaattttcatacttctatatttctgcccactgtcctgaaactctacttgaataaagcctgtgtaacttcactcttggggttgtgtcagtaattggtattagttgcattaattaaagttcattaatgaaatagagcattcttggaattattctgtcctaccggaatcatcactttataagcccatcatattggattttttttatttttattttttgtcattctaagtcagtttgttgttacaaatgaactagcaccattatgttaggaaaccccacaacaatactattatcacatatctacacacagacaggatagaggaattttcagtgaagagcgatgaggaacctacccaagaatgtttataataaattaaggctcactatctaagtaggctctgcttcattcttaaattcacattgcatggtgattttccgtagagcttccaactctctcatctgaccatcttctgttatggtctttgttcatgtttatatctcagagtggggcttattgcctttgtcacaaccgccaatcttcatcatattgtctttaatgccacacatatacccctggataataatcaccaactataaagagtagtaaaatactttgaaattctaaccatcaagaaaaaaataatagctcctttaaaaatatcaaggcactataataaaacattactgttataaatgttaaattctttgtcaaatgcatgtggatttacttgtcaacaggtggaaaattcagctgacattatttgcctgcttccttttaccagatcccaattaagaaaagaaaattacttaatacctatatacttgcaatgtgtaaattacagaataaactttatgatgaaatgggtaaaacttgcttttatcccatgaatacaacattttttaaaataatccagcatacttggagttctgttccaggttgtcttcctttgaaaatacattatatcaattagatattgactttgccatccagggattggttaaaagttaaattgtgattaggctactaacatcatgtttatactttttagattatttaaccttataaaatgaagtcataggaatgtcttccctaactgtataaagccatgtgtctccatttaatgggaaacctgttgataccactggttatgatcccagcccatagcttttaaagcaattacacacttcaacttcttcccagaatttggtcaaagcaacagatatttattgcccaatataatcaattgccaaaagcatttttcttgataaatgcatccctacagaagtttcaaataggcaagccaacccaatatttctattctttattcatttgtgctatgctctattttaacaacctttttttttccttcttcaggctgatgcagtttcatttgaagaaataaagaagtatattaatcaagaggtcctaaggatttttgaaggttagattttcttaataacattttcgaatttttcactgattcccacctcccacctactatggggaatccctccagcaacattctcgaaagatggccatgccacaaaaaccttaaggggcagcccattttatgatgggacagctctttgatgaaaattcttctttatacaaagttaacttttgcctccctggaacttcctttcattatacctggtctgtaaaacaacacaggtaaagtacctgcttgtactcacatgacagccctttgagtatttttcaatatccctcatactcctccttagttttctcttttatggagtaaatgtgtctagctcctccactattatcacccctgggaaatgtttaatttataaatgactctcatttaccaaggaatattttgaccaatgcagagtagtgtctttttatttagaccaaagtcagcaaactgtaccccctagccaaagctattgccacctgctttgtacagcctacaaactgagaatggtttttgctttttggtagggagcagtgggagcgagttatatttttaaacggtttttaaaaatcaaaagatatttcatgatatgtgaaaattatctgaaatttgaatttgtttccataaataaagtatgcacattccttcgcctcttttctctggctgttatcccactacagcaacaggactgagcaattgtgacaatatggtacataaaggcttaaatattttctatctggcccttgcagagaaagttctgacccctgctctagatacttcaataattcatcctaagatgtattgctttttggaaaaaagcatccatattattctgttgattcattacgagttttcagttaactaacagccctggatcttccttataaaaatatttttaaatgaggtgtttctcattatggactgtgtgtttattttttgaatctaagtgtgtgatcttatgtttcctcttattaatttcaaatcatttgtgttcatatcttgttccaacctgaagatgtcttttgaaatgttgtctcttgaagagcaggttggctgaccctataactttgtgtcatgctaaatttcataagcatgtcatcattctagctgttgatagaaatgttgactaaaaaagccaagagtcaaggattaggtctttccaaatgccatgggattctttctgtccacttgtaaatcatcttctaatctattgtttagtgagctctgaatccatttcattgtcctaaaactcaccctacatttctttgtctatttgcaaggaattgacagtatcacatgattttgacaaatggtttgctaaaatcaagattactcttctgaactgtaagatttaacaaatgaatccatgttggttctcatggttcctacttcctttgcttagcatccataagccaaaaatagattgttgaatttttttaaggaataagattataagatgccccaagtcgatcttgactccattgcttcaaacacggactcaggtcttctccaaggagtcttgattattttaaataataattagcagtagagactgaaatcttggtgcttggatgcacattatcttactttatatgagaactagaaatacagtagagtaacactgggacttgtagctactttaatgacaaaacagaaaaaaatggggttttttgttgttgttgtttggttggttggttggtttctgaggagtctcatctgtcacccaggctggagtgcaatgacgcgatctcagcccacagcaacctctgcctcctgggttcaagcgattctcctgcctcagcctccagagtagctgggattacaggcacccaccaccaaacccagctaatttttgtatttttagtagagacggggtttcaccatgttggcaaaaaatgtttttttaaaggtcgtgaatttatgctgttgattttaatttaccttgatcttcactaagtatctttatcttgctctgatatgacagtttactaatacatttgtccactcttttgttgagctaccagtaattttaatgttgcccttaaattttgaggtcttttctttcattctctttcattctttcttcttctttctttctttatttctctctctctctttctttctttgttttttttgacccttgaatcaaacattgtggactagactctaaactttgctttccaaacactcatttccccgtcaggaagtttgaaaaaaaggcaactgtttgaaaaaagacatctcaagctcttcaggggaatactgaagaatatacccatggctacataatttgcggtgttcagtgcacagtgaaaatgctggcacacttgttaaaaaatgattaagaattttaagacagcaatagtaaagccgtaaactaaacatggggccctatgtgactgcataggtagcccggacatgctagtcctggggacaggacatctagaatctcagatagtatccatgcatttagttgacctcaaccatgaaaagagaaatgccagcgtatgtgtatttttgaattgcaatctaaagttttcctttaactcttaatccctatgggctgtagtgtctttatttatcttttatctaagagagctttaatactgaacttcagtctcttaagaggctttagataaaatcatatatttaatagtcagtaattaacccatctttttggaagctgattaagaatgtcagaaaatataaccaagcattttcagaaaaaaaaaaaagtgacatgttgagatatagaaggtgttcgttttacaagtccatcagacactggatgaaggtgtggcccctggcagcctgccctgtgcattcagcaaaagagacacttctactccctcctggggaaggctccgtcctgcccactcccaggccattctgtggctactctcatgaagggctatcagtcttcagaggaggcaggtcaggggagttgggccactctccatctgtgttggggcaggctcaccagacttctgctttctgagaagctcctcctctgggtctggatccttcctctctgagttcctgcccctccttcctctgtcacagcccacctgcctggaagctgacaggtgcagagtcctccccaggtctctggcttcacacccatctctcttactgcgtctctgtctcttccagcctggccaggtccaggtgagtggctggacccccaccagagccagtactccctcagaaaccacaggtgtcttagccttaagacaatattttaaagcgacccataaggaaactattttctgagacttctaaactctaagactccatgtgtgatagccctttccttttgtctctcttgacactagtccagcaaaactgtcttctcccaaacaaaactgtgcctgaaacccagaatttagttatttagcatttaagttaatttgtcccaagatcatttcaattcactccatttaattttccacttagaaatcactttttccatggcttctgaacaccatttacaaaaaagaaaaaagaaaactccattttcacaaatcataaagctccaaggtcacaattaccattttcggaaagttttttctctaaaagcaaagattaattttcacatgttaaaacagttacagttaagtagtacagacagctaactgctacagttaagtagcacccgtctccttctctttttcttagtggtttcacaagagacagtgtcaataacagctaatgctatctctgctgcacgcatccctgcacatctgcagcctcgagagccattgtctccgagcggcaagtcgcagactgtcagcagggactcgaaggagtccttggaagatcctgctctccaactttatcatcccaagtgtccagattacaccctctagtgaaaccctagaccaggatgacccaaactttgggctctcctcttgtggctttttaacccctttggggcttcccaggtgacccacctggtgatacaataccctacaaatctcaaaccttgatctattttccaggccacctaacctcccttcaacatcctggtgccccttcccaaacctaactgtggtggaaagaggtgtcttttcaccaatcccaagtctaggttccagattgatcactatgcacaaatatatatcctctctgaagttcaattaaattcccaatttgattgtccaacaagtcaagtccttttgctagtaaagtgaccacacaggacaaggacagatgccatccatgtgtctcagcttagcatttggctttagaagggcttcccagctgccagtgatgctgcccacacaaatgaggctcttgccagatctgagaagtttaattcttgctattacactgtcctattatgcttgggaatttacatcaacatgcaggaagaatttaccaacctttgcagaaatgtgtactaacatctggctctctaagttcttgagtcaaacatgggaccaataagcccacacctccagctgtgggagaaaagaaagatttgggctaagtattcccgaacaatgtttctgcctccagatttccagtgttcagaaaatccccttacctatgttttctcgatatgcatttcatacatatatttcatatatatatatgcatatatatatgaatgtgtgtaaatatgtatgatcctattttcttatcccaaagttgtaacatcttttcttacctctctacaactaagatattaatttttatgtatgtatatatgtacttgttatatacacttcatctgataaatatacatcattgatgatatatatatatatatatatatatataaagagttaaaaaatatattttccaccacatagtctctgtttcttccaatttgcttctttctgtttttttggttgcaactctgttgttcagtttgtaggatttcctcagtgtccagtaatccttggctgtctgcatacataagagcagggttttaaaaaccgattgaaagttgtgagcgaacagtggggcttgccaacctcgagtttcacttagggtagtccagatgggctttttaagtgagggacccttaatttcagtgtctttaagtctttactctcagtctggtcagattctccagtggagacattccatttcctgcctggctgtgagcttagctacttcagattttcagtttggaagcctgagtctcaatggagtctgggctcctccatgcagaggcagactacttacccttttaagataataataaaccctcagtcttttgctagggatggggagaggcacctgcctagctgtatagagaaaggaatttcaacaactactaaaacaggctttcaatcagtgctccttattttagttcccctctttcacccccacttccagaggtaacttgtactgccaattctgagccttctgaggattttgtagtttaggtcaagttattcctctacttctagtctaagagtttagttttcttgcatttgttaagtaatgtatcactcaaccgtctggttcttaacttccaaaattgtgctgctattgtctcctttcatatgctcccccattcttgtctgtttaggcctttaggaggattgttttgctaggattcaggaggtagttaaagcagatccatgtgtttaatccgccatctttacccatgatagttcaaagcaacatactcattaaggtggcaaatgattgagacagagacaagtgaagtagtaaccacctttgggtcataatgaaccacaaaataaatatgaatccaccaaatgatgctgttgaattaacagtgaaaaatgaaactagaatataattattaaaatatcacaggaaattactcttctgatatttttgccctttaggagagaactatatttaattttggtttccacatttaggagacatttatggaaaagccctgaaataatggaaccaaaaggagatttacaaaatagattgtgaagcctatgagtaaaagttatttaacctgaatgctaatatgtaacaatatgactgatttcccaagggaaatactcattaactgctctctgtttccataatggggtagcaaaataaaataaattgaagttataccaagaaaatggataattagacatttccatgggcattaggaggagaagaatttctgtctttgaaatatttacaaattttgtctgtgaaatagaagatagacatgggccagatgacatgtgtgtgttccttccttctctaaaatacgtagtttatcatcatattaatattaatgtctgtattatattaaggagcccattctccaaggaagccaagccttggtctcatttgttagagtgactgctgtggctttgccttggcagatggaaaatgtgtgtttggtttatgcatgcttatatcggaactcttcaattcctgcctcattagaaagcatagccaaaaacattttaattgactgaagatccctgaaaacagaggaaaagcaattaagaataaaggcctttacaattcatctggatgctctgaaacatattattgtaaattatagagcattagggtagggttcagaagaggtaattacccttatgctaaatgactgtttctgagtgtatttcaaagccagataatttacagctagaagtagtgaaaataattatctgttttgctaaaaatattaaaaaccaccaaagtacttctaaactcaattcatatattaaagaggaaaaattagtactgtgaatatttgtgtttcgacattgaaggtatttaaacagacatgtttcaaattaagaaaaattgtgaccggtctcagtggctcacgcctgtaatcccagcactttgagaggctgaggtgggtggatcacgaggtcaggagatcgagaccattctggctgacacggtgaaaccctgtctctactaaagatacaaaaaaaaattagccgggcatggtggtgggcgcctgtagtcccagctactcgggaggctgaggcaggagaatggcgtgaacccgggagacggaggttgcagtgagctgagatcacgccactgcactccagcctgggtgacagagtgagactctatctcaaaaaagaaaaaagaaagaaaaattgtactgaaacacatctcttctttgaggtgcagaacagcaaatattcaaactgtgattattgaatttcatatttattgtaatgccccaagttcataatttgatgtaataaagatattatatgtacattcagtatgatgatttgtaaaactaaaactatatattaattacctatttgttttatctattaattactagaataagatatagtaatatcaaccacacatcccaggtagatagtgaggtagtgatactcgagggcaggtgatttcatatcactccttgggaccagcatccattagatccctgttggcctcccattcatccttcagtctgcagccagagattctagtcctgtgcgggttgtggtatatttccattctgcatgctttgtgacatgagaatgtgaatgtaggtgattacttttcggataatgtcagctaatgctctatagctattggggcttttctcttaataattctatatgaaaaaacaattgtttttctttcttaaccagtatgggcctacattgtttttaaatgattgttttaattgaaaactcatgggaaaacagattttcctcagaagtaatttactctttatttaaaaatttacataaaataaaagatacatatctgtttaagtatgcctttgcaattcaactaaatcaactaaactgaatgaaaagactggagaacatggaagtaactctttacaagacctatatcatttgggctttgtgttttctaactgacggctatcgtttctactgcgttgttgtctgtcatttggtctttacttacaaaataaatactaatttcctcagtaaaaaaaacttttctggaagatttgtctgcaccaaacccagactaaagtttttaaattgaatatttatttcttactacacaaaagtgtctttgaaaaattgtgtgtaaattattttaaaataaaaccatttaaattactaagagatttttgaagaagttatgcaaaaagaaaaagaaaaaacaatgcgattaacttcttgtcatggcaaggatagagcctcctcaggttttctgtttgaaatctagttgttcatatattagattttttaaatgtgaggtatactaaatataaacaaaccaagcaattttaagaaagactccagtgatagattgtatttataatggccttggaatgagttaatgattttaccaaaattaatttcatatagtagtaaaatattcgatatgctttttttagttatctgttgctgcataagaaaatacctccaaactttagtggcttaaaacatttatcttacatttcacattataaatgtttattatctcacattttttatgggtcagggacttgaagtgttgcttaattgtatggatctggctcaggatctctaatgaagttgcagtcaggatgtcattcagagctgcagtcatttgaaggcttgactagggctggatgatctgcttccaagttcatgtgcgtggccactggcaggtagcatcagttcttccccacatgggcctctccacaggacttcttgggtgacctcactccatgtcaactgccttcctccaatgagtgatctaagagagaaagcaactaggaagccacgatgtcttttatgacctcatctctctagttgcccactgttaattcagcctttttcttttcactagaaatgaaaagtctagcccccattcaaaactaggagaattaaactccaactttggaagacagtgtcaaagaattcatgaatatattttaaatcaccacacatacgttcacaacattcctggaaagtgccttaaagttattatgaaatcattttttaatgtgaacctaaactctctccacatgccattaccagaggttagattccatgctagtgttctgtccactagattgttacatctcagaagcactgaaaattctcagactttctgagtgacacagctggtctgcatctatacacaaacaactttgcaatcgatattatttgtctaatcaaaaaactcagcagtcagaccagttggtaaattagatgtgcttaaattaaaaactaaatctttttgtttgtttgatttcatgtattttgaaattttttgacataaaatatttctgttctatgatatattattttttcttctatacatgaagagaggatggctgtattcctatcccagctcaagctgccagcagcaatgttggctgcccaagcttatgggagacctgggccaccagggaaggatgggttgcctgggccaccaggagaccctggaccccaaggtaagtcttcaagtgtaatattggcttattgatttttaactctctgtatttataacatgttagtcacagttaaggaaaaaagtatgtatgtatgtcctttatttatacattacatatataaatatatgcaatatataaaatggtttcatatgtaatctctttataatatttgacattctagaagtagatgtttaactattactacttcaaatttaaaaccaaatgagagttacctggtattctaaatgtattgtaaaaataatatttattataacaataacagcaataatgtgtgcttatatatcattattatctaggaatcttagaattttttaggcttccccttttggtgtaagttaagcaagtctccatcatctgagtgtcttaaataaactggagaaagagttttaggtgactcaacgacaaatagttatttggttctaaaatatatttttaagaaattttagaatctttctgctttgaatacagcttgtggatggtaacttgaatgttaaagaatttttcacatgatttctaaagttcttaaaacccaacttatattggcaaagaattttgttccacttatgacaacttgacgagagacataatcttaagtatagcttaactaaattaatctgacaaggccatttgctagaaatatgattagcaatccagcaaagtggccaaataggcccaggcttagaagagtcaacaactctgaaagggaaatattaaattcagtgaatatatatcatgaaagataagaccaggaaaactgcttcttattgttaaccatggaggatctcaggttccttccttgaaataatcaaaagcaacttgtataaagaaagaaaagtggaaattaacactaaaattaaataagaatgcagtccaaaataatatatatgcaaagaagtgtttttctgtcaccagtttccttcctactgctattctgtaatattgagcctcattttctgaagtgtcccaaggtgactgatgtgcccttcctcttctgaaagagcaacatctgttcagttcccaatagcagtgcctgttagtatatatatcttaatataaccttataacctatgaccatgattgccaagtctttgcgtttaattagcacaatataaaacaggaacagttaaaatctctctagttttttttaaacgatacatatattccaccattatctttagattatagtgaagtttggcagattgatgaaggaaagagaaaagtataggatgagaagtagccctctatgtatacactattgtgtagagggggctaattattatctttcgctggttgggtctattctgaagtcagagtatatgagactggcatgcagatctcaaaagcttatctgaaaatgtgtaatgcctcaagccacgtgaagaataagcagcgttaacaccaataggaagaaaactttggatagatccttcaaacagtggtggtttgagaagacaagaacaatggaaaattgagatgatcaaggaaaacagctctggaactggggtctcctgttccactcaaacacctggcttcagacacctcacaggtgctgcgaaggcccatttggaaggctgtcagtcagaggcaattctaaacccacagtgtcagtgaagcttttggaaacaagccttctgttcaccactccacttgcccttccttttgcaaaggatttctatggatttcatctgctcttgtgcctcaaagatattatagactacttctactcctgatagggcttctggatgcaattcttaaacttggaagatatccccacatgatttccagtttttttgtgaaccaaggtttactaaaattgtcaaaacttttgtctccccattgggtttctgacaacagacatatcttgactacaacttagtatatgtctccttaacctttacataatactttcttttcagtatttgttaaatttgcctaaaatttagcaaaaaataaataaaaattgcaaaacatagaattcatttttaaggaatatgtgtttcttaaaaatatttgtttttaaggaatatcagtacagtaggcatgctgtactgataatcctgcctaaaggcacagagaaatctcactgaaaagaaagaaaatgagaggctgctgtttaatttttggtgcctctagagaagtgcacaggaaattgaagtgtttttctctagtacataaataggtgtgacatgctcagaagatgaagttatacatgtaacttataagctttgctctgctcaatttaagtgtttttttccaaaaaggaaagaaaaaaatgcatttaaaatcaccagtgaccacgcaaacctcggatgctgttgtctgaattagtcctcttaatgacacagcatgactgagtttaagaaagggttgaagtcagaaatgcaacataggttgggaagaaaagatggcttctgaatgtgacacagtgtgttctgccactcattcatcctgtctgatggtggctcctctgaaatttctagatgagacattttgttttgttttgttttgttttcagtgtttgtcaggaaagaaatccatttggttctgaaatacatttttaagaaattttagaacctttctgctaatagagcttgtggatggtaacttttgaactttaaataatttttcttatgttttctaaagtttttaaaaccaaaagttgcttatattggcaaaaaactttgttccacttaggacaatttgacgatatatatcatcttaaatattgcttaactaaattaatctgaaatgtaaaattaaaattaaatggttggtttgaaatgtgcactatggaatgagtcctttattatctttaggaaaggacaaaagtataaaggggtttcataaggtttcctgtgcttattctgagaagccggagacgtatagaaagcagtgagaaaatcgacgtcagactgtgagaggtacacaattcatattgaaaaaaggaagagccgctcctaccaagattctgatcatgaaagcttgaggatccgccttcagcaccctgaccttcttaaagtgaaaagaaagaccttttggattctgagttgcatcacttcatttgcagtttttctaatgtttccaaaggggtgattgtcgatgtcttttttaaattgaaaacatttccagacagcttttagattttagccgtcccatggggttctgagtattggcttcctgctgtgccttgagagaactttccttggtgtccattcccacctggggcttgcagcacagggcctcatggctggttctcccgggtatgagctaaaatgtgccacatcagaataaaagaaaccccaagaagcatgattcagctgagttcccctatataaacaggagaggcaaattttcctaacagacgttattctttcgagtgagttttatgagaaaacacttcatttaaacttcttctcaaacacagctgattctccatcacctattccacccgaggaatagataccacacctaaagccctactcatttcagaaggaaactcacatgtggggtcagtaggaaaaaacagctacatccatcgcatgcaccctgcatcagttccaaaaggacagtagtgggaatagttgttcttacttgtgcacttttaaagtaattgatcatacatactgtttgtaggaagcacttgtgatgtatagatttgacctttcaaatttagtagcattaggggcatttggatatgggaggacatgtgtgtgtgtgtcaaaatgactgaagggcactgctatcaattggtggagtagaaccagggaggctaaacaacttgtaaggcacgaggcaacccctaaccccacccccaccatgcccaccgtaaacaactatccctcctaaaatgccaatagcatccatttactggcctttttccggtatgtatacaggcgcacagatttacaactttagaagtaaatctctggagtcaaaactgaaatcttcctactggaaataaacacagtctaccacctgaaaaactacaccaagcaccaggtttcatcaatgactagtacctctagatgctttcaattaggacactgctggtgttttatttgttttcctacatgagctgcagttttatcaagctgtcatcctgtagaattttttttttttgagccggattttcactcttgttgcctaggctggagtgcaatggccataatcttggctcactgcaacctccgcctcctgggttcaagcaattctcctgcctcagcctcccaagtagctgggattacaggtgcccaccaccatgcccagctaatttttgtatttttagtagagatagggtttcaccatgttggccaggctggtcttgaactcctgacctcaggtgatccacccatcttggcctcccaaagtcctgggattgcaggtgtgagccactgtgccttgcccatcctgtagacttatcgtatatggaaatacatgtctctttgcagatagaccagcctcttccaaatttaaagacaggtccacgctgaagaggtgaaaagcttaattctataaatggggaaagctgttattgaccttgttagcattcctacaaggagttttgttatgaagtaatgataaaaaagaaaaaaaaccctacggctttatggcagccttcataatgaatgagcttgggaccttaataggaaattcaagagtagaaagtacttgtgcaattcagtcgctttatctattaataacaggtaattattaacctaatgaactgagaaatttgtacatggaaattgttacatttgacaggagaagggtaaatgttaccttatgcaaatacacgaatcacagtttcttaatttgtaataccacatgaaccgaaatgcatgcagaataatatatttctgcattatattgcaaatctgagagctgaacttaaatgaaatcgctaagttttagccaatatattcttcatttggaattgcgttacactcttgttaatcctcttattaatcaaaagttcatgtatcttcagttattattcttcctcatatttttagcctgtaatcttaagtacttaccgagatagctgaggatcaactttataacttttctgtaatagtgggacctgagttaaactatcaaatatacctcaggaaataaatattattttactccagaaatgtttaagtaatggatttgggagggtggtttcaaatgaccctaagtatatacatttttttcctgctgttcacatacgttaaatgaaagtcacctatatcaaagaaatcctggaaacattttaaatttcaatatagatcaactatggttattatgtcacatgtcaaagccactgttctctctagggtctaggattgtactgaatatctttaacacaattttcaaatataaatatgtgaaggtttcctgctggtgggtgtatttctactatatacttcaaaatatttttaacatatattcttttttccactagtttcacatttatgatcaggtcttacataaaaagcaaataaatacctgtgtggtgattacattgccaatgttgttcagataataatgtgtacattgtatgacctagtcaaagtgaaaatgataacccctgctatctaaaaactgctatctaattctcaacaataatgggaaataattgatcatacatactgttcatagggagcattacattttctcctcctgccatgttctactgtaacagcacacctttatgaaaaggcacaactaaatcacagcctactgtttcctactgagatgctctcctactgatatctttgctgtgtgtccacatgagtctgcatggctgctctgtccatttaggacaaggagtgatctttaaggggctgtttaagtatgaaaaagttggaaataaaaactctatttgccatcactgtgaaactcttacagcatggaaccttttattcaaacaaagtattacatgggtgccaatatataaaatgcagataaaaatgctttatgctttttataagcagggataatgacttccagagacacaaatttctctgtactcttgtagctcagccaatagcaagcatattagatagtaagaataattttgttttaaaatatagacagatcttagacctaattcattttggttaaaatatcttaagttgatgaagtacatttgggagactgtcagtctcctctcttgtttcctagctttgctgaagctcctttggagttatacactgccatgttcaaacatggggtggatgtttaaacgttacttagagaagatataatgtttatagttgatcatttgaacacagacctgactttttagatgagttaacccacatatactcatgctcttgctatcatttattagaatcttgaattatttgttcctttcatttcctttaattcttggaataagatccgtattcctattatattatcttgttctcattttaagcaagactctttccatatacttctttcatttagcctataccttgccttcaatcagaattcctactgaagagggctcacacagcttgtcatagctatttgcaagattgatttatttaggtgtcattttcagagccaaaatctcgctatcaagagtataactagttggggctgggcatggtggctcatgcttgtaatcccagcattttgggatgccaaggcgggcagatcacctgaggtcaggagttcgagactagcctggccaacatggcaaaaccctgcctccactaaaaatacaaaaaaaatagccaggagtggtggttgagtgcttgtaattccagctactcaggaggctgaggcaggaggatcacttgaacacaggaggtggaggttgcagtgagccaagataatagtgccactgcactccagcctgagtgacagagcaggactctgtctcaaaaaaaaaaaaaaaaaaaaagtttgactagttggaactttttatagtaattgcatgttttttaagatcctcattgccctattatacccaatctgtttgatatgtaagtttaatatgtggttaatgcaaaacagttagctaatatactatttattttaagcaaatgtatcacataattatcacagactcagaaaatggttcttctctgtgctgtgttgccatagaaccctttttgtgtgtctcttttttatatatttctcacttaggctacagaggacagaagggagaaagaggtgaacctggaattgggctgccagggagtccaggtcttcctgggacttcaggtaagtgggatattgtcttcacaacacaagcaagcctttacaaattagaaccatgcttctcccctagggtccttatatgtcaagtcgagtgatccatgttggctagagggtgggagagaggaagggccatatgtgatctgcattgtaattttttttttatgtcgttagctctgggtttgccaggctcaccaggtgccccaggcccacagggccccccaggacccagtggaagatgtaacccagaagattgcctctatcctgtgtctcatgcccatcagcgcacaggtgggaattgaacacacctgaagaagacttggttcctggtaacatttccttgccactggagctctcttaataccgtcaaaccctcatcatctgtgggttgctttttttttttttttttttttttgggagtaagccaggcattaaaagcaaccgtttgaatcctattcctatagcaattgcaaatcagcattttttgatttttcccaaattcattccatatgttttgctttacaattgctatgatttttactcagagttttatatgaaatatgcaagtaaatcttatcgttagttcttcttcaaaaggaaattgcatcttgtgacttagtagactgatgatgatatccattttgtagactcatcaacatgtggttggcctttgatttctgaattttaaagtttcagacttatcttttccttggtgtttaaatttactatcattgctaaacatctcgtcaacttttttgatatagtgcattgctcctgttgaatgttttttgactactttttataacttaagaatttttataccatctacatctatcctacttatgcagaaaaataggcaataagaacttcattttacaatttagttttcaaaaaaaaaatgcaggaaactgttttatcagggagcccaaacacccagcatagccaactactgaaatgattttgttaattctgtataatgagctcaattcaaagcaatcaccactggcatgaataagtactgcatgaaaagggagtatcaaattccagttttgtatgagttctgcaaaaaaagcctaatattctgtggtcccctcactcagtctctcatttggtaaacagaaagctgttttccctacaaggtgcttggtggtgaagccaccaagctgtctttggtactcttaaagcttcagtggcctagcaagatctttgggcccttgtatccattatccttatgacctcatcaccctcagactttaagacaagaagccaccatcaaaacaaaggatgggatacgtatagaatggactcacttgtcctagaagatgaatgtgtagtgtcagcaaatgcatgttaagaaggtgaagcccaaaagctcttaaggagaattgtatttctccagaagctgcagcaagaggtacagctcaacaaaggaaaaccacaggactggatatgcaactagtgctcagaccaaagagttcacacccactctaaaaccatgtcctctgaaaagaaacaaaaatacagtgatcatcaaatgcctaaacagtctttctgttggttagctgtacattcattgaggaactgttgattggcaggcactgattctctagaacactgggcatgaggatgttgcagaaatctagatggtgggtcccacagatgtgagaacatgctgcaagagcctgccagccacagcaatcaggactcacagctcttcaaggagcagtgcagatttcaatttggctaaaacaggatgattgcttttgtctgtttactgaaaaatgagtttagaaaggctagcccactgacattggaaaaagctgtgaacagagttgtgtctgaggaatgtgcctaatttaaggcagggtttgttccaatgcatccgtgatttgaaccggttttcattatagattaatgaactgctggtcaggtactgtctacaatggctgtgcatacctataacattttaggtatttcatattgaattatgctgtatatttcaattccaagtttatttattttccaaggttattttatttattgtaagcattttgacattgattttttttttttcgttttctttcttgtgcaatacctacaatggtgctgtgttttaaacttacacaattgggacatacgtatgtgttttcttagtaaaatggtaatttatcccgaaaaagtgtacatagatctaaaatttggtgctatgtgtatatcttgagcttttaatttgttgaattttctaaacgcttacaacttatctgccactcatattaatttacttgaatttgtcataaagctaaatattttatatgttttcaaagattattttttcatattaataggttgtttatctttttgcctgtttgctaatttaaaaatatttattttatcattttaatgttttcatggacttttttgctgatggtaatcaactttttttgttttttggtttttgagttgttcttgtcatagacataaaaagacaattcattttcttgttttattaactctgttcatttttattctacaaaatatgtcatgcattctttcttatgaattgtatatttagaaatctttctaaataccattaaggcttgactggttaattcctatttcaaggatttggatttattcaggtaatttgatgggatggggaaatataatattgtgtgatgcatattacaaagtggacttgtcacaatgacacaaactcattttttgtaactgggaaatatgactaaatttgacgtaactagagaaacaaggctgtatccacatggtacaagcctttctcaccctactctattatttaccttcagatactttttcctgcctcagctctgtacacatgatatgcaacaaagggcagcaagaaatgctgggtccacctaatttaacacaaaatgaagttgagattcggcagttgcccaattcctttaataaaaagaaactaaataatttgggccccaaagtagggtgggaagttttcctctaaatgacttgatggttgccaaatcccttgcaccattttattccattccaaaacatgtgtttatttccacatagatgttaatgatgttcaaagcaggggagaagaattattcaatttcatgaataactcttgtttgcactccagaaaacaacatacatgtttaaatacaaaataattatgggccatgacgacgattaatattaaaactgtgatttccatatacaagtatgtttgagttccaatcttacattttataccaagttcaaaacactttcagatagaagtctttctatgcaaagattaaagtatgacttcaattcatatttatggcctttggaatccaaagaaaaacagaagaataattcatggatttgttcattgttctttccaactgaaggcagtaaccattacttctaaccgtaacacaaacacagcaagttttaaccttttaaacttttcactttgtgagcaaagtaaccccataagtttatttccctatttcatggtattgtttaaactttaaaattttagtcacttaaagaacttaagcaattatattaaaatacgttgtctgtgaaaattatcatttgatatttggcttataaagtaatttttatgaatctgttttatgagttaggtaagatttagcctttctgcagtctgtctcatctgttgggaacctgtgatatacctccatttgtccacaagatggtgtttaaaacaatttgttcagaagaactgagcaaactaacagaaatacaaggctacgaacagtttagtggacaactaaatcagactcttgcctttgcacttttttttaacttttgtagataatttttgttaatttgttttgttaatttatgtttttcctaattttaagcatctttatgaaacaggcacagtaccctttggtttgttgactgttttgattttatttctttggtggatatatatgtacttatacacttagttaacatgcagattaactagtcataactgtttatacaccactctcatattttagtgatcaatatgaagacagctaaataattatcctactttttagacaggacagatactctcaacagacaagaaaaaagatttagcttatcacaagaagcagacaatttataaaactacacaatgtctaaactctatgttgctcagtgtacttaaaattttacagttatatttgtataacgtttatatttttctagaatacatcactatttacaaaagtacaattagaaacactgttttttttaagtaccgtttttattttcataacactaataatacactgggattgagaatttctgttaagtgttttgctgacgttgttttaatgaatactcaaaaaagctttgcagatttgtccattgctcttgttcttaaattatttttcatacttgtctgtatccaccttctgaagacacacaagtgtttactgtcgcagtttcccagcgttatttcttaatacttgagtgttgacacatttttgtaccatcccccttttgtaccatctctgctcacaaagattatatgcaggctttgaagaggaggagatgcagaagataattgaatttgtatcttgtatgcctatgtaattcaaagtgacttagtccattgaattgtgttcatttattagttggctggttaagatagcattaattatcttaaatttattcaactactaaaagtctcaggcaataggacagatgagtgtcatcatttttattgtgtggcatacttggagctataatccaaacgttttactcaacaaaataatgctagagtaactgatcaatttggttaaattgaatgaagaaccaagtgaacacagagaaaacttattcggacaagtagacccagcacagcaaaaatttgtctgaaagataagacaagcttataagaccaaagctaagtctaagaaaatctaaatggaaaaaaaattgcgtgttcagatccaatagtgagtgatgtggtacaactggaggagttagctacttgcttcatgaatttgtcaaaagtgaatactaataaagtgggaggcttcactaaatgagggggtaaataagatttaagtttatcagaagtgtgtgtattgtgtgaccatactaagcttctgggtgtaagtaaagatgctggctattttacaactttttattgtattgtgttatgcaaagtacattttggagataaatgtttttcagcacattaatgtctttaaattcaggttgtattgggtgtattttacaactatttatttttaaataacatttagggtgtgttttcccccattttgtttgttctctatcttacctcatcaaactctttacgatttaattgaatatactcatgttaagtgcaatggcattagttttattcaaaatcccacatgggcataatgctttgaggccttgattcctacatgttcattatgcataatgagcttgtcacctatctcagcaataaaggttctgaccctatgtcagggaaatctaaggtgcaattattaaggccatatctactcttcatcacttgccatggctgaagctccacacttcagtccattttgtttggtgtcaaccatggggatgctccagaagcactcttggctaaccatgagccccacaggtgtccaaggaacgttaattggtctattgcagggttcatgtttgtaccatcattatagttttctttgtcacatgaatcattgctcagcttgaaataatcaagtttgtcacccatctccctggcagttcataaaaagcctagtctaattatttcagatgagaattataagcagaatcaaaagcccaaaagcaggcagtcctttgggacttttgtcccccagagtgatcatctcactaaaatcatttgagactttttgctatagaggtccctgagggagataagaaataacacaattaacttttctcatccatagaagcttttacaccatgagtgataaggtaataggcaataagtagttaaatacatagcaggttttcttaacagaaattaattgcatcaaaacgtgccagaggatttatatgtttacctataccgggtaataacttacatagttcttaactattcctatcttcaggccccctttggataaattaactaggtgctctctaaagaatgttgttgtcttttcacacacatattttcaacttaagagacaaaatggaatttcaaatatatctcagaaagagaggtaatttgtttgagacagtttccctcccttgttctctctccagctatgttttgataacttggagtcaaaagtaatttgtgaaggcatgttaagcagagagttagcatgaattgccatttattaagactaaaagtaattttcagttagcagcatcctcttcctgatagccagatcaatcaaatatgttacacttcctctcgttgatcatttaaagagcacttaagcgtgtgtatttacagacaggcattactacagtcagcccattttgatttaatagttcttgagccataggtactttatactgccatgtcctggatcacaactcactaaagaaggctacacaattgaaaagtatttattttactttgcacaaaagggcttgacctatgtttattgaacacaagtattatttttaaaaagatatttaaaatcatttatgtttgtcacccctctataaacagcaagattgctagtttgctagtattttttccttaatactgagttttcactccttttgccaggttaccagcaaatatttttaagtaattttcttgatatttggaaatcagaatttctattggttttccacctatgttggtttacttagtttattttagagacagggtcttgttctgtcgcccaggctagagtgcagtggtgtgatcatagctcaccatggcttcaaactcctggtctcaagcaatcctccaacctcagcttcccgagtagctgggactacaggtgctcactaccatgcctggctaatttttaaatttgtttttatttttacagagacaggagactcaccgtcttgcccaggctggtctcgaactcctgggctcaagctatcctcccaccttggcctttcaaagtgttgggattacaggcgtgagccaccatgcccagccttggtttacttttaaactcagagactgtatctcagaaacactataatcaccaaaaaattttaaaaacacaatagaggtgatcttctacagcaggaatttatattaagcttatttcagttggcaaataaatcagattttactaatgatgtttaagaatagcgatattggttcagtcagcttgaaatgtaaagtatccaaataatcaaatcgatcatctatcctgatatgactactcattcatattcttctgctgtgcagaagccaattacccaaaaccatgccagggaatttatgtgctcagtcagtctcggaagtgatttccacagttcttaaccaacctgtcagctattagggttgaaaatcatatcatactgccatagaagcaccggctagaaataaatcaggaatcatttgcccttaattaacatgccaggttcaaaccaactttatttatttacactctcctctcccagtgagtgctctagttgccactttatccaactttcaaaaatatctcagagaggatttgagatttctattttgctagagagacatgcttggtcagattcaacatttaccaactctctttcatggagggaatttgctgggctcttttccttgcaatttctaagccaagtgtcttctgcttctgtaaactacttcacttaactgaaatttataacgaattcttcctgccatttggaatgtggtagttttgcataatctatttgtaagtgcttgtttccaatgttgctgactgtatctgtggagcttgttgtacaacctttacataaccaggtttgtaaaacagttgagtgaactgttctttgaaattttattttttttaattttcttatgaatattataaaacttagaaacatgtttgattatctaatttttcttttattgtatttgattatgtcactctagttaaaataaaagcactttggtgaaaagataatttctatgcctttatttaattatgtgtcacagctcctgaaaaagtttgccatttttttaaggattgttttagggagctataacagagacctttattttcaaaagtcatatttgaaaaaagggaaagaacattctttcagtctatgtaaatagcactgatctatatggcaaagttggaatcttcttaagcaaaattcatgctagaagcataaaactagatgctgtaagcagttttaaagaaatccaaatacagattacataatgattgatttaaccaaacaactaggactagaatttaaaatgtataaaagtacacacgagaaaaatatatataaaaaattatattagggctcactctcctttgacttgacagaatttagttccataaactaactaaagatactatgttgagctattgttttatgccccagcacaggttactcacaggctctgtgatataaaatgaatatattaagtctgttggatagttaagtagatgttaatgaaacagcaagccaatatgattacacagataataataaagtgcttaagtggtcaggaaatacttgttaagaatacagtgctttagctgagctgcatttataaaatttacaagaaatggtgaaacataaatcatgtttacaataaagttctgagtaggagggagctaacaagccattggaatgaaggcagtggttcttaacctagaaataaagcaaggctagacttaaaaaagtccacgaaatctctgaaatactatacaaaaatatagatgcgcatgcagctgcacatctttctagggaattaacatttcgaaaaggtccatgaagctctctccatacacactaaaacacacacacacacacacacacacacatacgcatctgtcacagggtaacaccctctgtggaacagctttttaaattactttatgtagaaaaaacactaatattataaacatacacctatagaaccagtagttaagtaatgtttaatgtatctaaataagctcagtaacttcttttcattgaacatgattatttataagaaaacatgcaagagattaagaaaccatatttatttcttctttggtacaaccagagatgttacctcaaacctttaaaataaataatctcatcaataaaatttatgaatgccagagtattaaaattatttctttgctttcacatagaagcgctcaaaatattaacaggtttggggtaaagtacatacagttcaacaaaagttcaaggtgaagaaggaaaccaatacatgacgtaaagaaatcatttcgggagatgtagccctttcttatcactccagagacagcacatcgatgagattttaagcaccaattccattgaatgtagtggggtttcttcataactagtctagtaatcctctatataactgaaacaataatctgagaacaacttctaaatgaaaataactactgcaactgaggtaaaccaaacagttgtttttgtttattggcacagtggcccacgataagacacataggtatagcacactaaagctcaagatcctgggaacaggagtataaatttattcaagggaggtgtttggttttctttttttttttttaactgatgactctgctgtcttccctccaagggaaaggaaagagaacttactgaatagcaccgttcttctatatgtgattgtcaagtaggacttctgtaatcatactgaaggtaatacattgtaatcatgctgaaggtaatcatctttgccccagctttggatggtgtttctcacccaggctccttcaccaggcgtggttcatgcagacagccatgcagcagtaagcctttcaagggtcaggccctttgttaaatgctcgctgaccagcctgcatggtgcaggaggctggctcacagaaaccgggaagcccaggaggtcccgggggtccaggcactccaggaattcctgccacccctggggggcctcgctcaccgtctcggccatttctgccatagctggcagggcctgggtcacctgaaacacacagaagattgcacatgtgaacaggagaatcctcattgatgcaaactggcagagggcatggctcagcagcgctcagataaggggtttaacaaacgcttttggaagcgatggatgatgactggtgatgattggtgatgatgatgatgatgatgataataagatcccttccttggacttgggttttcatggaaattaaaagcagaaagagacctcagtgtctctaacccccatttccatcagtagagctgcaccgtgcaccatggtagcctccagccacaggtgcctattgagagctgaaatgtgatgaggccaaatggagatgaactaaggatcaaacacacctggattttaaagacttgatatgaaaaaatgtaaaatagttcattaataatttttgtgtctattacatgatgaaatgatcttttgcacacagtgggttaagtaaactatattattaaaattaatgtcacttgattatttttacctttttcatgtggctacttgatttaaaatcatacatgcaactcacatttgtggctcacattatatttcttttgaatgcaagtagcagtattccttacttctaagagttgagcaacatccgggcagggagaagtatagtttagcggttaaaaacacaggttttggagacaaatagctttacattctagccctatcatttatgaaaaatgtgacattagcaagtcactaatctctcagtttcttcatctacaagatgggataatgtcttcctaataattaaattcaggccaggtgcagtggctcatgcctgtaatcccagcactttgggaagccaaggtgggcagatcacctgaggtcaggagtttgagatcagcctggccaaaatggtgaaacctcatttctactaaaaatacaaaaaaattagccaggtatggtggtgtatgcctgtagtcctagctactcaggaggctgaggcaggagaattacttgcacccgggaggcagaggttgcagtgagccgagatcgcgccactgcactccagcctgggcgatagaacaagacttcgtcttaaaaataataataataataattctacaattggaagcacctgataaataggggctattattacaattattaagatattattgattaatgtcttttagaaggctgtgccatgtgccctacaaattttcatatttttctcatgaagggctgaccccaacatgaactttgcaatagcaggttctctgggggacatttcttgcttgtcttccttttgtcgtgtttaagggttgtatgttgccctcaatggggcacactctctgaggcacagcaccccataacaaagaggaatttctgctgaatgtttaccccagtgcactagcagcactttcacacaattattgcaaaagtggtgatgagaagtcagtgtaaaacaaattgtgtatgccaaaataatatagggatcctcattccatctcagccatcttaacctggtctttcagccaaaaagccggaagccaaatctacatgttcaactacatatttgcttatatttggttactctccttctttctctgtggtttttacttttctttttctatttcagttgtctttttatatgtcttttgttggtcttactgtagtaatatggtcttattcatatatatctcacatatttttagaaggaaggtaggttagagatcctgctttacataacatctcattcttcctctggtgcatacacttcgatccacacaaagcaatgtcatagggcaatatattaataagttttaagggagaataattatctttgaatttatccatctcaaagctatagataagcagagatataagtaattttccctaatttatcccatatactttcattcaactatacctagtaagtatgaagcagatcattatgtgttttcttttaatgatgaggtccctgagaaagcttctccctaatccacagcatctatagataaagctgtagcagaactatgcccttagcagcacctgttaagatccttaacaccagatgcagttaaaggtgaagttgatttttttaaggtttaaaagatgagccagatctaaatccgattttcatgcaccttatcactaggaatgttcccactgagacataccaggtgtgccttaaaatcaaatcaagtttaggagaaggaaatgcccaaagaagaggtagaaaaccaaatgagcacaggggctgggatggtcattgagatcaggggtgggcaaacttcagctcatgagctaaatcttgtttttgtagttttattagaacacgaccatggtcatttgtttacatattgtctgtggctgctttggcgtaccagggcagagttaaatagctgcaatatggtgcccatagccaaataatctgatccttcacaaataaagtttgctgatccctgatgttataaagaaacaagcctggattaagaaattcccccactgtttttaccagatgaaaacgtaaagtacaaatgcaatgaaatttggccactaatattccacgtaagtgttggggagaccaaagggaggagtgaggcctgtggtgagctggaaagtggatgcgggcagcagctcttctccagctaacagctgtcatcggggaatacaggccagtgttgccagaacttctgataattttcaagagaggccaggaagctgagtctttaaataaatatctcccaatgtttaaatgttagcaactaattcaaatttttttcaacatttgtagagccagccaaaaaccttaagttttaagtaatttattctctaatacactaacaatattaaaaagcagaaggatagctttttagattttcacatttggttccccatcaacacacttcaggagaagtttttctttttcttttttaccttgctgagtttattccaaattgctgcttatcctctgaaggaagagtcgatgaagccatcctgtctacccttgatttattttatgaagcatgcatctcatccagttctgcctttggcaaatgcagcaatttaccctttggagcttttgatgatgtcatcatcatcatcatcatcatcatcatcaccacaaatgcttaatgagaatgctttctcttttccatgggcatacactatgctcattattgagcccatttttctcatgcataaactgagagttaggaaggtcaaataattgtccatagtcatatagccagaaatgaggacccttaaccactgcactaactgtattttcctacctattgatttttttaactctgtggaagggtgtggaggggtgtggcagggtgtgtgtgtgtgtgtgtgtgtgtgtgtggtcattttttttaattccttgggcctgagttgaccaggaagtagacagaggtacaaaaacaaagcacagtattgacttttgcagagctctaatgatcataagaaactaagatatttctctgaggttttgccctgtagaaataccagagaaaaaaaaacagccttaacatagcagattgtcaggctctggaaagccctgacccagggcctttgctctcatgtatgttctaaactatgtgggagcctcagttgggtgacactatgtccacagtccacatcactcaaaaagtgaagctgactcataataacggttcacaaaatgggcataaatggttagcccagcagctacattcatgaatatctatcaactgctttgtaactcttcagaaagagaaaacatgcatctaaagtgttattctgctctgcctgcctcatgtgtgtattacttacactaactgcctaatgattacatggttttctgaaatgtcaaggacctataaatatgttgaatattcccaatacaaagaaatgataaatgtttgagatgatggatatactaattaccctaatctggtcattatgtaatatttctattgaaacattactacatatcccataaatatgtataactattatatgtcaattaaaataaaataaaatatttaaaattattgctaaacgttttttttttaaacaaatgaatagctatgtcattctctataaaaccactagagggtagtcatgttacactgatggaagcccatctcggctggatcattctggaggcagcccctcacctaatacatgctgtggcgtaaaagggactgtgtatacagtcaaaacaaaaaaagtgaataattttcacattaaatagggtatttcataattaatccactggttatgtagactttttgtatgtaccaggagtttcttatatttcttgagcttaatgttgtggtatttgacaaagcagtatatgtttaaggaattataaactggtttatgtaaggcccagcaaccaaataaaacagctgcagcaatggaaatggaaaaattaggtactgaaaaacttagcccagaactgaatgtgtgcgtgtgtatttttccactcaatagtctcaagcaaagctcacctttctgtggactttgcacaagaaaaccaaatactcttataacctagcatagtccagcacaaagccagctacaacttccatgtccaagaggcaaaaagcaccttagctcacaagtcaccttcctagtgttcacattcaaatgatttgtcatttaatttatgttttgccctagtgagtgcacaaagaggaagtcaggactctttattattaataaatatgttcctttaaaattctcagagtgacgaggaactagtcccaatgggcaagtttggtggcagcagagagagtctttgagacaaccgaccaagcaataacactagctgacctgtggcacaaaactgaaggcgggggagactaaagttccagggattgctaatgtgatccacgtagctctgcaagagaggcagagaaagaagcgagacactcagcaattatgggacatgctcaattcacatgtctaggttgcaaagaaaaactaatcgtatgattagacagccagccaatcattctgtccactttgggaacatagactcaggaagcatgaatatctgtcttgttattacctgacagacttttgtcaggacatgaatttaagagtctgtattttctcaaatatattataaaaaaagggagcaacaataataacagttaaatttcactaaataatgtcagagtgtctgtttgccatatgccaggcactgttccaagagctttacatgtattaacatgtgcatatatgctctaaatacaaggtaggcatagtgattcccattcactgaagaggaaactgaagcacttcaaggtaaaagaatagtgcataagccctggcagcctggctccatgtctgcacttcttaaatattcacccagcctactcctggctgtgagaaacaaactagattgtg

SEQ ID NO: 257 - DNA, 174745 bp, Homo sapiens
aagcgtttctcctgcctcagccttctgagcagctggaattacaggcatgcaccaccattgcctggctaacttttgtatttttagtagagacggggtttcaccatgttggcaggctggtctcgaactcctcacctcaagtgatccaccttcctcagcctcccaaagtgctgggattacaggcgtgagccactgcactcagcctgtcatctcccatttgcttgtataaacgcctgaggctgtggtaggatcctgccctaaggatagcaattagggcttggctgcaaggaaggcccacaggactcaaaatgacaatgtgtacacacctacagttctttcaggaaaagggtacaacattgcaactgcattaacgtaagaatctgcttcacagctaaagaccacctcatagcaaggggtctggagaggccaggcgtgagcccgcattgtcctccccttgaaaggccataccaatatgcacttcctctctcagatcagaagcacagacgtgagtatggaatacctagaacccaggagccccacatgggagtctcacctgaagtttttcattcctgtttggtcatttgaggtatattcttgctacgaaaccagcgccagtggcagttccctccaggggtctcacgaaggccaggtacaaattgttagtcccttgttattagaaaacaatgctgacaagttggcacgaaccaccctgaaactcctctaagcaacactatttatctgtatgtttcatgccttaacaaggtcatgcagtcacagacccttaagccacatattcaataagcattaatccagataggcgaaaaggatagatgatacttaataaggactccactcggggacaaaactttactgcaccagagaaggcacatgagaaaatcttaggagtttctaatggtcatcagctcagtgtgaatgttgtggtgtggtcgtcaaaaaagctaacatgcactcaggttgcattaacaggagcatagattatatatgggaggaggtgatagtcttgctcaactctgtgctagccagatgccacccaaaccctcgagctttgctgtggtcacttggcagtagttgggtactgactgcaatgcgcttggaggagacaatgatggaagatatgaaaggggtaccagatgaggagtgattagcggaagtgagaatgctgggactggaaaaaggagggcttgtggggaaggcaagggtgttactttcagagagtgactggagccacacagtcaggcttcagctgattccagagttgcatttctcgatagtcactgtaaaaggagctctagcatgataacagttggagatgcatctgaaaagctctttgcagaaatggcttcttggatgggaggcatagtggggtgtgtgtgtgtggctcctctgtcctcattttgtgacaaggggaagcatccaacttttcctggaactacccgcaagcagtagtgtatcacattgcgtggtctgggcatggggtaatgaggcagccaagatcttggagtgcagattgcagctagaggagggagaatgatgtctctctaacacagttgactctccaatgtggctgacagcagatttgccacataagagttgactgaccacatcatggaaccaaccaggcactggactgggtgaattttcaactctgaaattcacttagtggttccgtcaccggctgtcgctgactggctactccttgcattgtgaagggaattcatcccctgcttatgcgcgtgcgtgcacacacacactcccatacacacacacacgcacacacacacacacacacacacacacacaggagtcttggtatagtgtaatgaacactggacttagggccacagttctagtcccagttttgtcaccttgctgctggctgaacttgggcaagaccctttgttttggatttggtttattcatctctaaatcagagatgcagatatctgtcttgtcaacctgatggggttgttgcatggcaacccaaaatgctaaatgtgacattgtttcagccatgaatggaggaagggattattattttattatcactgtcattgcgatcccctggtctgtttggtacagaccaaagtttttgttccattgatatataagctaggatgctttcagctgccagtggggaaaagctcaactaaaagtggcatcaacaatgagggacacttgttttgaaaaaggtcagtccaacagtgcctaattcagcatctcaataatgtttttaagaatcccattctttctttccttttttttttttttttttttttttaagatggagtctcgctctcttgcccaggctggaatacagtggcgcaatctcatctcactgcaacctctacctcctgagttcaggcgattctcctgccttggcctctcaggcagctgggattacaggcgtgcaccaccacgcccagctaatttttgtatttttggtagagacggagtttcaccatgttggccaggctggtatcgaacttttgacctcaagtgttccccccacctcagcctcccaaagtgctgggattacaggcgtgagccactgcacccagccaggatcccattctttctgcctttcctcttggccaccctcagtctgttggccatggacctagggcttgtcacctcatagtggcaagatgactgcagcctctccacacagtacaatctcatcccccaaagtccaaagggcagaaagggacatgtcgctggtctgtgtccacttgtaaaggtggggaaaactttctcagaaggcctcagcatatgcaattcttctcatatctcagtggcccgactgtgtctagtgtccatgaccaagccactcactggccagaggaaggaggccaccatgctaggctttgttcaaatagggttcaacccttggggtttgggagggacacggtctccactgaaggacaaagaggttggatgaagatgaaactctgttagcaaggacacaacaacagtgtccgcccctgttgcagggatgtccttggatgatggtcaacccacccccagctctgcctctcttccctccctccttccttccctgattcttccctcccttctttcctttgtccatctaagatttactgaggggttctatggacataagacatagccgtagccttgcagggctccctgttgtataggtgtgtggtgtaccaggcaggatgggggctggcatggcagagcggagggaacaccgagacaggactccagtgaagaagagcaggaagggcatttctaggcggaggtggccacaggagccaaggcctgaaatcatcagttgctttcatccccaccctgggctgctgggggtggcccagaactcatcactaatggcttgtctggtatagccaatggttccggacacattaccgggcagaggccagagaccttaacttgccacagtgctcacatctggaaaatggatctaattcttccaaggatgactaactgtgctgaaggctggagagacaggtttgaccctctgcggttagacacaaaggtggggggccctgcttcttcacaccagccccaccattaactttgtgtggctttgagaaaatcatgaatgctatctctgagactcagtttccccacctgtaaaatgaggaatttgggctaggcagctccataggttcctccaggtctgaaaagtctcacggggccccacatctgggtcagtgttggccaccataagtgggctttggatctcacagccctttgccacttggcctagcccttgggaaataaacccagagaggggaagaggcagaagggcccagatggtgggaccatgtgcctagaaggtgctgccctcccaatggtggcctgggagcttctttgacctctgcccttattccttctggtagagtgattgtgtttggaattttggcagccaccaggccagagtgacgtagtcctgcaggcagaacccaggccctaggagaccagtgggccatgaggacagccagcactgactccagccacctgccctggggagagaaatgggcccacattgcctggagggggtgagagagacactattagaatctgcctcactccagcctggaattcagttcattttaccaaaatgctttgtcctgggtgttaggaataccgccatgagcagggcagagcagctcctgccctcagggaatgtaaggtctacatttaaccaaggaattacaggaatgaaaagtcagtggggacccattcttgccttcccatggttcttctgctgaacgtgactcactcgctcatttctttccccccattctttctgtcctgcttaaacatcacctcctcagagaaggtgatatttaaataaaatagcccctatttaaataaaatggccccactcatcattctgccactccacgccctgcttagaggtcttcatagcactcattacaacctgatgtcatataacagatttgtgtatttcctcttcctctgttaagacagatgctttgtgtgtatgctcttcagtatatctacagcacctaaaatcgggtcttccatatgctttgggtctgcacgtgcctaacaaatatctgttggtgggtgagggtcatcatggaggagagggaggaggtggcagcgggggttaacctggtctaatctgctgaatttactttctttcatgttttcattcaggccttcattccgtcattcgctcagcacttgtggagaacttcctatgtgccaggcactgtgctttgtgttgttgtcagaagctaaacaaggcagccgcgtccagcagggaccacagcttgtatttgccagtggccagctcagggcctgatgcgtgacagcatctccctaccagggaaagaatgactccatggttagacatgtattgtgtgcgtatcctttgctacacgcagggtggggccgccaaatgaaagaaagacccagcctggtatgcccacagcagtgcagggtattggaaagactggcagactctagctcttctcctagtgggaggaatctggttctcctccaagccctgcagtaccacttaaacaggcttgatttgaggcaggacttcctgacctgcattttttatctgtctttctctttgctggcctccttcctcagaccatagcgcttctagagcagaaaacccagcctggtgcacagtgggtcttcagaagcagcttggtgggtaaacggacgtggattgatacttggggcagtatgcaacctctgtcctgcaggttaagacttcctctagggccaggtgcagtggctcatgcctgtaatcccagtactttgggaggccaaggtggcagtattgctggagcccaggagttcaagaccagcctgggcaacaaagtgagaccctgtctctaccaaaaaacaaaacaaaacaaaacaaaacaaacacttcatctagtggttcattcataaatattttgtgagcatctactgtgtgcccaacattaaagctattgcaaccaacagcttctcctaaggcagatgtgccacagagaccgatgggtccatggctgagctgcttgagcagggaacaaactatgtgttccctgaaagtccccaccaggccaggaattctcatcctgaggcatctacagaggcctggcagcccctgcccacctggttcccaggcttactgccttctgccccatagaaatgggccccttagggctgtttggtgagtgtgctgtcccctttgaagggtgggtaatggcttggtgtcttccagattcaacgtccatcagaacagttcatgcccagtcactggctctgcgccaagaacctgcctggcaggaagactgcttgtggggagacggcagaggcaggatacaaggcccttccttggaattctccccagtgtccctgcctcctcttctcagctgcccatgagctcctggaaggccatgagcctcatttccctcccgacctagcaaaatgcagttagccctcaatattcacatacataattggatttcttgttgaaggacagtctcatgcctccaagctcaaagggcccacacagatcatcacgtttgatgcacctattttacagatgggcagagtgaggctctgagaggggatgtcctcaatccttttgggttctcatagcattctcacgggtcttttgggctgacctgggtgaagcaggcagcattccctggcactaagccttgcctattcacatttgtgagtgaaatttggaaaggccttggtgcttagccactgacctgctgcctgcctgacctttcaggaaatgcagtcccttgcctggaaatggctttgtggacagtgagtcgtgtggtatcacccacacaatacagtggggagaactggacagtttccccagtttctcactgggccccaccgcctcaatcctccttcaaaacctgcctgaaatccaactctgtcctcttggtctttttgtgactctttcaccggagatgtccttctcctctgtggctgcacatttatccaacacaccctttaagatccaaatgccacctcctcctgggggccttcctcggtttctttccatcccttaatcagcttcacaattcaattgatctgcatctctttggtggcatttatcacattctccttatattatcttacctttatgcagttgcagggggttctccatgacatagtgatgtctgatgtctcccatccagactctcttccctaccccaagttgctgtgcgtgtctcctgtccacattacaaatgcgtgcatgaccagaaggcaggaccatatggaaatttttgtccctgcccccacagtggcagacccttttcccccagagtcttgtacaggggtttgcatactgtaggagttaaaacaaataacttatttaaattaccaacggtttgagcatctattgtatcccaggctccatgtgtcaggctgggtgtggggacacagagatggatctgacaatgacagcgccatgtgatgtgtgctgcaatcccggtgtagggcagagcagctcaccagagtcaggtgagctctggcctgcacctagaagaataaccaggttgtgaacaggcagaaaaggggcagagggagaacctgggaggaaacagtatggagaaagcatcgaagtagtcaagcttacctgagcctgggtgcaggtatcagagagactggagctcaggaggccggatctgaagctggggaggctgctgaggatctgcacagaaccccttaaagcctaagatttggatccttatgacaagatgcagaagtttggagttaggttacctgggttcaaatcccacctctaccacctacccgtttatgtcagctttcccatctgtaaatggagagaaaaaagcaggcctcccttaaaccccagcactgtgtgggtcagggtctggactagggtgtggcacatgcagagatgcagcataccaggagatgccaagaaaactcagcaacggaggtaaattgcccaaagcagtgccccaaacccctaagtaatcaaaataatattttaattttttacttttaaaatatttttaaaagtatcaaaattaatgcaaaaccccacaatgaacaaaatatctaaaatgtaaataaagacagggtctgcatggtaccaagtatgcaactaaaaaaacatcagttatgattgaagagggagttctcaaccttagggggccgtggacttctgaaaaccggaggaaagcccacggcccctctcccctgaagaatgcacaaacatgctcaatttgtgcacagtttgggggtgttcctgcactccctggggttcgtgcacatggaagttaagaactctggttcaacattgggggtgcgggggtggcgggggtggttccacgcgccggccagcagcctgccagttccccagtcccgcgactggcctccctcctggcagccatgggtgctctgccctctgcaggaagcagcgcacagctatgcagctcccccaacccccctacctcccctctctcggcttgggacttttcctaaagtttgttgaaaccagacaccttgctcgaccgagcccgcgtgcagccagggtttaaaaggccgccttcagcgccccctccccgcccccagcggagacttcaaaaggcccggcgggcgccgccgccccagcacctatgagccgcccccagctctcggagcccgcgccggagcccgtggacgcagagctgccgaagttcgagcgcaggcggaccgggtcggcggcgcagtcccgcgcgcccatgcccctcccggtgccgctgcgctccgcgcgcccgcgccccgtttagggaaggggacctcgccccccgcccccgcgcccacggctgcggggacccatgaatacaaatgccgttaggcgccggaggaaggaccgaccggccagcctcgcacgtagggacccagtaagtgcttgggggctcctggagcggtgcgaagtgttatatgcctgtgtgtgcgcgcgcctaaaggtgtgcgcgtatggggaggtgggtacacgcgtgaggagtgaatgcgtgtgtgcacatgtgcggtgggcactctcggagaactgtgtgcaagtgagggtgtgcgcgcgtgtgtccacccggggtgtgtacatgtgtgggggcgatatggccaggatagcgtgcatttgtgcctgtgtaagcatccgtgtgcatgcttctgcgagtgtagagtatcagcgtgcgcctgagcccagatatctgaggatgcgtttcgtgtgaacctaggaagggtgcgtggctgtcccagaatgggaccgtgtgtgagcgtgtgtctgagtttggggaaagggtggatacgtgtgggagtgtgtgtgtgcaccggtgaataagtgtaactttgctcgtgaacgagtggcaagaggtggtagaggcggagggagctgtggtcccagggctggactggagttttgggtgtgagaatttgcccgggggccaaggtgtgcagctcttagctcccggatgggatccgagggagtttttgtcgattctggggaggtgcgtggttagtggtggtggtggggtgcggttagattccaattgctgacagaagggagagagagggtggcaaacccttaacaagcccaccctatatgttctccagggcgctccgagtctgggagcgcaaacttttggtgggcggtggggatcacgatactggttgtcgtgggcgtctggacaccaagttctggtcctagctccgtccctgaaactgtgggtttcttccaggagtagaatttggcccttctcccctaccccaaccccccattggaggacccccagcctcaccagtcagaagttcctaatctcagaacggtgatcaaatcaccgtgaagccctgggcagccccttcctctctgtgaatctgtttccccatctatacaaggaggaggggggcgggtgtcccatcggggctgtagtgggccagctgaggctgtacccttggctccggccggcagggggcagcagggggcagcagagggcggccgggagcggggaggagggaaggtggagagccaccgcgggccgagactttaaatcgccttcatttcccccaaatccttccttttcctctcctcccccaggccggcggggaggcagcttccaccgccctccgcgcgccctcacccggccttgctctgcctccggggaccgccagcagcccgcctccaaaagtttgatcatctctctctctctttttcttgcttcttcttcctttttggtggaagcagaaaaggaccgaggcaggggcgagcgcggcgcccggactcctgggaccatgggcctggcgcgggcgcccgcggggccccagccgcgctgcctgcctgctcgggcgcccctgggcgcggggctgcgctgggggcgcgggggccgcgcgctctaagccggcctggcgcggcggggcggggggctggcggccccatggggcgcgcccacacttgccccccgggctcgggagcatgaagtaggggcctgccatgggagcgggatcggcgcggggggcccgaggcacagcggcggcggcggcggcgcgcggggggtgagtacgaactcggggacgccccctccctagcttcctgctgctccaatctcggggagggccggggttccccgccatgcggtcgcttccagcggaacgtcagcttcctgccccttcctgcgcccccgcgaggcgggacgccaagggttaataggggctgcgcccccggccgggcgagagttggcgaacgctgcccgccctgccgcgcctggcccggctgcccgatcccgttggggcgggggcagagccagcccgggggtcgggggtgggggtgggtggtggcgcctggagcggccggcggggtgcggaggggggctttttggatgcttgggggaggaggggggtctccgtttggggccgtctcggtgtgttccggtgtctcagtgtctgcaggtcccaagcctgtacgtctccgtttctatctgttcttgtgaaattgtccgcaagtttctaggtcaccaggtctcgggttctgctcctgtctccgtgtctgtgtggctctgcacgtccccgcgtttctggaaatctccgcgtgtttgtgttagtcggcctgggtctgtgtgtctgtgtttcctgcttctcggttcctgtccctttcacgtgtgtaagagagaaaaagtgagagccagcatgtcagagcagaaagggccctgggcgatcactgtgcggaacccctcagtgtacagatcgggagacagggccggagaggggcagggactctcccaggagcggctgcgcggagctggggcccagaggctgggattcccagcgtgtggagtaggagttgtaagagagagtgagcctgtgctggagccggcgcagcgtgtgggtgtgtgtgggagccagcagcatgcaagcagcccgttggggcctgtggacggcgctcctctctttccatcctgcccccaggacaccaggacactccccagaggctgttagggctgtagctgggccctgccccctttgagctggagtccgcgggatgacaccccctcctttcttccccatgtcttggaaaaagctggctgtttgcgattcccccgccccgcaccccctcaccacaacacacacacacacacacacacacacacatacgcgcgcgcggcaccagtgagcacactgctgactcattttctccagaagaccctgcgccagggtagatgccagcagttgggcagaaaagtggtgccaggcgagcaccccatggtggggctccagctgtgggcaagtgggcagtcaacactgctcggaggcccagtctctgccttctcctgcctccctgcctcccttgacatcacgttgtcctgcatcatgtgcgctctggcgccagcatacctctgctctccagcatgcctctgctctccagcatgcctctgctcctggacccttctggccggaccaaactccatgtcatgtctatggacacatccctggcctctgcctccttctgtttcctccctgtactcagaacattctccctctcctgtgcctccaccagcgctgcggaccctcagcagccagcagcctcctggtggtctctgtccctttctgagcacactcccctgttctttgttggcattttctctcctccatctctgtccagggaccctcttgatacccacatgcctggcttggctacgcagagtaacatatccactggtggtaggggacagcagtgagacactcacagaatcatgttggtgggaggcaggcggcaccacaggagggccatgaggcttgccatcaggcaggctcgagtttgaatcctaactctgctgtgccagcttgggtgagccactctgctgcttgtttttctcttccacaaaaccggcaccttattcctagctggctgggttttgtgaagatgaacaggaccatgcttgtaaagggcttagaacagggcctggcatgtaataagtgctcagtaaacggcagctggtatttgtattattcccttcatgttgaatgggtgtgtgagtcaatgggaaagttctgggctgcatcctctccagacgatgacctgtctgtgttcccatggaggacgtggaagctgtgaagaaagcccaggcatagccgtctgggcacagggggtctggccagtccatggaggcaggtgggacaggtccaccccacttgatgagctgtagttccagctagctcccttttcagcttttaccccatgcgtgaacagccaagcctagtgtccacagggccactttccctgtgtgtttctgtggcctgggtctcagctcagagccctcagtgactgttgaagctggtgtgggtttctaagatcctgtgtgtttccaggtaataaggatggaagaaaactatccaagcagtctgccggttctggcagtgtggttacccaggagtagccccatttggtgcactggcagagggccttttgcaagggcatagaaacacctgggtttcctctttggagggctgtgtggccagacgatgtttccatgtgatgtttcctcgcggctcccgtttcggctgcctcctggcctccctggcctctgtgctctggtcttcctgacattctggagccctgggtttgcagagacaaggcccacaagacaagtggtgaaaacagaagtctggaagaacaaagccctgagccagcacaggcactaaccatgattagcagtagcctaaacaggattggaacgggagcaaaagaatcggcagggcctccctctgagagccaactttccaggcctggagctgacttagatggctcgttggctccctgggttgcatctctgttcctgctggtgaaggctggggctcgggtctctggcaagtaggaagtccctgcaagtctccaatttctgctccatggagacaagtcaaatgaaaaggactatctgttaagtcatagacttgaagcactgtgtgacttcgggcaagtaacttgccctctctgggcctcagttacgcatcttttcaaagaagggagagagaggactagaatctgacccctagatgatcttaaatggccttcttccactctgacatgctctatacttgggaagtttatgggtcaagtgcacacagaatccatttccaagagggtcagctgcatttgtcagggagaatgaatggaggttgaatacttctgtaataggccttcagggctgaagtcctcaagttggaagccatggtgttaggaagcttaattgaagagaagattctgattccatgtctcctgtggacttcttcttcctgattttcagagattacaaggatttgccctctaattctctgcagagtagtcattttggtatagctgtagccagggaaactgaccgagaaggacatgtgtcgtttttgtaccttctcttccccacctcgcctttctttatcagtttgggaaacttcctaggaagtttggtatgtgacataatccaatgaaggactcaaggagtgagggcaggtgccagacaagggccaggaagagagggggctggaaggagatggaacagaaataaatgggatcgcaggaacacaggaaggcaaggggtagtctcctctgaggaggcattcatggaaaaaatgattctaaatttggggactgctgaatgacagaaagtacagtcaacttctttattgcaggatttctccgagcctttgatatacagttgtgctttccggattgtcaagactgggatgcagggtacagctcttccctaatgtatctggccaatttcctagaaagcatgtccctggtgggtgtgggaaatactactgaagaattatgagcccagacgttgcccaggatggaagtacctgccttccctgagccttggtattctccgtttgtgtaattaaacaaagctgccttttatttctctccagggctcatgctattgccatttgcttcaagtaagcaagtcatgccagaaaggttggccctgcccttctccccaggcaaccccagggcagcttgacactttgacctttagtcgttgcccatggtgagctgggggcctggccccatgaaaaggcattctcacaacagtggcagcagattggagaggatgaagaggaaggaccaaggattatcttggagcaattctggaaaaagtcagagtaggggaattaaggctttgggaagacactttttaaagtctatttttttttttttttttgaggcagagtctcgctctgtcgcccaggctggagtgcagtggcatgaacttggctcactgcaagctccgcctcctgggttcacgccattctcctgcctcagcctcccaggtagctgggactacaggcgcccgccaccacgcctggctaatttttttgtatttttggtagagatggggtttcgctgtgttagccaggatggtcttgatctcctgacctcatgatccgcctgcctcggcctcccaaagtgctgggattacaggtgtgagccaccgtgcccggccgttttttaaagtctagagtcctgtcatatcaggtgatattaattcatcttataaaaatatactggacacttcctgtgtgcctgccaggggctggaaatataagcccggcatggtggcacatgcctgtaatctcagctactcgggaggctgaggtgggaggatagcttgagccctggagttcaagtctagcctgggcaacactgtgagactctgtctcaaaaaaaaaaatgaaaaaaaaaaaaagagtgaataagacaggcatccttgccctttagagacttcgtctagacagggaaataggagagtagacaatgaccacacatgtgagacctgctgtagtgtggcatgtgcagtgagctgcgggaggtgacacccaagctgggatctaatggatgtgtaggaactgaccaggcaaaggagtagtgtctacatgatgggagtagcatgtgcaaaagcccagagctggagaaggcgttcaggggaccatcactggcgtctgagtgctatttcagctggtttacattatgctgcaagtaactgaagacccaactcaaaatagtttaaacgataaggggggttattcccatatcaagaggcctcaaggaagagcagtactagggttggtgaattcagcatcccaacagtgtcttcagacacccactatttttctgttctgctatcctcacgtgctcatggggcttgttaccttatgtgcccaaaatgactgcagcagctccgagcagtatgtccttactcaacaacatataaagacttgaagaaaaccttctctgtccctttgaaatgctttcccagggtccctaacaggcatccctcacctcttattggcctcatttgggtcatatatgcatgcctaaaccagtcactggcatggcaaatgaaattctcgggatcaacttagatttatccagattcatgtaggatcctctaagtccatgcctacgtgagcaagcaggaaggagggatgctgtgggcatgtaatcaccagtgtcttcaccatgcccacagtgacagaagctgtcgtctaaggtgcccagggagtctgggaagaacctagggttccagttatcaaccctggcagacaggtttcctagattatgtgattccacagaagcacactatcctagctttcctcttggaaatacatcctgggcctgtctgtcccagccttagccctcaccacccacctgacacagctctcttgcctgtgtcccgcctgtctctggccacgtgccggcctcccctctgcctgcctggggatcagataccccaggtggcttcgggtgtcactggtggctgctcccacaggaaggtgaaattgtatcattgcctttgcccatcttggcaaaagccacagagcagagctttaacccttcctggccctagagtgtagggacagtggggaccatctaggggagtatttttgtggctggcagcagactgagcccttgccatgcatgagcttattgaatcctcatgcccggcctgtgagatagggaatatcagcccatgttgcagaagataagacaggctcagagaggctgagcaactcattcggggtcatacagctgataagtgacaaggccaggtttgcacgtggctctgtctaactccccctcgtcccctctgttttctttctcccactttccattaggataaagccaagttgggagctgccttcacacagcactggttctggttaaggggtctcctctctcctgccctgtgtgggaattggtctcccaagcagtccagcctggtcttcccgctgacctttcacccctggctctgctgcccattggctggggtctggggaagggtctaaagatcatgaggctgtagtacagatggggagactgaggcccagagaaggggaggggctggcccctggttgctcactgagtcagcatcagattttgagctggaccctagatgttccaatgaccagggcagggctttctatgcactgcttcttccccgttgacgttggctaattgatctgtgagaagtgaggctgtgtttgtctatataagcaggtcctcactgagaggctgtgcctggaggccgggaagagtgggctgctgctctgatggggtcctagagcctgtacctggcctcctgcctcccgtgggcaggactggggtgagactgggactggtttccactcccagcttccccagccggatccgggtgtgaggggtggaagctgatgccgcctctgcttgtgtctcctggtctctagggggtttctcttctcctggatcttagtctcgtttgcctgtcacctggcctccacccaaggagctcctgaaggtaattctctcttctctttgtccagggggagacaaaggagaacggaaggggcctgagaactcaggggtaggagacagccgtgcctgtaattggaactcaatgcctcagttttcccatcagtagaatggagatgataattggcaaattctctttaggcttgaaagaatgacatttgaggccaggctcaagactgcagtcccagcgctttgggaggccgaggtgggtggatcacgaggtcaggagatcgagaccatcctggccaacatggtgaaaccccatctctactaaaaatacaaaaattagctgggtgtggtggcaggtgcctgtagtcccagctactcgggaggctgaggcaggagaatcgcttcaacccaggaggcggaggttgcagtgtgcccagatcacgccactgcactccagcctggcaagagagcgagactccgtctcaaaaaaaaaaagaatcgcatttgaagtttttgtaaaagggtaggaaggactctgtgcagaaatgtggaagggtgattcttgtgttcctttctggggcaaaatttgagtaagttactccggttttaagcctcagttgtccctgtttgtccaatgagtgctctaagaactgctaaaaaaaaaaaaaaggcattaagcattaactctcatggcccaagcctgggatcccatcttcctcttcccgtgagatcctacttttccctgctatccctgaggggctgtccagggggccggggcagcgatgggctggcttcacatctgcccagggaaactgaaacctctcccacatctgtttgtcaagcagccgcatgcctctgaaaatagctgcccttcccccgccttcacgcccagcccgtgtgctggggcaggcagcccggcacgccgggagtccctgtggcctgacctggccactcggcagggattgggcccctgggagggcagggctgtgcccggaagagacttctgctgcccagcaacattttgtgcaaatgtcatattttccaagcttgctgtttcccccacaaagtaggtgaacagctgtccagagtcctgagtcagtcactggggcggggggcggggggagaggctggagctgtgtggagccaggtttatgtaatgaagggatcttgtgggggccagctggcaggctccttctatcttggcgttgggctgaattcattcccctgtcccccatctcttcacccttgatggggtgctggatgtgtctccaccctgctttccgacaagcctgggaggccccaggcagaatagcatcatggctaagcacaaagaccccagagtcaggtggcctgggttcaaaccttggctgtgccttttttaagctgcaagttattccctctgactcttctgagccccctctataaagtgaggataataaagagtacctgctccatagattgctgagagaatcaagtgagatcatgcctgtaaagtatttggtatctagtaagtgctcaacaagtattagtttttcttattgctgttaattagttacctgaaaagtttgggcaagaacagccctttcctatgccctgcagggctcacagtggtctgactcatagcagctctgtgctggtcacatttgccaggtgtcagggcttgagactttgccctttagctgcagatggtctttgggggacacctggagactgctggttgtcagcttagaaacccacccagtggataggggaaacctcacccatgctgcctggcccagccagttgtgactctctttgggtgagtgcaggttagccctaaattccatgtgtggagaaagatgtgagcaggcctgaggggccctccgggggttgttgagcagggactaaaggaaggaccaagtggcttcctgcccttacctcttgtccaaccaaatggctcctcccattctaagtcccagtctatagtgaataatagtgaatagtatttcatgataataagagggtttcagtgactaaaacatataccactaagagaatccttaatcagtagtttattttagcttagaacctgaggacagacagatgggagaaaggatgggaaagaggagtttgaaatgaaatgaaagccccttgggtcctaaggaagaataaaggtcttaaactcaagccaacctgaaccagcaacacagagctatagaattcttagaacattgtaacacctgtgctatctcaagatctgtttctcttgtcttacaggcagggaattgaggcccaagggtcagtaagacacttaagcagagttactcaatgtggggcttgggtgaagatgatgaggaagatgaccatttcatcctcctaacaaccctatggtgtaggcgcactttatagccctgttttacagtggagggaactgaggctcactgctggtcttctcaggctctaaattttggccttctgactccagagtctgctatagaaccattataacatgctgccagcactcaggttctcaatttcccccagggaactgtccttctatccattcatccacccattcatctgcctatccatttacccatccatttatctatccatcatccatccatccatccatccattcatccatccatccaatatccatccatccatccattcatctgccctttcatccacccatccatccattcatccatttatctatccattcacccatccatccatctatctaccaattcatctacctatccatccatccattcatccacccacccatccatccatccatccagccagccattatccatgcatccatctattcatctattcatccatccatccatccatccacccatccatacatttatctgcctattcatctactatccatttatccatccatttatccatccatccatccatccatccatccatccatctaccctttcatccacccatccatccattcatccatttatctattcattcgtccattatacatccatccatctaccaattcatctacctatccatccatccattcatccacctacccatccatccagccagccaggcattatttatccatccatccatccatccatccatccatccatccatcaatccatccaccaattcatctacctatctatccatcaattcatccatccacccatacagccagccagccatcatccatccatctatccatccatccatccatccatcccttcatctattcatccatccattcatccatccatttatccatccatccaccaattcatctacctgtccatccattcattcatccacccaccatccatccagccagtcattatccatccattcatctatctatccatccatcccttcatctattcatccatttatccatccatccgtccatccatctacctgttcacctgcccatttatccatccatttatctattcatccatccatccatttttctatccatccatccattcatttatccatccatccatctgtccatccatccatccacccatccatccatccatctattcatctattcatccatccatctatacatccatctactcatctatcctttcatgcatccatgtatccatccatcaatccatccatccatccatccatccatccacccacccacctatccatttatccattcatccatccatccattcatctatccatccatccatccatccatccatccatccatccatctcccagttgtcagctgagggccaaatgccaagtgttgcattcagcccccagcacaacctttgcagggggtgatagggagagagcattcagtactcagggcctatcttgctgagcttaggggaagggccctgaggacctgacccagactcagattccagaggcagcttttccttccctgctgagtcagagctcaggagcctgctttgccaacactggcagctcagctgactgaaggggtctaatgacctgggaggggaaaggtcaggaagcctttccataaacactctggaagccctccttttcttttgctctggcaagccctgctgacataattattgggcggatgtgacctggccagaccacagtcagatatccatacgctttgccaggggacagaggttgcagggatgctttgattgcttcctctcctctccccagagtcctgtggggagaaggaggagtcagcggaaatgccatcacccttctgatagcagatggcagccccgtagcctgctagagacacctcgggagtgggaaggggaatgggtgggtccctgaggagatggtgaaacctgtcagacccctaggacatctttaccaagctctggtgacaggtctattcttgtcatcctggtccctcacttatggggctgcttcctggaggagatggctttccaggtggagaaaaaggagtataacgtgtcattgttgggcagcctctaacactctcagcaacagcatttggttattatcattatttttagtattagttattatttgaaagggcttcttttgtaccaggcacttaaaaataaatgtattcatcatgtaattgttacatccttctgaggttgggactgttactatcccatttaatagatgggaaaactgaggcactaaagtcacaagattagtaagtgttagaggtaggatttgaactcaggaagtttggctccagagtctgttttttaaccccaacatgcaagattatgcagccagataaggggtcacaatccctgccagatagttccaacgctgccctctcagccaccaccatggggcggtgtcatttttagatgaatgaacaaaggaccaggtagctgtgggtggacggtccacattgcctgtgccccttagggggtagggggtggggtgggctggagcaggccctgactgcgtcctctccccttttccctccctctcagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccggtaagactgagtggggtctgcatgctgcttggagctccagtgggggactggggcattggtcaagtggttgcccctagtaaagacaggaaaaggagcagcttagagcagggagctggttatgggtacatccttggctccagccaggcccccggctcctctggctctgctaaatgcatcattgcccaccctgctccagattcatgatccgctgggacagactcaagtctggtggctacccccaggtgaagagcatccctgggctttggttggcccaggtccaagcccgttctttgctaacccagctgcaaagctcgaacagcttaaggaaggcccgtagctgactggctccagatcatgcagtgagtaagcagcttccaaagccccgttctcccagctcatggagcaggggtccttctggcccatcagcttgtctgagagttgcagacaaaggtcacacatggggagctctggatatgttttgtttggcacgtgcagtgttcttttttaaaaatccaataacttactaacattttaaaaatgtgagagatttcttataaaaagactcagcaaccaacttctcttggaaagtgggagatgcgatggtgcttgagccaccccgttaggacaagtccactcctgtctgtgctggtccccacttctcctgactgagtcttccgaccagtcctttcacccgtttatgttacctgcctgcctggcacctgcaggggtttgatttgtaacccccggtaggagtttggggtgcagaaggtcagcgtgggccagaaggaagaggaagggagaagaaagaacacgatttgcaggatggtctcagggtcgatgcctccggcttgcctgggaccgtctctaggggcaacgaccttcccacagctggaggccaattcctccgggtggggaatgatgggatggcgtttccagaaggctcagggctctgctctgttctcccgccttggagatgaccaccgtgtggtggcctctctctctccttcctgaagccggctctcccactgggctctgtgtttgaggttagggctccctacaatgtggagacagtggcagatgctgggaattcccaggccttccaaacacacttaatgagttttaataatcattaggaataatatttatccagcctgtctccaagaggacggagagtctgcctttattataaccatattgtcgaacttatggaaactgtatgcattgctttgcaattatgtcaacgttctgctcaagttccgtgttctgaaattggcagcgtagagagttgggagccaccactttcttgtggaaagaacgaggaacccttttcacctctccagccaacccaggccaactctggcaccaggtgccttggggccctgacagctcagcttcccacgctgtgtgcgtgctgggctcaatggcggtgaggtcaaaaggggaattgccccctcctgacatggtgaggtccatggtctcaattctggccacacagcacaacccagccctgaggaggaggccggccctccctcccaagaatttgtgtggtgtggagagaggagcggagctggcccagggcagattctatagtatcttgggtctgctgtatgtctgagtcaaatactttttcctggggcttggggctctgggtcagcaggaagcgaggcctccttccaaatctctttgaaaaagaggaggcactgaaatgaaactggtcagtcagtggttgcttggggatgacttagttcaactttcctcattgggcaggtgaggaaattgcgctcagagagggccaggacctgcccaaggccacgcagcacggaggaggtggagttgaagtttacattccagactgtagcctccaagactagcacgttccatcccactgccctgagtgtccactctgaggctctgggactcagatctgggggactgggggcttcagacaggagtcactactgtccctggcctcaaaggaagggctcaacatctaaagaatctttttctttttttttttagagacagggtctcactctatcacccaggctgctgtgcagtggtgtgatcacagctcactgcatccttaatctcccaggctcaattcatcctcctgcctcagcctcccaggtagctgggactacaggcacgtgccactatgtccggctaattttttcactttttttgtagagtctgggtctcactatgttgcccaggctggtcttaaactcctggcctcaagtgatcctcctgcctcagcctcccagagcgctagaatgacaggcttaagccactgtgcctggcctaaagaagcttccgattcgataacccatcaagtttatgagctgcttccacaggcgcggtgtctcctttaggacctcatgaaaactggttgaggagggcaggctgtgtgtgttcatccctgccccacagatgatccaagaggggttggaaagagataaaggaccccgccaaaggctcccagcgtgttcctgaaggagctgggatgcaacttgtggtccctgacttctggccagggctgaggctctttctgctccttcagccctgactactgaggacaaggggaagacaccaacctgcccgggtgacatccctgtctcaggccccatgctatcccctgtccccaccctaggaggaacccggaagctggtagaatctttgtccactgtgtagcagatggcaacctggtcacttcttcaccagataccagaataatgtaatggaagaggcatctttgaacggtgatgaaatgaactctcattctttctggcctctgctgtcttcccttgacccccatatatatccaggatctaagcccagcagaacagaagctccagctgcccaggagaagagcttaattgtcccccatccaggcacatgcagacttgggttcaaatcctgactccaccccttttagctctgtgactgatccatgctgagcctgtttttgtagaacataagatgataatagctcccacctctggtggggagggtggcctgaaaatgtgcgtaaattttatttgcatataaagctgtagtagaggctgggcgtggtggctcacacctataatcccagcactttgggaggccgaggcaggcggatcacttgaggccaggagttcgccaacatggtgaaaccctgtctttaccaaaaatacaagaattagccaggcatggtggtgtgcgcctgtaatcccagttacttgggaggccgaggtaggagaatcccttgaacctgggaagtggaggttgtgatgagccgagatcatgccactgcactccagcctgggcaacagagtaagactctgtctcaaaaaacagctgtagtagaaatgaagtaatttgggctatcttatctagttttgctgagtgactttgaggaaattctttcctctccccagggctcagtcttccactgaaatagggtgttgggacagctctccccttagaaatgactgtgggacctttcagtgtttgagaaaggtgcagtggctgtgtctgcatgtgcaaacctgctcctcggggttcagggcacgagagcaactggcagaggcagagacagagttctgggcccaggcctgccaggagttgtagctgctgagtgaggaagctctgtgggagccccaggaggggggaacatggaaaaattgagcttggccctgggtgagttggggcggggaggccgtggttcacagccctgcacagaagctgcacagaagccccacgcctgagaggaggcgagtcaaggccttatttattcacgatcaggccactggcatttgcccgtgcttgcactttttgcaaatgtcccctcgggaagacgccgctaagggcctggcccacaccacgtgctctgtgactatctatctatgaaatgaacaaaagaatttgatccttacgaaatgcaggtcgtcctgactcccaggcggggttccttgaggttacccagaactctcctgccagggagatgaggaggccatgtggactgcaaaagaacataggctttggatttgggacaacctggatttgaaccattcccttattcagccatccattcattctttgcacaattgttaactgaacgtcctgtagatgcctggtgctgtatgacctttggcaaatcacttaacctctctaagcctcagtttctgcctctataaaatggggatacggtgccacctacctttccagggtcgttacatggattcagtgagatgcgggggtcggggggaggggagtaaagcacatatgaaacctgggtcctggtagattgtcatggctgtgattgtggactgatggtgggtgttgaggtggggactttggtgcactgagagaactgggagggtctggacatagtctcacatttgcttggagaactgtgctatgaaaatactaacctggggttagtcggtggagcagggacagcagggagcctgaatggataagagtgtcatgacacatgtcagctagacagcgggggtttgggggaggactgcccccatttttttttttttgagacagagtcttgctctgttgcccaggctagagtatagtggtgcgatctcagctcactgcaacctccgcctcctgggttcaagcaattctcctgcctcagcctcctaagtacctgggattacaggcatgtgccaccatgcctggctaattttttgtatttttagtagagacaaggcttcactatgttagccaggatggtctcgatctcctgacctccaggcagggcccagactcactggggagagttaaaggaacagactatttacggaggggtggacagcatcaagggaaccagcagaggcaggtgaaacacaaggggcctggaaactgcaggaaattgttaccacacccagaccagaaggtcccagggaaagatgttcccagaacccaataagagttaaaaccttgagcaggggtctcctcacagaagcaggggccatgggcgaatacagctgcagccaaattatagcacagcagagagggcacagggagagaaatataccctgtcctcccttctgtgcactctcttcctggggtctcccattggccaaacccagctggaagccagaggtcaaggaaggccggggtataatctgtagaagtcagcttcccagggcacggcacagatctggggagtaaatggagaagaaccagcatgcatatgccatctcagaatatgggtattacattcccatttcacagctggacaaactaaggcccggaggcccagggagattaagtaacttgctcaaggtcatacagagctgtactgatgccaagaagctctgttccagcaggtccttcccaggacagaggctagggaagtctgggtgccctgtgtgaattcttaggaataatcatgagctcagatggtcagagatgggagagccctttgaggccccctatctacccccaacaggttacagacacagagtcgaggcctagagatcaaaaggacattgctcagggtcacatggtaggtagcagcacacctaggatcggactttggtctcctaaaccccaggcttgtaaaacctctcattgcttggcaggcagaggctcttccagctggacacaacggtggacttgttccgtaggatggggttcccctagatctggctgtcagaggccaggacccttgggggaagccccgaggggtctgcttggttgtttccatggctctgtttgcgtacgcctggagcccaggcctcctccacctcccccaggcaggcctgagcccccgctctgctccccctcagctccaggccctctcagaggccccgttgtttgcaacgcaaagtggaaaatcccaccccggcctcgtgaatcatcccagagtcacccgctcaggcttcaggccctggaaagaaatggcagcgtttttccactgcggagagaacaggcagggtctcggatcaggggagaggggccagggggcacccgtgctcgccacgagcaaagtgggcactgagtaggggagggtccagcccgtggctagcactgggcagccggcggtccccacccaggttgaaggtggagtgaagggattggccaggcccgaagctggggccgccccgtcaaggagtccgcctgtgggctgacatcaccaggctggaccctgggtcctgagtggcactcagagtctgctctgcagatgtggtggatgaggtcagactctatcctggatgcccctatttctggggcagaagacatgccaagagggagtgtccaggcctctgcagctgcagccccaccagggtccatgaaggagctgcacccacggagcctgttcctccccggagtcctggacaagcccttcaccctgctgggtctttgccttctctgtgagatgggaagaatctcgcttttcctcttcacttgataatgtagcagaggaaattacccccaccttggctttccgcaactcaggaaatgccagtgccaggaagtttccaggatcttcatttcacagatgtccagagaagagaagggacttactcaaggccatatacctagttagagtcacactcaaccaagattgtgtggcagctgcccagggtaggagaacaggtccagtggtcctgggtttgaatccaggctctgcctcttgttagctgtgtggcactgggcaagtcacttttcctctctgaacctctctctggtttcttacctgttgaaacggcatggtatacctacagtatgcttcgtctcagccccctgctttttctttaattctgggtccacctgggacagttgggtcaaggagggccttctaagaagggacatcttttgctgtcccctagaaacagatgtgaaggaggatggcttaaaattttgagttgaggacgttccagaagcttgcttcacagaaataacagctaacattttttttgagcattaattgggtgccagacaccaggattagcacttgttatagattatctgtcggctaggtgctattattaacctcattttacagtaatagaaaaaaggcttggagcctggaaatagctttgctcaaagccacccagatagtaggtgggtgggggggggtgccctatgtgaacccaggcccgtggtgttacaccatactctactgcccagagacagctggagaggagaagtgggtaagactggcacccagagtccagaacccacaaaaccagacaacccctctacccacccctggaactctgccgccaatttggccagaggtctctggatgctcagaggtagctgggacttgcccgaggtcacaaaacagaccctcctccttctgctcagggctcttgcccagtgaccttggtacccatatctgcctgtctggatctctcctctgatttttattcatggacgagcaagcacgtggtgttcacaggccagaactgtgagccgagactgcccagcatgagatctggattaattaccagccaaaccagactgggttttcaacaccgattttaactctgggcaggaaatctggaatctcattgatggttatttgaaacaaatgaattccccaggcctcacacatcctcgaaagcctggcttccttcaaaggctgcaggcacagttcttcacatcaggcgcttagttaatcctcatttactccttcgaggtaaatgcagtggtagctattggacccatcttaacggggagcatctgagactcagataagtgggaggaactgcaggaagtgtgcagctattaagtggtaaagccaggatttgaacaaagatcagctcatccttcagtaagtctgctcggctgcctcccttcctgtgtaaagagaaaagagatgaggacacacagatgctccttaaatgctgagcttcagggttaggtttttcacttgtgggaaatggggagcccttaaatgttgttgagcaggggagggcttttggaaggtgaatgaggctgtgtggaggaggactgcagaggggagggaggagagagtagaggcagggagaccactgagggggctgctgccggttcttggggagtggtgatgaaggctggaccatgctgtggccatgggaacagatagaaaatttgagtgccagttacataccaggcaccgtgttaacatttatcatctctcatgtcatccttggaatcccatggggagtgttttattgcctccgtttgtatgggcacaagctggctaaagacttgtgcattttgtcagcggcaggcagggatctgaacccaggcatgtctgattcaaaaacccatgccatgctctgtgtgctgtgctgcctgtttgtggggcagagatacttggtgtgaccttggccaagtcccttctctgttctgattctgcagagaatttggctgagctctgaggtttctggctgttttattttatcaaacgtttggctgagccctggggataggcagatgactcatatccccttagttcctttgaggagactgtcatctgatgggagacacaggcttctaagcagataattccccaagtaagatagcggtctttaaaatagaggaaaagaagggactttgtccaacttggggaaggttttctggagaaggtgacaccctaagttagctgggtgataaatgatgagggcgtcagtgactgaatagtagctatgaaagcccaaaagccccaaagagcatgaatttctcagggcagggacctcaggggactcctcctcttagccgcggactatccatgcccacagctgcaggcgggattgttgaatgactgcttgagcccattctctgctgccagtgggcactgtctaatgctgtcttcttgttttctcctcagggtccccctgggctacctgggctacctggaatccctggtgcacgtgggcctcgggtgagttatctcacactgtcctttggaactcttggtggctctttggcctgcgtctcactgcccctgaggtctcgggtttgctgtgtgtcctcaggttcttccctccccctctctggcacccatatttggctttatccatttggagtggacttagggctctcaagggtgctatatggacagatatggcatggaacagcaatgacctcttgtaggtctcagttgtccattggggatatcaccctttgcagcctggggtggggaaggggctccagaagatcacatcccttcggctggtgagcttcagtgtttggccaggaaaactgccttggggaatatatgacccttgcatccctcttcctgtttctgcagggctctcctggagtaggggtgcggacataggtacctggaggggccatgcggggaggagttgagttcctcctgctggagagaggctgggggacagcttggcaggctgcggtggctgactgagctagcccaagcccgagagggaaaatagctcctatgtgatgtgcctggcaccttcttttatgctgccttatttgacctctcatgcccaccccaagttcccatgggacagtgagatcattctcattttagagatgaggaaactgagtaggaaatggcaaaaccaggactggaacccaggctcttacccatatactggaacccttggagatccccttagagggaaacctacctgcttcccttagagggctgagaccaacagcacccggcatctgtgcccaggctgaatcagcctttcccacgctgggtgcctggtgaggccctggcagaggtagctgcctggggcatatttttagctctgagcccagcgagtggttctggttatgcaattacccaagccctagttccctccagacctggccctgtgctccctgggcccagggctctggaatctgccatctgaagcggcatttcctcctggcttcagagccttcatgaagcacgtgccctctggggaccacatagatatcacagacgctgctagcccatgggaccttgcagcctgggaccaggatgaggccgttgacctaggcagcctactcccttccccaacctcctgagcccccaagcctctgcggttttgctctggctgtcctcctttgtaaacttgtcctccattcatgtctaagagcaaatgccacctttatttctgatgaccactcccttcttggaactcccgcagtggttcccctgtcccctctggatggcatgggccactttctcaaagctctcattgaccactaaactctgtttgctgagccacatgtgcaggatctcattccaccttcccagccattctgagaaacaggtttcaatctattcccattttacagatgaggaaactgaggctcagaaaggtttagttacttcagataaagtcaaagagagtaaatggcagagccaggattgaacccaggcagtctgcctccagagcctaccatcttttttttttttttttttttttttttgccagagtctcgctgtgtctcccaggctggagtgcaatggagcaatctgggctcactgcagcctccacctcccaggttcaagggattctcctgcctcagcctcccaagtagctgggattacaagcacacgcccccgggcccagctattttttcgtatttttagtagacatggggtttcaccatgttagccaggctggtctcaaactgctgacctcaagtgatccacctgcctcggcctcccaaagtgctgggattatgagtgtgagccactgcgcctagcccagagcctaccatcttaagcatctattgtgcttatttttctgagtattcacctgagcccctccagagataggcctcggttacctctctctcctacgtgatgcctggcagagcaccctgcgtgctggaggtgctgggcaaatgattggtgaagagttctaatgtaggagtcaagaatatttctaccaagaagttgtggaatcttaggcaagtcccttctgtccttctaggctcagtttccccatctataaaggctggggtcatggtaaggcatttctaagtttccacctagctctgggtgaatgactctcctgacacgcttctaggctctttgcctgcacgccaccccaactctccctgcccgccgtcccaccatcatcctgtttctagactggaaattccatagattataaaattccaaagataatagaatgctggattaaacaatcccagctcctctctgcacagatgggggctctggggcttaaggaggggcattcttacctgaggtcgcccaaagctctctgtcttgccccttcctacctccacatattcccccagcccatggagggatgttggggaatcccagagcctcccccacctggctttctaggctgcagcatttatagaattggtctgcttggctttcagtcaactatgtgcctcgtttctctgcaatactggagagggttggggacgggggggcagggaaacaggaagcccccaccttcagaagctgcagatgggggagctgagtgctctggcccaccatctgtggggcagctggggcacgactggggagaggcagccgcccttgaccttgtgcagcctacgcctggctctggtggaactgggtgtcaggaacccctccttgaacactccctcccaacctctgtccaattcccactgagcttgtggttagacctggttagaccccacaagcctgggctggggtgaacatcggagggtgttccagattccttagagactgctgggtcccagtcacttacagaacagagggagagaccgaggctggggattatgaggtggggctcagaattgggactcagtctcgatgcttccaggttctgtcgcgtgccaggagacagtgtttggtggactgcaggggagggcaggagggctgattattttggaaggagggtcacaagaggcactgagaaactccccaggctcagtgtgctctggacactgttccttgccggtgcattcggagaaggggagggtcccagttcaggcatcaaggaagagaggaagagggaggtgccttggttggaatgtgacaggctgcagctgggaagctggcctcagagagggaagaagaaagcagttcacacacagttagcccgatgaatcaagagggacggggaagagggcagtgtgcctagaggctggtggggttgggaggaccactggacccttgagggtgcctctcctcacctcctatgccccagattattcctgctagacaaaaaccctcaagtattccccggctcttagggctctatttatattactgtgctggaagactctaggccagggcccttgctggagaaagtggacataacaggacccagctgttatcggggaacttggatatggcctgggaaaatccagcgccatgaataaactctggacttgaagccaccaggccctggaccctgatctcacttggccacaaatctgctgtatgaccttgatcaagcctcctggactctctgggtccagtgttcccaggtgctctgtggtctctggaagaccttgaaagcttggagcttgcaggtgtctaagggtctgatcacgtgttgtagccacaggagaggtgcacctttgttcacaagaggtcaaatacatccttcttgagctctcaactccaaagactcatacaaaagtccagttggggccagctgccgtggctcacgcctgtaatcccagcacttcagaaggccaaggcaggaggattgcttcaggccaggaattcgagaccagcctgggcagcatagcaagactccatctctataaaataataataataaaataataaaaataataaaataaaaataataataaaataataaaaattagtggcccatgcttggagtcccagctactcaggaggctaaggtgggaggatctcttgagccgaggagtttgaggctgcagtgagccatgatcataccactacagtctagcccaggcgacagagcaagaccctgcctctaaaaaaaaaagtccacttgagactggaggagccctagagggttccccggaggagatggcactttgagccaggcctgaaggatggatcaggtttcaagcagaggagatggatgagaaaagatgctgccagatgagggaacagcatgggcaaacgcaacgaggagagaaagtaccagatacgtgggagggaaatgcatagctaagtgtggtttgagcctgaagaagctgggaagggctgacggggctaggctgagagatgtggagaggtggtaaaatttaggggtgaaggacttgtgctccgaggtcaaggtccagctctgcctcttagcagctgggtgatctgagacagttacgaacctctgtgaacattggcatcctcgtcttcaaaatagtaataacaacaccacctaccttccaggttaacaggatcaaatgagatggcacatgggatgtgcttcccactgggccaggcatggagggtgtactcccaaaagtaggctgagtggccacgacagtgttgctagggcttggcttggggagaagataaaccagtgggtggagggaaggtgccaggcattgctgtcagaggcgagatggcccctgttttttgtcacctttttttgtttttgttccttgtctctttcagggtcctcctgggccttatggaaatccaggtctccccggccctcctggagccaaagtgagtatttgctggagatgtggccatggagtgggtgctggggttggagccatgtttgcagtgcttcccaggggtgcctggtgggagggcttcaggggaactgagggggattcccgcctaagccaggggcaccctctgggcccctttccagggctgggccctgtgcctggtccggagacacagtgcttccgtctgggagagacttgggagagtcgggcagttggaacccagagccttcaggggagtgggcagagaggtgatttcttgctaaatagggaaggctggccttgaatgtcagactaagaacataaggcttaccgggttgtaagatgcatcctggggagggatgtggaaagatgacgttttagaaagctcactggatgccctgaggaggatgaatgcggggtggggaaccagagccaaggccgggagaccaggggtgatatgggggagaaaggaggctagtccgggccaacttaggggtgtgggaggaggtagggtggaaaggatggtggtgggtgcaaggtgagagacagttacaaacaccagacagtttttacctccctgatgttagccttggggactgaactgggtcccaggaggaggagtaagatgatgttgcacgcaggaacatgtagcccggtcaagtgatcattcatggacagatattctggaactcaggattgctctgagctggagacagagccagggggaggctggcgcagagatgccacctcccccagggagtcttcttggaatactcgaattcacttttaatgagaccttagtggctgatgctttgatgatatgggaacaccacttgctgagctcttcagtctgttcccggagctctggcagagggcaaggttgttggggcactgcattggaagtgagaaactcagagcaccaagaggattgccggagccagcaacatttaggtcatgggaaaagaaagtttgtggaatggctggagagataggaggggaaggaagatgctaaagtccctgaagctaagagaacagtgcctgtgccgaaggagctgtggagggggcagatgggctcctgactcaggggcctcccagctcagcctgtgtcatctgtggggtaaccaggtgaagagcacccccgtgctttggttgggccaggtcccgggtcattctttgataacccagctgcagaggttgaatggcttaagggaagcccttaactgattggctccaggccatgcacagtgagctgctgagcagcctctaaagcccatctctcctgagtcatggagtagggctccttttggcccatcagcttgtctgggagctttggacagaggtctcacatggtagccctgggcatatggatctgtggtgtcagagtcttggggcagagcagagtgcaggagcactggcctcagcccctctagatctgtgactctacgtccagggttgggctgggctgggttcctttccggaaggcaggcagtggaggcctcaggtgtccagtgcttagcagctgcctggaggtgctctgggctttcacagggtgaacactgatgataataacagccatatactgaacccttcctgtgtgccaggcactgttcatgcgtttgatgtggcttgtctcatttgatcaccacaaagacctaaagagatgggtggagataccgtacccatttacagatggggaaactgaggcacgggtcgagtaagacattgtctaggaaatggcagtggagactgcccccatgggtcaggcagagaggcaggaactcatttggagagttctgctttgcagaggccatggcacatcaagatgccgagcatcagcagctgttttgaatggccaggcttgccccttcctggcctgctctgggaccagtggagcctgtctcctcccacccccagactcactccctgctcctgtggtagcagatgctccatcagccccttctgctggccctgctcagagcactgtggaacctcagtaccaggcccatggtagcccaccccaatcttgctaacagatgtgccatggtaggaggagggcctgccagctgtttctcctcgcattttgaacacatctcttagtatgaccactgaggctcctccctagcaagtgagttctcctgccaccacatggagctgggaaccatggactcagggcctcatggacaggactcccatttgcatctgtgtataatagataaggatgtgggttctataaaatacactggaatcagaggctgcttctctcattgggacttgcataaaatgccagggggaaatgtcatgccctttgcctggacacttggccctgaggccaagggtgaacagaggtggccccagagcaggctggtgggaggcccagttaactgggccagggccctaggctgatctgtggcatgggcaggacaaggttaaagcagaggccttccctggatggaagtaatgacttggctgagattggctgagaaagctgtgtgtctgcatgaatgggtgggaccctgggaagagggtcctagagtccttactgttcagcagatcccctttgggatgggaggtgacctggtgggactgtagggctggcctcccccagggcctatgctgtcccgtcctcttccagcatggtgtctggggccacacatccattcatcctccttcagtcaacaaacgtgtattgagcacccactacgggctgttgacagataaatcagtcacactgtcagggcttgccctgggggcacggaactggatcagccccatgcagtcatcccatcagtgcatctccaccttcaggtgcttatggccttgtgggaagacgatccctctgctagactcaagggtgggagagatgggtggtttgaggaagaccaagaaagagagaaagcagaggtgagggacctcatccctccggagggtgcagaagagtgaaagttcaggaggccaagggaccttgcctagatcacggctgggcagtggggggactgtatttcagatccttgggtttgcctgccagaaggagctttgtcagggtgtcacagctggcacaggccagagccaggccacaccccatcttcctcctccagagtccaaggctttgcctatctgccagctacccacatatcccatgttccaatccagcagggaagggagcttgtcagctccagcacagagttggatccaggactttgagaatgaggcagagaagctaggaccctgagaggatgtgtttccgcttagagcggtgctgacccgtggcaggtgctgcagaaggggcagttgtctgcatgtgtgaggcactggggctaccagggacacaggcaggcatggtccctgcccttggggagtgtagaggtgagcgagaaagcaaaacaagccaaccatattgacaaatgcagacttacaccatgattaggtctctagggctccatgtgagaggcccggagtgctcggagaccccacgatatggggattgatctagtccgggaggtgagggacaccttctcagagggcaggaaggttgaaccaaggtctaaagtatagtggacgactaggcaaaggggctggaggaggctggtgagggcaacaggcctggtagtttgcggtatgattttcggactttatccaaagagcagctggaagacctggaaaggatttcagcagaattgacatgactggatgaggtctgcaaacgccatttaggccatttgagaagcagagcttggctggtggccagatggagggctggagctgcccctggggcagggtgctgatgctggaccatggtggagtcaggtgggatgcaggtccttggtgcaaatgaggagctctagggcagaggtgggggtctccttctggatagggaagctagtgctccccgccagtgctccctgcactgggccatgaggctcctggttccactcttgagcagccagccaccttgtctctggtctggtccacttggtctgcagtgaactagccaggatgatatggccctcagacactgggaaggagatgtggtcagcagagggcaggctccatggcccaggtggctgctggcagagctagtgtgagctttacctttcctcttcctctaatgttccttcctttgggccaggccctgtgctgggcacttgagatcagagatggagtatgcagggggcttccagcccagaatattttaatcctttgtgatttagtgctcatttgtctcagccccaccctgggcctcagccacccaaggaaaatatggagaagtccagaagatgtcaagaagaaagtgagctatctgtagtggtcctgcccagtaataagctctgagagcactttgagcaacctttgggccaggccccggccaagagctttatgtactttgcagggcaggtattattacccccattttacagatgagggaataggtccaagatgctaaataacttgcccagtgtcacatttctagtaagtggcagagcacgcattcaaaccctcaactgtctgacctcaaggtgtcaatctagccctcagctccacagctctctggtcttccctgtgtgtgtcacatatgtgagtgtggatccactttgtagtggctgggtatctggccttcctcacttaacaattattgtgaacattctcctgtgttagcaacttggcatccatcacatatgatttaatagcttcatggcattttatcaacactaatatcccatgctttatataacttactccattagtaaaaaaaaatcagttccactttaaattaatatacaaatattatcttgattaacattactgtatgtaaatgttagaatatctccaattatttcattaggataagttcatcaaaaatagaattgctgatgtggtctcaggagtcagtgtgcccaagtttgaatcctggctctactgatgcagggcagacaagccccaaattggggattagcctgggagggtttttggcttcactcaggaaagaattcaacagccagctggtggtagaagaaaacagctttattgatgtggcagtacagctccgtgactgctccggcacagcagggctaccccataggcagtgtgctgacagtaacggttcagaggcaattctgcagtcatatttatgcccacctttaattatatgcaaattaagaggcagagtatgcagacatttctagaaaagtggtggtaacttccaggtcatcaggtcattgccatggaaaggggcagtcactttcaggttgtcacctgagaggtgattctacctcatgcctgttttagctagtcctcaatttggtcccaagtccaagccctgcctccagagtcaagtctcatctcccacctcactaccatttgctgcttgtatgactttgggcaagttacttaaaacttggagggcctcagcttccacttctgtaaaacaaggatgatcatagttcatacctcataggattgttctgaggattaaactgtgtgtgtgtgtatgtgcacacatatatgtgtatttatatatgtatatgtagacatatatcaagacatataccaagatatatttgtatatacatacacaggcatacatacacatatatacaaatgatttataatatgccttgcacatgagagacatataagtgcttagctgttattttattagcaattgccttctagaaaggttaaactgatttatgctgctgctagcattaaaggaagatatttttaaaagaagataatttattatcattttcacttcattgatcatctatgagatgtatgtttttcttaaatctcttttccatttgtacttcaccacttatgagtgggtttattttggaaggttgggatgttgccatttgttattggtttgtaaacattattttgaggttattaaggcttcatccaccttacaaatattttctagtttgttgtttgcttcttaagagtattcatgatgattttcacaaatagaaatgttatcctttaaaaaaaataatgtgtcagataatctcaggagggctctattcatctataaaatctgtggttctttattttgcttttatacataggaatgtttttcccattttaaggtcagataggtattcatttatattccttgtaatttcataaaatcatttgtactcttaaaaaattaaaaccatctggaattcatgttaatgggggtgatggaaatgaagttgggctccagcattatttctcctccaacagttaaccacttgttaaaccatctttcctccactgtttactctatgatagacatgggtctaatacaagccattgtattatgtttcattgtttatttatttttatgctagtaaaataccaattatatgacatttactatctttattctgtgtatcctccttcttttcttcatttaaaacatttctggctatttattctatcagatgaaccttatgcctatcttaataatttccttgaaaaaacgcttgggatttttactggaattgtaattaaatacatatattaatttgtgaagaattgccgtctttaaaatattacatttttctatctaaaaacatggcatgtcttcctatttggttgaatttttacaatgtctcttagtaaactttaatggtttttattacataagccctgcacatttcttattaggtttatacttagaaattttatatatttttttgctgtcctgaatggaatattctccccattatattttctagatagctctcatctagtgaaaataactattgatttttgtatttttttactttttgtatttaatttataaccatccccttactgaatcaccttattaattctattagtatttctgttgggtctcctggattttatagataggcattcacattatttgcagaaaagaacatattgttgtctcattttcctcaaaggttagtagttcttatttatttttcctgccttattgcattgtccagaacttctagacccatgaaaatagtcgtactgatagtgagaggcctagtgaaaattcagagacagttctggggcaggagccagatttgacccattcctatccctaccattgtctcttgagactctgttcactcatttgctcatttgtgaaacattttatgttgacttctctgggccaggccctgtgccagatactgagaccaaggatgacatatataggaggcttccagctcagaatttctcaatatttattcatttatttgtttgtttgagacagggtcttggtctgtcatccaggctggagtgcagtggtgctatcatagctcactgcagccttgacctcctggactccagcagtcctcccacccagcctcccaagtagctgggactacaggtgtgcaccaccacacccagctaaattttttgcttttgtggagacgggctcactttgttgcccaggctggtccagaactcctgggctcaagtgatcctccttccttggcctcttaaagtgttgggattacaggcatgagccaccatgcctggccagaatttccaaatcttttgtgatttattcctcccttgtctcaccccatctctgggcctcagccacccaagccttctgttctatttcccaaccctacctgcaggaaaggtattcaccatagttcccattcctgctatgttcttggcacttaaggctcccatctgtcttctagtaccacctggctctgttaactaatccaggcagagtctgccatttcacatacagagagggaaagtggcttgctcaaggtcacacaggctctgtcgtggtcacacaagctcattggctggagagctggtctggcaacaagattcttgtttctatgaaggtgtaaatggttagttagactttgtatataacttatatttcttattggaagatttgcaggagcctggctgggaagacatatagtgtgctctatcccagaagtcataccttcacctgtctaggggtaccttgagcatcccttaagccgccacttcatctggttcctccttgtctttttccagcctcaacttagctgtaactcccttcaaggatttacctccgtctaggtgaagttctctccaacttcttcctgtcctccacttaccaccggattgtagtttttcatctgcagtatatcaaaatgtaaagagttcaggctctggaaccagactgcaagaacctaaatcccactttcttttttttaatttttaatttttattttaagtttcgggccacatgtgcaggatgtgtaggtttgttacatagggaaacgtgtgccatggtggtttgttgcacctatcaacccgtcacctaggtattaagcacagcatgcattaactaattttcctaatgctctccctacccctactcccctgccaccgacaggccccagtgtatgttgttcatcccagtgcgtccatgtgttctcattgttcagctcccacttatgagtgagagcaggcagtatttggttttctgttcctgcattagtttgcttaggataatggcttcttcatccatgtccctgcaaaggacgtgatctcattcctttttatggctgcatagtattccgtgatgtatatgtaccacattttctttatccagtctatcactgatgcgcatttaggttgattccatgtctttgctattgtaaatagtgctgcaatgaatatacaagtgcatgtatctttgtaatagaatgactaaatccaactttctaattgtatgaccttggacaagtgacttattcctaccgtgccttagcttcctcttctgtaaaagggggatagtgatcgttgccaacttatggatttggaggattaaatgagttaatatgtgtccagggcttaaggagcacacagtaaatattaatgcttatcatcatcactggtctctctggtttttccatcatggacatgagtgtgtctgttccccaccatggcattccctgtcttctgttcaacttgagatttggcttgtagcatctgtacttgtaggtatcatactcgggcaggcattgcatcttgagcactgtgctggctgctgagaatgcagagagacatccatgaataactaaaatgccctgggtaaggaccttgggcaagggagcaagtcatcattttgggtctcagtttcctttttttgtaagataacagaatgggatacctgaaggcccagccctgaaagcttgttaagcccagctcctctatcagctgcagatcgaggtgggcacaggctggctgagaaagagctgctgtccttttttggccattggaatcctcggtagccctaggtctggccttgtaccatggacataaaaggcattgagctgggcttctgaacagcccagggtgggagggtgtccgggaggagcagctgcagtgcaaggtgaatcccagaggtgaggttctgcagaagatatgacctggaggggcccagatggacagagttggagttctggggaccttcagcctggggttgctggggggatggggagtgtgggagaagcacccaggcctcccatttgcaaatggggctttgaagtcagacctagcctggggacagactcagcctttgtctcttccctgccagggaaggccagcccaggctgggacttggccttctctgaacccacctttgtccttccttggaacaaatgggtgctatgaggactaaaggagttggtgcacagagtggggctagctcagtgtctgcacatagtaggtgagcagcaaaagctcattcctttcccttctggaggcactttctagttcagaatgcagtgatgtctggtggagggtgaccgagtcaggatttggaaaatctgagttctaatgaagaaaagaactgagtgggaattaattaaagttgcccaaaccacccttcccatgtgttatgaccattatcccactggctccttgcctggaaacctgggaagctggcgtgtgtttgtgtgtgtgtgcacgtgtatgtgtgtgcgcatgtgtggtccccactttaaaggtgagggagctgagctcaggaaggtgcagtgacttgcctgaggtcccactgtgagtctggcaggtccaggacttctgactctgggcccagctgaggcagggaggggagagggctcaaggtgggataggaatggggacaaagattaagagctcttagaaggtgacacagggtggactgactttccacagggctgtttcctgagtcatctgatcaggtttggccaaaggagaggagccgcagccaggagcaccccgtgacagacatggctggtgaacctgtgggcccttttcccgagccccatgctctcaggagccaggatctgtgtgacagggactgtcccctatgctaggcacaaagagtgcttgcctctgatgggggactcactgcttgtcagtttctcctcaagttactgcctgttctaactcagcaggagccagggcatcctggaacgcaggtctgggagtcaccagtcaggattataatctcagctctgccaatgcttcatcttgaggccctagacagtccctttccttctcctagcctcagttttcccaaatatattatgagaggaataatgcttcctttgcctcactagattgtagaaatctagtgcggtgagggatagtgccaactgtgaagggctgtacacacctgtaagtggctgttcgtgcattgaacctcatgtagagacccatgaaatggatatcaacattctggaaaatcaaaaagtattgacacgcctcttggacatgtctctcagaaacccctgagagccccaggggaacaagccaggagacagtcctggccacgtgcacgggcagagactggtcacctggaggatggacgcagagctctacaagtaggatgtgaaggacacattccagctgtgaactgaagaatgtttgtggtttggctaacgatgattggagaaggggtttctaggtgtgggtgactgcctgagcaacagcctggtcgcaggacagtgtgggacatggctggggcgtgggctgtggtttgaggatagagcagagggaccctctctgtgggtttggctgctgaaaggagagcagagtctagatagggtgcctgggactggctggattacagaagacttgggatagcagaaggaggaacttggactttgtcaccatgcagtcaggggaagctgtggaaggtgttagagcaggggagtagtagaattggagaagaccctctggaggtgtgtgagtgggaggatggatgggaaggcatttaagcaagggagcagggctttgagcagagtttgtggggaggcagacatcctttctagatgacttggtggccaaagtggaattgtttttgtttcagggacagaaaggggacccagggctctcaccaggaaaggcccacgatggggcaaaggtaggtttccagggaccccagttctcagggaagaggggagtggatgatagtgaaattgccacactttaaagctagctgtcctgccagaggccatgcatggcaaaggcagggaggtgggaacatctggaagggttagggtatggtttggttttttccttgaagtcctttagcctttcccaacaccaaacccacccaaggttattcccagccaccttctttccagaatgcaaccaacaaaactgacaaaagatttctcctatggacacacgcttggtgaatgtccttttgcctaatgtcctgcatggctttctgcggggtctgctaggtgactgtgggcatccagaagtttcttggtagcacatggccaggaagcttccaatagacactcaaagcctttgctgaggttaactccagcagacgggtctgtggatttctaggaggctagagattcagggctccctaactctgaagggctatgaaaccaggcttgcctgcagaaggaaaaacactttggctaaaggccttcatccgtctctgaagcatccaccccataaactgagcaagggacttggagggagtgcaggacagatgggaagaggggagcccagaactccaaatgagattgtccagtgtgtcagtcttccaggcacacacaccctggaagcaatgcccaggtctgcctgacttccttctggacacagccccagagccatcctgatggatggaacactgcttctcagcccagcctcctgtgcttaaaggcacctagaattggctgctttctttgatttccccaagacacgagttgcttatttcttcacatcctcactgctaggtgtttgcacttagcacatatttactgggtgacccagggtcccaggagagtgttcccatatactaccacttgacccccatcataccccatgagccaggacagacgggcccagcttacaaatgagaaaacggaggcctaggcaggggtggcttgctggaggtcatgcagctgataagtggcaaaatgagatcggcacccaggagcccaggcttccctcctgctcctgtgtggcctgttctcaggtcttggggtggtggcagaaatgccccctgcttggccagtggcatgcccagcaatggaaggtgtcttaggactgcagggagagatggctgattgatatgggactgataaggcacatgtcctctggagcatagttttcaaacgtggttttagtatcggaacccattcttcaagtggtgtcttctgctgaagcccagtatgtaaaatagatcagatggagccgctgagttgagtggggaaggggctgggtacaccactcactcttcttgctgggcagcccccgagtctcctctgaggcctctacttctctatgaatctcatttggaaacaaccagccattggaagttaccattccaatttgtagagtgtagcagagtgtctctgctcccgttttcctgcctcacccaccttgtctgtgtcttccagggtgacatgggcttgcctgggctctccgggaatccaggacctccgggacgaaaggtactgtttggttttgatgctttgccttgcgcagtgggcctcctagcaagccaggtcttcaggcagaagagctgtgggcccacctgcctctccccagccccagcccagctcccctgggcacagggtacatgggtgagaggtgagagagctttccaagggttgtgcctgttgagggcagggaatacctcggctcgtagtaggtgcctcccaccacggttaatgaggtagcataggaagtatccttggtttgctgtccttccttttgggggcccagccgctcccagggaggccaccttcaagaaagcctgtggtgatggagtaacctgtgctggccctggctccaccacccactgtctgagaggccgtgggcctgcgagtcctgtctctgcccctcagcctcctcctacatgagatggagacaatgatccccgtctctgaccctgcacagtctggggctgtgtgaccaggagcaaggcctggagcggagaagttgagggagtggaccctggggtcagttggacctgggtcctactcctgcttctgccatttcctggctgggtgaccttgggcaagtcagtgagctctcagagtctaatatgcggccctcgctgatgctctgcaggggaaggggaaggggaatgatctggagaggcagtgggttctctctatcttgctggctgttgttatgtcacgcccatcccatccccatttcagccatgctgggggagttacctgtccaaacgcctgtgtgaggaaaagactggcatttcctgggtagtgggtctgtaacttacagtccccctggatttctgtgactcctccagcctgtgtctcccttccttcaagactctactctagttgtgcctactccaggaagtcctcctggagcacccagcttcaggccatgaggctcctctctgctcaagaacacttaagctgtcttggcttagttattttgagccaccaggcatgcctcaccaaccagggtgtgcaaatctggtttattgctcttcctactgagcctagcatgaagcctgtgcatagcaggtgttcaggaaatggggggaaggcaatgcagactaaggatcgattgctttttccaagaaaatccccaaccgctgatggattgtctggtgaatccatcggcctaccactgtgtcttaagcttctgccctggctcccagctgtggccacagctgaactctctctaggccatctggctctcatctggacagctggggtgtctcccagctccatcctgttcttgccttgagagccccatgacacagggggccttgcaggacctcgttcccccattcccttctccatggccagagcaggccataccttcaacctgagaggcccaccccagaagcagtggctgtttgtgagctgggaaacatggtcctttctggctcacagaacacagagggacttgcgctccccacttacttcctctctgggctctagcgctttctgatggatgaggtgtgagtggaaaaggctccttccggtcccagctcataaagcagcctcgggtggtcttgttctgcatgggggtggcagcctagcagaggtggcaggagatggggaaaccagactggaaccagctcctccctggggtgccagggctccttgcattaagcagatgtccggggaggccaaggacccccaaccaagaggagccaactcacctgagcagggagaggcagcttctccaagttaaggaaaagccactgcgcagctggaaaactatttggcaaagccaattgctctgagctcccctctggccctggcctagacatgcacagaagagtttcgtctgtggcaggctggcgtcacccacttacagagggtgctgggcgaagtgtcggggagctcaggtcccaaggcagagacccctgaccagtggtggggatcagagaagagaaccactgccatgggcaatgtgcctggggccaccattgtagatggtctttcctatcacacacatctttggtgacaatagcagccacttggctctgatcttgcagtgtggcttttctgcattatttcttgtgggaaaccttgaggggagaagggaagtgagtggataagaggtgaggttagcttcctcttcgtgcttaccagcacattgaatttttgtcattctgaggcaacacagataatcctatttattcatttatttaacaagaattattgaatgcctataatgtgccagccactgagctgaatggacaaaaatccctgccccacagggcctgcatccttgtgggggtgtggggagacagaagatacaaagaaaaacagtaaaaataaaaggtacactataagacagaaagggctatggagaaaaattagcaagagaaagggagttttggttggagggtgcagtctacagcagtggctcccagctggggagctcaagccccatcgtggtgattctggctcagctggtctgagtgggactcaggcatcagtagctctaaaaggcctccaggtgtttcccacatgcagtcaagaatgagaggcaccaatttaatggaaataccttccatgggtttctaagctgcagggctaggattcgaacccaggtcttctgaccctcaggccctttctgtcaccacaaggctgattgaaacagtttctcaaacaagacagtgtccatctggtaaaaaaagaggctgcctgcccgagaaggtttgtttctctgccaccgcctgagatacttgtggaaggaatttgctgggccagttcccaaggtggggaagacacgcaaaccaggtcagatagacctggatggaatccccgctctgtccctctcctgctgtgtgagcttgggcaagttgcctcaccttgctgggcctcagctgcctcatgaggtggttgggaggattaaatgagatgtaatatccctgccctcagcacagggctggcacacggctggcactttgtatgtatttgtgtgatgaataaataatgatcatgatgatcacgaagagaagcatctgaagaaggtcttgccaatctggtagcactagtcattttgctagtttccagctaaccaccctccactagccaagaaggctgccagaactccatgtgcacctcccatgctttctctcatctaaccctcctgctttctttcctgtagaccagtagttctcaacttggggtgattttgccccccagggaacagttggcagtgtctggagatatttttggccattacctacaactgggagggaggtgctactggcttctaatgagtagaagccagaaatactgctaaacattctgcagtgcacgagatagcccttccctcccatacacatacaagatgtgttcagcccacaaagtcagtgttgagaaaccttgctgtatagaaaccctggccccatccaatcccatataccctgggccttcctgcctccctggcccccgctgtgtagaaaccctggccccatccaatcccgtgtaccctgggccttcctgcctccctgtgtttgcttctgctgtgccctccccaggcatgccctctcctccacactcatcctcatgtgcctactccttggttctgttcttagagaagaatagcatcttcttcaagaacgctccccagcacctccaggcagaagtgacgcctcacttcctgaccatttggcctcccttctcggcctctttgggctagtgggcaacccactagtgtcaacacattgcttagactggacagtggacagaacccaacctgttcatctttgtttcccacgtggggcttagcgcagtgctgaccacattcaactccctcgctcctcacctctggcaagcctcacgaattgatctttctggccaagtcctgacacagcccctgaatctttcttaccatactgccccagatagacatgatgcatggaacaaaactgctactcaaatcaaaacctgacttgcttctctccagcctgacatccccccagctccctcctgttgcccccaccctgccccctagcaggaatgctgcctgagttggccattatccgtggaagctgtaataaaatgggagagcacaggggtcatctggaagtgtgtctggggaaatgtgatggaggctgcctgagacaatttcccacctttctgctgaactcccggttctgcctgagtgtggcacccccaattccatagagttcctctcaagaaacttctccaggctcccctgcttctgcagcccatacccactggcatccctcctatcccatcctgtgtctcctgtccaagtcctgctcctcccccaagcctcagtttacaatgtcacctcctctggctgggtgcatctatattcttctagcactcttcttcattccacctaatatgcatttaatgcccacatccccttgtagaaggtagagagttttttctgttcactggtgtatctctagtgcctaacacaaggtcttggtcattgctgggactcaacagacatttgtttgatgaatgaataactggatgaatgaatgagccatgcagaaaatataccttcctgcctggagccgtctcaggcatccacggagcagagttgggtgtcagacacctggctgtgccatgatggactgtgctttttgactagccacagactttggaatcctacaatttctgagcccacaggacacttggagaggccagctggggaaactgaggcccggagaggcaccttgtccagcatcacataataagaccctctactctaggcatgtgtttctcactctttgattctttctgtcctgctgatggcccagtctggggtgtgggctgcccgggaggtagcgaagttcagcagagattcatggagagctaagcaagcttggtgagtttcatgtcaactacaaggggagctgaggccttgcacaggcggaggtggagcctcggtggacagccgatgtctgagtacatatgggtccctaggacccccaggcaaggacgggacccctcccctccctgcccaaagcccagaaagcagcccagccagacggggagacggtttgtagcaacagtgaggtgatgtctggtttctccttgcgcattgtaagcaatgattcatctggctcccaaaccaaaatatagaccgagttctattataaacacaggttctgtggagacccgcctgctgggcagccagaggccccttgcagacaccacgttccctggagctccccgaaacattccctctcccttagtgccagtcaggcaccgatcgcaaactggaaagtcactgcccacgggcccacttcttgcggtcagcacccgccccataattggcggggcgctgcacaagataatggtttagattcttgcaggtctggggccctgtcatttgaagctatttgctggccccagctggtaaacattgttaagatgcttccagggagcataagcacctcccaccgcctacctcccgccttggctatgctcgctcttctgctcctggccatccaggagaaactggggtgttcacggcaatgttcaaggcccttcagggtcccttgatcaagagatacctagaaattgtatatcccaatgggtctggagtcctagggaaaagtactggcttggccataacttgctaggtaactttggacaagtcccttcccctctctgagcttcagtttctcagtccgtccagtgagaaaggagattgtcaaactaatggtttggggctctttcaactcagttactccagggtttcatgactgacctctgcctgaataatgctgcaatgatgtgaagctttcatcccagggaggcgcatctataaggggatctctccttgagtggctttgtggctcttctaggcaggtcttaggcctcaatgagcatgtttcatcccatgctttttgatggctaaggatgcgggattggagtcacaggccaggcgctgcccctagaaagctgtgtggcctcagcaaagtctctttacccctctgaacatcagtttcctcaactggcaaatgtgtatggtaatttctgcctcctaggagtgatagcaaggagtccatgaactgatatgtgaaggcttcagtgctgagccaggcatagggcctgccactgtgcatgcccgtgatgatcattcacttccatttagctgcatcctgagtaaaagggtttacttgaaatcttctcctgggatttcactggagaaatgcctctgcttcctttgtggggaggtttgggggctgaagaattggttttcagcagagttcttgtggctgcagatgaagccacaggagctggtgatggccaagggccccctggaccccacattatggttctcttggggttcttgccctgttactccattggatctttgcaggcaggtagaatacggcagagtgagcttcagagaggataattactcatacagagtcacataaccaagagtgcaaggctccattcagctcttcactgggaaaaagtttcacttgttcttcctaatctgcaagctccaggtggaaaaatgatgatcacggctgttagttacatcatgtcgcgctacctccctgctcgaagagcttctgtggttttgcatcatatcaccgccagcatgctctgacctcctgcttctccaaccaccgccatccttcaccctctcacccactctattccagtcatacaggccttcctgtgttccctccaagccacttgagggcattcttgcctcagggcctttgcacttgctgttccctctgcctgcactgcctttctccatggagccagccctgtgttcatcccattcatctccttagagcagcctttgcttgatcccaccctctcttcaccatccctccccaatgccgtgttctctgtctgtaactttacttccttttcttcacagcactgatcactactagacattttctctctgtttctgaaaagattttattttaattgtggttaaaaagcatataacataaaattaccatcttaaccaattttaagtgtacagttcgatagcgttaggtacattcacattgttgtgcaatcaatatccagaaatgtttcatcttgcaaaactgaaactgtacccattaagcaactccccattcctctctccttgcagcccagatgttatttttgtttgctttgtttttatacctccttaattagaatgtaaactcctttagggcaaaggatgttgtctgtctcattcttcctgtgcctagaatggtgctggagcatgaaaactcggtaaatgtttatcgaatgaatgaatgaaaaatgaagattatgataacagcagctaaccttttcagcgcccttgaatccaatgccaaatactgcgctttacacactttctatcctgccatccctgctccaactttgtagccccatgttataattgaggaaaatgagattctcagaggtgaagtcattggctttgggtcacccagccagccagttagtacagtagtactggaatccagatgggtctgaaacaagaggttgtatgccccggtttgcccactggggaaaagagtacacgccccagctagaagaatcacacccaaccttgttgcatcaatctccataggcccctgaatctgagatacaatcatgtcactgagggctcttgagacatgaataggtgcagaaagaatgcttgtaaactctccagacctcttagatcaaactgactctgctgtttataataaagagtccccacttcctgggggctgatggggggtgttgagtgtgtatgcctgtgtgtgtctgtgtaagtgcatggagctgtacatgtctggagatgtttgcaagatttccagcgtgttcccagatgtcagaaggatctggtagtgagtgcctgtggcttgttagcaatgggactcagagtaggcgtcttcagttctatgagactcagtgttctctgtaaaatggagatgatagtcgcccccgagcccagctcatctgactgttggaaggagtagatgaagtcatctattatgcacgtagtcctgggtaaacggcagcacatagagagggtctacaggtttgagcgtgcatgtgcgcgtgtgtgtattctggtcttgtgtgtgtattttagactctggaggagtcttcaaattctagggttctaaaacatcatagctgaagaggactcaagagttctaactcccttatctgaagttcagagaagggtaggaacccacccaaagttgcataataagttagggacagcatctaaagcaagcccagagctccctgcgtaagagggtctaacatggatgagtgtggctaccctgtgcacaatggaagccccccatctgatggaagcttgaagtctgaggtttcctttggagaccttactcttatgaaatggctcaggtgattatacctggtgccacctgaaagcacacagtcagcttggttctctcgactcagaggcctggcctggacatgccttttggccatcaggacagagggtcaaggttggtactggggcgttgccagagtccttctcatcagtatctggatggcctatccctccctggaataggagctggggccggtgggagaagggaaacaactatttgggttaataaatgtggtcaaggcgtgtgatgggggctttatgagaaggggcaggtcttgaaaggggagggaatcccagcatcccgtgtgacgtggtggctcagcacagtccagacctcaagtcctactcagtttactcctccattgacaaatcctagccctgagagacggtctcgccttctctcttgattcagaaggaatggttgcgatacaccatctcttggtcacagttgctctgtcccagttcagctcacctactctgccagagcagtgaatgaccctcctgatgtcctctggcctaagaaccactgggagcagagagaaaaccttaggaatatgtgaaccctcacatggtatctgcatccatctggggaacctttactgagtgcacactccatcccggatgcagtacatacggtgctgaacagggcaggccgggaggctgggcccttgcgatctccaggaccagatgtgtcctccctgcctgatgcagcttcttccccctccaacagggacacaagggctatcctggaccggcagggcaccccggagaacaggtgagggcctcagcctcagccctgccctggtcgctctccctcctcccagcccctacctgtctctggccccctccctagatcctgctctgtgagccagccccagagccaggctgttttgcctctcaccctgctggagcccccagcccactccagtccaccccacctctctcgcccagccacatttgcccaaaagagccagagtccatgccagcctgatgttggcatgagccgcacaacgccagttggagccatgaatagctggcctgttccgggcgatgttaggggatattatactcaccgccacggggtttgcaggaattttggccagcctggcccaagtgaaacagcagccctgccagcatgggagaaccagccaggcctcctcagtaatttcttattcctgggctgcaagcagagggggttttgtccctcagagctggtctgaccggtttcacagaggggtgggcttgggggccctccccttcctcctgttccatctcacattcctgcccctctctttattcattgtcagccccagtctcccagggtcccccagacccagagctgggcagggtctttcttttccttatgtttctctctgttcctttgcaggggcagccaggacctgagggcagcccaggggccaaaggttaccctggcaggcaggtgcagtatatggcttctggaagctctgtggccatggtgatgtgaagatggccacaggtgccccgaggcagagggaggtggtgggctgggggccaaggagctgcacctgctgggtggaccctaaggagggggctttccaggggactggaccaaggaagcctgtctttgcaggcacaggataaggctgcatagtaagaggaggtctggttctgcggggctggggctccagaggctcctcctactcagtctccctcctacccaccagccacctccctgggatcctagggctgtgggggtcaggccaaagatcgctgatctaaccccacccccattctacaaagagagcagcagaggccccaaagaggcaggacttgccccaggattggcagcaggtagagcgtctccatatgtccttgcccctctgtgttttgtgtttcaggggttacctggaccggtaggagatcccggccccaaaggcagcagggtaagtggttcctggccagtgccacatgggtggggttctaggtgagcatcacctgtccctccagtgggcttgatgggaggtcagagctataaggagagccaaggccctcccacttgagtgctcccggacaacagaggggcagcaggagggatgggtgatgggagacccttgagccaggtaaactgcttggtccccatggccaagaagtctgggaagtaaagactctgctgggggtttggccacagtccagctgcaaacagctaggcatttgtttgctgtgtctcctggctcatcccaagttacaagggagccagtatgggccacttgaattgcctgtcgtcgaatcttcagaggcctccctcctgctcccaaatgagggctggggggaaccactctttgtggagggcacctggtgtgggaatgctgcccaagcctgcagcctggtggagtttccagatctccccttccttcaaggcccccatggagcagaccccgagtagcgatcagcctcagttgcctacctctacaatggtcatgatgtccatttgtacctctagtctggttatgtcaagctgacttgacagctcaggagggggccaccaggtggggactcccatgtgggttgtgggaagacagagagggttctgggtggaccgaatggggtaaatggagttggaaagatttagagctgatgtggtggaatcgtttcttttacacacaaagaaactgggttcatggcggggcctggatggccccagcttacactgcacgcctaaggcggatctgggatggggacccaagtcttccgaggcctggacttgctgcctctcaaggaatgctcaggaagggggtcacacagtcctcggtcaggacagatcacgtatcctttgctcctgagccaaagctatttatattttggcaggagggagaggacagaacagttgcagtctcagccctaatccctgcagctgactggtggctgttaggagagtgtggggaggcgggagtgggggcggggaggtgcattccccaggaggttactgtgacaggcagggcctaaggaggctcttgtcccagggtgctgtgcctctcttcctttattctgctgctcccatgggccattcccccagagggaccccctaaacccaaggagaaaggtcttctcagtccagccccagtcctgatctcctgacctgccagaaggacaggcatgttaatgacatctggggttgctcgacttgcctgccaggctggtggcatctcaaagtcacatagcaggagaggactggtctggccccagcactcctgtctcttacaggccacacagccctgggtgggaagcctggatgagcagtgagtcactcaagctgcccttccaaccctgccaccaccagcctcatatttctgaagtaggcagagggcaggctttggaatcaggatgacaggctttgagacctgccctgccattagctagctgtgggagcttgggcaagtcactgggcctctctgagccaattattttctcacctgtaaatctgggagataagcactatttggaatggcagtaaatggcactctttcagattatggatattaatcatgctggatgccaacgaggaggctcagtggcttcttggccttccagggaaggagagatggttgtgagcctccattggttgcttgtttgaggagaggcagtatgcagagtggttaggagcccaggcccaggagtcagaagacttgaatttgaataccagttctaccacatttcagctgtttggtcctaggcaagttgcttcacccctctgggcctaaatggtcttacctctacagggggctgagtaataatacttcctcagggctgggcgcggtggctcgtgcctgtaatcccagcattttgggaggccaaggcgggtggatcacctgaggccaggagttcgagaccagcctggtcaacatagcgaaaccccgtctctactaaagtaactacaaaaattagctgggcgtggtggtgcacacctgtgatcacctgtgatcagctattcaggagactgaggcaggagaatcgcttgaacccggtaagcagaggttgcagtaagccacgatcgcaccactgcactccagcctggatgacagagcaagactccgtctcaaaaaatatatataaataaaaaaataataaaatataatacttcctcggggtgtgataaggatggaataaatgctttaatatatgcaaagcactggcagcaggcctggcctatcattcgtgctcaataaacattagcttttgttagagttattattaaatcattccaccaagagtggcacgcagatagtggtagaagccccgggcgaggttactgccctttagaagttcccaggctaatgaggacgtgaagcatgaacacaaataatgaagatacaagggagaaagtggagaaggatgctaccgaggtgcaaaaatggcactggggatgggggggagagattgcttccggcttggggtatcagggatgcttgcccaaggagagcgcttatgagagctgggctttgaaggatttggctcagaagtcatgagggatgggaaggacatgcctggtggaggggacagagtgaggaaaggctgggagggaggaaatgagatgcatcctagggaagagccccagaatggtgacgagccccagctgtggagtcagctggccctgggtgacccttgaactgattaggaattcccgaagagaattcacagctccactactgactagtcgtgttgctttatctacagagcctcagtttctttgtctgtccagtgtgggtggtgacaatctggggggtccttgtgagagtctaatgtggtagcatgcatgtgcctggcacaatgttggcactccgggttcgcagccgctgttagttaatgccagcactcaggcggccagaggtggatgtaagccctacatccaggaccttgaaggcctaggaggagccatggcaggagccacgggcacctaccagcatccctgggggtgggcagggcttggtgccgtgctagcatctaacccagccgcgagcttccttctgcaggtcctggagccctggcgtggggcgggcctcctgccggcgagcgcctgcgcccttccctggcgtgagggtatgtgcctttggactacatcgtggaagccagcaccatgcagtccatgggcatatacacttgcctcaaggcctatgtcatcgaggagccaccggagctgccactgccaccagggaggaagaggaggagccgggatgtgggatggcagtggtgggtgggctgcggcaggttgggccagccacacctcactgcttgaccgctctgaccccctttcttctctttcctagggctacattgggctcccagggctcttcggcctgccagggtctgatggagaacgagtaagtttgcttctttggttattcaccatccacagccacccctgcccaaacagagcagaacctgccaggcaccagcctggggaagtcaaggaattcctcctggaggaggtgcacttgagtcgagtaggagtctgataaggggacaagtcaaggcagatgcattccaggcatagggaacagcatgtgcgaagtcagggatttacggtaacttggcgagtttaacactcaacactgccaaagtgctgcgtgagagggtgagagtggtgggagttgaggctggagaggaccctggggcaatgtcttaggtgcccaggactaaggttagaaaaggaactctgttctgagggtatgcggagcctcttgaggacttgcaaccaatgaacaccgggcccactttataatatagatcaggggtctgcaaacggtggcccatgggccaaatccagccagttgtctgtttttgcaaacagttttattgaactcagccttgctcatttggttacatattgtcaatgccgctttctcactacaatggcagagttgagtaggtgtgacagagaccgtatggcccacagagccaaagatattcactatctgcccctttccagaaaccatctgctgattcctcttttagacagatcagttggtttacttgagtaaaatgtgttggttgggggtggggacagcaagagcaggtggcaggagttccagcagccagggggagcggctgtctggggaaggtggtgggactggtttggtggtgggcagtgggtgctaagatttcctaagacaccctgtccttccagaccaagtatctaagtcagaggagtccaaaagatggtgtgggagcttctcacagacccctggcccagcctggaggtccattagaagcccctggggtggtggcctcgggatcttcctccccgccccctcccaacctgagcccgtatctatgggaactcacttgtaacctccataagctgggtatagagaaccttaggacagctggagcctgagcatttatgaagcacctgctgattacaggaactggcatttctctgtctcttaggtcaccacagaccccgaccctgccatccgtctgatgtgcatgtcactggggccgccacgcaagtggcacacattccaggccctctgtgacttcctgccgtgggtggctctgggctggtttggggcaagcctggctgtccctgctggcatcctgccctgacctctcccctgtctctcccctgcagggcctgcctggcgttcctggcaagaggggcaagatgggtatgccggtaaagattttccgtgtctattacgcagactctagcggggaaccccacctcccacggccacgctgccctggccacctgctgcctggcatcttctgcttctccccctgctttgagtgtgggggccgcatgtggggttgtctggccacaggacctgctgctggcacacggcgtgactggggcctggctggggctggggcttccatgggctctggacccctctggggtagctcctgtctccctgtgggcatcagtggctctccagtgcagttctgtgtctgggggcttctgtctaaggtatttgtgtctgtgggtctgctgtgaccgggggaccttggctagaccaggtgactctgctcccatctcagggaacactcagtctccacatcgtcttggtgtcatccggctctgtccagtttgctcatgcacacgcaaagccagaggacaatggggtttatgggcagtgcccacagcaggcatgaccgaaagaggggctcagcggtgacccccaattcaccagctttctctatggctccccatcatgggaggaaattgtttttccctttgtttggacatgtgcagaacatggagaaagagccaaggcacggagagattaagtcacttgcacgatgagtaaacaatgcagccaggattggaactcagttggtttgttcccggtgtctttgatctcagtggctgcttgaggcagcctctcagggtccctagttggcagtcatattataaaaataggttccctagactcttcgcctggaaggaagatcattcattccaattattgagaagcgggaaactgaggctctgagaggcagaatgagataccagggtccctctgccactgccctgcaggttgactccttgacttggaaccatggtcagaccaagtctgggcctcccatcgctggtggttggtgaggaagggagtatgaagaggaggcctggagcattcgagagtgctcagaggggcctctccgtgcttctgccactgatgggcatgttagctgttggagcgtttaacctgggccctctgggggccaaagaggaaaaacaaagaaaagaaaaaagcctcaaagagctgacagaggaggtccctccacccccaacctagacccctctgtggcccgaacaggcagtcttctctaaggtccaacacctgacacctagacctgggcaaggagcagcacctgatgctcccagcttcagggcaaggacctggagtctgagagggctgggctggcacatggggttgtccctcaagccagcatgacctcaggcaaggagatttgttcatccagtgattatctgttcatcccatgaatatctgttgaatgcctgctatgggccaagcattttgctttgttctggcagagcagtggataagacaaagttcccactctcttggggcagacagacagatacccaatcactgaatggggaaatggaagaatgaacaattaaatgaaggttaggtagtgctgaatctaagagagagtaggatagggagacagggagtacttgagggttgggatcttgaataagttagtccagaaagtctccctcgctttatgaagaatctcaatgaggtaagcgtggaagctgtgtgcctttccaggcaaaggccctggggaaggagcaggcttggttcaaattttctgaaccacagttttctcttccgagaaatggggacaatagtatggctcataagaccattgtgcttgtcacatagtaagtgctcaataaatagagccgcccggaataaggtttcctggatggctgaggggatctctgtattgtgtgacactaagccaatgacttcacctttgctgggtctggtttcccatggtttaagttgcagagtgggaggatttgacttgcttaggcgatctcagctgggccctgccccaacactcaggccagcctccagggccacctttgggggatttgttcagacacatcctgggagccttaccaagggccaggcgttgctcctttacagatgagatcgcttctcggagaggtaaatgattaggtcaaggtcacatggctgctcagtgtcacagttggattagaacacaaccagagctttcaactccagtgccagagtgtagctgtttagagcttggggtacggagtctcctgagcatggaagaggtaagacccatgaaagcctggacatgttatggcctcttctccaaccggacacagcaaggaatgtcagcagggccatgcctcagtttcccccttctactccatcctctgcatcctcctcatctcccctcctggcggccccttcatccaccttctccctgccatgtacctgtgttcttcttggagcacaaagttaccctgttcatggcctggctgagaaggcagtcccaggtttgaggtcccattatcctgcctgtgtgagataaggccactcattcattcctcattcaaccaaagattatttgttgaatatattactctatgccaggcactaaggataacactgtagccaaaacagacaaaaatctctgttgtcatgaagctcaaattttaagggtagagacaatcaataaacacgatgaataaccagaagaaggcatggttgccaccctaagtcccctgcaagtgaaaggaagcaacgagtattgaggccctcggtgtgcatagtatttgaaccacatgcgattctcccagtgaacctttaaggcaagatcgattatccccattttccagatgagaaaactgaggcttagactgtcaaagccatttgtccatagacactctgagccttgccagactgagaacttctgtctgcttccttgcttcttgcctttaactttctaagactaggctctgatcttcatgacaggcgtgttgttccctggcactggggtgtcagatgtgggtggagggaaacatcttttcagccctagacctgtgcaatacccttgagagccatgaaaataccctcaactctgttccagccaccatggccagcaaatcggcgagatctgcatcagatatgatttaatgtgtacgtaatgggacttcacatcggctgagtccctacagcttggtctctgtctccgctgggcctctgagtctgccatgcctctcagcctaaagaccctggacagtctttagggccatccctctgttgctgttgctcccaaccccttgatctgtctggtagggttgggggctcctgtcgtgaatggtttttcctccttatccaagctttaggccagacagtttctaggcacttattaagaaaaggaagtgacaggggaatgagctgaattccttcatgccagattgcagctggcgtcatttctggcagggctggtgatgattttgctgtagtcagtctttccccagcaggcaaaaccttgggcccgtgcatgcggcctcctcagtatccagtttggaagggtgatgtgtcagagtcttttactaacgggagctgaggaagagacagtggaggtcaaagcacatcagagctataggaaccttcgtgatggcctggcccaaactctttttcagacagataagcagacatagcccagggagggcaagacacttgcctaagatctcacagcaagttgttggcaaagtcaagacttgaatccagaacacttgctttccagggcaaggtactctccacatggctccctcttctctctgctcccatcttcaacctccagaggaaagcttggtccacagctctcatccctcctcatacctcctgctaagagaacgtgttgtggttttctggcgaggggtccaggtggaaaatgttaccaacttggctggagctgaatggctttctcctggcctgtcctggcttgttgggcatggctcagtatcactcacagtgagagactgagccatgtttcccagccaagggtctctacgagcaggctaggaagatgctgcagtgagtccttctacctgtcttctccaaatgtactttcaagcctgctgggatggccctgcaaggcaggccaccatgcacagctttactcacagcccctggccaggactgccaaggctggcctcatgcagtgagtccggagggaagaccctaaagcttagagctggaagggcccagccctggcaccgactccctggggtgtggttcagggatgactgggacctgcccaaggccgcgcagtcctctgggaggaggcagggcttctaacacagtgcatttgggcttcaagttcatggctctttccagttctcagattacaggcagcaagcagccaagtaacagagaattcctatttccaagtagggaaattgaggccaaagcagattaaggttctcagctgaggtgatgctgtgagctgggggtgtggtctccagtgacccagatgtgaaccagagctgacccaggctgttggtgcccctggaatcctggagagaactctgccttcctattttctccttgtcccctgaggcgacttttcttgagtagatttcctagtggatttcaggagggcagggtaaaaacatgtttagaccacgagagaaaggggctgggaaagttcaggggtctttccatgtcagcacgcttggagcctgcacacctagaaaagaatatggctgcttcgagtgcagcaggaaggatgcaggttagacttaagcaggaacttccaggccttggagaatgtccacctggtaagaagttctccaagatccttttgcgggcttctcctagaggttattaaatattcccactcttgatataaaccctaactagtgtagtgatggcacattagagttgaccaggggctgcattagaaacatctcaccgtttcttcagcccagccctgccaggtgagtgggacagtgctgactgttttgcaggccagggacctgagccttaggagcatgagggggactttggattctagatgtttcttgcttctctgcccctgtatcctacccgctggagcacacggttggggtggacacttcctggaggcagaagagtggaggagatggccttctgagttctccttggcatcctgctttggatgtggtggcgaggaccgtccctgtcctcagctctattcctctgagttgttgtggccaagagagaatgcagagtctcactccttagccttgttctatctcctcttgggccttgttctgctccaagtatgaagtgttcagttctccagaggggcccgacctgggaaagtagagaaaccacgtggctggggccctggcagggagccaagctcattccttgggcctggggccagcctgctgcagccaggagctcgggcatgtggaggaaggtccctgctgctggccaggctgggcatgcatgccatgtggtcgccttacacatgcaggcatggccagagagagggaagcagatggggttgaagtgggggctatacattccagctcagcagccgccaccctaagacccagggagctctggggtgactgctggaaatggctctgccacttagtagcggagggatgaggcaaggtagtgggtgagggggtcttgggtgtgttctgggctgcagtctccccattggtgtaatgaggtggtgaacatcaagaacgtctcgggtcctttcatccttagaccatctgtgattgttccaatcagagatttgttccagcacctttaaagctcttttttccaaccactgtgctcttaattacaaaccctagattcctagaggtcatctgcttgacccctccattggaagggagattgaagatggagacaggggttgactcccggaggccctcagcgtgtccaagcagaaccagtcctcagcatcaatcatgccattcctttttgcacattagctcagggctctaatgagccctcggagagcctgtaggctggttctagttcatctgttcattcagtgtccagttgtagctaagagaacagcttctggagtcacactgcctaggttcgaatctcatctctgctatgccagggctgtgtgactttggaaacatttcctagcctttcagaatcacagtttcctcatctcaaaaatgcagccaataataggacctgttgggtggtcacgctgttggggtttactgttgctatgattgtttcatcccaccatcatcgccctctggctagactcaggctgcattttgtctgcagaggttactcccctccagaaactgactcaaaattctgatgaccgtctctcccttgcttatacctcagagacattccctcacatggctgaggcctcccatgtggcagtgaggcaccctcactgaggcacccttcatgtggcatctcagctcatcctcacagcactcccttttggatggcaaagagaactgaggccccaagaggcctgtgggtggtgcagtcaggactgtcttggggcaggctggccagcctggaatggcctctgaatgcagacccatgggtctgagacctgcctggcagctgctgtatgtgaatatattgggcatcacagggtcctaaaggatccttagagatcacacacctccaacctgagcaggacagagggtcaagtgtgggggcctgcccaaggtcagacagccagcctagaggagagccagggctcatctgcaggccatctccatatgctggacttggagaacagggcaggactacaagttctgtcccttgtaggccatgtggagtcagccaggtgcccagccagacaacattgcccttgtctcaaggagttgctttcctctcctaccaggtccttctaccccaaagttcagaggccagaggtgggaactcaatgccttcagaaggtgccctggctggacgccatggctcacacctgtaatcccaacactttgggaggccaaggcaggcagatcgcttgagcccaggagttcgagaccagcttgggcaacatggagaaaccccatctttaccaaaaatacaaaaattagccaggtgtagtggtgtgcatctgtaatcccagctacttgggaggctgaggcggcaggatcactaggaggcagaggttgcagtgagcagttatcacaccactgcacttcagcctggatgacagagtgagaccctgtatcatgaaaaaaaaagaaggatcccctggacacagcccacctggctgattcttgtcccaggaggtgagacgatctaccttcagcatgaccaagaagagctggtttaggtgagactggaatttaccaggggagaccctaaagatgtgggggaggaagcttgggtaaggtcagatatgcccccacaaagacatgatctggaaacacacacacaccctcccctgccacactcctctgccaccctctgcaaccagttggacacgcgtttgagcagcttctacataccaggctttgcccgtgcatagctcatatgaacatgccaaactccagaggtggacctgggctctgcttgctttatgaccttggccatgtgatgttgcctaaccgagtctcaattttcccatctgtgaaatgggactgataacttttccctcaaagatagatatcaaatgcaaaatgaagtcttgcatgcaaagtgactaccttggtctgaatttcattatcgtcttctcgtttcctccttttggtgtctgaatgaagccacaccttctatggggtgaatgtcaatccaagaggacttcctggcaggggagagatttaaagggagtagggctgcggggcagggccaggctaaacacctggttacatacacacatttcaaggtgtctttgcctaaccagtagagactttggtttgggttttgtttgtaggtttggtcttttgggtttagtgtactcactggactcctccagtagtattagaaaccgaaaacaggatcatcctccatgaggaatgtttaccatttgaatcatagccccagcattcacttggtcaggaaaacatgtgctttgtttttttttttttttaattacatttccctggaaaaacaatgatttgaattcaaggaggggaggagaacaggtttcccccaactccaagcttgaggactttcttttccttttgaagtaggaatggagttctgtccccggcccccgaaggcgtccttacagctgatatttttccagctgcctatctccccagagcgtggagcggcctccagagtggggtcagggatggggcgagagggccagacctgcctgggccgggcagctcagcatctctctgagctgctgaacacctatggaggctgtgctcatgttcactggtggtgtgactttgtgtgaccttgccacttcactctttcacagcctcgtttcctttatctgtcaaatggggatcatgagttcactgggtggcttttgaagaacgtgccacaatcagagaaggtctgagctgggaaatgcaacagaggccttctcctccttgaccagtggggaaacagaggctcttaaaactggcatagatccagcttcctgcccctagtctctgtctttcccattccatcaggaccagatctcagaataggggattggcattttcatgctggggagctgggtatcattttcttttcagagacttagtagaaaataaaaggatccctgagaaattctttatgttcaggtgcttgtcgatggtaggggtgacctcaggaccgcactgtctgcccatgaccaaggagtgagactgcttggacattgtccttgtgtcccccctgggggtctggatcaaagcccaccctgaaggtgacaacactaacctacagatgtttgttctctctcatgccctccaggggtttcctggagtctttggggaaagaggccctcctggactggatggaaatcctgtgagtatttcaagtctttgggaacaggagcgagattctgagtgaacacacagcagattttaggagcccacgctttagggtcagacagacctgggtcaaatcccagccctgtgaagtaccagctgggcacccttggacaaattacatgacgtctctaaacgctaggctcctgtctactgcggctgcaccgtcgcccccctgtaagagtccccagcccactgagcccctgggtccaaagctccaggctgcaccccatttccaggactttggaaggttcatgggtcactccccactggagaggccccagctgctgccatcttacacagcatcagcaatgtttatgggccggcagaggcatggggaagcaaacggtctgcaggccgtgtttggagaaaaggaagagctgagttccaaaggaatctccaccacaggcatgtttatagagtttgtaaataattagaggcccaggctctgttccccgaggagccaggtcagcctgccctggggagccgagtctgtctttcccttcccagctccaggccctggtgggagaaggtgttcatggttccccatctccccctggggcttcctgcctgagcagctgtgccagctgtgccctctgcagtggtggctgctgcgttcataaccagcacccgattaggcgctaattcagttccacaaatgctccctgagcctgacccagccaggctcccttggggattatagccttgacctcagaaccctgcggacctgggtttgaattttgttgtaccacttgtcaggtgtgtgagcttggaaaaatccattcacctccctgaatctcagtttccttgtctgcaaattggggggatcagaattccagcctgaggccgggcgcagtggctcacgtctgtaatcccagcactttgggaggccgaggcggctagatcacttgaggccaggagttcaagaccaccctggccaacatggcaaaaccccgtctctactaaaaatacaaaaaattagctgggcgtggtggcaggcatctgtaatcccaggtacttgggaggctgatgggggagaattgcttgaacccaggaggtggaggttgcagtgagccaagatcacgccactacactccagcctgggcaagagagtgagactctgtctcaaaaaaaaaaaaaaaaaagaagccgttgtgagaatgacaggagggcagccaaggtgttgcctcatcacacaggttcagtgggtgaggctgtgtaaaatactgggtaatccggggtatagtcctgcctttgaggagttcatgggccattgccctcctctgtcacacaacaggcagtgggatgggtgggatcagagaggtcccaggtgcctctttggagaagggaacagggaagtaacatttgcattgggatgaggagataggtggggagacattgcaggtggaggaaggggcaccagcaaaggcatggggtgaggggaaaccagagcctctccctcaatacagcatttgttagattaactattagcgatatgcagtatcattctgcgagtttccttggcgagcggcagggatgtctttatgctgctggcatagaggaacagaaaagacctgatgtccatttcttcctctcatttgaagtgaaggctgttgcttacttctcattgctaattacaatgtctagagccctggagttttattctcacttttccattttgaacttgactcaaacccttccacctgtcatttctcatgtgggccatggaagatccatgtttaagacgagaaaactgaggtatagggggataaatcacacacacagcctcgtctcctgactcccaggctagaactctttccagtctctgggggcccctggaagaaggaaatgtgagggtgtggggtgctggggaggattctccaagggccacagcacctcccggctgagaaagggaaggaggctggcttagaggctctcagcttggagccctcatggctttgtcatttccttgcacctggccttgggtgaatcacttaacctctggagcttcagttttcctgtctgtaaaatgagcgtgaaatgtcaagcaccatgcacgtctgtatgaccttgatcgcgattccgctccttcctttatgcttccaatgggaagatactggatttggaagtccgacctccccatttgacagatgtggaaagctgatggcagagaggggatggctgtggtccaaactccaggccaggctcaggaaagtcgctggagcctgtggtcaggaataaggagtgttcagctctgaaagaccccaccaggtgcctgtgtggaggatgacatggagggaggggccctggagggagatgggacaagtaaccaccttggtctctctctatctgcagggagaactgggcctgccaggcccccctggagtccccggcctcattgtaagtacattgatgcctggggcagcaggtgggtgttgaggagactcagggtggagccagcgtgtggggagccaggagcaggccctgcaggggaggttgaaaagacccttctctcatcaaacccccagaggggctggggggccaggagagaccaacctgggtgaggaaggtgggtaggggaaggtgggtaggggagggcgggcggctgagggaggagagccctgctgtgtggcctcaggtggatcaccttctctgagcctgtttccttattagttaaatgagatgagcacttggaacacaagattgccaaagccctttcacacctgctgcgtgcatggccgttgctctgcaaggaggtgtgggcaagtggtgatggcatacttatttcacaagcgaggtgttccaggtccagagggagaaggtagctggcagggtggtcttttgcactcttttcctccaagcagactttggagccagaccacctaggttcaagtcacagacccaccacatcctggctgtgtgacctgggccaagccacttaccttctctgggcctagtttcctcatctgtgaaatagaggtgatagcagaatcatcctggagtggccatgaggattaaaggaggcatcatatgtgtagtccttggcacaggatctggcacccagtaagtgctagtggaaaatattgttataataattcttgttattacctcctgaaatgcccaggactgagagaggcctatacacgaggaggtgggaggcgatctgacctgactccatccaggtggtgtaggcctcgaggagtggttctagccaaagccagggcccctgctgcgctttcagtggaatgagtgttaaccttgggcccagccgcaggggccagtgagaggtcagagcctgggaaatgacactccaagtgtccccataatctgatgccccctccgccctgtccattgggtcattcctcatggggtttgagtttgggggcccgtggagggacacaagtaaactatctgctagcttgacaaatgagcttccagctttaccactccagcaactgtactgagaaattctgctcagagggaggctggaggaggtccctgagggaggcagggaaccccatcgctcagggaaggccagtcctgggaagaaggcccagatgtccccgtggccatctgtgcctgctcaggtgagtgggagcagaacctgggtggggtgggcaggaggtgagagctctctgtgtctgaatcctgactttgctacctcctgactgaacttcaccttggcctcacttccctgagcctcagggatcccctctgtgaaatgggatcattgtatccactcttattagaaccacagaaacacacagtccattccagtccagtggctaagagaacagtttctggaaccagaccacctaggttcaaatcctagctctaccactcatgtaatcacaatcctgagcaaaatttttaaccaccctatgcctcggtttcttcatctgtaaaatgggaacaatagtggtacctaacttggaggattgttgtgagtgaggatgtagataaattaatatgtgaagtgcctagtatgtagtaagcactcaagaagtactagttatgataataatagctattgttggtgttattatattacacacacgtgatattttacacctggtagcagctatccgggttactgaattgacaaaaatttcacagtcacattggaacttggtgggagagagtgctgcaattgataagtgatgtctgccttggctggggttgaggaagtgtcaacacatgagtcataaatttgtcatccctgatgtccattcagtaggactttgctgagcaccttctttggcacaaggcattgacctaaatgctttggaaaaagaaatatctgccatgggaattcgagaactctctagaagtcttctaatctgaccctctctaagcccaacaggaatcccttctggagcatcttggtcatatggtgattaaactccaaattgaacacctccagtgcaaaaagtccctccctctgtgggagcctagtccattctacagagctctctttgtttggagttttcctgtggatggagcccgagtcgtcctcactgtccctgagtgaggctgtttgaggtgtaaaatggtctttgtctgtgcttcccagggctccttcttcaggctaaacaattcccatcccaaagcctttctgaagggatgtttacatatcctgtctgtcatccttggcacatgttcctatttgtcatcatcccagcgttcactaggttgggtcctgagaggagcaagaatattgcttagtggaataaacacagattgtggggttttggactatagcatcatagccctcctggttcttttttttttttttttttttttgagacagggtctcactgtgtcttccaggctggagttcagtggtgcagtcttggctcactgcagcctctgcctcttgggctcaagtgatcctcccacctcagcctcccaagtagctgggacaacaggtgtgtaccatgatgcccagctaattttagtattttctttttgtagagacaggatttcgccacattgcccaggctggtctccaactcctgggctcaagcgatctgcccacctcgacctcccaaagtgctggtacctcctggttctttaaaaggtcattcttacctgtgctctccgctgcactccactgttaaggttgccagataaaatatgacacctagttaaatttgaatgtcagatgcaatatttagaacacatttatactaaaatgtcactcattgtttatctgatattcaaatttaactgggcatcctgtctttttaattgtccagtctggcaacgctatttgcagtgtctcttaggagaaaccctttcggcaaatgggaaaactgaggcccttggtcaaggtcacatacctggcaggtgaggatgggggccatgaatctcaagtcctagtccagggcactcctctttttgcttctgagcagcctgcactgggggcagagccctgggactttctgcatttcatggtacccccttttcccagagctgatttgttctgccttgtggttccttcatgctgtgtctttttttggccactttcagcctccttcctcagtttttagattcttttcactgccaagatgaagtgtcctctctcctgtaactgggggatcacagggctgggcctgagcccatcaaatcacctctgctccctgagcaaatgcctccttccaccctggatttttgggaacagcagcttctgtgcctggggaaaaaaactgtctccccaaagagctggaaaggaaaggaattttctaaccagaagttaaagaggaagagggattgtgagtcacctacggttttccagaggatgtgggtttttagctgagcaaatgggaattccatgtattgataatcattttagtggaaattcaaatttattcaatgcctctgtctagtcagttgaagcaatttgcatgcagactgaagccaaaccttccttccgtcccccgggtccctgcagccgggaggaagggcgtgagaggacaaactaacatttattgagcgtctgtctgctatgtgtgcaacacatgcactgggctggggaggccttgcgaagccgaggtcaccagttagagagtggaagtgtcgggcttgtcacctgggtccatatgcctcaattccagtgagccaccggtggctccctgcagcctcagaggtgagagggcctccacacagccctctttgagtaactgaaaccctttggcaggccctcaagaaaactgtgcctgattccagaatctgctcaacaaagacgatttctgtcctttttattcagagtgacacagaggaaattttggctcctccacaatttaatgagacccaaagaacatgtgatctggccacaaacccagcatgtgaggggcaatggatttgtccaccttattctgccactaaatgatcacctgcctttgtttccttgtctgtaaagcaaagttagataccccaccacctggcatgcaccaaaccctcttgtgcccaacgctgtgccaagtttttagttgtcacaacagccctctgagggtaggaagtggggccaccaatttacacttaaggaaactgagcctcagagagggtgaagcacctgcccaaggtcacacagccaatcagctggacctggcctgtcacagctcacactctccactgttgtactatatccccagctcctcaagacttctgtgctgaacagagatagcgtgtatgtgacagcatggactgggcagtgccagggctgttctggtgtgacagatggtgcttagtaagaccacacagcagccagaactgaccacagctccaggtccctgtcccgaacccgcctggcattgttggccttcaaaggcagtcctcagagggattataagtgagcgtgtttagctttctttttcaccatcattaagccacttttaccaagcacctcctcagagctgtgccctgtgctaggcactgggatcacagaggtgaggtcctcagagcaggcacctgcctttggtctgggggcagcacaggtggtggccccataggcacacgcagaaaggatggtcagtgtcagaagggccctgagcgagaggcatggggctctgaggcctgacagcaggggcatgacctggtcttggggtcagggaagtgatgttagtgctggaggccgaaggacaaatgggcattaacaatgccagtggcgggcatggcactccgggtataggaaacagcttgagccagggtcggggagatatgtcagtggctaagtatgtcacagctaaggaggaagagcagggcaggaaggtgagatgtgtgagcaaccatcatgaaggatgggcaccagccgttccccacattagcctccggaggtccactggctggcagtcaggggagcacaactcaatttttctgagtctccaacctgacctgatgccctgtctcatgtgagacatagcaataggaaaggcaaccttgagtgtttttttttttttttttggtcaacagccaactcaggccttgtgagcatggactgtggggtcagacagacagacagatggatggacagacctgggttctggtcctgcctctgccccctgtttattgctcgatctcaggcaggttacatcacctgtccctaagcctcagttttcccatctgtaaaagggagtgggactgacaatggtgcttacctcctggggttactgtgagcagctggtgagggtccaagccaccagcatcgtccctggcatggcaaaggtgcccagagtgacatttagctattgctaaggagggttcaaagtggatagcgtgcatctggcacacagtgggcgttctttaaatggtgacagacaggaccgattgtgttcttggtgggagtcagtgagacgaagggcacagcgtgtggtgcggtgtctgggagcttagagaaaagtggaaacaggttccaaattaagggacttactcattattctttttcatggggacatgacattctgagtggctccggccaagctggcctcgagggcgtctggtacacagtagacggctgctctgcaagctgccctcgggggatgctggcctggagttttctttgttcctcccggaaatgcttttgtagcccaatgtgggggtcccaccaacacagggggacctgtcctatgcgagctggcaccttctccgggtgtggcctgcaggcaggggtctctcttccagattccttctcccctggggttgcccatgcccatgggatgcccatggcaggtccctgcccccaccacacacagacccctttggagagccctgctgaggcagcgagtgggacctggggagtggggtgctgcgccgtgactccccgaggccccacaaaggtgaccatcctgcctgcactgaattcagtcccacacaacaagccacttcaggcctggagggaggaagaaagagcctgtgtttctgagctgctggcggcccctctgcctgccgccctgcctggcccccggcagagaaagactcctccagcagagcccgcctctgtttatttgtgcatcagggggaactctgggcgggccaccctggctgccttcgtccaggaaaggagagaagcagcagccagaggggcctgtggacatgcagctctctgcagagagctggcctcccttccaatccggcttctctccctcctctccagagaccacctcagaatggcctagaagctctggagacaggctgcctagtgtgaatcccagcggtgccccgactccgtgatatcgctggagccctaacctctcagagcctcagtttcctcatctatgaaatggggacagtagtagactgatcttcatgggctgtggtgaggaattactgggttaaagcacgtcaagtgcttagcacagtgctggcaactggcatttgcttattattatcacccgttaaactgagccctcactttctcagtgagactgtttgatgggacctgaaagcagaatttctttctctctctttttttttcaaagatagggtctctttctgtcgcccaggctggagttcaatgacgctatcacagctcactgtaaccttgaactcctgggctcaagggatccacctgcttcagcctcccgagtagctggtaccacaggcatgcatcaccatgtccagctaatttttaaatattttctgtagagattgagtctccctatgttgcccaggctggtcttgaactcctggcctcaagcaatcctcctacttaggcttcccaaagtgctgggattataggcatgagccatggcgccacgctgggcctgaaagcagaatttcttagcaaaggctcagctgggaggttttgtttaatccaatcagatgggaatcctaaagtccagaaaggggaagcatttgcccaagatcacacaggtcaggatgggccaaggccagactccagttgttctggggttgggagagtgagaatcggcatcatctcaggcaggctgagctgccatctgcaaactccatgccgtctgtctgtctgtctctctctctcctcgggggcattccatcacatagtccccttggcccttcctccaggagccagggaggaatgtgatttttcattctctgcctggcctccctccgagacgtctccaggcagctccgacaagaactccagttcccattcttgagcctggctactggggcagcctttgttcctccaatgcttcagagctgtgcccccacctcagagcacttgccaggggcctctgtagagcctgatcgggtagcaggaaacagaggcccagagaggttgggcacattgaaaccacacagcagccagacactcagatcagtcatggaggatggacaagggagagaggagggtattttcagggtctccctttctctgagtgcagacttaatgttatggttgtggctgagggagtgatggagtgggcagaagtgagatttgagggagaaagcgtaggctggttaagagaaaagtcagccgcttcttcactctgtaccagggttcctggaccttggcactactgacatttgggctggatggttattcgtggcgggggctgttctgtgcactgcagcatgctcagccacatccctggcctctgcctaccagacgccaatagcacctcttaagttgtgacaactaaaaatgcctccagacattgctaagtatttacatgtgaaatcagtttctcctggaaacaaggctggcaggtacacagtattgtacgtcctcacttgtcacatgaagaaaccgaggcatggagacatcaagttcctccagttcacacaatgagtgagtcccagaggagagtgggatccagtggtctgctgtccactgggtggacagggaatgaaaaatcacattcctgcctggctcctgctggaagggccacggggcctgtgcagtggaatgcccctggggagagagacagagggacggtgtggagtttgcagacggcagctcagcctggctgagtgcttcccagagccttccttgcagaggaaggaaggctttggaaaggacaggaggggcgtcatggggacagcactcagccaggctgagctgtcatctgcaaactgcacacccgcaaagagaacttggctttctaggtcgggaactccatttttctcaccttggaccggctgatctgatctgaagctgggtctccaacctgtggtccaggatctgccagctgattatagtgtcccacagggtccaccatcaaccctgggatttctgggatcaacagcctcactccttacttgctgccctcctcagagagagccaagcctctgggaagcaggaggtgcctcccctcatgtagccagaggagtcagaacttccatttatgctgaatttaactcttacagcagctccggggggacagatagagagaaagcatgagggtccaaaatagtcaaatgaaaagccctttatccctgatacggggtaaagaatcagatataggagagaaatattgaatatggaaaggaatggggatagggaaggggcagcagtctagaaatgagcttgggcagggatctttatgaagtttattccagcactttagtgaaggtctctggatgaagaacattccagattccaagatcaatcctacagagttgcgtctttggaagcccaggcccagggaccttggggattgtccccaccacccaggccagcctcctgtgggccactgctcacagcaccctcttctctttctctccccacagggtgacttaggagtgttgggtccgattggctacccgggacccaagggcatgaaggtaagcaagggatgttcccccgattcaggccttgtccaagctgggcacccccgacccatttcagcccagaaggaagggtgaccttagatgatgctgggggaagggaggatggcaggatgctcagaggggtgctaggaggaagctgggcaggtcaggagctgtcagctctggcctcagagccaggcatcatctgtatgtcatttaggccagacatcctcctctagctgagcatgagtctgacagggttccaggcctcagggcaccggaagtccagtgggggacatcaccagggccatagaaactaccatggcaaaccagtgaactcagcccatccctgagtgggaagggcgtgcagcaggaaggcaggccaagactgctagagcacatcccaggggcgaccaaatttaaccaacgtgcgtgtgacacggctcattaagcccttccctccccaccagttccttcttcctctggatttgcctgcagtgctgtggtgcactgcctctctcacagctccttcagtccacacccttgccctgtgagattggagtcatttgcccccttttacagatgtgaacactgaggttgggggatctagcacggggtcttgcagcaagtcgtgtttaagccagggctcctgacttctgtggcctagagtcccatcacagctggccttgggctttgtcttgcagggactgatgggcagcgtgggggagcccggactgaaaggtgataaggtgatctgaatactcccttattgcactgtggtttctctgcatgccacccccctctccgcccggaggctgctgctgatttctcgccaggtccactcccctgcactcttcctgcctctcctctggcctcccctaaatctgtgctccctagcttcttcctggtcactctgggtggggctcaggcagatggttctgggagcccgaaaacctcagcagatagtgcaggagcagctgttgcagcaaggagggcaggtatgtcaagacagggctctgaatccagagagcagagctgaggccagcatctgggatttgaaggcaaagccacagagcaaggagggtggcagtgagggcacaggaggaaacaaatctacatagatcaccctggcatgaaattggaaaccccagagagcgtgccgactggaaatgcgactctgagcccctgacccgcttctcctcctgctgccatgggggtggctgcccttgccatgtatcctctgtacagccctgctgctgagctctccctatctcaccctgtgccaaaccagagttggaagtgggaagacaggccctgggggcccagagcaaagcagcatctgaatacgagagacacagggcccagcacttgtgccctgctctgtggccatcttcctgcctagcctcttcagaccttggcaaaccaggacccccgaagggggtgcaggaggggttcagagcaacattccaagtatccatgagacatccgaaggactgactgctgctcagccagcccctcatgtggtcaggtgacaccgcacctgtctctaggtgcctctgcttcctcctacacctgagtcataaggtcaggtgccatgctgggcgccatctgagtgtaccacatggatccacccattaatcctcctacccactatgaaataagaagcttgcttgggccgggcacagtggctcatgcctataatcccagcactttgggaggccaaggcgggcggatcataaggtcaggagttcgagaccagtctggccaatatggtgaaaccccgtctctactaaaaatacaaaaattagctgggcgtggtcgtgggtgcctgtaatcccagctacttgggaggctgaggcaggagaatcgcttgaacctgggaggcagaagttgcagtgagccaagatcgtgccactgcactccagcctgggcaacagagcaagactccctctcaaaaaagaagcttgcctgaggccacgcagctggtaagtagaaagttacctggctccagagacctcaactgtgaagcagaactaagtcagaaggtcagagctggtgagactctgggaggtcacatttcacagttcctacgtctcacagatggagaaaccaagacccagggagagaaagagatttgcaggcccctggactcttagaacattagaattgctgggtgaaaatggacatctccagattgttttactcaagcctatccctgggtagccagctgggtgccatgccaaccccagtcctttctctacctgtttctacctcttccatctcctcctgtcatgcccaagcctccagccacaacccacctctgccccccttgccctgctgtctgctacacctttctgccagagccctccctctttgaaggggctttctgatggaggcagggggttccccacacctacctgtttatcccaaggtttgagacatcagcgctctggaaatgttgaagtcatggacgagagagaaaggaagctggggaaaatgagagtgtaggcagtgagctctttataggcccctttgcagagctggtctcagctcagcgttgcttcaggaacatggaaataaatgtgttacatggaactcggctggcttgctgatgggagttgcctgggacatttagagatgtgaaaactctggaaaaagaaaaaggaggaggaaattattttcatgcccatagtttttaggaaaatcaaatgtctttaggggaaaaaagagagagagggggagaaagaaaccccttttcctttggtggggaggagccttaaggctgtgttccgatcagccacgcacacatccgtgtcccctggccctaccctgggatgacagagccatcccttcacgttccaaggttgctcctgcctcaaatcccagattttccatgacccagcctggactcagtcccacttacaaccgcttggctccctctctcagcctggagaagcattctggaagcaaagctcctgctccgagcccagctcccttcaaattcattgtcctgatttcctaggtgccttttaaactttccttgtttttctattttcactcctttttttcaccccttcactcctctcttggacattaaaaaaaaaaaaaaaaaaaaaagtcctgtggttccccaaataccaggatgttgtacaggattttccaaattggaaaaaccaaagtaagttgaaaaaaaattttttttttaattctgacttttgttctactaaggaagttcttttgttaggtcatggccttagccatgtgtgggttttctaaggttttccatttttcctgggtttttctccccattcttcctcctgctcccagggatgtaaatgttttcggaatcctggggctgacagagtgtcagtaatgtccaacgtggagggctggatagagtgaggccagggctgtgtgaggtggtttcggccctaaggggaagcagctcccaatctggactgcctgttcagaatatggctaaaaacagggagggagcagaagaggcctccagcagccagaatcagtgtcacgaagcctgtgcagtacatcgtgttagaagacaaacacccagacttaagtcaagaccaatttacttgctgtttacacatagtctcaacaagccaggaaatctgatttcccatgctatagctgattaaaatagttaattagaagtagaccggccaggcacagtggctcacgcctgtaatcccagcacgaggcgggcagatcatctgagttcaggagttcaagaccagcttgggcaacatggcgaaaccccatctttactaaaaatacaaaaaaaaaaaaaaaaattagctgggcgtggtggcacgcgcctgtagtcccagctactggggaggctgaggtgagagaatcacctgagtccgggaggtcaaagctgcacagagccaagattgcaccactgctctccaacctgagcaactagagtgagactccatctcaaaaaaaaaaaaaaaaaaaatagaccaaagctgcttgctggcacagaaactcccacatgaggaggaagtgacagctcagtctgatggtgaaaaattgagcagacacaaacgctccgaaaccacgttggtgtgggggcccttgcacacgctgccttcacccctgtgtgacaacacccgttaatgatgaagaggttgaaggatcaaacacttgatttgctctgcatcagttctccaggcaaggccagttgacactgggcagtgggcagcttagcttctgttagtggcattttcagccatccgagcagccccaggcaagtctgcacattggccagctcaccccccgccaccgcctgctttcctcgccaggggcccgtcctttcctctcacaaggctgctgctggccggatccgacttgggaaacagcctcggcacagctgtacctcgccagggggtctgtgggggaggcttccagaacccacgtggcctccattgtaaccttctttgctggtgtgtacttagggtgaacaaggggttccaggtgtgtcaggagatcccggattccaaggagacaaggtaattgcatgagattttcccctccccctgcccctgcccctgccctgctgttcccctggtcttggcttccttcctagggtccatcatgagcaaggacccacctgtaagacggctgccctcgaaataatccagtcttctccatccttgatcctcttgtcatctcttccttggactttacagtgtgaccttttaacttatttctgggccccagcctcttgctttctctctttcttctttactgctacccagttgttcttctgagggcaaagctctgctctccgctcacacaccgtccatggctccctattgctctcagaatgacaccctggctccctaaccagacatcaggaccccagtgagtgcatctctctgatattctcctgctccccgccttacagctctgcactccagccccactgaaccgcctgccgtgggcctctgtacacacacacacacacagactgctacccgcccgggaccccctccacccagcctctccacaccaccctgctcagagccctttttccccacctgctcagaaagtggccatttccctctctagatgctctgagaggcatgtcctcccctcactggtggtgccacctttctcctctgattttgggggacttgtactgtgtcccctgccagacagtgagttccctaagaacaaggctccagactgccctgatggagctcggctcagggtcctgtccttgatcatgaatatttaggataaggttgagggagtaactggccttacaaaatgacatattgactatgggatcaaactgaggtggccttgacttccagagcccagctgtgggcctgctgagactggctcccctttgcctgtgtccggcatcatgtggccacatctggaactctcccggccagtcaacgaggcccagatgttggccagctctccctcttcctcttccctccctcctcgctggcctgtcctgacccagccttggtatctccgggttgtgaaccacagcaggcctggctcttccctactggaccctgtctccagagttccccaggagtcagaggcaccacagagcctgcgtgcagccccagggtccctgattcttcctggtgaggacaggggctgctgtttcatgttagcatttcctggggcccagcctataggggtgtcaggcaggtgtgatccaagccagagcccacagcagggaaaggaaggaaggagctcatcttcctccaaggcgggcgttctctgggcctgggaccagcaggaggactgggcggctgttcacctggccatttctcttcctcactaaccccagcctgctctggatctcttccaggggagccaggggttgccagggttccccggtgcacgggggaagccagggcctctggtaagtacctgctcctccagcacccccaaacctcacactctccaactgatcgtgtaatgtggctggggacaccttcacctccaagacttcatttcctcctgcagcagagctcctgggggcaagcagggcagggcaggaatgggatgtgctcatttcacagatgaggatactgtgagaggctcagtaactcagccagcttcagaggcaggcctcatttgccgacaaagctctgatgaggatctggggttcctgatgccttgtaaacaatagtgatgttatcagtaacagcagtggctgtcatttattgagtgtcactgtgcatccgaccctttctgaactgtttctttgaaggctgccaactaccccaggagtgagggaattaatattgctcccattttacagatgggcaaactaagattccgaaagttgaagtgacttgcccagggtcccatggttagcaagtgcaggaggcagagtttgaatggtagctccttctagttgtccaggcagattttatgcacatgcttctgaactttccaaccatccacaaccagcgggggaacgcagggggttcatggaaggtggggtcctcacccctgcctccctgcaacctcttctcttccacagggcaaagtcggagacaaaggatccattgggtttcccgggccccctggacccgaggtatgtgatgccccatttctccgtgtctggctgctgctgggactcggtcttgtccttgggaaactgaggcccagggatggggaaagacttgctttaggtcacacaggatatgagagatgaggctgagaggagaaactcctagatcagcaatcatttattttccccttctgctcttctgctcttactcaggggctctcaaaagtcaacagggccaaaaggtggcctcagagtcctctgccaactttgtggccaccgcagctttgtgattcatgaaagccctctgtgcgccactgtctggtccctcacaggagcttcccacattctccactcagagttccctctccaagccctggaactttcctagccacccacagccactctggaacggttcagggctcagagcttccgggtatggggagcaagaggtaaatgcaaaattcgggcttttgaatgaagaatgagaaataaggatagatttagcaattaatataataactctagttgagtcaggagagagcctcagggtttctgatgtgtgtgatcattggcataggtaggctacacctgaatgatcaactcggaattcacatgtaatgttgcgaagcaagctggctgggttctttttgacgcccccgtctttaacaggggtctcgtgtctagagagctgggctgagcaggagccagggctgccgtccctctcaggatcattggcacccaggccaacctcagttggagccccccacccacaactccctagcctccaggtcttgctcacccatgaggtctctgcatccaagacaaaagtgtggctctgtggataggccggaccctgccaaagatcacttctgctatcactcggatggatgaggaaatgtttcctaaaagctacaagttctgactttccactctgttgactttggccatgacacagtcctatctttagacaaatggacttggcctctcctccatggccccaattccctcctctggtcgctggaaaaaggcttttctgagagtccagctttcccagcattctggcccgtgagggtggaaggcatgctccctcacatttattaggcacctcctggtgccaggaggctgtgcagtgtcctcgagatgagaacttgctgaatcgccacgacagccgcatgagggggatattaccaccaccagtttacagttgaagaaactgagtcacagagcaggaaagtggcttcctcagggttgctctgctatgtaggaacaaataaggtctgctttggccctttcctgggtccctggacaatttagccatcagcctctcccgtctttgtgctctgttttgattggctgactctgtagccgagagatagctctgctcagctgaagggggaagctgataagcgcggaagctgataagcgcgtcagcaccctgcctgcttctttccctgagaccatgggagggagctccagctctccagcacccgggtgaattatctctcactcatcagtgggttatatgcaagtgagcatcaggatttgctcagcatcccgactgctaagttctcacttagagatgggcccaccccaggcagacttcttttcccagagtacaggacccaaaatcattttggatgcagatttttactgagcacttgcaactttgctggttccatttaaacttaagactagccctgtaagggaggtgttacgagcaccattttacagatgaggaagctgaggcccagagaggctaaggaacttgcccagggtcacacaggaggagggcagggctctgggaactgcgtaacaggtctccaaattgtgcaaagaccactgtggggagagggagtccctgtgctctgtggggccctaaggaggagcacgaggatattgcagggaagggaggtgattccgctccatgtgggaagaaccttctattgtacagtcatcccaggggaatggccctcactgggaagcagggagcccccatgggtggagtggggcagagtccaacacatgtggccaagatgtaggaaggacttaagcttacgatgactggagctgaggttaattaaatcagtgcttttcaatgctttcaaagtcacagcaaacccagaaaatcatcctctttgcaggattactgcagtcaaaagacaagacttctcagggcaaggcgtggctggctctggggagcaatgtccccagacacccataattctgacccagtagcagcaccggatttgagaaataacgaccttgagtgtgaccttccatgttacaaccttaatgctttcctgcaccgtccggtgtattgtctcagcaactctctgaggtgtcagggctggaaccatgcaccctgttttagaactgaggactgtgggatcaaggtggttaactgacctgcctggggtcccatcccagcaggatgagatggaaacccggtcagtctccctgcaagacgcatccccgtagcactcccttcacagcccccgtgggtgaccctgctctctgcttcccctcagggattcccaggagacatcggcccccctggcgacaatggcccagaaggcatgaaggtgagtacctgcccagggcagctccagttggaggagcagacagctctgcagaaaccacaggggctggctgcctggcttggaagcaggggttgccttgccagcctgcgatggagatggaggtaccgcctctgagactccctttttgttcccttctccccagggtaagcctggagcccgaggcctgccgggaccccgtgggcagctggggcccgaggtgagactgtctggccccctccactgcccatcctggcctgattgcagcccccagcctgccctgtcctgggtactgaaggccttagcttgggctggagccccctcagccaggacaccacccagggcttccccagacttacccaccagctcatcctatacagccctgccccgtgccccttccagggaccttctctgccctgctgtcacctggcagggtggcttccccgcaccctccctcctctgcaccctcgtcaccctggggttttctttcccagagctactgacaatgccgtgctcgtggtagcagtttatcagggcattaatgagggagtaggaagtgtcagccccattttacagatgaggccactgaggcccagagaggaaaagagactcagtcaggtcttatggttagtagcaggcagggctgcaatgggaacccaggtctgcttgagcccaaagcccatgacatacgtcctatgctgtcaactctgtgcttcctgggagtggccttgctgtcaactctgtgcttcctgggagtggcctaggggcacctccagaatattacaatgacttgcacaattagttagtggcagagcatcgatttgcttatttatgtgcgctggatgaagtgggttgggaggggtctctatggggctgttggagcaccaggtgggcacttaatgggtgggcccctgattttgccctgtgcacgaggccattcttagccttcccatgccccacctaccttagctcaggcgccaggcccccgtgacacacagccctgggctgagggtgcgggaagcccagattcaccgcgaccgcaggcgggcatccagctgacatggatcccttctcgggctggctctgggtctggcggggtcccagcactggctctgggagccaccacgtggagctgctttcctggaagctggggaaaaggagctggggggtgtctctggagggagccccttggtcaggcctggcatgccagaaggagccaattaggaggctgcctgagcctgtgggggtggggagcacctggagagtctcatgggccggaagcgggaaggaaggggagaggagggaacggcaccagccacatgcttctgtctacactcacattaccactcaagaaagccctatgtatgcctgccacttgttcacatcttcattcattcattcattcactcaccaaacaccccttagacacggcaccatcccgagtgatgtttgggggtggctgcaagaaagaataaggcatcactgctgacctccaggaactcagctgaagccacttattatatttgaggatgatcttctccaatctgggaaactgagacacagtgaggctgaggtctgccagtgagcaaatggcagaactcagagcctacatctttgagctgcagtttgaggctctgttcctcacagcacacaacggggtttaactctcatgcccagggcttccatgaagcctggagtctccattcactggaagtcactgtgtagcctggcctctaggccatggccagtggagcctctgccctgggtggggccaggcaggtgggccaggcgtgctgtttccctttgtccaggagggctctcctctgtccatccctttccctccatacaggacaagatctctgcaagtccaactggattaactttctccttttttcctctctcgtgtctcccaattctagggagatgagggacccatggggccgccaggggcccctggcttggaggtgagtgtcactggcctggggtaggtggcattcatgggagctgagccagctgtgcacaggcagggcaacatctggccagtgctccagagggaagtcatcagtgagggccttggaccagccagagagagaactaggacagaccccaaaggagagagacaagagccaagaaactgactgtcactgcccacctcctatgttccaggtgcttcatgtcagtatttattctccttgattctcccatgacacatgattgctttccttggtttcattagagaagaggcaaacgagagtgaaggctttagctcgacatctcacagccaggcagtggggacgccctgcctgggccctcagcccgagccctctgcactcttccaagctgccttcccaaagtcacttgtcctacaccccttcttggtcccagccattgcataaaccagcagctcatgaaatttctggtatccagagctttttacactcttgaaaatgatggaggacccaaaggcttttgtttgagtgggttacacctactgagattagtaattaaaaccaagagactttaaatgtatttattcattcattgaagattaatcataaactcatttcctgttgataaaaattatatttttaggagaattcacgctattttccatagcaaaataattgagtggaaagagtggcattgtgttaccatttttgcagatctctctttaatgtctggcttaatagaagtcagctggcttctcaactccgcttctgcattcaatccactgacaatattgcgcgccatgcagcctcgggaagatgccacttaacattcaccagagtgagagtgacaaaggcgaatgacatcttagtgttatcatgaaaatcattttgacctcctgaaccttctgaaagggcctccgggacccctgtagtcctcaggccacactttgaggaccacttgcataaactgttccttccctgcaccccccgatcatctgccaagttccttcctttccctcactccctgaaggcaggtgtcatcttcctcatttacaacaagaagaccaacccagggatgggggaggcttccctgagttcacgcagctggaaaccctgcctgtattccaggacagctggccacctggtggactcagggttatatgcccctgtccaccagggtatgtggctctctacagctgtggataccctgtgccaggcccttggagcccctggaccccagccatgttgcccctgtccagcttctcccacttacctgtctctctgttgcagggtcagcctggcaggaaggggtttcctgggaggcccggcctggatggcgtgaaggtgaggggacctggagatccctggggacaagaggaaagaggggatcctacatatctgggccccaagtcaagccccaaatcccatggccagttgtgaaaagggagaaaaaaattggttcctgtttagaacaaagtattggtaagggagaaaaaaatggacacaacctaagtgtccaactgtgggggattgttcaagtagtgggatatagtccagccaccctagatggtgtttcgggctattttacaagatgggaagatgcctgaatgtggggtgggggtggtggaggaaacaggttataaaagggaatgctcaagtgtgagcctgtggcaggggctgggttgcaccgtttctgtttttttctttcatttttttttttttttttttgagatggagtctccctctgttgccaggctggagtgcagtggtgcaatctcagctcactgcaacctctgcctcccaggttcaactggtcctcctgcctcagcctcccgagtagctgggactacaggtgtgcagcaccacgcccagctaatttttttgtatttttagtagagatggagtttcaccatgttgactgggtgcagtggctcacacctgtaatcgcagcactttgggaagctaaggcaggcggatcaagaagtcaagagatcgaaactatcctggccaacatggcaccctgtttctttacgcacagagcagaggctagaaagtggacagggattatctctgggtggtgggacaataggagattttcattttcttctgtgggcctctatattttccctattctgcataataaatagatagtacatatattaacagggtttttaaaaaatgttatcaaaaaagacctggcccaagataggagagtaatggtcctcagcccatgggcagcctcacttaatagtttcccaaggactcccttaagttggagttttcccagccattctgggcaaaagattgtcgggtcaagtttacagatgggcaaacccacaggaggttaggacagagccagggggagcgcaggtcatccatatctccctcccttctggggaaatggcccacttatctgtcctggcccctctagttttcatgaggtccagggaggagccgaagggggaggaggctccacccaggcttgcagtaagccacatccatgtatgcgccaaactactggctagcccgagcccatgtcctgccgtctgaggtttcggcctctctccctcagataccagttgggtttctgtggtgggagtggtgacatcgtctgtgtggatttgtcccacagatctgctgtgggcctgaggagcaggagccatctcagcatgggacaaaacagacagacaaggccgagataggccacccaatgtgaaagtgggacagagccttgaagacaaatgagtctgatttcccttttttatagctggggaggctgagcccagagcagagatgggactcaccccagccacccgtgagctggtggcagagctctagtgtgttgaggtctaggaccctggtgccctgacgtcccatttccctgctcttcctgagatagggcagcctgatgcagtgggaatgtgcattcttgttttttttttttttttttttttttttttgacagtctcgctcttgtcacccagactggagtacagtggtgcaatctcggctcactgcaacctccacctcctgggttcaagcaattctcttgcctcagcctccccagtagctgggattacaggcatgcagcaccacacccagctaattttttgtatttttagtagagatggggtttctccatgttggccaggctggtctcgaactcctgacctcaggtgattcgcctgcctcgggttcccaaagtgctgggattacaggcgtgagccaccgcacctggcccagaatgtgcatttcaaccgggcagaccaaggtttcggttctagccctacctctggctcactgtgtgacctcaggcaggtcacttcacctctctgggcctcattttccacctccacaaaatgcaatgggcttctgaaggacctagatgagacatacacatccaggtgctgagtaagccaaggccccctcagagggaatgggtgactagagtcatgtctgcctgaggttctgtccaagtacccctttgactctgcccatttgttgggggtctccaaggccacacactggagataagatccctggttcatccccactaatggcagctaaggccagcaggcctgggacttccccaggaggtctagactttcatctcccatcccaatccatcctcctctttgtctctttgcagggggaaccaggggatcctggtcggccggggcctgtgggagagcaggttagttagcaacggtctctgaatgagtggctccatttattgggcccttactctgtgccaagccctttgcccagcaccctccatgcaccacctcgtgtaattctcagaacaactccagaggtaggttcagtcctctacccctttcacgaatgtggacggtgaccctcagaacggggaagtctgtaaatgagaaagctgtggatcatagtcacgacagcttttccccacagcctgactctacacacaggtttttggtgcatttgcccaaagaggttatgtgactgctcccccaggacattaaaactggaggagcccttggcagtcgttgctcgtgttcccatcagcttatagatcaggaagccaaaggccagagaagtgttaccacttgccaaggtcccttggtctaggcatccctaaattatatagaagatgaaatccaaaccagtggctctggctggttgagaagctgggtcaaggtctgaagaagagaagaggttgcaactagtcattaaaatgaaggtttgaggatcacgaccttcaattaaagtccagagaaacagctctgagggatgggcagagggacagcttcaatccttcctgcccagccctggggcctcctgaaagcttaacctcttggctccaaggtggagaggtgttcatctcctccactcctttaaatatggagctcattcctggaaggggcttcctcaatccggaaggactgatgctggggatggccatagaggaatttggccgcaccacgaaaccccgtcagtggcgtgagagtcacacacgatgggcttcctcaccaggcctgcaacatctgttgggggaagaaaggaattaaaacagggggaggcctggatttttgaaatctttccagtgtcattcgagcgcattctgtgggaagcccgggagtttggagaggctgccgcggcctggatatatttcctgattggaaaaaaaaaaaaaaggcaatttgatcagcaaattcagtttcatagttatgctaatggtagggccctcgggaaatagatatgcagggtcttggaagtcagagcacaaagatccttggaaatcactgtatctaagagccctaaccatattttgtgccttggatttctttgccaggctggaaaggcccagggatccccttctcagaatagagtttataaatgcataaaattaaaaacaaaggaaactgattatatagaaatgcaattatgaaaatatgttaaaatataatatattcatatatatgcttctttggcaatgcattaaataatgagttctagtagcaggtgtaacagcggcctcaattttgaagtaatgccaagccttagtgatgtattttgagatctctgcagcaatgattgtaatgtgccatgtcactttctgggacagtcccaggtcctggtagtactactgtggtttgttgcctacactcatattcgaggcaaatgctaaatttcaattagaggttcatgaaaatgaaagagttttaatttttttccattcaagttgatataccctctgagttccattcatagagactgacagagaccccgggtttagaaccctcagattctagtccatgttggcaatctgggatttatggaggagaagcacgtttgaccaagatcaccaagtgggatagtggtagaactaggcccaggaggggtgggaaccttgcctggagcagcccagtctcatttggtcagcagaacacccggcttgctgcccaggcagcttggacagtagcgggaaggaggcagagctggaaccctgtggctgctataaggcacatggaggtaccatgccagccgttcccttggcccccaccccatgtggtcacagtgaaaggggaggcattttctgttcactgcaggatcagaggatccctgggaaagttctgaagctcacaccacaggacctccttgtaatcatagtactgggtcggtgcaaaagtaatcacagtttttagcattataatggcaaaaactgcgattacttttgcaacaacccaataacagtgacatttattagtcacctgttaggttccagactctgtgccaaatgctatctacacaatcgtctatggcagtaggtattactgtcctcattttgcaaatgaggaaactgaggctctgggaagttaagtaacttgtccgagatctcacaggcagtaacatcactgtcagaggcaagattgaccctgaggtctgctgggttcccaatgcctgcctcgagggctgaaaactctccgacctcctgagccctggcctgtctctaacagagcacagactggctgccaggccctggccgaggtgctgggaacagggcatgggtcttgccttcaagacaccccgtccaggggcagccacgcatataaacacgtcacactgagctgtctagtccagctcagggtccatagccctctcattctcagttgcatccccagtgcctagcatatgagaggaggaagaaaacttccggtagcagacaatggccctttatctgtaggcaatgtgaggaccaggctagcctcctccccaaaactgggaactcggatcctgcctgtgcggtgcccgctgtgggtaacaatgctgcctcctcccatgcccgccttgccagccctagaggagccagccatgcccgcagctttccaagctgcttctccgttgacctgcctggacttctgggcctggcctctctggaccagcctcaagaacaggcctgccaggatgttctgggacagtaccccgggggggtcccaggggtgcgggtcgggggatggggcacttgctgtatggctcttattcattaggatcttgtttggtttcttgttagaggtttatgacccgcttgccttccaggacccaacatctcataaatttaaagtagctatgaaatttctgtttctctgggccagtcaggcaggggccttttaacagagcagtttttattcccttcattcggcatcctctaaatgtctgactgctcccttgtgggaagcccaggcctctgtcttacccctgtgcccttgtaaaataaattaagaggggatgggaaagagcgaacatgtatgaagtacctctacgcatcgtgcaccatctcccgtattcggaacagtgccaggaagtagggaggtacctttattgtctcccattctgcagatgaggctcagagagactgatttgcccagaacccacacacctgaagactgaatgacagttacatagataaagtgccaggtacagggcttggcacacaggaagtgctcaatacgttgaagccgttgttataatattgctatcacttagaaaatgctctaattaatttttaaaaataagttgttgcaaaaatcaagtatttggttattttctgtgaaatgttagctgtgaccttatacctagtgcctcatccctcttaccttatacttcagaaagttctctgaacccagggaaccaggggcaggtgcaggatccaccatgcgtagtgccagcgtggtgctgggatgtacgggagatccgggccctgttcacagccacatgctttggaggccttgggctggaggggaaggtgcgtggtctttggagccacacaaccagagcggacatcccaggctgcagcagcaagacacgtgtggccctcgctgaagtgaccactttaaaactgtctttagataagaaagtgtggatcccagaggtaaccctctcatggtagttaactgacagctgggccggccttattgactgagtacacaaactctggcctattcctggcccaaggtctcattttactctggccagggtttgggggacagggagcggattttatggacaaaatccactcatccctccatctttcctaattcacccagaacctcttggctgcaaatctgggttcttccaaagccacttctgcactcctgaaccacacaaggccctcccggctcagtttgtattttccttagcagggaagaaggtggggcctgaataagaaattgatgggccttcctaggtgacccctctaggctgtccaccctcgctgcgcgtgtgcgtgtttgcttgctcagggagacggcaaggactggggccacctagaagaaccccctggaacccagaggcaagttgtcacccagcggagttcagcagagcagcaggagctgcagcgtgtgtctgtgtgtgcaccctttcagaaaaaggcaaggaggcctttcagaagacagtaaagaggcctccgcctccccgattccaatcagttctcttggcggaggctgttacggtatttctgtcccagccagcgggtttgtttcactctttgaaacagccccagagccccgaaagatgggcacagatggcctcttcccagctcagcttaagccaccccccgcccaaccccagctctccaaacgtggcagcctcccagcctgcttctggcgcgggaagaatgtgtggcgctcccagggatgttggcagcggccccgctgcttggcttcaaaatcagaaccatctggtggagtgagggaagtcagaacggtgcccagagagaggcagcgctctccccggcacaaccccatgctggctgggtgaccaggcacgggtgggagacacctgggagatgagcttcaggggaaggagcgggagggctgggtccccggattcacgttgtttctcttgctttcgggaatgtgtctcatagggatttatgggattcattggtctggtcggggagccaggaatcgtgggagaaaaggtaagtggtgttgaggggaaaagataaacaattagagcttgtgttttgaaattgtaaaaaggtgaagaggccctttgacctggggatttcagaataccctcccctagcctctctcctgacctggcattctgagtctgccaagagacattgttccctttcctggcatcccttggggttctatccctgccctactgtcatcagcctcaagcacagttagacttttgtgtgacaaccagcagatgcatgtgacctgggctcctcacagctgcctactggccctgcacaggggtcggcgagagcagggaggaaaagactcatctttacaaagaggaaagatgaggttgccttgctaagcctctgttttagatgagataacagaggctcaaataggggaggtgacttactccaggtcacccagataataagtggcagtgctgagatttgaaccaggttcattgccaaaggttagctacactttgctcactaagacactctgcctcatgttggctcccagctcccaccaagggccttggaggcacttgtcttcctttgtatgggtttatccgatccccagagcaggccctctgggagaaccaatattattcccattgaatagatggaggaactgaggtccagagggaggaagtatcccccgcaagtctggccccgcctaactctccaggatcctcttgtgccacactctatcactctatgtggcccagaccctcgggcctctgccttcctcctcctcctcctccctcgcttccccctcctcctccttccccttctgctcctcctccttttaaattcagctttttatcttgaaattttaaatttaactttttattttgaaataatgacagattcacaagaagttgcaaaaaatagtacccttcaccctgtttcttccagtggtagcatcttacataatgatagcacaacatcaaagccaactctgggcttctgctgttgctcaaatgacccatgtcccttctcacctacaaaccattgactgcgccattcccttagccaaatgctttcttcccattgccatctgcctccaccctttctgcccagatgctcttcattatccttcagctcttgggtcaagagggacttcccgagggaagctttccctgaccggctctgcccccaagtgggtcaagtcctccaataataacaccttagcaccatgacccccaccctcactgcactgtgtctcctacaaccctctgagtgccttgctccatgggagcagggctgctcaccattgtatattcagagtctcgcagatagtgtcagacacatagtaggtgctcaatagatatttgctggctgggtggatacaagaaacagagcctcacgaaaacagagccaagattcgaacccagagcacctaccttctggctggagctgtctgctacactgccaactctgcccagtgtgtctggattggtcgagagggaatgagttatgtctctgattctctagcatctcatctaggtttggacagggagtttggagagtgaaagacatgccttctcttgctgtttctgcctcagcaagcctagcccaggggatgccaggcctaataaggaccaacatgatgtgggccaggatcaaaggggacagtgtaattagtgcttccttaatcaggaccatccttggagggaaattcactgcgtggcccactacaggggatgctgaggccttccagggcttgccagaggtcttggcttcctctgagtgaaatcccagatccccacctgggtgatgtggccatgaactaggcagggaccctctagagaccttgagcaaacccctacctctctttgagcctctggatggccctctgcacctgcctcccacagagccaccccacagccatagccgtgacctgcctgcattgctgtctccatcacagggtgatcgtggcatgatgggacccccaggcgtgcctggacccaaggggtcgatggtaaggagtaagtctgcatcctcttgccctctcctgttgcagccttgagtgacagctctgctctcctccatgaaccgcttaccccagacgttcagaatgaccagctccctctttgtccagggggcctagctgctgtcctcctggctttgcactggggctgagccgaccgaggtgggactgaaggaggaagcttccatagctgattcctcctttgtcttctctgtcttggcagggtcatcctggaatgccaggtggtatggggacccctggagagcctggaccccaggtaagcaaagccctcgtgatccctaagctcaaaccactgtcagataagggttaggtggctgggtgtggtggctcacacctgtaatctcagcacttcgggaggccgatcacttgaggccagagttcaagaccagcctgacaaacataccaaaaccttgtctctacggaaaatacaaaaattcgctgggcgtggtgacacgcacttgtaatcccagatactcagtaggctgaggcatgagaatcgcttgaacccagaaggcagaggttgcagtgagccaagatcgtgccactgcactctgcctgggtgatagagctagaccctgtctcaaaaaaaagaaaggaaaagaaagaaagagacagagaaaaagaaagaaagaaagaaagaaagagagaggaagggaggggagaaagaaagaagggagtggaggaagaaagaaagacgaaagaaagaaagaaaaaagaaagaggaaaaaagacagaaagaagaggagaaaaaagaggagggagggagggcgggaggggaggaagaaaggaaagaaaggaaaagaaaagaaaggaaggaatgaaggaaggaaggaagaacagaagaacagaagagaagagaagaggagaaaaagaataagggttaggagttcaagcctcagaatcagacagacctgggtagaatcccagctacaccactttctgactataatcctggggcagatctgactgtattcctggggcagatcatttaacttctccaagcctgaattttgctcatttgaaaaacagaaaaaagaatcatggtcaggatagtgtgatcgtgtgggttaaatggaagcgtggggctaatgttcattacagaatggtgtttgttccctggaagcattttggttattagcagcattattgcttttgtccattcactcattcactctgtagttactgagcgataagtgcttgtgggcagtttcaggagctgggtgaaggggcccaatctccactcactgcaacctccacctcctgggttcaagagattctcgtgcctcagcctccctagtagctgggatcacaagcgtgtgccaccacacccagctaatttttgtatttttagtagagatggggttttggcagttccaggagctggggatgtggcagcaagaaaggtagaaagtggtcccttcctttggagcatgtagtctggtatgggggggcagggtagatagaacccagtaagtgatgtctgttctggaagagcaggcacaaagatgggaaatgctggacaaacagggctgagggtcctcaggggcctgggcttctcatgatgactgaggaagcagggttggtgggaggctctcaaggcagagtggtgggagaggctgggagagctgggggaagggtgcggccaggagcactcaagttcaagagccccttctccttcccaggggtgatgatgtgcagggggtgggggtgggcttgctctcatttggagcaggtagaacttgcttcagatccctgtttctgccaatggaggatggaaactaggaaagggcactcgcttcagccaaagccaggggtcagggctgggagcccagtccgaggtgggcttggggaagttggggagggtgtgggggtagagggaccagcccaggcacagatccggaggtagggctgaggggcgatgagctcaggttgcctgggtgtctccaaagtccagactgaggagttccctggggtctgatgaggaagggccctgaagcctttcatggtttgaacccaggggaagctcgcataaacctgttctctactgtgattagggaagcaaggccaactcagctcctacactttttcatgcacctgctgtgtgctagcataagctcctccctggaggtacaaaaatggtaagaaagagttccagctcttaagactctcactgtctggtggggctgtcaagtataaacattctctccatcattaacagacttttatcgagcacctactctgtgccaggccatgccaggggccgaggaggtagaggggtggactagtccaagggtgagaggcctggatataggtgaccgtcacccagaggagaaggcatcagcaccaggggtctctgtccatcctcatgattctttggacaagttggaacgttcttgaggagcacagttggaagcagaagccagcactctgggctcccagtgacatatttttgcccttttcatgagaaggaggaaaagtcacatctggcccagggctggaggagctggcagtgtggaagtaggactgttggggtagaagcagggggtcagaggaccagcattctggtcagggggctagcacggctggccgaggcacccagcttggaatgcaagggcccggcctccctcccagtggtcagagatagagtgattggagccctcagcatggggggtgcccagagtagggccgaagcctgagtacaaggatgctgggggtacatcatcgagttctatccctggcacccctgcacctcagccgtcctgggcctgtctccccatctgtctagtgggaggaggaaagccaggaaaggagtcactgggacacaatggaaggccagcgggagatggggaaagagtggggatattcaggccaatacagagaagaaggtgcaagcctcctctgaatcccttgcctccctggctccactcacctccccaccccaccccatctcctcagtgcttccccctcttcagtgggttggctcaggcttggtgaaatcagacggtcacttactgctgtttctgatcccaaggttgccatggtcccccactgctacggtacagggctggtcccttggatctcttggggttcctcctggccagcgacactggggaagccggctagctcggaggcccagaaaaccaccttcagaatcagatacatgggggtgaaattctggctccccgacttgccggctgcgggattgttggcaacattcatagcttctccgaccctcagtttccccatctgtaagtcagcatgatgccacctggagtatgagattgtcatcggaaatggtgcagtgcatgatgtggtgtctcacagccctcctgcataactgtgtgcttcatgaatggtgataactatttgttagagatgatcattgccactattatgagtaaggctactacgattaaaagtgacatttctggtgatattgttcacacctgattggcattttcccactttatcaatcactttcacctccatgttgtccgatagcacattgagatctatcaagattattatccccaggccaggtgcaatggctcatgcctgtaatcccagcactttgggaggccgaggctggcggatcacgaggtcaggagatcaagaccagcctggctaacacggtgaaaccccgtctctactaaaaaacagaaaaaaattagccgggcatggcggcgggcacctgtagtcccagctactcgggaggctgaggcaggagaatggtgtgaacctgggaggcggagcttgcagtgagccaagatagcgccactgcactccagcctgggcgacagagcaagactccatctcaacaaaaaaagattattatccccattattgggggtgggagtgaggccctgggacctgcctagggtcgccctgggacctgcctagggtcacccagtgaccagagttgggtctagcattcaattctgacctcctcctgccttgcgagagcaggcagctaccttttcctgaggactttgtcacttcaccttctagaaactctagggggtaaggactcttctatccccatgttatagatgacaaaactgaggcccagtgagttgaagtaacgtgcctaagatggcacaattagtaagtggccaaactggcatgtgagcccgggttctccagtgctacagcctgctcttttcagcactctatgccttgatgtagagacttggctcccgaaatttcccagcggtgcattgcatgccttctgagctctgagatcactctataaaatggcccattctcacccagtctttctgttctccaccatccgggagtcagaactgccttttatggggccaagcccgggtccacaccctgcttgctctactgacgaagggtcagcctgggacccagcccctcacatcagcccctccacagcagctgttggagggtctgctgggtgatagcggctgggttcacacccctcaaagccatggggaaagggaaatgggaaagtcaagagttcgctctgaggcaccagatggggctgggcctctccctggtattcagaggagggatgagactggctctgccttgcaaaaggagcacgcccagtctgagaattgctgcggagctgggaggctcctggagctggcagagggtcctggctggccggtggatgaagttgctgcttgaggtctctcaagctgggcctggaatcggggtgggggcgggggagacattaggcagaggggtggcctgcttcccatcttctcctgtgttccctccgttcccaccctctgccctcttcagttcatgtgctccttgttcattcagcagattcctgagtgtctgtcgtgcacctgtgccaggccaggtgccgagaattccaagaactaaactggccctctcaccctgtctctcttgcccctcttgtcgtctgttcatcaaaaccaagatggctgcccatttgcccggggctgggccttgctcccttctcatgccaccccacccacttctctgcctctgcctcccctctccttctctctttcttgatcctctcccactctgccctctccgcctcccaagctcaccccaggcctgtgttctcagttcttcctcctcctcttttccctgggagaaaatattcaggaaaatattgggtgtcagggtggaggtgagggacagaacttgggtcaccagattctcctttctggtgggggagaaaaagggagatgaggatttgaggagaccttttgtcatacatgtcattgtagtctggatgcagtggctcacacctgtaatcccagcaatttgggaggctgaggcaggaggatcacttgagcctaggagtttgagatcaggctggtcaagatagtgagaccctgtctccacaaaaataagaaaattagctgggcatgatggtgcatgcctgcaatcctagctactcaggaggctgaggcggggggatcacttgagcccggagctcaaggctgcactgcactccagcccaggccacagagcgagatcctctctcaataaatacataaatgaatgaatgaatggcatcgtatcttctcattgttgattttgaggaaaaggagaagaaaatgtcatgcagggggccttatccccactccccagactcccaggaaaggtcgaggcccatccccctatagcccagggcattggctgtgttcgaggctgtggctcgcctgctgctttccccagtgagccaggtgcccagtccttccatgtggaggctgctggggccccggcagcttctgaacatgcccgtctgagggctgcaggccttcaagctttgccccacactcccagccccccgtgttgctctcacttcctaaaaaggggcctctccaaactctttctcctcttcccagggtcctccaggatctcgaggcccaccaggcatgaggggagcaaagggacgtcgggtaagtcgagcccagctcctgggggctgatgctggtgggagggggcacacttggaacagggccatctgccagagactgcctgggctttgcccctagcccagctctgggatctgtgactttcatagcacaaggcaaggttctaggctcaccctggacctgtctctaggggtgggaccccacccctctttccaactcatttctcagccttgctatccaccaggcacagtcgggctctccggtactagttctttgttcattcatttattcaaccagcacttatttagcacctactgtctggcggacactgttggaggctctacaggtatagtggtgaacaggacagacataacccctgcctgcccttgtgagccagtcaacaagtgaatcaaaccacttggcagatgcaggtgataaaatacagggtcatcagcacatggactgaggaagtattagcagcctggaagcccagaggaggaccctacctgggcagggtactaaggaaggactttaggagagggcagtgcttgagttgatgccagcttcctggcaggggactggcaggggaagacctgaaggtgatacaggaggtggatgcttaggtatcctcagggtcaaaagagggacgagggagagggatggggctgggacttagcaggcaccaagcgaggcagggcctcaaaagccacagctatactccaagggcattgggaggctgcagggggttttaaacaaggcttccctgagcagtcactggaagtaatcgccagcacttaatctatgccagatactgcctgtcacacacattaactcatttaatcctcaacactaccctgtcatgaaggtgctattctcattcccattttattattattttattattggattacttaacctttctcccagaaagcctttgattcctgggataaactaggtgctatgtgattcagcccaagccctgaacacctctgagcctccactccactcccagagaggcacagaaaggttgagtcacttacctcaagttgcacagctaaaaagtggcagagctgggatttgaacccagggaatctggctcatttgcatactgaattcagccttattttcaatcacacagggagggttgacaggatggtctgccagcaataggtatacaggcgtggggccgtgcagccttattgtaaagagaaagtgagatggtgcaggtggtgccggcagcccaggcctgatatccaagctccatacggggggatctgtgattattattctcctcttggctggatttcaagtggttttacaatttcccccaaaccagatggcctgagcagccggcctggaagagggaagattaaaaggcattcctgtggcccagcagggtccctccggtgcccatgtcctctgggtggggggggggtctcttcaaatgggccttgggccaagggcagccaggctccatccggatcctctgtacctcccctcctgccccaggaagctggatttcctggagggtgagctgcatgggcccaggccccctgccctgcctcaggcgcggggctcaggcccccttcaactcactgggctcccttcaaccatctccaccaccccttcccagcagtggcttgaagaacgtattcctgcttagggaaacacaggcttccaacctcgtcagtgtctcccgggctgggaggggagcatcaggaacatgagcccctctccccactgggtttgtcaggaatgcacaacctatgagatcggccccctgggtctcctgccaaacaggctgcccttcgccacctcctagaggaggtgactgaaggtggggaacctacagaggcacccaccgtgcctgtgaaagagcttgattctgggcaagtcctgatcagctcccggtttgccctgtgcccttagcaaggccttgtggcgctctgtgcctcagtttccccatatgtgccacggggaatgggcctggaggtctgaaaggccttgcctgctttcctgcctatgtgtaggacgggccctgctccccaccccaccgcccacccaaggaagaatgagcactgagagttgatggccaggggcaagggaggctctcatcctctgttcttggtgaggacgctgactagaacctgggcccaccagccccagtgaaaagaatgaggactctggggtcagatgggcctacggcaagtctcagcacccccggttcccagctgtggaaccccaggccggtttcttaacctctcagagcctttctcccacctgctcaggttagagactttaattcctccttccgagggggtcgtaaggaccccaagattccaatgcctcgggccaactcttcccctgcctgtgggtgttagagcttagcagaccttacccaaatccaggctcttcctcttggatcttagaccttgggccactgatttcccatccctgagccttcacttccccctccgtaaaacgggttggcaacagaacaaagctggtgggctggctgtggggactcagtcactgcctgagcaccttgaacttgctgcagggtggcagcacgtgatggtgtgtgctcattcccgcttgttcatcggcccctttttcacaagagctgtggttggccagattttctgtcccaggcaggagctcctccccaccaagcctgatccccaggcctggctggagggcagtctccagcgtgcctgcagacatcttcctcgaggagcggatacaagagagcagacaggtagctctgatagaaacccaagcttccctccagcaggcggggcgggggtgggcctgcccaggttcatttagggaaggaggcagcaggactggggaacctgcgggatgaactgttgagtggcccagagcaagggttagagtgtgcggctgttctcgcccctctccctgccctgtggggctggggagacagggtggctggtggccccactactgcctcctcctctctcttaagccaagccagcttctcccgggttctctggtgctctgctgggatagtgagttctctcagataagagggattttagatattgtcttctccaacaccaggccccagtgtgcagccttcctggcaggatcctctgggtcctgacctgtatacccccggtgacggggagctcactccatttctgaaaaacagtgacaggtagtggtgaaaaaaatggatgtccagctgacttggtctcaaattctggctcctccatttcctagctgtgtgaccataggcaagttcaccaccatcctgagcctgtttctgtccctgtgaaaggaggataacagctttcactgctcctgcggtggctgctactgctctattattatttgatgacttaagctttctcccagaaagcctttgattcctgggataaacaaggtgctatgggcttcaggccaagccctcaacacctctgagcctccactcccctcccagagctatccctttctagggaggtgtatgtctcagcgagagacagagcccagagccagagatcatccctcaggagggttcagttgtctgccatcagctcagcccctgtcccagctcccatgacctgacacggccccaccccatgtggctccagctccgccaggcctgtgcccatgaatcacgggtgttaagcctaatgacgtggtgtgacagtgtccacgtgagcctgagactgaggcccagagaggagatggggcttttcggggtcacacagcaaaccagcaacaggctacggctagcacctgagccccgtaatgcccactagagatggcttgtttaggggttcatcaaactgcagcttgaatctgaaaattctcaactggttttacacagcatagtgtgaactgcctgaggaagggactgagcccagattccccaagccactcctgtgtccctgcctctggggaggctgccccctcccctggcagagcctggcagggatggaactagccattcttaagcactttctgcgtgccaggcactgagctgcctgtgggcatcgcctcctgtcttgagggagagatttcttgtgcccatttcagaaaaaagaaatggagtctcagtgaggagcagtcacttgtccccagacacatttcctgagcagcccggtgcctagggctggaccccacaatgggcaccaggccctgggcttggggatgctgaggacagcgtctcccagctgagccttggccttgcccggtggctccctgttccaggattatttgatcagtggggtgctctttaaggctgcggtgtgggattgaagcatagggagctccaggcagctgagaagtggaattttcactttgttggcccaattattcattgaaaatttccttgtttgattttttttttttttttttgagatggagtctcgctctgtcgcccagggtggagtgcagtggtgcgatctccgctcactgcaagctccgcctcctgggttcaagcaattctcctacttcagccgcctgagtagctgggactacaggcacacaccaccatgcctagctaatttttgtatttatagtagagatggggtttcaccatgttggtcaggctggtcttgaactcctgacctcatgatccgcccacctcatcctcccaaagtgctgggattacaggcgtgagccactgtgcccagccttccgccactgtgcccagccttccttgtttgatttttaaatgatttttcttcatttagttttcttattccccatcctctcccacctagacacttccccagttccttttatctgggggagtattgcgggctgatcccctgggctcccgggccaggatgggctggcctcctccacaggacactcctgtcctcccaacacagactgcttgagaccccctagagaacacagcctgctctgttttccacgggttttttccaggagagcccagcccatctgcgtctctgtgggagcggccctggaggggacacacgtggggcagtgggtggagcccacatgggggatgagagcggctaatgtgttagggaccttagctaagtcacttcccttggctgggccttagtattcccatctgtgcaggggggatgggggtggactccacctgcccctggggtctcccagcaatcagggaccaagactcctgtgtcaggggtcaggcctgagcccagggctccagggagcagtagcctgactcccactccctcgtgcaaaatcctgccctgttcctgcccccacctcatgggctcttcctctgtgagctgggctgtattcgttgtacgtctggctagagatggggctgctccacacatctgggaaggacatgcaggttcttcccaggtcctgctctgtcagtttcccctgagggctgtttctgccccgtgtgtgctctgggaatggcacatggcagcagagtctgaagagttggccgtgtggacgtggccacgtgtaactcaattgcggccctcagtctccacgtctgtgaaatggattggctgggtgacccccaaggtctctctgaacagggccattagtgccccagcccccttctggaagcatcagcctctagctgagtctactcatgctgcggcctctgcagagctgtctcgaaggcgctgcacgagggtgaccacctcagtggggagtgtgtgggaagtgggaggaggagggggccggagcttgtgcaggggaaggccccaggcttggagcagccccgccctcctggttctccgcccgagggagacccctgctgtccggtgtgctagtccctttttcctattccagggcccccgaggaccggacggaccagctggggagcaagggtccaggggcctgaaggtaccgacccctaggacctgcccttcctcactcctccgacactgggtcaggaatcgtgaacaaggctcacagctcctcagaacaatgccccttagggacaacaaagggagccccatggaggctgcagggctctttctgagagcttagcccttccactcctcctgacccctcactgcaagcccaataaagagaaagcaagaaaggaggagggagatcatacacgtcctcagaccctttccccggaccccaaaccccaccaggcccctgacagctgagactgcttctggcagccccatccctaggaaggggtccttggttctccacctggagcagctggtgacggtggcgagccactccccttgtcaggccttagttttcccatctgcaccatggaaagggggcagactctgtggcctcaaacgggttccttttatctcccatgtggaggggtccctttttggggaacggtcctcccaagcaccctctcccaccttcacgtgctctgcttcccacagggccctccaggaccccagggcagaccgggccggcctggacagcaggtatgtcaggccaaggccaagcaggccagctgcaggccccctccctgctccgtgctttgtgatctgagcctgtaatgacccccacatgtgcttccagggtgtggctggtgagcgaggccacttgggctcgagaggctttcctgtaagtagcaccagttcttgaaattctctacatggggcttttgatgggggtggggggcgggtgcggtgctgataataaccacttttaccaagttcctgtccttctgtggaaaccccgcaggttctggttgcccacctgccctgcactgaagctcctccagcacatcctctcttctctgggtctcagccttcccatctgtcacccggtgtgggaggaggggacccaaatacactaggatggcttgcttgaaatcaagacagggcagagaaggccatggagggcctaaggtcacctttaccttgtctctgcagggcatcccgggtccctcaggccccccaggcaccaagggcctcccaggagaaccggtaagagccctttccttccctcttctgcttctttgccgctggcacctgggggtgtgggccaggtggtcagataaggagaagggttggaaagggaccatgcctggcctctaacccgctgtgggccaggccttggggttggtggcgagcactaagccaggagctctgggtttgaggctcagctcacttggcctccagcctgttttcttgccaggaaaatgggggtgattgtctctgccttgccattctgttgtgaagatgaaatgcgaaaatgtatagggagtgcttggcacagggaaaggcaggagggagggaggtgaagataagagtaaacgaacaagctgaccgggaactgcagagtccagcatggctgaagtggaaagcgggacctcagaaagggcaggaggaggcagcaggctccagtcgcccaaggccacggggacactgtgctttttatcccaagggcaacagggaaccatggaagggcttgaagcagaaagggcgatcagcttgccttccagaagatgtccctgggaggacaggtgtggggggacagtccaggaaccccatgaggaggctggagagtggtgctacaagagatggcagagagaggacagaatctccagggggctagaaggatgactcctgcacagggcaggggaggacaggaggctcccatcctcaaggccgctgctgcattcccacatcttgaggcccaaggagtcacccttttgaacagtgggttggctgggggtgggggtttccagacatggatccgaggtggaagagcgttccaggcaggggcaacagatgagcaagactcaagagctaggaggtttctgatcagggagggccccctgggctttaggtgggtggataggagagtgtgcagctgtgttggagggagtatgacagataccagtgatgaagaggggctgcagacaccaggaccctcggtgtggctggggcggactaggggtgtgcttcagagtccccagttctgggggtcagctccctcattcacccctccagatcccaaagagggcccaggctgacctctcccaactgtctgtgtgtctgtctgtcttccagggccctcagggaccccaggggccaattgggcctccaggagagatgggacccaaggtgagtgtgagagacccttattcgtcccatgatgctgctggggatgtatcagcccttcccttccctcctccccaggagcctctttctgccattccctgtcctggcccagggagatggtcatgtaccgtgtagttcagagaagggtggacgccctggcagagagggtagatccatcctggtggcataggttgaggagctggctcctagtccaggggcattgggtgggacacagaggtaccaggacccttgtgggggttggcattgcctctttgggcatcactggaagcatggatgcttcccaaccttgaccttgctgggactttgccccagcagaggtttgactgtccatccagcccccaagggtcatgcagcaaggaacttggaaggagcctcgcacacccctgccttatccagagggaaaaaccaagccccagggtttatgcaagggctgcagccatgcccacggtgataactcagggctgcttcccacccgcctcacgctggctaagctgtagagagaagggttagaatcacttggccctaaacacagcatccaatggcttcctcccccgtctttttgtgaatcatgaaattttcttccctctgcttgccaaagggctcctagtgtggtaaaccacacttgtggggcgggagaaggctctagaagcctctgggtagtcccaaagctcagccagcctgggcccacccccagccccctagttccagctccaagctccaagaagctacaagctgctcccacctctgcatctcttgcactgtgtgaccctgggtgttctcttgccctcttggagcctcagttacccccttgcttacaaccagggggcagctcttgctctaggagggaccaatggcgttttctttcaggggccgcctggtgcagtgggagaaccgggccttcctggggaagccgggatgaaggtgaggtgggatgaaagaagagaaaaatgacttgttgaaaccagctcccagatggtggccacatcctctccatggaagagaaatgggcctttcttgtggctgggataatgggttctctgtgctcctggctggggagtggggcctggttagggccagagtggaatgtggagcccccaccagtgccctctgcgaggtaatgttttttcgggcacctgcccctgcctctatgctggggtggctgtacctcctggcctcatgcgataccatctgcagctcggtgccagtgcccttcattacctgctgagaaacaggtgcccattgatacatggactctggggagagccccctccccattctgctgttggaagaggacgctgttcccccttggaggccccagagctgatgagtgatgctggctagcccgtggacattgttgaggcagggcccaggggagcccgcagaggggctgtgagacttgagtccagtcacccccttccatgcctaagtctccctgtcattcaaagagggagttggaccaggccgggggctgccagacttggcctagtcccaaaatcccttgctcaaacaccaatgaagaaaaccaccccacgtagaaaactgatagaagtgggattgtttccactggagcagggctgggggctcagagctctgccctcctcctgtgcccctagacaccagcagggagcatagcttgaaaattcaccaatgaagaaaccaccccacgtagaaaactgatagaagtgggattgtttccactggagcagggctgggggctcagagctctgccctcctcctgtgcccctagacaccagcagggagcatagcttgaaaattctccaatgagaaagacccttttagggcctttatgcagggggcaggtgacatttattccggctcatttagggcttcctcctcgtttgggtttctcttcaagtctctcaaggaagaataaagtcacataattgccattgctgcatccaaggctcctggaaccagactgcccaggttcggatcatgaatctgtcactgaatagtctcacgagagcttgggctccttaccgaactcccccaatgcctctgatgcttcacctctaaaataatgcctttccttgcagggctgtcttgaaagtcagatatgttaatataaaaactgatgtcctcagcctgggcaacgtagtgagaccccatctctacaaaaaatttaaaaatctgccgggcatggtggcgcatgcctgtggtcccagctacttgagaggctaaggtgggaggatcacttgagcctgggagatcaaggctgcagtgagctgtgattaccccactgcactccagtctgggcgacagaatgagaccctgtttcaaaaaacaaacaaaaaaagtccttagaacagtacagaacagtacagttagttattaataggatgatggtgttggtgctaattgtcctcctgtcctggcgtgggagaagaagtccgtggacaaggcttacttggaacaggagctctggttggtgttttacgatttctctgtggtccctgggaagaaggaccttccccagctcctcctcccacaccccaaagtcagagctggtggaaacaggaaggggtgtcgagagctggggctggccctacccacccgcaaggacttttgttcggcttctcctagggtgaccttggacccctgggcactcctggggagcagggcctcattgggcaacgggtaagttgaagcaatttattcttcctgaaagcccccagggtgtgtgggtgccgcaggggaagagaccggcttttctcaatctccctaagcctcagtttcctcagttacagaaatagactatgaatgtctacagcctcgcccagtctctcttggtaggccagcatttccacagtgtagagaaaggcattttgtggtctgtagtcccagctactcggggggctgaggcaggagaatcgcttggacccaggagttggaggttgtggtgagccaagatcatgccactgcactccagcccgggtgacagaggaagactccatctcaaaaaaaaaaaaaaaaaaaaaagaagaagaaggatgttgaggttcagtcgagtctcggcagtaaagagaatgatgagcacgcatcctatgcccactgtgtgtcgagcacttttctcgaggcacaaggagcacagcagtgagtaacggaggcctgtctctggagcttgcattccagcgggttgataagtgatacctgccatgggtacaagaggagcatggaccacccaactggcacatcgttgccatcctgcacctgacggcccctgaggccctttccagctcagactctgaacagcgatgaattctaaaagcagagagagacccaaacttaatttgatggccatttcaagaactgttgtccaggggcgtctctagagctggaagggcaagcctggttgaggttcagccagggactctgttcttgctgtcattcccgagcttgctgggaagaaaagtcgaaagactggcctccctttcctcatctgagaagtaggattccaccaaggagttccatgcaggcttactccagctccagtaatagtatctcacatggttgccaggtatggggcgcttacaccatgccttacagcaacccttgaagaaggtggtgtcagccccatttttcagataaaaaaacagatgccaatgagacctaagtagtttgcttgcggtcaaacagccagtgaatgagaaaccaagaagtagcattgacgtctggctgatgtcaaagcctgtctttaactactaggccactctgcagcccagccaaccagcctagagatgatgttcaggacaaatccatgacaagcaccttctaaattcgtgacctcatgtagcccccaccccacgtcaccctgcagagggagctgtcggtagcttgggggtctgctccccttttctggagagctgagggtgggcacctcaaccttcctgttcatttgctaactcagcccctggctaccatgcacccactgtgtgccagggcccccagggtcccactgcctggagatccatgggtcagggtcctgccccagggagggggaagagaggaaaagcacaccggggcctcctccccagtaacatctcctcctctttctccatcaccttttccagggagagccaggccttgagggtgacagtggccccatgggacctgatgggctgaaggtaagtgcccttttagggcagggcctggggaccccggcagggcattgctttcccatccaagacctaagtctcctcccagaaacactgtgttcccatagagatctgagatgacagctccagctcccattgacagcagcttggggaagggtcagcagtgtccagcagccacctcccaccctgccctctgcactacctgctcaggtgggaccagggccatcaccaccttccagtctttcctgctacccttcttaaaatatcagcttctcttggctaagggtgattcctgagcaccggcactacgccaggcccagagccagagtctttggtctctgttatcttccaaatattctagaaggtcaggaaaataataattaccaccaatgacttataagccacaatttagggaggactagtcacacacataccaggtacaacgctaagccctttaccagctggatccataggacaacggaagttctgtctttagatgaggaaactgagactcagagtggtgaagcaacttgcccaaggacacaccgctagcaactggcacatccaggacccaaatctgggcccgtttggctccaaagcctctgctcactctgctgtaccatgcacccattctaaaggcgaagaggctgaggctcagaggaaggcatagatacattcaggacctatggctatgagtgaggatccaaaattcaaacccacggctcacaggtgccaaagcctgctggcccaacttgaccctgctgctccctgagagactcctgtcagccacaaatgtcaggactctgaagagacaccttagctcacctgaattgcaggtgggcaggcgggcacctccctctgactctccagacccatctccaggccagtccctggcctccgtcttgggccccgctctgaccccacaggtgggctttccccgaggctggccggtcaccctgtgcaagtcagctccccagcccaggttcctaagggccatgccctctcgcccacctactctccaggtgacctcagagaagcagaccccttctctgaacctcagtttccccatccacaggcttccgcccaccctcgttaccccctccccacagtctcccagggtgccttggcgaccggcccctgctgactcctcacattttcttgcaagagcgagagcaccccctgtctgtcatctgcctgactcctctcccccaaccctgctgcatccaagcgtacagccgagtcccaagacccggagcatttgacagctgctccacaccctttgccagtgcctgctacactgggtggtgatgctgatgaaggtcatggctaaaatgctttgggcacttgccatgtgcccagtgccacccacccaaagggctttatgtgaattaacccatttaataattaatgttcccagcaactctcccaagcttgatacattaccatcctcactagacggatgaggaaactgaggcacgaagcagcagccttctcactccactctgggcggccacctttcttcttggaaagtccactgaggtgggcgggagggggtcttccagcctgggtgcctcatgcagtcttctgcctccaccttgcatggctttttggccctgacttcatcctcttcccctcccttcaaagccaattctacctgagtccttgtgctcaaatgcacagcatcttccctggtctttacatgaatcccaggagagacccattttcttaaggtgtttgtccaggaatcacccctcatggtgaaaactgcgtctcgaatatgcacagcacttcatagtttatagagtgcttttacacccgttatctcttcgctgatgtccagctgacagtgatgatggtggtggtgaccaataatagttagcttttatccagcattcacatgccagacacactgctaagctatttacatggtttatctctttcaatccttgcagtaatcctttgatcctgattttacaaacgaggaaacttgcccagggtcacacaactattcagtagcggtagcaagatttgaacttaggcagcataacccgagggttgagggaggcatcgtcccctgagcagagaatcttggaattagaaggagccagaaccccaggttcacacagcactgactcactcggtggtattagggagtctccacctgtctgcacttcagttgtcccatctgtaactgaagagggttaaggaaggtgacttgcaaggctcctctgagcactggcagatgtctgaggatttggggcatctctaggaacccccagagactgttctgcatgagattcacaaggacgcccaccccaggggtccagttagcccctggagtgtggtcttaggcagagcccaggtgagggccctttgttgaaaacccgactagccacctggaacaggctgtctgcctctgagaggagaacaggtggccaggacgacaagccagaaatggaatcccagagccagaggagtctgcaggagagttattcaggccagccccctgtcttcatgccaggctgtgcttagaagctgaggctcccagcaggaagggatccgggcacaactttgtgcccagatctgctctacattggcccacgcctcagctcggagtcttctgcctttatctgtgccatctctggaccgctccattggaaaatcttcccaactgaactagaaactgccccagcaactccctcacacccacctcctgccccagagctcaggcctcagcaggcccagcttgaagcaatgagcaatcatgagttgctttcttgagcctctcttctaggcagggccaagccccaggctccagcttcatgccctctgcttcctgtgctctctctcctctggatgcacaccagtttatcagtgtccctcgtaaaccttggcactgggggacagaactggtaaagacacactatgcttttccaagcctgctcttctcgcccatcccttcctgatggacgccgcccctcagcagccatgcccgtgctgcactccacacctgctctgctcacggtgatgagggtgacagcccacgccccatcctggaatcctgcatgccccatcctggaaccccacctgcccccaatctctctcagagtacgcaaagattaccgtgatgagataaggcaagcttagagtgacactgattgcttcaaaaccataaaaagcccatgccagcctggtgcagtggctcacacctgtaatcccagcactttggaaggccaaagtgagtggatcatctgaggtcaggagttcgagaccagcctagccaacatggtgaaaccctgtctctactaaaaatacaaaaattagccaggcatggtggcgcgtgcctgcagtcccagctagttgggaggcgggggcacttgaacctgggaggtggaggttgcagtgagttgagatcatgccactgcactccagcctgggcaacagaatgagatccgtctaaaaaaaaaaaaaaaaagcccatgccaagggttgcctttccaaggaaataacctcaggtgccccaaaggtccgaagccccaagaagaccttggttacagccctatcactgtaaagaggatacgctcaggatcctgcttcaaagtccagctccaccgctagccagttgtgggcctctgggccagaccacttgatttagctctgcctcagtttcctcttctgtaaaatgggactaaaagcggaccagccttagaaagcttttgtggggattaagtcagttaatagatgttaaaggactcagactatggtcctgacatggttagtgctatataaatgttagctccatccactccccagagaaagtattctgcagccaataagaatgatcgccatgcagagcccagagcgataggagggcacgttcaccatagagcaaagcagtaactataacaaacaaagatggagaccagcagtccagtgggattgtgcctttagagcttagtttactgctgtccgattcattgccttgggagagttgcttcactgccctgagcctggtacataccatccaaactgttacctaccatttattattattattattattcactgtgtttttgtcatcgaggattgaaaatacaactcagaaaaatggaaagagtggttctgagaaggagaattgggtgaattttctttcttgatgaaaatttctttcagctagttgcagcagctcatacctgtaatcccagcactttgggaagctgaggtgggagaattgcttgagcccagcagttggagaccagcctggtcaatggtctccaactgctgggctcaagctctcttgtagcaagaccccatttctacaaaaaaagaaattttttttcaattagctgggcatggtggcatgtgcctgtagtcccagctacttgggaggctgaggcaggaggattgcttgagcccaggaggtcgaggctgcggtgacctataattgcgcctctgcactccagcctgggagagagtgagactctgtctaaaaaataaaaaaaaaaaatctgcttcataagactcttgttctcccaatgtgtctaagttggagagaaattgcccttgtctcctgtgaactccatggggtgggtgcagtcaggaccccggcttatctctgagtcactctgcccttcgcagcccaggcccaggcagggacacatgggagcctctacgtctgggatgcatccttgtgcaagcttagagctacactgggcttggcagccgagtcacagcaccctgcctttttggctgcagagggaactatcgagaatctagggaccagttggctgtggatgcctgaatggagccctgagatttggggcctctgatgcacttggcaactaacttattctctctctctctcccctcttcatgccctgccacccagggggacaggggagacccagggcctgatggagaacatggcgagaaaggccaggaagggctgatgggtgaggacgggccccccggcccccctggcgtcactggtgtccgggtgagtgtgcaggccccttgcagcgcctggagctctggggtaccctgaactctcatgcctgtgcaggcggctgggcgggagggcttttggtcgtgccactgaaggatcttctgctgtggtcctttctccacctggcagtttgccagagaaccaatctgctcaatgctccatggctctggagaacaacctcggttactcatcctcctggctgccctgccctgtgcaaacctggtccctgccgacctcatctcatccatcccccatatccagacacactaaacttttttcagtttcttggacaagctgtggcccttacccctgggcctttgcatgtgctctgtctaggacactctcccttcttcactcccctgtcacctgcttaagttctatttggccttcaggtatcaccatagacatcacctgctccaaaaagccattcctgcccccaggctgggccatgagccctcagggacatgcataaccttcagtgtatgtcttggctccatgaagaccaagaccttttctggccttcatttacgtctttaacagtgccttggccaggtgcggtggctcacgcctgtaatcccagcactttgggcagccaaggcgggtggatcacttgaggtcaggagttggagaccagcctggccaacatggtgaaaccccgtctctactaaaaatgtaaaattagtcaggcatggtggcgcatgcctatagtctcagttactcaggaggctgaggcaggagaatcacttgaacctgggaggcgggggttgcaatgagctgagattgcgccactgcactccagcctgggcaacagaacaagactttgtcacaaaaaaacaaacaaacaacaacaacaacaaaaccagtacctgacacataagaggtgaccaaagtctgtttgttgattgagaagacggaggaactctgctcttccaccctaacagaaatgtacttagtcagtccacagaccctcacgagcatcttccctgggccaggtcccctgagattgaagaggtaaatcagaaagcatccctgactttgagggacatagaagccagtagggaagggagcagaattctcctgtttcaacatgtacagacaagttgcccaatgctttctcgaaggttccctctttgataccgatagcaacccctgaggattgggaaaatcggagaggtaaaggaaacttcccaggctcacacagtgagaaatgacaaagctggaatttgaacttaggcctgcatgactctacgcatactgcccctgtgctctggcagagttggaatccagggcttggctgtggggctgtgaggatgagctggaggcaggtggaagcttgatttttgagtgtcgcaaatactggactgatgactcggaacttgacttggtagtggggggcagtggtagtcttgtacagttgagcagggtttgtgtgacccaggagtgctgggtcggttcagttgaactccttgggacccgtggattaggtggcctcgtagacaaaatgcccaaatgcacaggcctgctggcatctaccttgagccaaccaggtggtgagaactcatgcctctgctgccatcccagtctccctggggtgtcattttcactcttcatccctcaagcggagagactgacgttgttacctaggcaaagcagcccagtttgattcaggcctgctcttgacactgtttttcccccctgaagtgtttacatgactaacctaggacagatccaagttagcctgcaacaaactatggttgtgggaaaatatttgtttcctaaaaatagcactgaagtgccaatccccctaaacagctgcaacagaatgaactcaccaaactagagaagaatacgagggcgctgagtcagccaggaggcttcccccaggcttgactcagtggcgggcttgactcagcggcggggaagtaggccaaggggaatttagcaggagggtcccgggccaggattctgcattaggaacttggtctgcgacctttcacccgccccctgccctctctggttttgcccttggagggtttggaaggaatgtgtgctaagattactttgagctccagcgttctagggacccttttttagtgagtgttgagtatcatggctgtggaatgggcaggaacacatggcagaaatagccttggaaccagagtcctgaggttgaacttgagtttctggctctagtaacccattctctgtgtgactttgggcaaatcactgcccctctctgagccttggttttcttatctataaagaataaataaaacttagggtaggaaagcactttataaaatgcaccagaaatatagaagattgtctttataaatttagaggagaaagtgactagaggctggtggtggctggtggtgatggtgagtggatggtgtgggtgggggcagcagcaatggtagtggtggtaatgacgataataatgatggtgatggtggtagtactgatgatggtgttggtggtggtgatgatgatgaagatgatgggggtgttgatggtggtagtggtggtagtggtgactgtgatgaggtggtgatggtggtgctggtgctggtggcgatggtgatagtggagtggaggtgagggtgatgatggtgctggtggcgatggtggtggtgatagtgatagtggtaatgataatgatgatgatggggcactgatgatggtggtggtgatggtggtggtgataatggtggtggtggtactaatgatagtggtagtggtggtgatgatgggtggtagtgatggtagtagtgatggcaggggagtgatgatggtggtcatggcagtggtgggggtgggagtggtgatgatgatgatatggtggtatggcgtaggtagtggtgatgatgatggtgatgatgatgatagtagtggtgtggtggtggtagctgtgttaatgtcaatattttgccatcactcccatttctcatatgccgggattggaaggagagtcacttgggccagacgaagtgtgtgccaagtgataaggcagtgaggggccttacttgagtctctttggcatcaggataaatacctcccactctgtggcctggaaacagttgagtatttaaaaacagaattttatgagccatcggggcctttccagaaatgcatctatatggatggggcccagcagaaatattcattccggacccacagcctcacccactgtatgtatgctctcggctggagagggcacgtcccagcaagtggcaccctgtcccaggggagacgcagcctcccgtctccctgcccctgtaccggatgcttcagcactgactcatctcgccttctgcaagggatcagtcagccattgccgccacctcagtgcactggaaaatgccaccaatcactgtgacatggcttccccattgcctgaccaagaccagcctggaaggagaggtgccccagaagtggaggagctgcttgtcacttctgacctggctgggaggcccacagagggcttcctctcactgagcctcagttcctttagctccaaaacgggataaataatcccttcctccaaacactggcgagaattgaacaaacatttatgtggaatgagaacacagcacatggcccgtggtgagggttgtagggattgttggtgttttattaccggaggagctggagactttgagattgcctagtgcagtccgatagaaatgaaatacaagccatatacaagccactccttttaaattttctagtagccacctttaaaaacagcaaaaagaaacaggtaacttcaattttaagggccagtgcagtgactcatgctggtagtcccagcactttaggcagccaaggtgggaggattgtttgagcctaaaagtgcaagaccagcctgggcaacatagtgagaacttgtttctataacaattaaattaaattaaattaaaaagttagctgggcgtggtggtgcatgcctgtagtcttggctactcgggaggctgaggtgggaggatcacttgagtcccagaggttgaggcttcagtgagctgagattgagccactgtgttccagcctgggcaacagagagagaccttgtctcaaatttaaaaaggaattaattttaataatatagtttatttagcccaatatatccaaatattatcatttcaaaatataatcaatataaaaatcattaataagatatttagcactctttttgtagtaagtctttgaaatccagtgtatagtatattttcatagcatactcaattcagatgtgaattttcattggaaatacctgatccgtgtttagattttcattgtatataaaatttcattggaaatacttgatctgtatttagatttcataaaatttacagttgacaatgtaggttcatatacccaagttactccaaacaagttttgtagcaacctaattgggtgtgtcaacttttaatttttttttttttttcttttgagacacagtctcactctgtcgcccaggctggagtgcggtggtgctcactgcaatctccacctcccaggttcaagaaattctcatgcctcggcactcccaggtagctggattacaggcgtgcactaccatacctggctaatttttgtatttttagtagagacagcattttgccatgttggccaggctggtcttgagctcctggcctcaagtgatccacccacctcagcctcccaaagtgctgggattacaggcatgagccaccgtgtccagccttaaatttaattttaaattaattaaagttaaataatattaagaattcagttcctcagtcatagtagccagatttcaagtgttcggtagctgtatgtggctggaggccacggggctagtcccatactagaggtggggaaactaaggttcagagaaagagcaggatttgtccaggggtacatgtagactcaggcactgggttgcaggcagtctgtgctgaggtccttcccgggccactgttcctgcctttctgaggaccgcagggtggtctgactggtgcatctctttgggatagcgtcatcttttctggcatcatagttgatgccgcattagtctttagagcagacatttctcccttgtgctgaatcaaagccagccgccccataattttcatgcgctggccaccctagagaacatggctggccctgcctccagaacagctgcagaaatctgcagacaggaaccaagtcctctgggttggtccagatgtttccttgttcctctaggacctcctcttcctgtccctcttctatcacaattagtcagtgcctcttcttaaagtacaatacctattcccaaatgggacatcacctccttcattctacatctggtgcctctgttaatgcaaccagagggattacatcaaagcagctccttagtgcttaccaagagcatagacattctttctagatcctttgaggcttgcagtcaagaagtcctttccaggccagaaacgctgcctgccccactccctccatcctgacctagtatggcccaggattgattctctctcttctctttctctctgtgtctgtctcttactgtcacattcacacttgcacacactcactcacccttgctgtgcagtttctctgacaactgtggacacaaagctggatttgccctcccagggcagggcagggcagatcaggccggaggatctctttgggaagccctgtggggcaggggcagagtggcctgtcagagggaatggcctggggactccaaggaaagtgggagaaggcagctgacctttccagcacaattccctactgtgaggaggctcctccagcccagtccctgagagaggaggggcccgttcaagggacatgcccacaggaattgctcgcaagtgacgcacaacatctcagagatagggaagaacctataaatcctctcctgccacctcatgtcatcagtggggaccatgagccaggggtggtaagagccctgggcatggagccagaacagctgggattgattcagggcctgcaaggcgcagctgggaccctgggcaaaagtcactgtatctttgggaacttggctgcctcaactggaagcgggtctcattggggcctaatgttcaaggtcgttgggagggtggaacagcacttggcgctggagagagctcagtgcagagagttgctccctgtaggacacccctggatgcctaacagtaaccatgacaacagcaaagccagcaattgcagaagccgcacccgccatccacccctgcacccaggcctcactgtcagcacgttcttacatcgccaggtcgaatccctaagttctgtgacactgtccccacttcacagcagaggatgctgagcctgggaaattaggtcaggctcaaggtcatgtgggtactgggtggcagaatcagtttcgaacctggccatctgcctccagagccgacagtctgaccgccttgcggatccgcctcagtttcctctcttctctcatctttctcttgctctgtccctcctctctcttcagggtcctgaaggaaaatcagggaagcaaggcgagaagggccgcactggagccaaggtaggtgtccccttctgacttgataggcctgcgtccctcccccgcatcccttccccacatccctcccctccctggaccctccgtcctgttgggcctggtgacagcttgtctttcctcctgttgcagggtgccaagggctatcaaggacagctgggtgagatgggcgtccctggagaccctggaccccctggcactccaggccctaaagggtcccggggcagcctgggaccaacggtgaggactctctggctggggtgggggagtcagatgtggaatagagggaaccaagggcaggaaaggagacaccaggcttctctgtgctgttatcacccaccccagctattagctgaacacctggtgctcattgccccagccacctctctgaatcatgaatcgctttggtaacctgcagaaagctgcagccccgcctccggaacagtatacaccacacagaatacttcctgcaatttgaaggggtgtgtgggtcccctgaagccctctatggacccaaattaataagccttgttattagcatcgggggagaaaggaccagattcttagaactgtttttatcaaacaaggagatttcccactggaaatagattcaggaggaatggagtgatgctgctgcaggtccctggatgactctgagggtgtcccagcattgctgggctgctctgaaggaaggggcccagagggctttgatacctccaggagatgaagaccccagggggaagccagggaaggaggctgaagagggtgacacagcagctccgatctggttgtgtgtaaggttaagcaaccaggctggtttgtggtatttgccagtttctgcggtgtaaatgctccctccatgtctggtttcaagccactgacatgacgtcactgaatgcagagtggggaggagttacacggcagccctcccttaggcagtatttccaccaacacgcacagatgcaatagaccaaaataacctcatgagtgtaggtaggaggaaaatgtagtaaaatggctaggaggagatgagttttgagtatcctctatctttgtttttaataacattaatttaactgtaagtccataaaattgaattgttaataacggctctgtttcactggcttgtaaaagtcctgaaaatttagcaatcagctgtctcgaacccctggagccaggagaaggagggctggggcaggggtggggaactccagggaggagggataatgttactggctttccgccttgttcacacactttggttatgggcggcatggatgtgccaggctgctgggcggagcggggctggagcctgcagggagactgctgtgtccccgctgtgagagccacactccataccaacgagggtctcctcctcttgtagggtgctccgggacgcatgggggcccaaggagaaccgggactggctggttatgatgtaagcagatatcacctcaccccaccccccgactctgtcctgcaggcctggaaacacaggcccatgccagcctctgccccaccacctcccagctgaaggctgacccctggaatactgaagatgtggggtctcacctgccccagggagcgctgggcccagagccgtggttggggtggaggatcatggatgggacaggtgtggttggggctgccagagcgaaatgtgccaccccaagccttcttgggtatttcctgcccagggtgggcgctctgcatgccttgtctgctgtctggggaagggaccatttctgcatccaggttggcaccttcttagacatggctgagccaaacccatgttacacatctggagaaaccagggctcagagagatatggtgcctactcagaaggggaaaccagggctcaggaggataaagagcatgcacgaggcctgaccacttcagtttggaggtgggatcctagccctggtccttgtggctctagatccagtgtctggaagaaatgcagcagggaagggaggaggaggagaggaaaagaggcgagacaagacctggaggggtgttgcgaggagcccacagtgggtgtccatacctgcaggcctagccaaagcctgggaaggtctgttgaggcaagcattttgcccctgtccctggttctggctgggagaacaaagctggttctcccgagtcacccttccaggtctgctccagggtggggcccccaaccatcccagctggaacacccctttggggtgtgtctgggaccagcacggcacatctggaaggccagggcccagacaggcacagacttactcagagccacacagccagctggggcagagctgggacccagttttgcagcccagtatccccatcttggagtccatgtcctttgtccttcctgagtcctcattctcacttccctccttcttgtttgcctgcagggacacaaaggcattgtgggaccccttggacctcctggaccaaaaggcgaaaaggtgggtgtttgctctggggaaagcagctgcaccctcgtgtctgaggctgaggtcagcttcagggccagcaggagaaagcccctggggtacccatggctggagaagcctgtgggggctcaccccctgcagcagccgaggctggtgtcactgccactgtgcccagcccgcaggagctgtcagatccacattcagcactatgtgctgggtatcatctttgtacccagcgctggaacgaaaacatgcaatccctgccctcacggggcttatagtcaagaagcagaaatggacatcaatcttgtaatgactaaaactgcgactccatcatctgtgtggacatgggaattgaagtcttgcccatgaataagatcacccagtgaagagtggggagaggatgctgagcaggagaggcttgggacagagagcaaggaaccccagtggttagtggtcaaggaaggagccaccaaggcagaggggaaggcatgttcattccccacgccttggctcaagattcagtagaggagaggaattgctggaaggatcctcgctgatccctggaccctgcccccccatgccagtggggatgtggagggccaggagtgccagaaggtccaaggtgttggtgtggtgtcacgtccaaggcaatcccaaactggccccagaacccacgtgtctaagtcctaccttcgtcgcctgagtccctcctgtctttcctcctcctcccctcccctgctggctcagctggaacgcttcgcttgccccctgcctccccagcacgcctttcttttgctgagtcagctccccactaactaaatcctgctgttggtgactcacgctggcccggcgtgctgcccagccgaccccttcctcctgctggaggaggacagctcagccatggtagacggccacccgccccagccgattccacaggaagccacagaaggtgccactcagtaccccgggtccctcctgggccctcgcagcctgccagggctggcacagaaggggttaacacagactctgaaacaaggaggccctggtgtgccccaaggcctctgcgccggagcatctgcagctctagaagcagtctctgtggctgctgagaatgggaccctaacaccaaatctgccctaaggctgcaggggccttgtgggggtccccaggattccctgagccttgagtgcctcatcaagtggtggggtccttgggaatgagaggtcaaggtgggggcagaacatgttcatcagccagatgccttttctcacttagaaggcattattagattcgttcattcctccagctctccaacaggtacttatggaggatttagtgtgttccaggccctgagctagaggatggaaatgatgcccttagaggtctcaaaaatagggcgagtcccatgaatgaacagccaccccgcaagctggacggtgctagggaggagagagcagcttcctggggtgacccattgagcacacgcccacgtgcagagttctttccctgccattcctcctgtaatcttcaccacagccccagtgcagaggtaccattgttctacaagacaggcggggaaactgagtccccataaggctcagagactagcccaggatctgtagtaagagggtggcagggccaggatttagaccccatctgtccgatgccagaccctgcttccctaaccaaaagcagacccaagataaggaagccatatgcaatttaacttgaaccgcccatccctgctcaccgtgggggtgagctcactacaaagctggtggccagagagaggggatgagactctgggacttggacagggcagggaagtatcctaccagatttctggtgctaaaaaatgatatacctaatgctaaatgacgagttaatgggtgcagcacagcaacatggcacatgtatacatatgtaacaaacctgcacgttgtgcacatgtaccctaaaacttaaagtataataataatagaattaaaaaaaaatgcatccccagactacagtcacattgcgggggatcagtatagctggctttgggccgagattgccccctgattcctgagtggccttggctaagaccttccttcctctcagtttcccatctttaagtgtggacagtagtcccagcggcatagttactgtgcagatcggatgaaacaaacctcacagagtgcctggcacatggaacacgctaggtagacacaggcaggccccttccccaaagccgtcaagtccagctgcctctatccacagtgggacttgagcactggatccaagaaccatagagagtgggcagggtcaagaaggaatccccgctccttgggccacccctctagacctcaggccaagtccctgccagccttcagcctccacccaccagaaccacagaggcccaggctggtggctgatcaccaccagcctttagaactgcctcccaccagggatgtgtcccagccccagggacgctttgcctctgtccagcctcttccggccccctttcaatccctatgaacaaaggggctcaggggtgcctggcttgagccctgtgcccaggggagtgacaccagtttctggggctggagtcttctgagccctgagattctgccatttgccgttccgcttacaccttccttgtagttgaaaggtggcgtctacacctgtcctgtgggtggaccagggcctggggtggccatggcataaggacctcacctctaaactctgttccgccccccccaccccagtctctggccatgtctatatgacacagtctcactgctgctattgttaccggctacggcaattttaacgccatctgctgagcccctgccacgtgtgcagcagcctgctgagtgcttcctgtgcctttcctcaccgagtcccctgaacagcaccgggaggcgctccagtcccgctctgcacataggaacctgtcttatggacacagcccccatgctgactggctgccaagtgccacctggggctaccatggagggtaggaggttcatcctaaagctggttcctcccagcaaggatcggagacagggactctcgggttgagggtgaaaactctgagcaggtcccatcatctctccgagcctcatctgtgaattgggataataatcgcatctgcttcacagcactgcactgcggatgtcatgagtctgcctgtgactggcccagagcagtgcccatgcgtgccagctgctggagttggtgttactccctgccgggcgtcgcgcatcattccacggagtcctcaccactccttgatgggcatcacatgctgtccccttcaccccaccccactccgctctgttctcctattccccagcagaggagagagctccgagacaggaagggaagtgttgcaggccacacggctggtcctttgcaagccgggatgtgaatccagctgtctgagctccctgacttcctgcaggatcctacagctcaagggcgtctggagggcacaaagcactgttctgtgttccacagtcctggttccacaccagcctgagtctggctcagacacacctacccttccctctctagtttgtgtccccatctgtaaccctaagcaggctagaattcatctctgacgaagcgctttccgtctggaattccccacattccccaggagcaggcggtttgccctaaagctggttctgtgtccacagggggagcagggcgaggacggcaaggctgaggggccccctgggccacctggagatcgggtaagccccctccctcccctggaccatgtggcgtcctaggtggaatctgagcctcccgctgcatggagaggggtgggccgatcaggggccaggtccctgagagctccgcagaggtcgcggccaacagggcccagggctggcatccttggcacctggtggcccaaattttgctgttgtctttgtcattcagggccctgtgggtgatcgaggagaccgcggggaaccgggagaccctgggtaccctgtaagtatcagagctcctacctgctggcaggatcgggcatgtcagggagaggggggatgacacatgtctagaaagaacaagaacttcccaggcttctgtgctgcctcccagccctctgcaggatgggcccccctcacctgtctctctttggcttccagggacaggagggtgtgcaaggcctccgtggaaagccaggccagcagggccaacccgtgagtggtgcttcgtgtcccatccctgcctcccaccctgagtggggcggagcagtgggaattaaagaactaggccctttaaagcttaaagggaccctccctgcaggagggtctggggcagccatttctgtttctcctgccctgaccctggggatgcccccagaacctgcacccccaaacccctccccacccctccccctccaggcggagactggccaccctccccgggagagaatcctggggctgccttgcgtcatctcaccttggtttgcaggggcatccgggaccccgggggtggccgggacccaaaggatcgaaaggcgcagaggtaagagggccgggggttcagcagggagactgagtcccaggaagggggaagcctgacccacagtcacacagcaaaccaaacgcaggctgcagaggctgcgaggcagggtagggaggggcggcccaccaggagcccggcaggctgcttctggccatgaccccatctcccttcaaatagcctgagtgaggagggacaatcagccccatttcactggggctccaggaggggagccaactgcctgaggccaaccagagtgacttgaacccagggctcaccacactgtagagagaaaactgggagaagtcaattgagggggtctggaggaagaggaggcagagacagggtgcttgagcaggagccacttcctgcctctgccccagggcccctgccttcccccagcccccagactgggccagtgctctcttaatgctctttccctcccccgggtgcgcccccctcacctgcctgcctcggtgatacctagtctctaaaagatccagtggaactgtggcctctggctcctcccagaaaattgtcaatgccagtgaggggacaccaaggcccagagcaggctcagtgacagccccaggaggttccaaggccagctctggccccaggcttccaggccagagtgcttgggtacatctgtggcatcagatgttcacccaggggcccacaatcctctcagtccctccttccagagcccctagggtcccacacctctaccaggcagcctccatcatgtggcccttgatttttcagggaccaaagggaaagcaaggcaaggcaggggccccaggccggaggggggtccaggtgagtgactacagctgctgtttccagccaacctccctgcccgccccccacacccgccctcctcccactccctgcaccaaatgccctcaccagctttttatgtaccccccagggcctgcaggggctgccagggccccggggcgtggtggggagacagggcctcgagggcatcgctggaccagatgggcttcctggcagggacgggcaagcaggacagcaggtgagcgggaattggcattaacagatggtggctccatttgggaccaggtgtaggggaacttccccaggccatgggccagaggagcccgtttggaaacttggatgggcagaaccaacacatccagaagttctctggggtgggcaaccatctcctcccctggcacctgggagtgtggaccttctgactgtctctcctggatgccagcacccagaaagaccttcctttcctcccctgcctggtggatagggttcctctcccgccccttcctcactcagaatcccgcccttccccactcacaatcctcagctcctcctgtcctcctggtccagccacatcacacacaggccgtctgacctccatcctggagtgtgaccccttcctccagcttcacccagggtttgcccaggcgttgagccatctgcttccttggctgtatcgtgaaacacaagagaccctcctctgcctgctttcttaacagggggagcagggagacgatggggaccctggccccatgggccctgctgggaagagaggaaatccaggtgtggccggcttacctggagcacagggacccccaggattcaaggtcagatacctcttaatacacttacccaccctctgccctttctgccttgatgcagactctagtggttccgaccctttgggcacccatgtcccagggcctgtgtgaaaatggagtccacattgttgacctttctccgtcagcagtgcttgggggtcctgccccaagcttgaaccagaatgatagttcatctggggagctgtaaatatcgcccctaccaggcccttgaaaccttcaactggtttttgagttgtccacgggcgccctctcgtggacatttgtggaacaacacgttgcttgcagccgggatccccaaggcatccttagaaagcttcccagtgccgcgtgggaggagggggcccccatgaatccgtcagagccaagggctggacactgaaggggagatgtagatgaatgactcagatgtggttcttgccctctctgagctcgaggtttaattgggggaaagattggaaccctctgagacacaggaggcggagggagcgatggccttgacccagggaagatgtgaatgagaatagaaggggaaaaggtggccacacagtggctcacacctgtaatcccagcattttggaggctgaggctggcgaatcacttgaggtcaggagttcgagaccagcccggccaacatggggaaaccccgtctctactaaaaatacaaaaattagctgggcatggtggcaggcacctgtagtcccagccactcgggaggccgaggcaggagaatcgcttgaattggggaggcagaggttgcagtgagttgagatcgcaccactgcactccagcctgggcggcagagcgagactctgtctaaaaaaataaaaataaataaataaatggggaggaggcattctacgagtgtgagctgaggtttgaaggagggaactgcatgctgttggggaaaagcaataaggaggagaggaattgtgggagaggagaggggaaggcagggcccggaatgcgagaggagagacagagaccttcctctttgggaggtgaaagtcttgtcacccctaccccaccaggcctccatttgttgccccagcattctgcaatctcgggtaccctgtggaatcactgttctggctctcccaggccccctccgcctcctcctgccttagaaccccttcccactttgactggtaattttttgtgtgtttctttaagggtgagagtgggttacccggacagctgggtccccctggcaagcgaggaacagagggcagaacggggctccctggaaaccagggggagcctgggtccaaaggccagccggtgagtgagcgccaaagaatacacatgcccacgcactcacacatgcacacactcacatacacctacatgtacaaacacatgcacactcatacacacacacaaacacactgacccagaagccacctccttgctctgtgacaaggtataaaatctgggtaccagataccattctgccacccctcaaccaggtggtgggggaggctgaggaaagagacctgagtggttccttcagaatgaggagagggtgatcacaaccagaaggtgggcgctcctgactcccagtccagtgctcattctgtgcctcactgccttcatccccctgtcccagaggctgcattcaactcacccttgcctggaaaaagaaggaagaatgaacagagaataaacagggcaaatagaaaacacacaacaaacagtttcaataccccaattaaagctgagattgtcagagtggatgaaaaagcaagacccaactacatctgctgctacaagaaatccacttcaaatataaagatataagtaggttaaagatagatatagaaaaagacatactgtgctaacattcatcccaaacagctggagtagctattttaatatcagatgaaatgaatttcagagcaaagactactaacagtcataaagaaggtattttcataatgacaaagaagccaacttttcaaaatagcataagaatcataaatgtttatgcacctaaaaatagatcttcaaaataatcaggcaaagactgataaagctacaaggagaaatagacaaattcacaattatactcaaggatttcaatatatttctctcctaatgggtagaacagaagcaaacagaagatcagtaaggatgtcttgaactgcattatcaaccaacatgacctaattgacatttatagaacaccacatccaatatcagcaagatacacattcgttataagttcattcagaacatttaccaagacagacactattttgagccttaaaatcaatcaataaattaaattataaatcaataacagagagatctgaaagatctccaaacatctggaaactaagtaacaaatgtctaaatgacccatgggtcaaagaagagaccaaaagagatgttagtattttgaattgaatgaaagtaaaaaacagcatataaaaattggtgaaatgctgttgatatatagggagatctttatagtaataacttctgtgttagaaaagaagacaggtctcaaataaatggtctcggattccgtcttaagaaactgggggttggggctggagaaggcaaatttaaaacaaagtgagcagagggaaggaaataatgaaaatcaaaaataaaccaaaaaaaaaaaaaggaaaatcaaaagttagctttttgagatctgtaaaactgataaacctcttgccagactaatcaggaaacaacaaaaacaacaaaaaggatacagaagttactagtatcagggataggggagcaatgtcactacagatatgacagaaattaaaaggctaataagggaatattataaatgattttatgacaataaatttaaagacttagatgaaatggacaaattccttgaaagacaaaactaccaaaggtcatcaagaagagactgataacctaaatagccttatatctattaaagaaattgaatctgtagttagagcttcccacaaaggaaactctgggcccagatggcttcactggtaaatgctactaaacatttacaaaagaaataataacggctgggcgcggtggcttacgcctgtaatcccaacactttgggaggccgaggtgggtggatcacgaggtcaagagtttgagaccagcctggccaaaatggtgaaaccccatctctactaacaatacaaaaaaaaaaaaaaaattagccaggcgtggtggcgcacacctgtaatcccagctactcaggaggctgaggcaggagaatcgcttgaacctgggaggcggaggttgcagtgagccaagatcgtgccattgcactccagcctgggcgacagggagagactctgtctcaaaaaaaaaaaaaaaaaaaaaagaaggaataccaattctacataacttttccagaacattgaagaggagaagaataattcccaactctttccttgaggctgattctaccctgatgtcaaagccacaccaagatattacaagaaaaggaaacaatacaccaatatgcttcataaatatagctaccacagttctcaataaaattttagttagaggaacctaagaatatataataaggataatacatcaagaccaagtggagtttatcttaggaacacaaggatggtataacatttgaaaataaatcagtataattcactatattaacagactcaaaaaagaaaacccatttgatcatctcagtagttgcaggaaaagcatttgagaaaaatctaactccacttctgataaactctcaacaaactaggtatagaagttcctcaacttgataaaggacatccatgaaaaacctagtcaacatcatacttagtagtgattgactgaatgcttttttccaaggagcagagcagaaacaagtcaaggatatctgttctcaccacttctattcaacattgtactggcaattctagccagtgcaataaggcaagaaaaacaaataggaggtattcatatcaaaaaggaagaattaaaacttttcatttgtagaggaaataatgtctatgtagaagatccattggcatccacaagaaagctactagaataagtgagtttaacaaggtcacaagacaccatatcaatatgcacaaatgaattgtgattgtatatactaggcaatatgcataaatgaattgcatttctatacactaatcaatgagcacaaatgaattgcatttctatacactaatcaatgtgcacaaatgaattgcatttctatacactagcaacaaacaattagaaatggaaatctaaaaagcaatactacttataatagcataaaaacatgaaatacttagagatacatctgacattaagtgtgcaacatatgtacactgagaactatagaacactggtaagagaaattgaggaagacttaaataaatggagatatatactgtgtgcatatttcaaaagactcaatattaagatgtcaaatttcttcaaattggtgtattgattcaacacaattccaatgtaaagcttatcgggttttcatgtagaaaatgacaagttggtcctaatatacatatgaaatataaaggacttagaataactaaaacaacattgaaagagaagagcaaagttggcagactaatggcacttgatttcaagacttattacaaatctgcagtcatcacgaaactgtggtattgccgtaaataactaacagatcaaaggaacagaatgaaaggtccagacatataccatacatatacggacaactggtttttttttgtttttttgttttttttgagatggagtttcactcttgttgcccaggctggagtgcaatggtgcaatctcagctcaccgcaacctccgcctccaggattcaagtgattctcctgcttcagcctccccagtagctgggatgcaccacgatgcccggctaattttgtatttttagtagagatggggtttctctatgttggtcaggctggtcttgaattcccaacctcaggtgatccaccacctcggcctcccaaagtgctgggattacaggcatcagccaccacacccggcctggacaactgatttttaacaaaagtgcaaagacgattcagcaaatacaaaatagtctttcctaacaaatggtgccagacaagtgatgcctcataacatgtacaaaaattagctcaacctggatcatacacctaaatgtaaaactgaaaattaaaacacttctagaacatagaaggacatcttcaagaacttggataagacaaagatttcttagatatggtaccaaaagcatgacccagaaaagaaaatgtgataaatcagacttcatcaacatttaaaacttttgctcttcaaaggacactattaagagaatgaaaagacaagccacatactggaagaaaatatttctaaatcatgtatctgattaaggatttgtatccggaacctaaaaagaactcgcaaaactcaataataaaaataagcagcccaatttttttaaatgggcagaagatttgaatagacacttcaaagaaagtatactgatagcaaataagcacatgagaaaaagattaatatcattagtcattagacaaatgctcattcaaaccacaataagatgctatggcatacctattaaaatagtgaagagttttaaaagactaaccataccaagtgttggcaaagacatggggaaactgaaactttcaaatgctgataatgggaatttaaagtggtacaatcactatggaatcagttgggcagcttctttgaaagttaagcatatccctattgtataatcaaatcattccactcatagatatttaccctacataaataaggacattcagccacatgaagactatacttgaaggtgcttagcagctttatttataatagccccaaattgaaaaaaacctcaaatgtgtatcagccggtgaatagataaagtgtggtatattttgcaatgaaatacaattcatcagtaaatggattgaactattaatatatgcaacaacataagatgattctcaaaataattaggctgagtgaaagaactcagataaaaaatagtatagactgtgtgatttcatttatataaaattatagaaaatgcaaactaatctgcattgaaagaagatagatcaatggctcctggagatgggagggtaggcaggaaagaaagattacaaaagggtgtgaggaaagtttctggggctatgggatgttattgtcttggttgttgtgacaattacaagggtgaatacagacagatatgtcaaaacaaatcagattatacaatttaaatagtatagttattatcttcagttttactttagtaagactgtttttaaaattaccccttctttgcacctgatgggtgtataggagacagccatcagagtgcaaaaatgaacagttaggacatcacgcaactggttctgtgaagccagtattatcctgataccccaaccagaaaaagatgtcacaagaaagaaatcaacagacaaatatgccttatgaatacagatacaaaaatctttaataaaatattagaaaaccaaattcagcaatatgcctaaaggagtctacaccatgacaaagtgagatttatcctagaaatgcaaagctggttcaactgttggaaatcaatcaatgtaatacaccatattaataaaataaaggacaaacattatagagtcatctcaatagatgcagaaaaagcatttgacgaaatccaacaccctttcgtgatgaaaacacaacaaactaggaacagaagggaacatcctcaacctgatagagaatatctgtgaaaatcccacaggtatcatcatatttaatggtagaggactgaacacttcccccaagatcaggagcaagccaaggatgtccactgttaccacttctattcaatattatactgaacaaaattagtagaactaataaaccaaagttgcaggatataagatcaatatacaaaaaatgtcatttctatatataacatacaaacatcaattatatgtctatacactagcaatgaacaattcaaaaatgaaattaataagacatttccatttataatagcatcaaagagaataaaataggaagaaatctaacaaaagaagtgcaagaagctgggcatggtggcatgtgcctatagtcctagctactcaggaggctgaaatgggagaatctcttgagcccaggagttcaagtccagcctgggcaacatctcaagaccccatcttaaaaaaaaaaaaaaaagtacaagatatgttcagtgaaaatttcaaaatgttgatgaaataaaagaaaacctaaataaatggaaagacatctcatattcataggtcagaagactttgtgtggttaagatggctatacttaccacaaacagagctacagattaaatataatccctatcaaaatccaagctgactttttaacgaaatctgacaaattgatcctaaaattcatatggaaatgcaagtggcccagaatagccaaaattttgatctttaaagaagatcaaagttggacaactcacacttcccaatttcaaaacttattacaaaagtatagtaatcaagacagaaataaaaccttacatttatgtctgttgtttttagcaagagtgctagggcaattgaatgggaaaagaattttttttcaataaacagtgctgagacaatcacacaatcacatatcacgtaccagagaagtaatttggacctctgcttcacaccacatgcaaaaattagctaaaaatgaagtatagaccaatgtaaaggctaaaactgtacaactgttagaaaacataaaaacacatttttataaccttgtgttaggtaatagtttcttagatatgacaccaacaaaagcgaagtacatagattggacttcatcaaaatcaaacacttttgtgcttccaaaggcaccatcaagaaagtgaaaaaactcacagtaggggagaaagtatttacgaatcatatctctgataaggaacatgtatctctaatatataaagaacccttacaactcaagaataaaaagacaatccaaatttaaaacggacaaagtattcaagtagacattttttccaaaggagatacacaaatatccaataagcattgataagacaaatgaaaaccaccaagagaaccaccaatagctcaataaagctattatcttttaaaaatgaacaggtagaatttagattaaatgggaccctcccgaagcctgacccctcagcctacctccatcagcactgggtcttgacctgcctggtctcattgcatccttccagccccttgggagggagatgacgtattatcctattttacagatgaggaaactgaggctcagtaaagggaggtgacttgctcctggtcttataatataaggctaggagattctaatacatggctttctgcttatgagcttgaaggccaagccccaagaatgtgtaataatggcaggctcttctgcctccaggggcccccagccctcccttcttggctcagaccccagcatgcccccttgccaattgctctcctaaccctttacaagattgggagcagaggtcaggaaaggaggccaaaggttcctggaatcgttcacactgggtttgaatctagcacagtccacaacatggtgtctgcgtgacttttagcaagttcctgccctctctgagcctgtttcctcatctgtaaacaggggatatggtgtgtccctgggttgatgtgggagcatggaagtgtggcggtccaggcaaaacatccggcacctaacaggccctcagtgaactgggttatttttagtttttaggggaatccttccttaacagagcttttcagagctgtgggaggaggctgcaggcccttttattctgtcccttgaagacctgggacaggagctcctgagtgtggcagagcctcctctgtggaatccctgagccgggctcctctttctcatctgacggagagcacaggctcccctcagagcccaggcggactggcatctagtttgtgagctgttcacactcacttggtcgcttcacagaggagtcactgatatccctggaaaggctgggagggaaaaggcaggccctgaggtcccaggtggctggcgggacacgctgaccatgagctcactcgctccatcacttcctgttcttcctgcagggcgactctggcgagatgggcttcccaggaatggcaggtctcttcggacccaaggtatggactcccacggctcactgttcctgtggggtcccatccattcaccccattcattcatttattcattcaacaaatatttatggagcactgaaaacattggctggaaaacagccagaatcaggcatgaacaccctcatcccccagtactccagaagatctaggttccaagcccagctacacaattacctgctctgtgccttgcaaagtcacttagtctctctaagccttggtttcctcatctgtaaaatgggagcaatgacagtagaagactgttgcaaaaataaagaccaggggcatatgccacacagcactgagccaacacactgctggtacctgctgaataattgtaggtgtttcttactccttctggggcctctcaggtaaggcctctcttgacaagaagggcaaaggttgacagaccccaggggtgagggagctgtgggggccctttacccagtggctgccaagtacagacagccctttctctgcctcccacagggcccgcctggagacattggcttcaaaggcatccagggccctcgggggccacctggcttgatggtgagttccctccctgctgtcggagcagagatgattgtcctaggcccaaggttggccagccatcagctggcctgtcttcatcctcctcttgctccttgactcatgagccctttctgcccacaggcctggttcccaccttcactcctgccgttcccaccagctcagcccccatccttccccgctttcactcttgcccccatcgccccactcttgaagtccacccctaggcacaaatgaggggctcaggagatgcatggcctgggcccgcttcagatggtctcccttctactcccttgcgacgctcgggctgccctccaccccgctccccgtgtctgttccccaggccctggaacaaggacacatgagcctttctgtctcctttagggaaaggaaggcatcgtcgggcccctcggaatcctgggaccttcgggactcccggtatgtgtggggattggacaggaagactccggggtccccttgccttcctggctccagattgtctctgtgactcagtgccagtctgagcctcagtttcctcatctggaaatggggcttcacctctgggccctgtctcactgggccgtggtttgttgcagggtccgaagggtgacaaaggcagccgtggggactgggtaagtggatgggctggggctgagggatgcagcactgcaggggcgggggaggggtgggctcccagagttgggccatggctcagccaggttccctaactctctcccctgcttctgtctccctccagggattgcaaggtccgagggtgagtgggctgggcatgagggctgtggggcggggcgtggggcgggcaccctgcattctcctcccggtggtacattctctccctccggacctccgtcatcccgtctgtgccagaggaaccattgtccctgggtcccaggtctgcttgaggagggactgggttggggagagatgaagaccctgtggaccagggctcactcttcttctcttgttcccccagggtcctcccggccccagagggcggcccggccccccggtaggtaactgagtgctgggtgcatcttggactcctggggggttcctttgaaggagattcaaggcttcaccggcagactaagccttgaccctgaaccccacaggggttcttgtagcccacagactcctaggagagtatagggcatcccccgaacattcacttttgcctacgtggggtaacacctaggggccaggcctccagaaaagcatagaccagcccactggggcccaccaagcctccgggaaagcagaggccagcttggcaggtcctgcatgctttgatggtctccctggtctcctgacaccctctcagattccagcacactgtccctgtcatttgactgacccgcagtcttcttttgcagggtcctccagggggtcctatccaattggtaagttggaaaccttctcttttgcctacttggggtaaggcctgaggggtttgggggaagaggctgctggccctctctggccctggtggctagagccctaagctgggtctagggacgcccatgtccttttgtcacttcatactggagacttggacccggaagcaacagaacgagccctgggccaggaggcaggaaacctaagtttttgagttgcctctgactgaatccgggaagatgctccagccaccgggttcatggccctatctgtgtactccatacacgtgggctgattgcaagggtctgtacatctcagattctgaatccaaagagagttggggccgggcgcagtggctcatgcctgtaatcccagcactttgggagttcgaggcgagcagatcacctgaggtcaggagttcgagaccaacctgaccaacatggtgaaaccctgtctctactaaaaatacttaagtagttgggtgtggtgggtggcacctgtaatcccagctacaggagaggttgaacccgggaggaggaggctgcagtgagccaagatcgagccactgcactccagcctgggaaacagaccaagactctgtctcaaaaagaaacaaaaaaaacaaaaaaaaaaaaaaacaaagagagtcgggccaggggggcagattggggcccctgcattcttccctattggccactgtggccctatctgagagcatgactcctcccaagccctatgacgagtccatccacattgtactattgcacggtggctacacgactattaccatcaggccccaacagcatcccagggcacagcctcgaggaaagactgaatgggccaggagcccttgagccatgcgtcattcagaacctctgctctcctcatgcctgctctcactgccactccctctgcaccatcctcaaagacagagtgacagccctggcctctcctctgcagccttcccttgtccttctcatcagtaagaaaggcagggaaaggaaagtgaaaagatccaggaaaaacagaaaattagaggattttgcatttttttgaataatcactactaatgctaattgagtgcttgctcaatgccagacaccattacaggtgctttgcttttctttttttttcttttcttttttttttttttgagacacagtcttgctctgtctcccaggctggagtgcagtggcacgatctcatctcactgcaacctcctcctcccaggttcaagcaattctcctgcctcagcctcctgaatagctgggattataggcgcgaaccaccacgcacagctaatttttgtatttttagtagagatgggttttcaccatgttggccaggctggttttgaactcctgacctcaagccatacacccgcctcggcctcccaaagtgctgggattacaggggtgagccaccgtggccgggctacaggtgcttttcatgtattcactcatgtgttcctttcagcagttcttgtgaggaagttttattatcaggtccattttcaagatgaaagaactgagaaagagttaagcagctttccccagattatgcagttagtaagtggcaggtctggaatttgaccctgaggagtagccccagagtcccccgttctggaccccaggcctcagcttttgctgttttcatggcaagaccacggctatgtctctgccaagcccagtggtagggttgggagtgcaaagttatattagactattaaagtgcgagccaaaggagaaacacggggactgggggcatagagaaagggggcctccctcatcttagcctggagtcagaagcttcgggagaggcttcccatcacaactgacatctataggatgagtctagggcaggttttctgagacacagtgcaactgacatttgcataattctttgctgtgagtgactgtcctggaggatgtttagcagaattcctggcctctaaccaccagatacaagtagtaccccctcccccggcttgaacaactaaactgtctccagatattgccaaatatcccctggggggcattgtcgcctctccttgagaaccactggtataggagatagccagatggtgcattgaagggagggagaggtcctccaggcaatgagaacagcatgtgcaaaggccccatggccagatggatcatggcgtttaggaacttagaagtactatagtgcggctggtgccagagcacatatgagggagaggaaggagacatggctcaagaccacagtgttcaaactgggtcttataaccatgttgaggagtctgaacttaatcctgagggccatggggagctattagtacctggggaaagggaatggcagggtcagctttgactgtctgcaaagagaggaaggaccgagagttctgcagagggcatatgacttggccaagatcctgccagggaatgtggccctggggctcccacttgatgggtgtggagaaccctggggggccacgatacataccctgtcttttccttgcccagcaacaagatgatcttggggcagctttccagacgtggatggacaccagtggagcactcaggccagaggtatctccaggggctctccccatgtgggatcccttcctgggagaaacgcaaatagataatggcccacatgtggtcagtgccttccatgtggcctgcatggagcatttcagagtcctggtcttggtggcatctcgcatccacaaatgggggtttgtactgaaactcagaatgggcagtgagtccaaggtcccatggccagtgcaggcagagcaaggccagaaacaggccctgaacccttgagctttctccggaggcctctcagagtctccaagctcttgctggctggagtcagggggagaagcttgcctgggcccagagcccgcagcagcttcccagtgctcatccccacgtttcttcaggagtaagaagctcatggttagctcgtggggctctgctaagaacctgccctgtggttaactcagctgtaagactccaggctgagaagggagtcccatgtcctctagtccagcctcggtcaggagccccctttgcagccttgcctccttcacatgacagggaacttactgcccccagctcaaacctcctatgaacatttcggtttgttccctgtgctggatgctgagacagatggatggccagtcacagccttgactttcagagggctcacagtctagggtggaggacagcatggatgagccccttaccatctgtccggggaggtcagtggaaagagaggggaacactcaggatccagtgcggctggagaagggaagcgtttccttccatccctagaagccagtgatgccgcacaggagagcgctgacctgcaacatccttaacatgatgaaggaaagtggctccgtttatcaagcacctcctacccactctgcattggcggtagaatagaggcttatttctcgtgcacgtaaaagttaattggcttgttgatgagagaccttggctacctgccaggggctctgccctcttcctctcccacacgtggctcccaaggtcactccacaccagggggaggcaccaccggggaaagagagtgtagagaattgtgcaggagggtctctgggccaggcctctatggggctagcatcgctccacttccatcccgttggctagagcacaaataaggctgaagatgtagtctgtccaggcagaagaaatggattgggtgagcggctgctggtctctgacacacgttcacacatgcgtgcacacacacacgtgacctccgccacccccagtggaaggagggtttatttagctctgatttgtagctctggaagctgaggcttaagggagaattctggccagggtaaccctgaatggccggctgtttagcatctgtggtcccctcctgccccctagtggagatctgctccttctctgagctgaagtcctcctcccagcacttgtgcctgctggccccagtcccgtctcctggtgcctcacagagaccctggctcccaccctaggggagcccagtgggggctgtgtgacccccaagtcagctccccccagcacctccccttcctccacaggctctttgcagatagagattgggccgctgccgagtgtcccacgcaccctcgcctacctcattcacggggctctgcctgtcccatatcagagaacatggtctgaccctgagctcttttcaagcctctgagccattgtgatagcctctcctcctgcactttgtccctggcccgttttcttgtctgcaaaataaagagaaacccaacccgtgctctagccatgaccgtggaaccgagatacctcccaggttgtgagaactgggggctgtggaggcttgaaccccaggctggaccaggaccctaaggtcccaatgaccaccctctcctcgtgacagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtgagaaggcttcctgccgggggtgggtgcgcctggcggtggggagctggggcaggtggagtatttgatttccgccgcattttggctgagtttttgtcctcagcaagacagatacactggcagtcatttattcactcagcagtcacagagcctcacaatataccaagatccgcatgctggggatgaccatttcagtgcaaagagacaagagctctggcagaaaaagctcctgaggctgtaagagtccccacccctggggcccatcctgtcacaggctcccgggtgagccaggattttccccctttctgagcatgaggactctgctctctcatctgtgagctgatgtggtgctgtgaaggacaagctgcggagccagacagacctgagttccaatgtcagttctgcctcagacttggtctgtgagctggggcaagccacggccccatcccgagctgcccttgcctcctctgcacaagcggctgggactagatggctggttgttccactcttgagctgcaaaggttttggcttcctgagaagcccagtggggaagctagatgtaagcagcagcgctggctgatggggtgggagacctgactcctaccctcccccggcaggccctaggaggagccctaggcctcgaagaatccattcaactaggtgatcccccaaacccttgtgcaagtgacccagcctctctcaatgtcagttgtcttctctgtaaaatggatacatcccagtagcaacataggcaagtacttagccatgtgacccctcctctgggggctctgccagttgtgagctctgcccagaaggtttccttccatctcggttggaggaatcccttttctgctcacccaccctgacttcatgctcacctggggctcggcaggtcacaagatgcagggtccatctacagaaccaaggaatgggctcatcccccagatacatacatcacctccatcccacgctgcctgcaggtacctactgggtggatccaaaccttggctgctcctctgacaccatcgaggtctcctgcaacttcactcatggtggacagacgtgtctcaagcccatcacggcctccaaggtacccatcagctcccacactgcccaccaggctgtctgcctctatccccagcctgccctgggccacaaccaacccaggttctgttctgagctgtgcctgtcttactgcatgcccttgggaaagttatcgcctccttccgagactcagtttccttatctataaattgggagtgagtaggactaatttgtaaccacaaaccctttcgagtcatatgatgctgatgattctttcttcaaatagaatcttctgcctaatatctaaagcagagcagttggccaagctggcctggcttgtggaactatgaatcatcagcatgaaataaaagagaaaactagcatgatgctcatctgaagcatgttgtgtgaattatgtatgcgaatacttaactcatgttcaatgcctgcgtaccacgtgcctgtttctgggttgagcattttaggtggtacagggccactcaacaacaaaccaaggcaggtggcagcatgagacctgacagctccctcgcccagggatcctcagtggattgtgggtctgtagttccactaagccttccgaatttgggggcaatttatgccacagtgagaagctgctccgactgcgggggaaaggaaccctcccatttcatcagccacatcccctaggagatgccttgtgctgactgggtcagactggcagtttgagaatctctaggagaggcagccagccagtagccaggtctttgttgggtccctatcatgtgccaggccctgagccaggacggggaggtcagactcgaaactcccctgcggccagagctcacagtccagcagggacttggtgacctccacaggctctcttccctggtgactcgaaggttttgggatcacgcagcaaacctgcctagcagaggggtgaggctggagttggcgcctgggttggtggcatgaatgcccaactgggtcaccttctccatcagaaacaatggcagggagaggccctggctctgtgtgggaaagtgctgaagccacaaatcctgccgtgttgtttgctctcaggtctgccatttccggcagcaccccatcgcacctcacagggatcttgggacttaggaagggtctcgaaaacacctctcatttcctctgcattccatgagcctcttagtcttgggcaaaaccctctccctcgctgagctcctggatcctagctcagcccaaagaccccccatacagtaagggagtggatcagatggcaccaagatctttgaagctctggctctggagtcaggcaggcccttcccacttacgcagccaagaacctgtaagaccagctcacgcagacctcagtttccccgtctatcaagtgggcacatgtctgggagcatatcaggaaatgcttgccaggaaggggcctatccctgttccctccatagagaggcagggaaccctcggtgtggggggtgtggggggcagcctgagccgctcactgccgttgcttctctataggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtaactctcagagcccctcctaggcccttcatgtggggacaactggaaaaacacttgtttggaaaaatgtgtttctattataagattatatctaacattttaatagtatactatattaatgtgatagatatgatttcatctttgtgtaatataacagttttctaaaatcgtttttactcactttcctctctgggaagctatgaggggaggtctgggctggtaaaaattctttgggctagtagatgttgtacttacttgcaaggctctttcaaagaagatacatttcttcttcctgctcccaccctagtcaggctaatttcttctcattatattttttggtcattttcaaatgtcctgaacagggtgggttgtcaggggaggggaagacagaaagttgagaaaaggcaaaaatcagttttataagactaaacaaaactaataatactacacagtgttcatgaggatgtggggaaaccaacaatctcgcatgaagctgttggaagaaaataaattggtagaggctttctggatagcagctctaatatatatccaaaaccttagaaatgtacttattttcaggggagctaagctatgaagacacaaaggcataagaatggtacaacggaatttgaggacttagggaaaagggtgggagaggggtgagaggtaaaagactacacattgggtaccgtgtacactaaagaacttattcatgtacccaaaccccacctgttccccaaaaacttattgaaaaaataaattaaaaaatatatatatatgtatatgagatgtacttgttttttggtctagcaatctagaacaatccttctagaatttgttctagggaaataagaatgcacacaaaggtttagttacagtgatgttcatgacagcattccttacaagaataaaaagagtggaagcaatctaaatgtgccatataggtcattgctacaatgaaatacagtatagccattaaaaattgtgaggaaagatggaagggaaaatgctcatgatgtatgataagaatcacgatggatgtacgtgtgcacttttccttctgccttcaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaatgacacgcctgtggtcccgtgctgcttctcaaagctcaggggggcagtttctggctgggctgggatagggagtgggaggagatgctcagaggatgtcctccttacgctgtaacaaataccacaaacttggtggctgcaaacaacacagaaccgtctctctcgcagttctggaggccagaagttcacacaggcagtgttggcagggccacactccctccaaagcctcaaggggaggatctttccttgcctcttcccgctcctggtagccccagtcattccttggcttgcagctgcagcacttcggtctgtgtccctgtggtgacacgtgttctgatgtgtctctctgctccatcttctctttatgaggaccccagtcatattggattagagcccacactcatgaccccaccttaacttactttcatctgcaaaggccttatctccaaatgaggtcacattcactggtgcagggggttaggacatatcttttggggggacacgattcaactcctaacacacagggaggaggtacactgaggttaacatgagcaatttgtttttattattattgtggttaattacacataacataaaatttgccactggtgatagtacattcagaatggtgtgcaacgttaccatgatctaatttcgtattattttcatcacccctaaaggaaacctgtacccattttagcagtcccaccctcccccaacccctggaaaatcaccagcctgctttctgtgtccacggctctgcctactccagacattttatattacattggtgccaaagtaattgcggtttttgtcattacttctaaatggcaaaaaccgcaattactttggcaccgacctaatacaagtggaatcatacagtatgtggccttttgtgaccccggcctctttcactcagcgtgatgttttcaagattcatctgtgtcgtaacgtgtatcagtacttcattctttttatggttgaatgtactccattgcatggataaaccacattttgtttacctactcataagctgatggatatttgagccaaactggtggacatttgggctgtttctacctttggctattgtgaataatgcttcaaaaggagtgatccctgcctgtcacattcttgagagaagtcacaatagtacctgccacggaagaagtgagtgggtgtgagtctgggagatggcgttgccagacttaaaaaataaaactataggatgcccagatcaatttgaatttcagataaacaatagctattttttagtacaagtatgctccatgcaattttgaggaaatgcttatgctagaaatctttttatttgttatttatctgaaatttatacgtatctgagtatcctggcctggagcccacatttcctgacccttgtttcagatctctttcttcctcagcttattcctccttccctgggacaatgaataatcagaacttttctgccattctcattgaggagaaagagcacatcactaacagttgagtttatacccaggattttatattttaaaaacttgcagccgggcgcggtggctcacgcctgtaatcccagcactttgggaggccgaggtgggcggatcacgaggtcaggagatcgagaccatcctggctaacacagtgaaaccccgcctctactaaaaatagaaaaaaaattagctgggtgtggtggcgggtgcctgtagtcccagctacccaggaggctgaggcaggagaatggtgtgaacctgggaggcggagcttgcagtgagctgagatggcgccactgcactccatattaagggatttattatatgaaattggctcatgcaatgatggaagctgacaaatcttaagattggctgctggcagctttgagacccaggaaaacccaacggttcagttcaagtccaaaggcagggaaaaaacctgtcccagcttgaaggcagtcaggcagaaggaattcgctcgtactcagcctgtttgttctattcaggccttcaactgattggatgaagcccagccacattggggagggccatctgctttactcagtctcccatgggattacccaaatgttaatcccatccaaaaacaccttcacagacacacccagaatagtgtttggccaaatatctgggcaccctgtggcccagtcaaggtgatacataaaattaaccatcacactcctcaagctgaggttgaaagagaaggaatagaagtgagccagatggggaagggcacttggggtagagggaacagtgcctgccaaggcccagaggtaaaggtagcactttgcatttgggaacggtaagtgttcccatgtggggctgcaggaaagggtgaggaagcctgcggtatggagctgggaacatgacaagtcacaggtttgcacagatgagcagaggtctgagttggcaagttgggtttgactgccatggggccctggagcagagccatccaggaggcagctgcctgcgctgcgaggaaaggagagaggtctgcactgcactcagagctctggaggcatcagcagtttctgctaggcctggaagacatgggtagagattgaaaaagccagccagaagggccagagggggaaagcaagaagagccatgttagaactgtgacactcacgactctcggcctggtctccaatcccaggtgggccagtgaggatgctggagctgggccagctcattcccagcaggggcagataggaggttgttggggacagaaggaaacttttcctaaactggcagtacccacagttcccaatctcctgttgcacaactgagtgtcaggaaacagtcaggtggacttcccaggctgggccaactccaggggaaagcccaggccagcctgtttgccctgttcacaatgaatcaaaccctagctatggtcacaacccataatggccggcagcccaggattggaaaaatgaggaaaagaagagcgagaaaaagagaggctggcaggcagattccagttcctgactgggacatggccctgggtaggtcattctttctctctaggcctcagtttctctctctgcaaaatggggccgatatgctctgcctttcttgccagccacagaaaggactattgttcaataatagtagagtgaacggtatgaaatagaataatatccaatgcttttggacctgcaaaacccagtttcatatggttcaacccaagaatagcaccattcagaagaataatggctacaatttcttgtgcatggacggcacaccaggtggcatgctcggtgcgatctcatgcgcatgtgcatgtgatcccacattttcatctcatacacaatctcgtgggacacatgttgtaaccctggcttttcagatgaggaaactgaagttcaaagaggtttcttaagttgcccaagatcacaaaacaggatttgaacttgagaaaatctttttgggtctttcctcagcccagtcacagagttccccatgaggacaatttgctcagcctatgtattctcatgtggaagcaggtcacaggttggtcttacacagaccttggctctggccttgatgaagaagggtggaatgtgactttttcaggaaatgaagtgtttcaaacaggtgcatttccctgatgacttccagctcacctgctgtgtgacgtttcccacactgcctcgcctctctgggccacttttttcctcatctatataatggggggaatgtcttattttcttgagcctaggatagacacgttttcatgttttgatatctttaaaagagagatgtagcttgcaatcactgaagtacatatgcaatgcagaaatttttcttccctcctcaccccagcttgtctgggggatggttaaactgacagcgatagttattataatcagaagacccttaggagcaaatttattttatttaacaagcattttatgggtgtggtagctcatgcctgtaaacccagcactttgggaggctgaagtgggaggatcacttgagcccgggagttcgagaccagcctgggcaacatagtgagacctcccatccctaccaaaaaattttaagaactttaaaaaaccaagcattacaactatgtaccaatttaatcttcataacaacccaatgaagtaggtaccactattattctcattttacaggtagagatactgaggcacagagaagttcaccaacttgcgcttcaccaccagcctgtactgcctgccctgaggccttttctctctcttttgttcctgcctaacttcttttgacatcctgccagggccagatggaggatagggccagacgagctagaaggactacttaaagcctcagtctttagaggcattcatgcatacctgaaatgttaggagacagagaaaattgtactgtggtagggtaggtgccagatgagcttggaggaattacttggatagtctaaggtggagagtgagacccccaagcggcagcctgagggacagtgaggacactgaagaccacttactcctgccaaggagaggcactcggaagcgcctctgtactgcattcacagtgcacagctccgctttgaatggtggtagctctccttattcacccttcccctacacaggctgcgcctgggatctctacactcgagcagacggagaccccagaccccattggcctaagtgcctgaacgttataaatcaaaagtattttaaatgaagctgacatgtttacatttaagttttagaaatttaattaattatcccagcactttgggaggctgaggcgggtggatcacaaggtcaggagatcgagaccatcctggctaacccggtgaaaccctgtctctactaaaaaaatacaaaaaaatattagccgggcatggtggcgggcgcctgtattcccagctactcaggaggctgaggcaggagaatggcgtgaacccaggaggtggagcttgcagtgagctgagattgtgccactgcactccagcctgggcaacagagcgagactctgtctcgaaaaaaaaaaaaaaagaaatttaattaattaattaaatcatgtccaaaagatttgtacaactgaaaattattcacgaggctagcatgcagcctctacatgcccatgtcaagaaccagattcaattgtcctgatgcagtgactcacaactgtaatcccagcactttgggaggtcgaggcaggcagatcatttgaggtcaggagtttgagacgagcctggccaacatgatgaaaccccgtctgtactaaaaatacaaaaattagccaggtgtggtggcaggcgcctgtaatcccagttattcaggaggctgaggccggagaatttcttgaacctgggagatggaggttgcagtaagccaagattgtgccactgcactccaacctgggtgacagagccagactctgtctcaagaaaataaagagaaaaagaactagattcaggctgtatgtgggcaccatctacagacatcagacacacacatttaggagtaataatgatgcaatattgccaaatgtttctcagcaaccatgtgcaactgttgcatgtactgtttatttctaactcaggaggatctctctaaccacacattgcaagaaaatagactttcagtgtttctggcaaaacaaagagtttttttgttggcatttatgctgaaagggaagagttaaaatgttaatttgtcttttttcttacctccaagttcactcaaatcctctcttgaagcagtgtctgtctcctatgtctgcggtggcatcatccacgaagtatcaggacatttgacctgttgttttcagagtcgagtgccacatgtagagattgtttcctggggcctaaacagtgttggttgtgaaagagaataatcagtgatgtgggtcccactgtgccagtaccaggcaccagatcccaaaggacagaggtgcttatctgttatttaataaactgttgtgtgtgggtgggtgtgtgggtgggtgtgatatgtggggctctctaaatccctgggccccaatagtccaggtctaatggtggtgctgtccccaacaatgctcagcttctcctcaaaatacatggtatctgggctgggcacggtggcttacacctgaaatcccagcactttggaaggccgaggcgggtggatcacttgaggtcaggagttcaagatcagcctggccaacatggcgaaaccctgtccgtaccaaaaatacaaaagaaattagccaggtgtggtagtgacacctgtaatcccagctactagggaggctggataggagaattgctggaactcgggaggcggaggctgcagtgaactgagatcgtgccactgcactccagcctgggcgacagagtgaaaccttgtctcagatagatagatagatagatgatagatagatagatagatagatagatagatagatagatgatagatagatgatagatagattagatagatagatagatagatagatagatagagatagatgatagatgataggtaggtagatagatgatagatagatagatagatagatagataggtagatagatgatagatagatagatgttagatagatgaatggtatctggagtctgtccccatcatctcacccctggaccactgcatcagctccagctggtttctcaggtttaatctccttccctagccctccccattcttcccattcagacagagcgatctttctgaagaaccaatctggttatgcctttccaacccctttgaaatctttccatttctctcctacacctcctaagtctagcgaacccctcagcctggcttccatgccctgcaggctccatctcctgccaacctcttcaacataaagtctggccactcccacttatcatgtgctccagctgcacagactttccagctccctgatacacccactctctcacctgcgctcttccctcttgataactccaatcattgtttcaagcctcaaattagagcaatgcaaattcaagaaacaaaccaagctggcaaaaacacaaaaaagaaaggaaaaaaaaagggtcatttctgttctgacaaggatggggataaggagactcacttgtacactgccaaactgacattcaaaatccttagtgcttttggatttgtcatgtttgggaggagggtttttaaatcatcggctttcttgaggttgaataaataaaagaaaatgcacacattttaggtttactgttcaattagtttttacaactatacgtgtgtgtgtataatggccaccacgatgacaacctggatcgttgtcatccacttcagtgttctctcatatgcttttgcagtcaaattgccctcttttgcccttggcaaccactgatctgatttctaaaattatagatttgtttgagctgttctagaacagaaccgtacagtatataagctcctttgtatctggcttcttttgttcagcatagtgtttttgagattcatccatggtgttatatgtatcaatagtttaactatttttattgttaagtaatattcctttgtaagaaaatgccacatttttatttaccattttcctgttgatgggcatttggattgtttctttctttttttttggtttttgtttttgcttttgtttttgttttttagacagtcttgctctgtcaccaggctggagtgcagtggcacgatctcggctaactgcaagctccacctcccaggtttgagcgattctcctgcctcagcctcctgagtagctggtactacaggcgcatgccaccacactcagctaatttttgtatttttagtagagacggagtttctccatgttggccaggcttgtctcgatctcttgaccttgtgatccgcccacctcggcctcccaaagtgctgggattacaggcgtgagccgtggtgccccacccttggattatttctaattttggctattttgagcaatgctgttatgaacattaatatgtaagactttgtgcatagcacgtggtttcctttcccttggatactaaggtaattttaaaagggaaattggctgctctctgacacttatcatcagaggaaaaatcacaatatgaaatgctgttagataggctgggagtggtggctcacgcctataatccagcactttgggaggctgaggcaggaggatcacttgaggccagaagttcaagaccagtctgggcaacatagtgagactctgtctctac

SEQ ID NO: 258 - DNA, 32807 bp, Homo sapiens
aagaatatcataagtacgagaaaatgcatttactatttattaagtggaagtggatcatcatgaaggtctttctcttttttttttttttttttttgagacatagtctcactctgttgcccaggctggaatgcagtggagtgatctcagttcactgcaacctcctcctccctggttcaagcaattctcctgcctcagcctcctgagtagctgggattacaggtgcccacgaccatgccccgctaattttttgtatttgtagtagagacggaggtttcaccatgttggccaggttggtctcaaactcctgaattcaggtcatcctcctgcctcagcctcccaaagtgctgggattataggcatgagccactgtgcctggccatcacaaaggtcttcatcctcattgtcttcacattgagtaggctgaggagaaggaagaggagggttgctcttgccatctcaggggtggcacaggtagaagaaaatccatgcataagtggacccatgcagttcaaactcatgttgctcaagggtcaactatagttatatataacctactaaatattgctattgatagccaagcccctttaattggaaaaagaaccttttttgctttaatgggggtgtcttacatttgtgtgtcattttcacatattaatatattgtattttttaaatttatttttgagacagggttttactgtcactcaggctagagtgcagtggtgcagtcatagctcactgcagccttaaattcctggggccaagctaccctgtcgtctcagccacttgagtagctgggactacgggtgcacacaccacaatgcccggccaatgttttaatttttttttagtagagataggggtctccctgtgttgcccaggctggtcttgaactcctggccttcacggatcctcccacctcggccttccaaagtgctgagattacagatatgagccaccatgcccagccatattgtctttttaatcttgatgactcagtaaggttgtcaatattggtgtaccgtttccattttatttatttatttatttaaattaaaaaaaaaaaatttttgagatggagttttgctcttgttgcccaggctggagtgcaatgccgcgatctcggctcactgcaacctccgcctcccaggtccaagcgattctcctgcctcagcctcctaagtagccggaattacaggccccccacaccacaaccggctaattttttgtatttttagtagagatggggtttcaccatgttggccaggctggtctcaaactccggctgccccagcttcccaaagtgctgggattacaagagttagccaccatgcccagccagtttccattttgtagtttaggaaacttaaaattaagttatttttctaaggtcacaaagctggtagaatcaaaactaaaactcaagttttctgggtgctggttcacagtagtggaagaacatgagctttagaacaggttagacctaggttcaaattccaaattccatctactagctggctgtatgttttgaacaagttaataaatatctgaaatcttttgtcccacattggctaacaatgcctactgtactgtcttgttggaggaatgagtaagatgatgtaggttatgtgcctagtatatagaaggtgttgggaaatgttacatcacagagaggaggagaggactgtaaaatgtttgctggcaactgctctgggaaaaatccttccaggaatgattggaacccagcatggggaatggggtcactgtcttggtggaaagggtgggagatgaagaggaggaaagaggaggtggtgtggacaagccctcctatggggaggtgagggaggccccacattcccagaatagggacctgtgtgcttcctctttttatccctccaaagttcttgagcactaggtcagaatttaatgcacctgcctctcattcgttatgaatagacagttgcaattcctgggactgttggaggtgatgggtttattctcagaaatcttaaaaaggcattttctgggcacctgagcaaacacaaaattatcctgtggaatgagcaagcttcgaacgctgagaccctggggcatctgaaggaccagctaataaccatgtgctaagcagtgtgtattcctaagttcctcagctctgctttttaaaaccccccaccccccgtgctctgacttgaccaaatggtcttccctcagtggggtgtgtggaaagcagctgctatgggaatgcacaaacctgggatctgctctcagctttgtcctttacttgctgtgtgactttgaccaaatcacttcccctctctgggcctgggtgtcctcagctatacaatgaagaagctgaactagatggtctccacaagatgtcttccagctggaaattaaattttcgtataatgattcctgcttctccagtgcccctttctctttcagctccactagctgttacctccccacagggttgtgctgtgtgctgcctctgggccacatcccaggcatgcagtgatggcccatgtccagggttccttccctatgagggtctggctcctggcctgcagggtctgccaagacaccctgacttcatgcagattacatttttgtcttttctaaaagtgaaagacgaaaaggttgcctgagtttgcccagggtggagacagcctgacctggagtcctcacagagcccatcctggcccctgggaatccactggaacaggcctgcaacccctcgcctcaggattaaacctgagggcccacttctggggactgaaggtcaggaacctgtgagtctcagcattagcccttgacagccccttagaagggtcaccagctttaagggaaggaagagtgcttatcaggacaaagaggggccctcagttccagcagggccagctggtctggcccaagacaggaggattaaacagaattcttggatgttcaatgcggctccatggggacctctagcggctgttttgtcgaactgcggtctccagccttcccagcctcaggacattccacacctggatggatactaagtaataccaataaccaacatctatcctaggcagcgtccctgattcacagaggggaacctcttgaggagcacttgcctaaggccacctggctaagtggttgagcaggaatttgaacgctgccgcttgacttcagagttcatactgcctgccctcaaagatgtgagtgtgctcctcatgaaaacctggtgttttccagcacatggcacttgccaattctatacgatgcacctctaaaacaagtgagaagacatctcttcaaaggacccatgtgccaccagcagttgaggggtcaccggattcttggagacagagctaggttgaagggatgggtctgacacgtgtaaacttgcccaaggtaaccatttgcgaatccaacctcctccacgaaataaaaataaagagtgtcctgcctatctctagggcttgttgcaagagttagctgaaacgccacgattgaacatattttataaaattaagtaatttgacgattataacttttatttttgtgaaaacaacctgtagttaccaaccgatatttgaagctaaagaaaaaaaatgcaaccagtatttatggaatgtttgatatattggatagtgttctgtgtactttttacgtattagctcgaactttttcctacaaaccagggaggcaggtcctatttttattctccattttactgatgaaaaccctgcagcccacacaggggaggcaccttgtccatgatgaaatagtgatggaacgaggatgtgttcctatgcagccccactgcagagccactgtgcttgattttgacacttactctgctgttcttcaaggatacattccagtctcccagagaggatgcaatgaggacccccagagcttgaggatgcctcttctactggccctaacaaggatcactgctgtgtcaggcactgtgctaagtgatttgtggacatttttgctaatctgtactcccacctgtgaagtattgcccttgctttacagatggggtctaaggctctgagaagtagaatgatttgcccagggccacgtgcagcaagtgcacaactagctcagaacccagtgctctcgcagccgaaccgctcctaacctccgctatactgctcctgcttggctgctccccccatccatccaccggtggggccccccacagcccagggctcccttgggctctgttcacactctttttgccctctctgggattccatgcataggaagcaaaaacttctaaagtaagaaatggcccgaaagccaggtgccaccaacccataaagtgtcatttttaggaaagatgccctttggggtgatgctgctcacaccaggacaaaggcatgagctcaggctgggtttcagcccctgcttccctgtcagctggggcctttgtgcaggatacaacctgcaaaagcgtgtcgtaaaaccacagtccagagcaggaatggactagaaaccattgaggataaatcttcttgcgtgggtgggcctgggagttatcaaaggaggaaaggtttgggatgaacaaagcagccttatcatttattctcttccaaacacaattactataagctgaattgttttcccccaaattcatatgttgaagccataacccaccctatgattgtatcgggaggtagagtctttaggaggtagttaaggttaggtgaggttggaaggttggggccctgatctgacaggactgtggtcttagaagaagaggaagagagaggccaggcgtggtggctcacgcctgtaatctcagcaccttgggaggccgaggcaggtggatcaagaggtcaggagatcgagaccatcctggcaaacacagtgaaacctcatctctactaaaaatacaaaaaattagccaggcgtggtggcgggcgcctgtagtcccagctacttgggaggctgaagcaggagaatggcgtgaacccgggagacggagcttgcagtgagccgagatagcaccactgcactccagtctgggcgacagagcgagactccgtctcaaaaaaaaaaaaaaaaaaaaaaaaagaggaagacagaaagagatctctctctgccatgtgaggaaacagcaagaaggcggccgtctgcaagccaggaagaaagccctccccagaacccactcttgctgacaccctgatcgcagatgtccagcctctagaactgcgggaaataaatacctgcagtttaagccacccagtctatggtattttgttctggcagcctgggcaaactaagacaaagataaatcccagggtcacagatgactcttggcaaccaaataggagagtttgtgttgaccgactctgggcatgcatataatgtgctgaattccccttctcagagcagccgtaaagagagagaggagactgtgtcttggttaagctgctctgccctcattccatgctcaaaagcgtatttgagcagcgtctatacatcaggctttgggaacagaacaatgagacatagtccgccaaatctgaaaaatcaaagacatgataattaactcacttcgaaatcccttgcttcctcatggaacgtttgtggcagagttgctcagcgtgcccacaagacagatgtctccatccaagcctgtaatgtggaatgccattccttaatggaggctgatgtctggggtgccaagcaaagtctccttgagatttgccaagtgcttgggattaaatgtgccttcactgaaacaaatcacttcattctaagtcacacagcaagttggaggtccaacctccatcttccactatattcactaaagtacaaagtctgtaagcaaaacgtttgttaaaatttcattgaggggttactccacgtaatggaatattgacacttggtgttttggggctacagtgataaatatatcagatgcagactcggccttcaaaggactacctactcctgaaaagtgagggagatgaggaggtaggagatgcctggctaagggaggagcatgtggaaaagtccaaagggaaaagtttggggtataaccagatcagattggctggtcatggcataggatacactgaggaatggcagataatgttgggagagccagctgaagttttattgtggtgggacttgagaatctagctaaggagtgtgtgtgtgtgtgttagacaacctccaaaggttatgagaatattatcagaaccatgcttctttgccaattccaatccctcaagttcaagctaagggatacagagtgtctctcagacagactgtccagcaggctaggccgatggccctaactcacttacatcctcacttctgagaaagctatgcttagatttgggttcacatctagactacaaaagctaagcataatttgggtttgtcatccaaaaaagtgaagaatattatacacaaaatgcattctaaaggattaaaaagtataaaaattaaacataacaatttgaaaatctgaattgacatttatcaaatttctcaaaggaaacaaacataccaagtttaaaggaaattaaacttaaagaagtcaagggaaaaatattatgttaatttcttctatagaaatggaaaatctataggttttaaacaaaataacttaaaaggaaaactgagtattagcaacaaatttactaactaaatgatttcatagactgaatatacagaattcagcaagatcaattttttaaaatgatcccccaaacataagtggacaaagaatataaattgacagttttcaatgaggaaaaataaaccaaaataaattttaatgttcaatgttattagtaaccttaagaattgccaattaaaataacacactattttaacccatcgcagagtaagcactttcatacactgcttgcagggctgttcattgatataaattctctcccctcccccattattatgtattttccaaaattttactgaaaacatcctttcaagaaatctctattgaactcctgaatcaccaagccaaacttgttatctagctccctagcacccactactcatgccccctccccacccacaaacatagattagctctgcattcctgccttggtgtgttgcggggtgaagaagagtcaggaagccttacgctggcataatctgtgtctcagacaatatgaccacatgccaatttagtgtggagtagaagaaatggccaggatttaaagcctggagaccagaactgggtgggcttgggaaagtcacttaacctctctagatcctcaattctttattttttttcaattcaatttagaaatctttgtaattttcagacatacacaaaagagaataatagcaaaatgaatctccaggcacctcacctagcttcaactgttaccattttgccagtttctcctcatctaatcccctatacttttttctttgctagaatgttttaaagcaaacactggacattataattgatacacattcttaaaagcaatttataacatgtaccaaaagcttttggcttggaaattccactgctgggaatctaaggaaataaacagaaatgtagaaaatattttatgtgtaagacttttctaagaggaaaaaactgaaagtaacctaaatatgcaaaaactggagaaaatgctaatagcctttggtttttgcctgctcagtgttccttcagttcgcataagcactcttttcattgcaggagtcccccttctacattctcccagtctctgtgattctgatggtgctgagtgaacccgcaactccaggagaagccacactactcaagttcggccaaagagggcaccccattcccagacacagtgattattcgggaatggctagggcccagctaggaaggacacatcctcttggtggtaagattgctggctgcaatgaaaactaacacggcagaaagaggagccaggaaatgaaagccaagttctgaataatataagatcaatgaactctttttgtttaaacaactttgacttaggtttcttgtcactagcaacagagtcccaatgcagaccattatttggtggcctgcttatattgatctgatgaaatattctgcagccattctcagccatcctcgtgaatggcttctaggaacacggttgtttatgataaagtgaaagaagcatgatacacattcattaaacagcaagatcttgactatgtttaaacatcactcccaagaaaacacacccaaaatattagcaaccatgctggttggtgaggttataaatgtcaaactttttattctccacatttcctatacaaatgtcttacaataaatcttaaagaaaaaactgaaaaatttacattttactgatttgtaccccccttaattccaaaaggaattataattaaattataattatcttctctaataatatttatagaacacttggttttgaagtgacagtttggaattcccctaggaaacactgaccaaccagcattacacaaattagagcattatttcctcagtactaaaactgaaaaacatgctcccttaaaagaaagtagtctccttttcaattactttgtgatcttcagtctaaatactactaagaagggaacatcacactagcaacctcctcagaatatctgatgcatttatttcattgaacttcgtcacatttcataaagatttttctccactcccccacatacctgtcaaggactttgaacctggactagaacacagaataaactatgattattggccatggttggtaaagacaaatggccttgaccagctgagtgcagaaggatggtcaagatagcatctgccaaacgcagctgtctggactctgtagcttcaggatcctgagctactccctctttccacttttttttttttttttttttttttttttgagacggagtctcgctccatcgcccaggctggagtgcagtggcgcggtctcagctcactgcaagctccgcctcccgggttcacgccattctcctgcctcagccttccgagtagctgggactataggcgcctgccaccacgcccggctaattttttgtatttttagtagagatggggtttcaccgtgttagccaggatggtctcgatctcctaatctcgtgatccacctgcctcagcctcccaaggtgctgggattacaggtgtgagccaccgcgcccggcccctctttacacttttatctttctctatcagggcctgtcctgctctctgcaccaaggctgactccccctccccaccccagtctaagatactcatctcctagctgtttgagcccagggatctgttctccttctgcagcaggtggggtgcaaggagaccagaagcctgatgtagaagcacatggtgtggagggaatgataaacccaggaaaacctagcagcagcagcagcagcagcagcagcagcagcagcaaatcaggcctctgcttctcctcttgcccctgctgagctgcatttactccagctcctaacccagagcattattcctaggggcttgatttggctgtgtaagaaacccaaacttgcacaaagagtagtccagtgccccctagtggctaactggaatattaacagtgacatattctggcacattcaattataaaagaatctgcctgctgtgaaacactggttgactttactctgtatgataactagatcttacctgaatgtcgatatgtatttatgtggttccaaatgctggagaaaaaactcactaagtgggtaaagggagaaaaccaaatagctgccctcaacctaattctatcacaaggtacactggcaaccaaatccctgaggcagaacctgtgacaaaggctagatctggccatgcccagaattttaggacacaatgagctttttgccaattagaaagagtggtattattcacttcaagttttgaaacagccagtgactgatttaggaacatgctatttcgacagtagacaataaaacaaagtgtaataaatattaatgtctatgtttaagaaaacgaatccaacacatttcattaaaataattcttttaattattgatgctttgaataagaagtccattttactaaatttagtataaattatttttcttaaacagaacctgtttgctggatctcagttaagttcactttgcagttttcagacacaatgactcatattcaacttttctctttaaggattcagtggcttgattcctgacatttcctctttaagaggaatcttatgtcatcttctgaaatcatgtatatgggtaataatattagtgtcttctcttctgaagatgtgattcttttaatgccatgttctcttccctctggtgacctgacttagattgtagcagcactagaagctattaagagatttggggcagttgaggaagccttaggtaattgttaagagtagaagtatttttaaaaagctgtggagagtggtttgggaggggattttgtccctggctgaagctggtccatgcctgggtaaactttacttataaaagaataccaggaacacacaaaatattcttctcctctttcttttgcaatccagttttggagccaaaaaataatctgtgtgcacatgtgttttgataatactgtttcgacttaggtggggaaattaaattcaggagttttatgactttcttttgttctgagtatcactttagagtataaaaagtttttcaaaagttctttatcagaaatagtttcaccctatgttgaattaacaatacccaggattgtgagacataaatcaacgtgagtaggaagctccatctgagtttcatcattgtttgtctatcttggcaagatttattcagaagcaccataatgggggccaatccttttgcaccaggctcaggcagctcaggaggcagctgtggtgagtgatgcactctaccaagcacagtggcttctaggaataaagaacacatactcaactaccttcaaatgccaatgggcaatttaaaactggtactcattcctcttcaagagcaccactggaaacatctttggaattgatgggacaaaacttatttgattatagtgaaggatatttctctacgaaaatggcttcaaaataggaaaaaagtagctaccacatcttccaggaaatccaataacaggtcaactctattggtaaacaagcaagtaaacaagcaagcaaacaaaccagcatgtgacagaaaactggctaatattctgggacgctttccagagaaacattaagccttttaagtgtgtatgagccactttaagaaacttcataagtgttgctaaattcaccacagtctgcttcacctagaaaggggaacagagaagaattattttgttaaactgggttaacaaatcttaaaaattaattcattctagggaaggactagataaaatttctgatctaaattaagattttcagttcatttcaaccactagaatatactaaataaccacttgggtttgttaaaatgcagactcctgagtttcggtttcaataggttgagggtggggcctaggaatcctcattttagcaataaccctcctctccaagtatgattctgacacactgataaacgctactaggatgtagcaagaagcaggccactgccgtggctgctgttgttatctcatttaagagtatctgaaggcttaaaagacaaaaatagttgagaacagaaggggtcctgaacatcagggcagaagagcagtgattagccattgcccagtgatagtgaccacagctgggaggtgaactttccccctttctgctgccaccaaccagggaatccatctctaggtatcaagactgggcaagtctgtaatccatgaccttttgttacctgtgtgtttgctaggaaatatccggatgtgcgccagaggagataaaatgaggcttagcacaaacatgctgctgcccagacttaacagtggtcaaaagcaatgcttatgcttataagaactgcttgttgggcgggcgcggtggctcacacctataatcccagcattttgggaggccgaggcgggcagatcacgaggtcaggagattgagaccatcctggctgacatgatgaaaccctgcctctactaaaaatacaaaaaattagccaggcgtggtggcaggtgcctgtggtcccagctgctcaggaggctgaggcaggagaatggcatgaacccaggaggcagagcttacagtgagctgagatcgcaccaccacactccagcctgagcaacagagtgagactccatctcaaaaaaaaaaaaaagaactgcttattccagggtgccagcaaatgcttcgtgtagacatttaagccttccactgatcatgcaaacatgctcatgggggcttcacccaacagtccaatgaggcaaaccacattcagttaagctccgtatcagctctcacaagtggcagtctccatctgtgtgaaacagatttcagatgcagagggcttcgtggtatttggaggaataataccttccaaaaccgatctgggcaagccaagcaaggtggctgccaatgtggggaagctccagaacgcctgtgaggcccctgtgggtggttctccaagaagatgggggccctggtcctcacagatatcactgtacactccccggactattaaacagctctggtggcaaacctggcgggtgggattagtgggggcactcctagactcggagatggacaattcctagccagaggcacccggtcagagcgggcagctttcaggccctgcccatccctcgggttctggtgcactgcctcagaagagtcacatctgctctagcctttgggccgcctctcaggacaagggaaaaatgttctatctctgtgctgcagagaagtgctcctttgtcagcataataaagtgggaacctcaaaagtatctgttttactcacttattcagtgtggagacttatgggaaaacagttttattttgttattaaaccaggcactgcctttgggcatgttatttatataaagataactgcgctttagagattatgtcctgtgaaagtaaactttaacttcgaagagcaggcccttcttaacagtcatcctgataatttgttgccagggaataaagttgtaattgctacctctatattcctatgaagtcagatggctttgccagcccagaagacgaccagtggcccgtgcctctcctgcatgcacagcagcaaaacaagcgccaggactgtgggattctttattccaacagagtgtgagagtgtttgtctcaagtaatgagccagacaatcattcctaaacacctgctctatgacacacactgtcctaggccctgcttggaattaaaaaaaattagaaacaaaacaaaactgagatttccaatcatggtagggagtcaatagttcaacacggaattgttctacaattgaaaaagacagagattaaataaatgctaagaatttaagccctcaaatgacctacaacctacaagtctaccttagttatcatcaccgtaatctcctgaaacagcagtcaatcattacaagcagaaagtgcattataaattacactgagctaggagcctggccagctaccagtgaggcagccagaggagaagtacagcatcatggatagaagtcaggtgatggctctggagcaagaatgcctgggtttgagtcccagcaccaccacttcctggctgcaagaacaaacagtttaggccagtttgttctctgtgcatcagctttccatttcacacatgtggaaaaacagcacctacctgttgcggtggaaggttgcgcaagaaagggatgtggtgagaactgaatgagttaatacatgaaaagtagccagtatagcacccagccagtaataaacaatggacactagctgttattgttactgttcttatcacctccccagatatgccagaattccctgtgtcacctgggagaagcaccagtcccttgtattccctcatttgaacccttagctaactccaaagactccagttacactcttctttcctttccctttctgtcttcaggtcctgggctttattttctcccatggcctcttttatctcagcctcctcccttccatgcacttcttagtgggataaaccacacatccccataggcatttgtagtactggggctgatgggatggggttacttgctcagactcagatgaagggcattcacagtccaggagcacctgagtctaagcctcatgagaaaatgccatcgtgggtcataactgggctctgttcagggcccaataagcacagccttaaaatggagtctcaacctggtgtccaggcctgtagacagagttcaggggtctgcgaacttggctcaaaaaaatttttttttcattttcattaggctctaactgaatgtatcatttccttcaataatgaatgtagggaataaaccacagggtgacagcctatctgtgactgtctccaacagaaatagagaaatcacagatacgttcatatcatgtcacaggtgttgcagatgtcttaaaatattgtcttcaatcctcactactttaaaagcacagaaaaggccaggcatggtcgctcatgcctgtaatcctagcactttgggaggctgaggcaggcagactgcctgagctcaggagttcgacaccaccctctttatgaaaatacaaaaaatcagctgggtgtggtggtctatgcctgtattcccagctgcttgggaggcttgaggcataagaatcgtttgaacccagtaggtggaggctgcaatgagctgagatggtgccactgcactcagcctgggtgacagagtaagactctgtcttgaaaaaaaaagaaaaagtaatagacttattactagatcttatatttaatatattaataaaacgattataccacacatttacaaatattttcataaatgtatttcattatagttgattttcttcttaatcctctgtattttatgtgtttaaaacattattctgagaaggggtcagcggctttaccagactgcccagggtgtccagggcacatgaaacggttaaaccccccttgccttagaaggctgaggatggctgtaagggcggcaatcttaggtgaaagatgtgtaagtacttactgaactgtgacattataatattcttctggtgtcacgatttttggtccaccaaagtagtccaggacccagatattggttatattcaacttagcaaagaaccaattatggctggaaggccaggttttcatctcagggtgtcgaatgaataacgaatgctttgcaatatccatttctgtttcattcacctaaaggacatatatgaaataaacattcttatggcagtaacactttatcttctcatttgttaagaatgtgtgattaggccgggtgcagtggttcacgcctgtaatcccagcactttggaaggccaaggcgggcggatcacgaggtcaggagactcagaccatcttggctaacacggtgaaaccccatctctactaaaaaaaaaaaaattagccagatgtggtggtgggcacctgtagtcccagctactcaggaggctgaggcaggaaaatggcatgaacccgggaggcggagcttgcggtgagccgagatcgtgccactgcactccagcctgcatgacagagcaagactccatctcaaaaaaaaaaaagaatgtgtgactctagcattctataaatcctaagagtttacttacttgtaaatcttgatcttaaccttaaggaatcaagagaaaataaaggaaatgtaaagaatgcagagaataaagatttcaattgttggtaataacagataccacgaagtgggaaaccactgtaagtataataccaactttcattggtaaaaaggcattttgagctattagaataactagcactaagtactgtaacattactggtgcctaagacatgtaatgtttagcatatttatcccataacatggacatgttaaacatacagatgaatgtactgaaggataaaaatgtttagaaaccacataacagaactcaaaagcatgtgctgctcctccatctttttcctgccagtgaaggacactcaactacagagatgcatccacaaagaatttacagaccataaataacacttgtctgaggcattaatgattgacacggtcaaaaagcaaatctgctggctgggtaatcagatcagcactcctgacaccatgcccactgctcttcctgagattgtatttgacctcttcccttcagcaggtgatccaaactaaattcacttccagttttcagtaatggatagtcctctggttggcctacttaatatgttttctctgctttaagccactgttaaaatatggagacaaggagcccagacatggaaaaacattataccaatgtaaaatgtaatggagagtagagggctttggtcaaccagatgctctttagtaagaataactttatatacaggagcttcatagttgttacatctgcttggcttcagaaaatcattcatttttgtcatatcttatttaacacctatatgaaagcaacttattaaaacgtttggttttcatggaattacttcacctattagaatagaacatgttctgactgggcatggcaatcacaaatcaactgcatttcattctgaaaagatctattctgccaggcatagtggctcacgcctgtaatctcagcactttgggaggtcgaggtgggtggatcacttgaggtcaggagttcaagaccagcctggccaacatggtgaaaccccatctctactaaaaatacaaaaattagctgggtgtggtggtgcgtgcctgtaatcccagctactagggaggctgaggcacaagactcgcttgaacccaggaggcagaggttgcagtaagccgagatcacaccactgcactccagcctgggagacagagtgagactctgtctcaaaagaaaaatgatctattctttcattgtgaatacgatggtgttctgaaaccatctcccttcctgtaggataactacttaccttggtcacagttcctgacagcattatgtgaacacaaaggggactttgtggatcaaatccatgtttcttgcagaagttggtctgtgccaaagtcatggtcagtgtagcatatggattctcctatagagagaaaatgaagatcctctcatgtgaaatatggtttctggagaggtaataaatttcaaaagttgcatacatgatgtccctagagcttgactggtcttccacgaaacaatgaatcataaaacatcaccttccactcaggggaaaataatacttggaaagtatcctgaccactccccaaagggggtgcgggggttcatatttaaaatgaactgacttggtaaaaattatttcaatattctttttctgaaaccctgaatttattccatattcatcagaagaattataattatagtgacacccaaattcaaggctgttctataggcttcactgaaagatttaaagggttaaactctatacaaaaccattgctaaaaacaccacagttgctcaattggctaactacgcgatttaagcaagaaagtagctgaatcatgctacttggttatcttacattagcagaaactgtcatgtgatttcaaaactggagaagttgttcattcctgctttagtaacaatgagttttatcccacattcaaaaagtaacacaagtaaaattcttaatgctttcttattcagaaatcaacttcataaaaggcactgttgacagattatagcaaaattcacacatcgcattttagactatttagctctttaagctctaagtgccttgtgtggagaattttgccatttcacactgacccatcaaaacaaagagtcataaagagatttctttgaaatcatttagccaaatagtcactgtctagaaactattaggcaaggcaccacaggagaccaaagaaggggagggggacactcaggtaaactctctccctccgtgagtttataatctggttgaaaaggcagacataaacaaatgtgtatgtccagcatagaccagagtgatagaggaactgtaaggagctttataatatattcaaaaccaggatagaaggtgggaggacatattaaagggagaggagacactgactgcaaaaaacacagaactgggtgagcctaagacttgatgaacagtaccaagaaacctgatttgctggaaagaagggctttcctacgggaggagcctggggttgggagtggagagggctccaacctaagttaaggagtctagattgtaatttgtgggccaaccttaggcactgttttctaagaaccacctgcctggagagcttgataaaatgctgatttgggttaaaatgttgaaacaggcttcactcccaacccaaataactgcaatttttttttgttttttttttttgagacggagtcttgctctgtcacccaggctggagtgcagtggtgcgatctcagctcactgcaacctccaactcccaagttcaagcgattctcttgcctcagcctcccgagtagctgggattactggtgtgtgccaccacgcccagctgatttttgtatttttagtagagactgggtttcatcatgttggccaagctggtcttgaactcctgaccttgtgatccacccacctcggcctcccaaagtgctgggattacaggcgtgagacaccgcacctggcctgcaatattttttttaagacagtgtctcactctgtcacccaggcagccacccagtgcagtggcacaatcatggctcattgtggcctcaacctccagggctcatgtgatcctcccatctcatcctcctgagtagctggaactatagatgtgcatcaccacacccggctaatatttttttattttttgtagacatggagtttcactgtgttgccctggctggtctcaaaatcctagactcaagtgatcctcccacctcggccttccaaagtgttgggattacaggcatgagccaccaagctgtcctctatctgcattttattatttagaaacagaatcaagctctgtcacccaggctggagtgcaatggcgtgatctcagctcactgcaacctctgcctcccaggctcaactgatgctctcaactcagcctcccaaatagctgggactacggtcgtacaccaccatacccagttaatttttgtatttttagtagaggtgggtttcaccatattggccaggctggtctcaaactcctgacctcaggtgatccgctcacctcgacctcccaaagtgctgggattacaggctggagcctccgcacccgcctctatatgcattttaaacaaacatcccaggtagctcttacgcagctataggcagctgggtattgttaaaggtttctggccagagggcaatgctgtgacaggtatttttgttaatctatttgggtaggcaaggtggatggggcagacaggaagactatgtaagagctgttctagtacttttaggcatgagatgataagcttaaggatgaggtggcaggaatgaagaggaaggggcaaggacagaggtaaagaaggcaacaaaaaactgtcaggacttgggaactgagggatttggggaggcagtgagaaccaactgggtttactgagaaaacaataattccactaacagaaatgcagaagatcaaaagcagcttgtttcaggaggaagaaggactggatttaaacatgttgaatttgaagtggtggcaaagtaacgaagcaaaaatgaacagcaagcagaaatatagagaactttgaagaggtcagaaatggacacacatctggaagtgagtcctagtaaggactagaagagaatgtatacaacgagagtgtatacaatcttctgaggatcgctgcagggaacaaaagagtaggaaactgactttgagggatacttattttagtgggtcagagaaaaaaaaccaagagtgaccagaacagaaaggggcacatcacaagaaaagaatgccaaaatggaagggaggctaatagtaagaggtcttggtgcaaataatcaaaccccaagatttcccttcagactcactggctctgcagccaaacacggtcccactataagctaacatcagcaacactgtcctacagacatttactatacaaaaatgccacaaagaaagagacatacaaaagaaacagcccagtggtaagtacgtttgaagctcacaacatatctctaagttacagaggacaggtattttacacatgagaaatggtcccaaacctaggtctttttgttccttctgaacgatttcaccccctgtcaatgagaagaaatgcagagcaccctggaggtcaggaggaggaaaagaaaaaagcagaaactttgacctgctaattgatggaatcaagtcagacaaattctaatgtggccacttcttttcactgccatcatggaaacctaaagccctgggtaggttccttgccactgccctgtctatttctagaaacatgaaagacctgggctaatgtcctacctgacagccattagctgactggtcacagggtaagtccctgcacctctgagtctgtgtttcctcacttcctaaatggggacaataataccagcaactccctagtcacctcacaaatttaaatatgattatgtattggtcaatctccctcctcccccattagaatcatcagggagtggtttgtggggaggcgggaaggggtgttgtcttaaaataaaatgtgctttcaataaaataccttggcatcccatttttaaagccttcttaggtgactatgatttgcagtcaaagttgagcaccactgatggagtggagtgagtttgttttgagcaaacgcctaaaggtgtggaatgggctgggaataagaaaatggtgaactggggtgtatctgccttagctaaaagagggcactgcttctgtttttgctcaaagagtgcaggcccacagtgtcactggatcttcccatttttcaagaaaagttagagatttacattttaaagtaaaatctaaattttaaaatgttggtaacaaattcaaatttattaaaaacaaaacagaactttgtgtaggccaaaccggtctgtgggacatattcagctgatgggccaccagcctgtgataggtggtttgaagaaagatgaacctgagatgaaactaggggtttgcccgctggctttaaacaagttacttaacctaggtaggcctcaagttcttcatctgcagaatggggtatataatacctacttcaaagaattaatagaagagacaacgaatggaaggcaaatggaaaagtgattaatcaagcatcagtttcttgcatcctgtctttatcaacaatgttgtactttcagagttgaactcaaatgtgagagctttgtcaaaaagaccctccatcaaatcaggctccattcctggactctgtgtgtctccggcctcccaagctgggtgtctgtgaccccatccctgagacagcagagatccatcagagttgtaagtgtggccctgcaccagaaggtgggcaaagggcgaggaagagatacaccttcaatcagctctgcatcttactgaggagccactatgcctgtggaggcctaaagactgcagtaatcattgtaatcgtccatgatattgtacgttagcgtcttgctgcaggagggaaaagcttaattcaggaagggtaagagagtgagaaaccctgaagtcacatattaaagtgcttaagtacctaacaatctctatgccctgtaaaacctttaagaataggagcccaggcagggcgcggtggttcacgcctgtaatcccagcactttgggaggctgagatgggtggatcacgtgaggtcaggagtttgagaccagcctggccaacatggtgaaaccccgcctctactaaaaatacaaaaattagccgggtgtggtggcacgcacctgtaatcccagctactcggtaggctgaggcacgagaatcgcttgaacctgggaggcagaggttgcagtaagctgagatagcgccactgcactccagcctgggccacaaagtgagattctgtctcaaagggaaaaaaaaaaaaaaagagaataggagcacagttaatagagacactgggccccaagacgactgagaaccactcacggatgagaagtcctcgggctgctggcagagaatttaccccaggtgcgtggcccagtggcggaggcttgtgggaaattcctggtacccagctgcccaacatctgggacgctgcaacgcccacctacctgcctgcgcggcagagaagcaacagccgttcgagccacgctccacttcccgggaagaattctggggagagtgaaggctcgctctgtggccgccccgcccacagcccgcctggggaagccgcgggccccagctcacctgcaggttgctcacggagagctgcagcgggctcaggtagaaatagggcacgccgctgcccgcgcccgggggcccgtcgctgagcgagaggacgtcggcgaagggccggccgcgcaccgcctccagcgtggagatggtggccagagcgccccagtcggagacgtgcgtcacgaagcgggccacgcgcgccgcgtcctcgcggggtggtagcggcggcagccgggaggcctcgtcccagtccccgtggtcccggccgccgcgaccccgcgcgggcgacacgagcagcgccaacagcgtcgacgccagcagggcggcgagcagtgcgcgcgcggacccgcgggatagcccggccatggcggtgtctccaggaagagtcccgggccccaagacctgcagggacccagccggagctcggcgcgcccaggccccgccccctccgcgaggcgccaatcagagctaagcacaatgcagggggcggggtccctctgcagctccgcaacctgcaggagaagggattggttcatctgcattccaatcgctctgcctgccctctttaaggattgtgaatttgtcctaaacgggatatttgttttgttttgtttgacaggcggaaaaagaaaggcttgaagaaatcaagcaacttgcccaaatcgtactgctaggaaaagaccagcctctttacacaggcacacaccccctccttttaatacctttggagatgaatatctggcatctgagaggaaatgctgcattttctacccatgcgcctcttttctgttgaatttaccatcagctccaaagaacagcgagggtcccagcgttgtagaagcccagactcaggctcgtgtaccccatgtgtagctgatgccaaacactgacatataggtgcttggagataaaagtttattcgatttggccaaagcgagaaggcgggagggcaagatctctcaaatccgccctaacaaaaagaagaagcagagagtgtttatgcggccagcgagtcagggagggggagtttcagggaatcgagggaaaaagtctgtgtttcttcagtctcagataattccttgaacaatcagacttctgggcgacagaagctggcctcaaagtacttcaaaggacttattcctcctgcaaactttttcgtaaccctgaagttattatctcctcctgcttgataaagaaacagtacatcagcagtttatgattatgttgtaggaacaagggatattgggcaaaaagagagttgtcaacatgtgcaagcaagggcctgatcagaattttcattatttcagtcactaacaaatgctggggtgctgaaatctcaaggggcccacttacactagtagtaaagttaggcagaagcccgaaagttcaagacctttaaaaaactttttatttacttattttaaaatttttaatttttgtgggtacatagtaggtgtatacatttatggggtacatgagatattttgctacaggcatacaatgcataatagtcatatcagggtaaatggggtatccattgcctcaagcatttatcctttgtgttacaaacaatccaattatacttttagttattttaaatgtacacttaaattattattggctatagtcaccctgttgtgctatgaaatactaggtcttattctaactattttttgtacccattaaccatccccactcctcccctgcaagtccccccactacccttcctggcctctggtaaccatccctctactctctgtctccatgagttcaattgtttccatttaggctcccacaaataagtgaggatgtgtgaagtttgtctttctgtgcctggcttatttcacttcacgtaataacctccagttccaactatgttgttgcaaagacagacaggatcccattcattttttatggctgaatagtactccattgtgtatatataccacattttctttatccattcatctgatgatggacacttaggttgcttccaaatcttagctgttgtgaatagtgctgcagtaaacacaggagtgcagacatctctcaatatactgattttctttcttttagggatatacctagctgtgggattgctggatcatatggtacctctatttttaattttttgaggaactccaaatttttttccaaagcggttattctaatttacattcccaccaacagtgtacaagggtttccttttccccacatcctcaccaacatttgttattgcccgtcaagaccttttaaactactggcccaggagtccctcatatagacgcacaaagggattgttagtctactatcaatatcccatgtacaaatttgaacttaccagttcaggacctgttaagacattaagcttggggtcggcggtttcatgaatttattgcccccgctgcccttccctgctccatgtaagggacattccttttgcttcttctaagatggcctgtctcattctctcacgggtgctcctgattctgctattctggaaactggtcaataagctcatagcacctggcctccattctttatgactttaagctttggtcacgtctttttggagcaagtcttaatctttttggcctggcctcaaatttccactgtaattgttgttataaagactgtatggtggtgttagtgcaagagtttgtcatcttgtaaagctggctctggcagacacctggccctgtgaggctgagttgtgtaacagaggtgaggtaatttcactcagctgctgttggccagtcatgtgagcagccgtgggcaacaggtgtgtgagccaaagtcccaccgctacttcccttctcaaaaccagcctcctaatattcagccaacttctcaggctacacagtaggaattgtgtatcagaagaagcaagatcatctactctgaacaggagacttcagtgccctctggtggccaaatgatgtcacacaccctgatttcgacattggggtaagaaggatccttaatcaaagttggtttgctttataacaactgaatttggaagaacttcaaaatagatggaaaactaagtgggagaaattcaaaaggaggaaaattgggttcatcattttaaaaacaaatgattaatacaaatagtttgagtacctgccggttataaacatttcatcccttacctgttaaggaaagaatactctcacatttggagttctaatctcaggtctgccactatcgtgccatgtgaccatgggattttatcttacctttgggcctcaattttctcatctaaaatgaggagttggattagatgatattaatatctgatgcctcttccagccctatatcttctttttctttgtggttgtttgtttttctttttctctttttttttttttgaaacaaggtcttgctctgtcatccaggctacactgcagtggtggctcacgagctgtgagcctcaaaatcctgggctcaagtgatcctccctcaagtgatcctcccacctcagactcccatgtagctgggactaaaggtgtatgccaccacacctggctaatttttaattttttgtagagatggggtctcatatgctgcccaggctggtcttgaacttctggcctcaattggtcctcccacctcattctcccaaagtgctgggattataggcatgagccactgtgcctggccttatttttctattaacatgcaaagtatgagccttttgtaagtttcacaatgtgaatttttttgcaaaaagatgaaaaaaatttatttattgctacatcatttattgctggcatacaaaatagcaatagaccctattacagctccattacaaaacaggtgcctagagcttggtctcaggcatcagagcaggagaatgaggtctacaaaccctctggctttaagcacgccacctcagtatctatctttgtgtttgctgttccctatgctcaaaatgctcttccctcagctgctggcatggctacctcactcccattgggacctccacttagatgtcactcctcagcagtgactcctagagcactctttccgagaggccttccccagttactctccctcagccaactctatttctttcatagcaatcattaattcatcacaacaaaaataaatactataataacagtatttatttttttagctacgtgtttattgtctccactggtagaacgcgagctccgggagagcaggaatgttgtctatcctgtccgccttcgtattcccaatgctcagagtgggcactacataaatatttattgaaagactacctgacagtgaataatatctggcaaaattctttgcacatagagctgtataaaatgattaaaaagtgaggatgagtaaatcagcataagctaacaaccaggcgctccagcttttgtttagcaaatcctcctcattgggatattaggggaagcccttagccaggagtggctgaaataatcatcccagatcctgctgcttctcatcctgactttatgtttttatgtgaacaacctacactggtccccatccccacaggcccactgtggaatagttatcttttccttatgtctaggtttgatccttatgaagaacccaccctgcaaactccttcttttacatggtgttgcccttgcttatttgtctaggtcaccaccggttccttctaggttagaagcagtggctttgtcctttccgtctcccagcaccgagcacagatccaggcatctagcaggtacccattacatgttattgacaaaagaattgtatcagaacagtcacaccaagggcagagggttctcaggctgtctgccatagctcaggctttagtctttaaagaatagaaaacttctcttttgtggtatgcatgcttcaaatagtagatagctagtgaaacagtgaagagagttagctctggagttagccacttaagcatgagcttacataggatgatactgaaccacaatttccctgtcattaaaatcatagctcctccttcactggatttttatggggattaaatgagagaatgcatttaaaatatccattatagtgcctggaacagaatagatgctcagtagttgttagctatgtgttagtaattgttagcttttttctcactatttcttttttttttttttgagacggagccttgctttgtcacccaggctggagtgcagtggtgcaatcttggctcactgcaacctccacctcctgggttcaagtgattctcctgcctcagcctcccaagtagctgggattacaggcatgccaccacgcccagctgatttttgtattttcagtagagatggggtttcactatattggccaggctggtctcgaactcgaactcaggtgatccgcccgtctcggcctcctgaactgctgggattacaggtgtgagccaccataccaggccttttcccactatttctgttcccactttctactctaaaaatctgtagattgcttcatttaatttctctatagatttttcacacttttcactgtggcctctgcaggaaaaaaaaaaagcctcttgaaaaaaataactttataaaatgtcttgaaagtccccaggcagctattgaggaagtactttcatagcccaccccagctttgagggagaaaatgccgatgcctattatttttcattaagcagatagcctttccccatggttcttctcacatcccttcactttagtcaaatgttccgaatttaaaaggtagcaatgaaaacctgcccttttgctgactgccttgagttttacatgtttctctttcatgcacgtttacatttggataacaattattttccagacatttggggaacaattcttgactcctttcaatctagaggacatgttttccaaatgcctaatagtgcttgctacatagaaagacatgttaatatgtatcttttggattgcatttgtttaatcaaaaacacattaactaagctttagaagagtagtcatcccagtatttcaatatatctgtaaaatttatttttttaattttactttaagttccgggatacatatgccgaatgtgcaggtttgttacataggtatacatgggccatggtggtttgctgcacctatcaacctgccatctaggttttaagctccacatgcattaggtatttgttttacgctctccctcccctttacccccaacccgcaacagactttggtgtgtgatgttcccctccctgtgtccatgtgttctcattgttcaactcctacttacgagtgataacatgcagtgtttggttttctgtcctgtgttagtttgctgagaatgatggcttcctgctgcaaaggacgtgaactcattcttttttatggctacatattattccatggtgtatcaatatatcagcaatattaaacaggagaagaaagttacctgcgagtcagaagaaaataattagattagaatttgcactaaaataaggccagcctttcacatcatcatcatagtaattttaaaagcacaaatgaaagagtgcctgtaacaaaatatctgtcctctttgcctgccagatgcccataattccactacttatgcatttgtacattagatgtatgcatttaacaagtatgcattgagtgccaaacaagccctgggtgctgtgatgggtgatgagaattaaaattattaatagacattgtccttaattttaagaaaaatttctgcttaattaattcacaaataagcaaagagacaaagtataattcgatgtcattagtgcaacgtggagggctatccacaggcaaaggcgccagggaagaaggagcataggcctgtctcgagggaaggttcatatcagaggtaattcttgagttgaaacttgaagaacaaatagaagcgtggcagacagtgagaaggtgggactagagagaaggagaggaagagttttacacagaggaaatagtaggtacagaggcaagaagacatgatgtgtcagaaaaagccattttaagttgaaaagaatgtgaagaaccaatgcaggcagatgagcatgttcagctgggtaggggaaatatatcatgccaagaagagattttgattttgggaagccatagaaaattcatatgttagaaagatcaattcaggcatgatggctcatgcctgtaatcccagcactgggaggccaaggcaggtgtatcacttgagctcaggggttcaagaccagcctagacaaaatggtgaaatcccgtctctaccaaaaaatacaaaaaaaaattagctgggcatggtggtgcatgcctgtagtatcagctactggggaggctgaggtgggaggatcccttgagctcagaaggcggaggttgcagtgagccaagattgtaccactgtactccagcctaggtgacagagttagaccttgtctcaacaaaaaagaaaaagaaaggaagaaagaaagaaaaagaaacaaagaaagaaagaaagaaagaaagacagaaaaagagaaagaaagagaaaggaaggaaggaaggaagaaagaaagaaagaaagaaagaaagaaagaaagaaagaaagaaagaaaaagaaagaaagaaagaaatataattttatgaagatatctgttctccccaagttatcctattaattcagtgacttccaaccaaaatctccacagaattttttaagggaaactgatgaactcattttggaatttatttggaattgtaatccatgtgggtaactaagatatttttgcaaaagaaaagcagtaagggggaaattgccctataaatatcaatcatactgtaatctctccaagaaatgtgtatgtaacagtataacttaaagctttaaagcataattttaacaaacatataacaataccatttataggatttagattgatttttgctaccttacagtgtcatgaaaaacaaatatatatgtgttcattgacaaaagctcataggttaaaacacactgtacatgacagtaattgaggcagctgtaggaactatggtaggaataggcaaattgttacagattggattcctcagaagcagacactgacagagtttggcctgcagagcacagatggtccctgacttaacaatacttcgacttaatgattgcttgactttaagatgatgcaaaagtgatgggcattcagtagaaaccatactttgatcacccacacaacaattctgttttcactttcagtacagtattcaataaattacatgagatattcaatcctttattatagtattggctttgtgttagatggttttgcccgactgtagactaatgtaagtgttctgagcacgtttaaggtaggcaagtttaagttaaatgcattttgacttatagtatttcaagcttacgatggtcttgttgggacatagccccctcgtaagttgaggagcatctgtacttattaaggatcaatatctgtgggggaaaaaaagggtggcagcaggattgggcagagagagaagcgaacctgcagtgcaggcctgacaaagcccctcttcctaaggagttctggagtgtatatggtccatcggaagtggggcaatggcataatgactcatgagatgcagattaaaatcgcaatgtgatgtgactacatacccaccggaatagctaaaatccaagtgttggtgagaatgtgaaacagtggggactttcacataccgctggtggaaatgtgaactgctgcagccaggttggaaactgattggcagtatctattttttttgagatggagtctcactctgtcaccaggctggagtgcagtggcgtgatctcagctcactgcaacctccgactccctggttcaagcaattctcctgcctcagcctcccgagtagctgggattacaggcacacaccaccacatccagctaattttttatatttttagtagagatggggtttcaccatgttggccaagatggtctcaatctcctgacctcatgatccccccgcctcagcttcccaaagtgctgggattacaggtatgagccaccgtgcccggccagcagtgtctattaaacatatggcccagaaattccactccccagtatatacccagctgaaatacttgtatatattttttgttttgttttgtttgtttttgagacagggtctcactctggttgcccaggctggagcgcagtggcacgatctcagctcactgcagcctcgacttccctggctcaggtgattcttccacctcagcctcccaggtagctgggactacagatgcacaccatccttcctggctaattttctgtattttttggtagatacaaggtttcgccatgttgcccaggtggtcttgaactcctagactcaagtgatccacccaccttggcctcccaaagtgctgggattacaggcctgagccaccatagccagcctgaaatactgacatatgttgaccaaaagatgtgtacaagaatgttcatagcagcattacttgtaatagcccccaaatgtccattgacagtgggatggaaaataaactgtggtttattcccacagtggaatagttcagcaatgagtgctgctacatgaagcaacatggatgaatcacataaagatgatcttgagcaagagaagccagccacaaaacacatgtatgattctgcttatataaaattcaaaagtagacaaataattctaaggtctaaatatgaaaacaacagttccttttgggagataatgactggaagagagcatgaggggagcttcgaggctgttggcaatgttcgtttctggagctgggcagtgcttacagaggtgtgctcaccttatgaaacaatcattgagctctacacttgatttttatacttttatgtgtctatgtttgtgttgctccttaacaaattatccctaaacttagtgacttaaataatgaatatgtattattccattatttctttgggtcaggaattgaggtgtgggttgactaagtagttctggcttaaggtctgtcatgacagtcgcagtcaagctgttgacaggagccgcagtcatctcagggctccactggagtcttacaattttttcataatctcagaatgacattccgtcattcaaggagaggagattaacacaggacatgataccagggggtgaggaaggcaagcatatgggattggtgctgttatactactccagtattcagagaggagggggtaacaaagaagatggaagaacacctacaacttatatttatcctccagtccagctttataacctcccctggtctcatgccttagtctagaagtggaacatgatggataggggaaggaggggctaaaaaaaacctcaacaacatgaactgaaagtgcatatgttggcagtaatgtttggcaatagtggaggtccagtttcgatgatgcccggtggttgtaggccagtgcagagctgcagtatccggtgcaacagttccccatgaaagtggctcatctgaaggctgt

SEQ ID NO: 259 - DNA, 61511 bp, Homo sapiens
ggcaaactctctctgaagccccttttataagggcattcatacatacatgagggtagagccttaaggactcttaaccacagaaccaacccaatcaggttctactttgtgtgataaaatggtgagttgtttttcaattgccatggacccccaggttgcaagttaaataacctcatcatgctcagatgaaccaagcatgcaaccacaggtggaacctaagtgctcagaccaaggaaccaggactgaattaagaagcaagcacatcatggcatgatccatgatccaatcagatcaagccctggcctcaccccatggcatgatccagtcagatcacacctcccagcctcatctcatggcaagatctaatcatatcatgccttattaccctctgcctataaaatctgccccagctcccaggttggagagacagattttagcattgcctccgatctccttaccagttgacttacaataaggcctttcttttctcaaaagccagtgccacagtattggcttctatgggtgtcgggcagcaagcccattgcttgctctataacaacttaatcacttcccgaaaggcttcacctcctaatatcaccacaatggaaactaaatttccacatgaattttgcaaaggacatcacattcaaactactagcactactagcaggccacggtggctcacacctgtaatcccagcactttgggaggccgaggtgggtggatcatctgaggtcaggaatttgagaccagcctaggcaacatcgtgaaaccccgtctctactgaaaatacaaaaatagccaggcatggtggtgcacacctgtaatcccagctacacaggaggctgaggcaagagaatcccttgaatccgggaggcagaggttgcagtaagccgagatcgggccattgcactccagcctgggcaacaagagtgaaattccctctcaaaaaaaaaaaaaaaaaactagttgggcatggtgctgcacacctgtaatcccagttactcaggaggctgaggcagaagaatcgctcgaacctggaaggcggaggttgcagtgagccaagatggtgccactgcactccagcctgggtgacagagcaagactctgtcttgaaggggaaaaaaaaaaaactatagcactactattaacagctaatattttgtgtcctacacaaaggtagttgccatctccattttacagatttacagataaggaaactgaggcacagggaggttaatgaacttgcctaacatcacactgctcgtaagtgccatccccagagctaccctcttcgccaacacactttacaccatgaacaatgtgtgttttgccagtagcggccttgctgtgataaagaaactccctgagtccttgaatttagacctgaaaataactttttaaatcagtcagtctgattttgattcacaattttcctagtttaattttatatttcctcattttacaagggaggaaacagattcaaagaagggacttgcctaacactacacagctatttctctttaaggattgtttgatgaacaaccttcacatcaaatgattgacagcttctatttctaacattttctgtcccaccttgtttgaacactattggaatttctaaaacagtatttttagctagctgctactagtggagacacatcactctccctctacacgcacacactgcggaatcttttgtcctttataggcccaggtgtttcttttttgaagcttggggaggaaaggcatttgcaagggaacaagatgagagaggagggagatggtcagagaaagctaggactgtgctccctaccaggcccgacagtcaggatctgtggccgcatggttaaagggtgagttccagacactgagaaactgttcaagttgaagtctggcgagaaggaagctgccaggagaggggaccgcctttcttccaccagcaggtactcagcagcagggggcgctccaagatggagctgaggatcagagaattagggcagagacagggaccgccctaggtcatagacccgtttgggagctcaagcgaagtgcacctcgggtcatggcgactcctaaaaataacaggtgacacggaagagggagagccaccaagatattaatcatttcacctacagcttgtatcgtttaagccaccatgatcctcaaccttagtggcacgttagaattacctgagatttgtaaaattcctacccagaaacatgaaatctggggttggtggagtggggtggtattgagatactgggaaaaccaaagcgttttgcctatcctcctctattatgcagaatgcttcacctctggtaactaaaatgtgtggggatttctccccaccaccaactagtcaattctccagcagattctccagcaaggtgtcctcaaattcaatttaattgtgacactgtctacctggagatagcatgagatcccatagagcgaggactcagtcccacaagattctccccgacttcagataccaattgcaagccccagcttgtgtcctatggttctgaccgactaactgtaaatcagggttgccaccatccccctccttgggtttcattaatttgccagagtggctcagagaaatcagagaaatcctttacttacatttactcatttatcatatatgatattacagaaaatacaggttgtcgacctaaaaaaagactgaggcaaaattaatataaagagtttatttttcagccaggcgcagtggctcacgcctgtaatcccagcactttgggaggtcaaggagggtgaatcacctgaggtcaggtgatcaagaccatcctggccaacatggtgaaaccctgtctctactaaaaatacaaaaattagctgagtgtggtggtgcgtgcctgtaatcccagctactcgggaggctgaggcaggagaattgcttgaacccggaagacggaggttgcagtgagccgagatcacgccactgcactccagcctggggaaagagcaagactccatctcaaaaaaagtttctttcttttctttcccaaggtgaacagccaggtggaagagatgcatagggcaaggtatgtgggaaggggcgtggagcttctgtgttctctccaggcaccacccttcaagaacttccatgtgttcagctatccagaaacccctccccaagccctgtccttttgtgtttttatgcaggattcattaggtaggcatcattgattacatcattggccattggtgatcaacttttcagcccttctctcttctcctggggggtaaggctgaaagttccaaccttctaatcatgccatggtctttccagtgaccaagctgcatcctgccaccagtcatctcattcgcatacaaaagacacatcattccagagattccaagggttttaagagccctatgacagtaaatagaaataaagaccaaatatatacttcacagtgtcactggtgagaagcagcgttttcatattccccattgaatccaaggttgagaaccagtggtttaagaaaaaaaaaaaaaaaatagaatgaaaaaaatgttttccattctattgtggtttttaaaatgtaacaaaagctacattgaaatgagattagttgtgagattcaaacaagttatatcaggaaatgctttggaaattattattaaaggtagtagttactgttggtattattattagacctagtttagagcctcatttccagctctaatgaactggaaagtatttactatagaaatttcacccttgtctttaaaggtgggatgctgtctagaatagcatcaaactcagctgaatgtgaaaagataattgaggtgtttggggctgttgtatatagatgtacctaattaagtataatctttccctttctgtctctgtccttttacttaaaagactagtaagaaaggacgagttattagaaaggaatgatggagaaaacatatcctctttctctgccttccatgtccctgacaatcctcaacttccacttttggcctacaaattccttgccagttcccacagtgtcctggctcccacccaaggtcctaaactggccaaatttggggctagtccttgaccaagatcctgtgttctacaaaggggagatccttttatctagccacaggtagaagaaactgtatcagggagcgcaagtaatctgccctaagtcccacagtagtttagaaccagagaaagatgcacttcttcacaaacctctcttaaattccacagataacttaagaaataatcaaggcaaaaatattggaagaaacaaaagaggccaggtgggaggagaaagggtaagaatgaactgcctgatgcaaaatattctcccactgtgaggctgagttgccacagagagctgagaagtaataatactgtggacaaggccacactgatgcatatcacagaaccggaaattgaagggaattgaagcctttcattgtgagacatttcatcattttctcagtaattgcatcagttttacaatttcttccatcactgactccccagtagtcctggcaactcccgtctgtggtgtagaagtggcaagtaatggtgtttgcctccaggaaattaaagactcctctcaataactgtattagtcatcaacgcttgctgctgtgattgatcttgtaaccaccatcagatctgggcagcgaaaggatatgaaaattcataagcaggaaaacaaccttatcttctccttatccagctctgtgatatagaaggaatatctgcaaactcttttctgtatttctaatttgctcaccaaggagcatatttttgtcaggctgggaatatgtccaggtactgaaaattatttgtattcattggaaattgtgaattctgcctaggtttcccagcattgctctgttgaatttccctttacttaaaagaacaaaaatgttctagaattgtatttcaacatttcaggatacccagaaggcaagtagccacagcactgaaaaaaaaaaaaacaaaaaagaaacctgttctctctctctgtggaaggtgccagaagaaatgtgtactatggttttattattgctttatatcttgggcagtccctggtattaggggctaggaaagatgctgggtaaattattccataagcacagtgcttcacactgagccactcaacaaagtccagtctagagtgaaaaaaaatctaaaggcaagaatctcaatgaataagcaatgtttcctgggttttttaatccagtggccctaagatctctgaaacctgtcaaattgcacctattgctttcctgagaatatggtaatcaaattctaaatgcacatacatactctttaatccagaaattccagtgctaggcatttatcctacaggtatactttacatagaagaaatactttttacaaagctgttcattacagtgctatttgtgattgcaaaaaaattgtaaatagcttgaaaaggcatcagtagggacaagttaaaaaaaaaaaaaagagtgtggttccaaaacttagctgggcatggtggtgggcacctgtaatcccagctacctaggaggctaaggcaggagaatcgctcaaaaccgggaggcaaagcttgcagtgagccgagatggcgccaaatgcactccagcctgggcgacaagagcgaagctctgtctcaaacaaaagaaaagaaaagaaaagaaaagaaaaaagtatggtttatccacacaatggaatgctaagtagcaggtaaaaagaataaagtagcattcacacactaaaatgaaaaaactcccaagatatattaactgagtaaatgggagttattcagcagtggatatacggtgctaccatttgcgtaaagaacagaaacacatatatgtgtgtaaatgcatgggatatctaaggaaagatatgcaagaaatagtgcctcaacacacactaatgcagtaagaatgggaactaatacacatagtgcttactcctcatgttctaagcacattacatatttaaactaattcagtacactccttttaaactgacagatattcacatacctgtcttacttcactggaatatcagctccttgagtgcataaacatggcataagcctttttatatgctacacaggccaggtgttgtggctcacacctaaaatcccagcactttgggaagccaaggcagaaggatcacttgaggccaagagtttgagaccagcctgggcaatacagcaagaccccatctctacaaaatatgtgtattgtgtatgatacatatgtgtgtgtgtgtgtgtgtgtgtgtgtgtatcctacacaaatgctagtatatttatcacataatattctcaggaagtatgtgtctcattcagtcagtatcaaatataagagaaaatatcttcatttagagctgctgatcttagaggttaataatcattaagtagaaatatattttcataatgagtttgccgtagcatgaagttgagccacaatgcaaaaataagtggcattgaaagtgcgctattctatatatgtacacccaattatagttgtgctggacacaccagggaactgaactgaattattgaagaaacgtcctgttttcttcttactttccattcaaaagactgcattatcacagcacagtcccctccctttttatactttgagttcaggggagtatttttaagtgtttaagtttaaaaggtctgctactaagttaaatgggatcaagtatataaagtgcttagtacaagcctgccccaccataaacctcctttaaagtggagcaatgtctctttttcatgttggaggcttcaggcattatggaagagaaaagtaaacaagagctggtgctcaatcttgtcgacaattgggaaatgagtctgtaacaaaaatagagtggaacgtgggagtgaagtgtttttgcctttgacaagtcattaaaagtcatcagtgttataaatcagacagtctggggaaagagaaaaaaaataaataaaaccctgattcttagattcaaaaattcacttgttcaatatggtatttatttgggtgcctacataggtgaggcaggcattataacaggcaattgttgccttttggcgggaaccgctctcttccagtaattcgccaaaataacaaacacaaagggaaagaggagaggcacccatagatgttctctaggccttttagaaaacatggacttgttcctttgaccccgtatatgcgaatctattagaaaggtgacattgtatgcataagggaatgggtactgttcaaaaaggaatgccccgcaagtgttaccagggcaaaaccggaagagtctacagtgttactgcatgctgttggcattgttataaacacacgagttaagggcaagattcttgccaggagaattaatgtatgtattgagcacattaaacactctaaaagccgagatagcttcctgaaacgcatgaaggaaaatgatcagaaaaagaaggaagccaatgagaaaggttcctgggttcaactgaagcgccagcctgctccagccggagaagtgtactttgtgggaaccaatgggaaggcgcctgagctgctggaacctattccctatgaattcatggcataataggtgtgaaaaataataaaagacctctgaaatgtaaaaatgttcctcttcattgagtagaagtgtggtgtcccttcccccaaagaaatatttaaagcaaattttaatcgtgtcctaattcactgtgtaacgtctttactattcaaatttaatgtatttcttgctgaaagatgtgaggtggcttattgtgcaacaaattactcaattggttacaaaatagccagatattatttatggctggtttgaagatagtccctctaaatcaccatggaagaaacaaaataatttacaaaaatttaagttaaaaaaaaaaaaaaaaaaacaggtggccgggggcggtggctcatgcctgtaatcccagcactttgagaggctgaggcaggtggatcacctgagatcaggagtttgagaccagactggtcaacatggtaaaaccctgagtaactactaaaaatacaagaattagccagtcgtggtggcgggcacctgcaatcctagctactctggagcacctgcaatcctagctactcaggaggctgagccagggagaattgcttgaaccctggaggcggaggttgcagtgagccgagactgtgccactgtactccggcctgggcaacagagagagactccgtctcaaaaaaataaaaataaataaataaataaataagctacaatgattggaaggacatgacatctaaataacagacagccctttatactgaataaatttagctttttaaaggacactgcctgtgggggaggggagtgggaaaaaaatggaaaacaaagttgttgtcttagtccactgggctacttaacaaaataccataaactaggtagcttataaaaaacaatattttgtttctcacatttctggagaccgggaagtccaagatcagggcagattcattatctggtaaggccccactttctggcttacagatggtgacttcctgctgtgtcctcacatggtggaaggaatgcaaggggtctctctctctcaatcctctttcataagagcactaatcccattcatgagggtgagcccgcatgacataatcacctcccaaaggcgtcacctcctaataccatcaccttgggtgttaggatttcaacatgtgaatttgggaggaacataaacattcaggccacagcacttactatactcttatctttctcagtgtgctgtagcccagtgaaaactctgtcactgactaaggaacctctactctaaaatccttttttttctttatttttcattcacttgtttgcaagctaaaaagtaaatatagactacatgttttcatcaataattccaacctaaagaagttctattacctaacaggttcattttcatagttagaatgtaatttataaatttatcatttgcagccaggcacagtggctcatgcctgtaatcccagcactttgggaatctgaggtgagcagatcacttgaggtcaggagtttgataccagcctggtcaacatggtgaaacaccgtctctactaaaaatacaaaaaaaataactgggcgtggtggcacactcctgtaatcatagctactcaggaggctgaggcaggaggatcgcttgaacctgggaggtggaggttgcagtgagctgagatcatgacactgaactccagcctgggatacatagcaagactccatctcaaaaaaaaaaaattatcacttgcttatataacacaaaaaatcttgtaaaaacataatttccagttgggcgcagtggctcacacccgtaatcccagcactttgggaggccgaggcgagtggatcacaatgtcaggagttcaagaccagcctggccaagatggtgaagccctgtctctactaaaaatacaaaaattagccaggtatggtggcaggcacctgtaatcccagctacttaggaggctgaggcaggagaatcacttgaacccaagggacagaggttgcagtgagctgagatcatgctactgcattccagcctgggtgacagagtgagactccatctaaaaaatatatatatacatatatttttttcctcaaataaatcataacttttaaaattaggttagaaatatctattcaaattatttttaaaataccatcaaggctgggcatggtgtctcatgcctgtattctgagcactttgggaggccaagatgggaggatcacttgaggccaggagtacaagactagcttgggcaacatagcaagacctcacctctatagaaaataaaaaattggccagacatggtggcgtgtgcctctagtcccagctactagggaggctgaggtaagaggataatttgagcacaggagtttgaggttgtattgagctatgattatgccactgcatagcctgggtgacagagcaagaccctaaaaaaaattgaattataaattcatttatgaactttgggaaaattatttatttctccccacggggttcagacaagtaatttcacatttcattgtaagtcaagggtaagaaaacattttttgtacatccatcactaatagagatcacagtatgtcaatgaaatatttaaatacactgtacagagattgctttttaatggatttctataagtagtattaataggaaaaagcatataatacaatctactctgtatctaagagctttaatttattcaaatattggaagaaattcatcttctgaatttttcttatttaaaaagcattatgagaactgattcaaggatggaggaatcaattagtactcagcaattcacagacatgacataaacatgacatttttaagacataaacaaagactgcatgttggcagcataggggacagtcttgctcttcctcattttttgaagcagagatatttcatatttcatagtttctgaacttcctcaggagttctgagggagcatccttggaccagcggaaacgaaggtgccaaccattcacatctgcaaaacctttaaaggaaagaaagtaaatatttaaaatcagaagtaggaaaagtcgatcttgttatagtaaaacagcttggggataatatttcactgcagcaggtacaatgtaagggtaagactttggtatgaattattaacatcttagagaaatggattaacttaaacagactggaattcttatgaacacgaattacaatttatatggatgataagacctcacatgcttaaatacttaataagaggaaatacatagatgcctctggtggtggggaatttgacaattcacatgcaaagaaatttgaaacaaattacacagttttcaaaaacctttcaaaagttaaaagtcaatggcaaaaggatcgcttgaaatacaagtactataattgaattccatggtaataagatttttttttagttataataaacaacattgttgaaaaccagaggaaaagaaggtaattttccttccctactagaagtatgaattagcaaaacccctctggcaggcaatttggcaatatttatcaaactcgttaaaatgtataaacctttgccaggcgcagtggctcacgcctgtaatcccagcactttgggaggccaaggcgggcggatcacgaggtcaggagatcaagaccatcctggctaacacggtgaaaccccgtctctactaaaaatacaaaaaattagccgggcgtggtggcgggcgcctgtactcccagctactcgggaggctgaggcaggagaatggcgtgaacccggcatgcggaggttgcagtgagccgagatagcgccactgcactcaggcctgggcgacagagcgagattctgtctcagaaaaaaaaaaaaaaaaagtataaacctttgacccaataattttactccttgaaatgtatcctaaggaaataataatggatgcacccaacgatttaactctaaggatgtttataatgataccatttataaattttttttgcaaaccaagaaacattctaaactttagcaaatgaaagctggttaaaaggttttgatatcgtcattaacaatatcttaatatttaccattatagaaaaatgctcacagcatattgctaagtgacagttaacaaaactgtttatatagtatgatctcattcctaaactcattatttacatgaatatttatgtgaaatttttttaagtctaaaaaaagaaggcccagcatggtggctcacgcttgtaatcctagcactttgggaggccgaggcaggtgcctctcttgagctcaggagttcgagaccagcataggcaacatggcaaaatcccgtctctacaaaaaaatacaaaaaattaggcgggcgtggtggtatgtgcccgtggtcccagctactcaggagactaagacaagaggattacttgagccccagagggggaggttgcagtgagccgagagggtgccactgcactcaagcctgggtaatagagtgacactctctcaaaaaacaaacagataagaaaaggtacaccaaaattaatagtatttatccctggattgttacaatagatgtgattttccttttttttttttttttccttttctgaaacggagtttcgctcttgttgcccaggctggagtgcaatggcgcgatctcagctcaccacaacctccgcctcccgggttcaagcgattctcctgcctcagcctcccgagtgctgggattacaggcatgagccaccacacccggctaatttttgtatttttagtagaatcggggtttctcaatgttggtcaggctggtctcaaattcctgacctcaggtgatctgcctgcctcagcctcccaaagtgctgggattacaggcgtcagccaccgtgcccggccaattttcatttttaatactcttttttgtttatctgtactttcttatttttctgcaataaacatctatgcttttcgtctttttatgttaataatattgctaatgaaaaagcaggttacagaataatatataaaatacacttccattgatattttaatatagtatataaatatgtagtcagaaaaagcatatacagaatagttaacaatggttatctcagaaaaacagattacactgacactttttaaagaattattggagaaaacaaatctgaagaattttcatttggggaaaaagcaaaaaggaaattgtttctgattgctataattgttcctataattaaaacttactcacaaaatatgtacagtatgatccttttagatatactaacacaaatgaaaatataccaaaatatcgataatacatatttctctaaatgataaaattatgagttatatgttcttccttttgcttgattatattttctcacattttatatagtaagtaagtgtcatttttgtttaaaaagatgtagtttctggccaggtgcggtggctcacgcctgtgatcccagcacgttgggaggccgaggcgggcagatcacaaggttgggaattcgagaccagcctgaccaacatggtgaaaccccgtctctactaaaaatacaaaaattcgctgggcgtggtagcacacgcctgtaatcccagctactcaggaggctgaggcaggagaatcacttgaacccaggaggcggaggttgcagtgagccaggatcacgccactgcactccagcctgggcgacagagcgagactgtcaaaaaaaaaaaaatgtagtttctagttagggttcccgtagaaatagacatgcagacaagaacttgaaacaggttgggcacagtggcccacacctataatcccagcactttgggaggctgaggccaatggatcacttgacctcaggagtttgagaccagcctgggcaacatggcgaaaccccatctctataaaaaattagccggatgtggtggtgcacacctgcagtcccagccatttgggggcggaggtgggaggatcatctgagcctaggaggtcgaggctgcagtgagtcgtgatcacaccactgcactccagcctgggtgacagagagagactctatctcaaaaaaaaaaaaaaaaaaaaaaaaaattgaaacaaagtggctaatttgggaggtaatcccaggtggcaccttagcagaatgagaaccaaagctataaaaggtacattatcaaacaagttactgccatgggtaactgcaaatgatcccactggggaaccctgggagataatataaaacttcttagagttatctcacatgaggggtgaaggacctggagaatttagcttcccacttccactcattattgtcatccaaagggcatttactccctgacacttactgcctgctgatttgctgccaagtaggctccattgccagagcaagccctctggcagagtcacaatgtttgtggctggagccacaaggttggcaatgcctaggaaggtagtgcccagggacacggcagcacaccaaaatcattgcgtacatttaaatttttcttggtgggacgcggcggctcatgcctgtaatcccagtgctttggtgggccgaggtgggcagatcacgaggtcaggagttcgagaccagcctggccaacatggtgaaactccgtctctactaaaaacacaaaaaattagccgggcatgatggcaggtgccgtaatcccagctacttggcaggctgaggcaggagaatagcttgacccgggaggcagaggttgcagtgagccgaggtggtgccactgcactccagcctgggcaacaaagcaagattctgtctaaaaaaaaaaaaaatttctttctcttttttactccaagatgttacacaaaactattttattttagaactgtatttatcagaagacatatttattgcatatttaagcagaaagaaagtaaaaatgagattgtctcgcacagtggttttcagatgcagtgctccatattttactttttgcaataaagaattagaatgtggtgggggctatttggtggctgctcatcacagaagagacatcaaaaggcaaattccaaagtgaatatctagcactgcttgaggaaattagcaaatatgctgaaaagtaatatataagaagccactcagggcttggtaaagttgacaggaataatatttcttaaatgctgacattataaaaatttacgctgcagtaaaatgaaatcataaataatcatgcaacagcactttgatatatccaactccagctttaaggcactagtcagaaaagccaataatcttttaaacagcataaagaaaatacttgtaaatgcaacctttggcagaatttcataattctccaacaacagctttttagaacaatgattcccagttggatgcaatggctcatgtctgtaatcttagcactttgggaggccaaagtgggcagatcacctgaggtcaggagttctaaaccagcctgggcaacatggtgaaaccccatctctactaaaaatatgaaaattagccaggtgtggtggcgggtgcctgtaatcccagctacttgggaggctgaggcaggagaatctcttgaacccaggaggtggaggttgcagtgagccgagacagtgccactgcactccagcctgggcaacaagagcaaaactctgtttcaaaaaaaaaaaaaagaacaatgattcccatcccctccacttcattctttttttttttttttttttttttttttttttttttgacacggagacacagggtcttgctctatcacccaggctggagtgcagtggcaggatcatagctcactgcagcttcaaactcccaggctcaagtaatccttctgcctcagcctcccaagtagctggaactacaggcgcacgccagcatacctagctaatggttttttaattttgtggagacagggctcttgctatgttgctcaagctggtctcgaactcctggactcaagcgatcctcccatctcagcctcccaaagttctaggagtacaggcccaagccactgcagctggctccacttcattcttaaacaatagcatacatatcacaatatgaagacatcaaaactggcatcacaatttgttctgagtaaattatatgtgaaaattgattatatgaattggcattatctgttattacccaagtaaattagagccgagaaccagggagaggaaaagaaaagcactcaggacacaaatgcctacccaagaattctatcacaagccagctgccgaaatgacctgccttgcctctaaggctagttttacctattgccatcactcaccaattacagcttgctagctcccagaactttgctagtgccaatgagttttctttcataacaatatgtaacatttctctttctaataaaacccccaacattttatttgttcttcagacacaccaaagaccatcccatctgtgtgtatgccttgaattgcaatgtagtttttatatattttcccaagtaaaatgttttacatagagattcgaatctatatttttgtttgactttgacataacatatatctacactgtggaatgttatcagctgttaaaaagcaggaattcattctgaatgtaaggatttaaagagaagtctcttaataataaaagttaacactaaaaaaagtgtttacaatgtgcctggtattggtctaaatattttacgtatattaagttattgtgcgtgtgtgtgtgtgtgtgtgtgtgtgtgtgtgtgacaggatctcattctgtcacccaggctggagtacagtggtgcaatcgcagctcactgcagcctcaacatccccccccacacacacacccgggctcaagtaacgggattacaggcacgcaccaccactcctggctaattttcatatttttttttagagatggtttcaccatgttgcccaggctggtctcaaactcccggcctcaagcaatccgcccacctcaccctccctaattgctaggactacaggtgtgagccactgcgcctggacaattaagttatttactcctcaaaaaaaaaaattttatgaggtagacactaatattttgaccattatataactaagaagacatagatgcagaggggttaactagcttgtccaaggtcatacaactcatcagtgaaaagctgagcccacattcttaaccactgcgtaacacagagaaatgtgtacagtataaccccattctttacttttaaagctctcataagtgcacatatacacacctgtgttagcatagagaatagtggaaggaaacacacctgagtgtcagccttggttacttcaagaaacagaagcagagaaggttggcaacctggctatatatgattctttgaattttttaacagcaagtctatactacttttgtttttattcagtatctaaattactatttttttaaaaagaaggaaaatttcgtagaatcctatgagaggggctcaagaggcctcagcatcatgcctgagtctctgaagtgtctcccacccacactacacctaattttggtgtgcacagacttggtctgaatctgacagaaacagaaagacttggggaacccccaggggttcaagaaacacagaactgaacattcatcgtgtttacatgtaggggagtgattgtactcctgtgtttgcttaaaacactgtttttctacacttcaggcttctcctttgatcagtttgttaaattataaccatttccagttactgggtgatgcaatcaatgtgcagactccacagccatctcttgggtaaccaacagagacatctgaatcaaactctatggatcttcattcccagcaagaagagaagatgtaaaagttctccccaaagagagatttgaagtgactatttctcaaaagactataatccaccacaagccatctaactatcttcttttgaatacaagtgttctagggtgttcaggaacgttctgcttaaaggctaaattctaatagggtgctacatcacaaccctgagaatcaacacataataatttgaaggacagttacaatgtgtgtatacaatgtgtgtatatacaacacatccaaactagttggatggctagatagatagccagccagatagacaaatgatacaaacaggtaacatttacctagggcttcctagaggtgaaccgctgtgctaagcattttttatgtatctccccatttaatcctcatggtaaccctataagaaggtactattttttatttaagagatggagtctcactatgtcacccaggatggaatgcaagcacctaatcacaggagtgatcatcacacacagcagctttgaactcctggcctcaagccagcctcctgcctcagcctcttgagtagctaggactacaggtgcacaacaatgcacctagatgagcaagtactattataatccctattttatagatgcagaaactgaggtctagagaagttaagtaactttgccaagtaatacagataataagtagtagagctaggatgtgaactcaggtagtgtagcttggtagccaggaggtaaacttctataatactctgcttcagtggatttataaatgattcagaatgtctacagagctatttacagataaggcattattgggccgggcatggtggcttacacctgtaatcccagcactttgggaggcccaggcaggaggatcacctgaggtcaggagtttgagaccagcctggccaacatgatgaaaccccatctctactaaaaatacaaaaattagccaggcatcatggcaggcgcctgtagtcccagctactggggaatctgaggcacaagaatcacttgaacccaggaggcagaggttgcaatgagctgagattatgccactgcactccagcctagatgacagagtgagactccatctcaaaaaagaaaaaaaattaaattcaattcaataaggcattatcataggatagggcaatgccttggaacactgactgaagtcaacctgccttggttcagacccctttcccttcccatacaagctgtatggctttaagcaaattattcaacctcctggcctttggttttctcatctataaaatgagaataatattgatatcagcctcacaagcttgtagtgagaataagttaatatatataaaattaatattaaatgagataataaatgtaaactaatatatgtaaagagtgttcctgcacatagtaaacattcaatcaatgttagctagcattatgtcagtaaagccaaagacactgagaattgtctcaaggtttcccttctgaggaataccttctagtttcggtgtcaatgctaagtgtcttttaagatgataaaccaatctttaaacttggcactgctgtgcagattgaaaaagttaagaataaatgcaatataaacaaaactctttaatttcagaccttctccattctgcagttatataacgtgacttacctgaagaatctgaattttgcggggagactgacttctctaggggcttgggttctttctgctccgttttctctgcggttgaagccagctcctctttctttctttctctttgctcattacattcctcattttccatcttggtggtatgagtcttgtcagattcttccagcatcaggtcttttttacctctgacaacccagtgcattgactaaattaatgtaaagcagagatataaaaattaaattgatattatatgattttctatatttaaagtttgatatgtggtaacacctgacctactactgtagtgctaattaacagcatgttagacttgactattaacaagatactcataaattaatccagatattaattaatccaactattaatagttacttttcaccatacacccttttgtacctttttcattttctgttctgtatatgtatttcctattagatctaaaaattggacagatggatgaatgaatggagggatggatggatgaactaacaaatgaatacagtgaaaaagagcgcttttgagtttgctgtatcaagaatatttcaagtggaatcattagccctaccatcaaccaaaataatgcataactatttcttaaaacctcatcgggatattgtgggaagctattcctgaagtactaagaaacagtgacacactacctctattaccacaactcaagactagaaggaaacatagcctttaacaccctaaaattataaatattctagctctctgccctaatcaaatcaaagaagtcatttattcccaccttcaacctatctcttcccaactacaaagaagtgtcatcctgaatcctcttctccaaatataaccagtccaaaggctaatcaaccccaagatccaagaaccaccccataaagcagtcattgccaccaataaatgtaaccagctctcaccctaacaagaaaaagaaaagaggctgggcacagtggctcatgcttgtaatcccagcactttgggaagccaaggtgggtggatcatttgaggcaaggagttcgagaccatccttggccaacaaggtgaaaccacgtctctactaaaaatacaaaaattagctggtcgtggtggtgcacacctgtaatcccagctactcaggaggctgaggcgggagaattgcttgaacccaggaggtggaggttgcagtgagccgagatcgcaccattgcactccagcctgggcaacagagcaagactcggtctcaaaaaaaaaaaaaaagaaaaagaaatgggaaggaaaggcaccaaaatataactgtagttatgcctgtgtaacagaattacatcttttgtttttgtatttcccaaattttctatgagaagattatatatatgtacaattagaaaacattgtattttaggctgggcgcagtggctcacaccttaatcccagcactctgggaggcctaggtggatggatcacaaggtcaggagttccaaaccagcctggccaacatggtgaaacctcacctctacttaaaaaaacaaaaattagttgggcaaggtagtgtgtgcctgtaatcccagctacccgggaggctgaggcacgagaatcacttgaatccgggaggcagaggttgcagtgagctggtatcgcaccactgcactccagcctgggtgacagagcgagattctgtctcaaaaaaaaaaagaaaatattcaattttaaaaattaggcgaagtttcgatgcaaaaacatacaaggtgggagattcctggtgccaacaatatgtgtgggaagggaatagttacagagtaaacacttcaaaaccatttgctaaattgtaaatgcaagtattacccatttctctgtagattttatttcaaaataaaaacgttaatttttaaaagaggcaatgcctcagctggtattaaaaaaaaaaatgacttttgtttggttggtttaggtttgttgttttggtttggtttttgcatatgcacaaaataaaagaggctgccagtgacttcctctgcagagggaaaaggatattaggaaggttagtgaaaaacaaggaataagacattcaagaattcagggcccagagagctgaaaatgtaaactgtgagcttcacaagccagcaaagtggcctgtacgtgatgtattgatctctgtgcctcagtacttctctcttgaaatcaaagtacctgtggtctgtcttagataggttaggattaatgtctaatccacagtaaatgctttaaaggtcctcagtgaaaagatgttctgaaatagtagtcttatccatctcctttgtgagtaaatcagaataaaatatgttatcagactcccatatctgctgatcctcattaaagaaatatacagaagaaatatccaaactgtatctaaccttagatacaagtgcttctcacgctttgtagttcaatcaaaggactaacatcagagtgatgctaagcagcctggtttgctgggacacagttagatagtctgcaaatcactcatttctgtgttcacaagcatatttctcaactccacaagggtattagttgcacagaacaacatttaacatcaagcgaactagtctattatgcagctactcatttcagtagaatcagcatcaataaaagatatcaaatgacagcaattgatacagactaagagagagactagaaaggggagagtctacagcaagataataaaatgcacaagacagaaaatctatatatgcatggaaggaactaacgctaaacagacagcaagcctaggtgcaaaggccactaatcttaacagtctgtgaaatttctatgttgttattctgccttcacaattaacttgtttactagctttcttgaacgagttggttttttttctctaggaagtcattttcttacattctagaccttggtcaatactaggaaatagtgctcgtctcagcagcacatataccaaaattggaatgatacaaagaaaatgatcatggtccctgtgcaaagacaacaggcacgttcgcgaagcattccattaaaacacacacacacacacacaaacacacagggaaataaaaaattttgtttacatgccagtaaacattggcacaacatttttttaaatccatggactcagatgagccatagatcagctgaatagctatacaaaattgactggttattattatcctggatcagtgatcaccatgagtggatttttcacttatcagggtgatttctgacctgcttttggataacatccaattaagacagattgccttttgaaccagcagaaggtgttgaattgcatactgtttcccatctggctggtgaaactgtggccatgtgggcatagtgtaggaagctttctggataggtagtctatggccagttgaacccaccccaaagacaccttgcccagctgggaacccagaaacaatcagcagacaaataggtccacacgaggctgacccaacaagccctcccagaggcaatcaatttgtcaaatgatcaattcaccaaaaatgtgtttctattaactctttataaaatttacagcaattgaagtggcataagatagttttaacggcttatgagaattttttttagccattcattttgactgtgcctttgctgtggcttctttttcccataggcatcctaaatccatgctgccatatattttggtgctagagggagagccatccacaccctgggtctctttgggtaaaaccatttagcatgacaaagatacatttccctaagattctctggaatcctgggataactcttcaggttatcccaggatcccaaaggcctgaattactgaatcctcactccaaaccttttttttcaaaccaatactacatgtctaaatttaaatcgccaacatattcattgacctgggtgaggtcttaaaatatttttaccaattaaactagcaggaggaacttctagaaaacaaaaagaaataaataagtaggtagtaaagtgacagacttagtgtagggaaaaaataccagttcagttgcatcactcctggatgatagaaatgtggtggatatatacaccatggaatattactcagccctaaaaaagagcaaaataatatcttttgcagcaacttagatggacctggaggccattgttctaagtgaagtaacttaggaatggaaaaccaaatattgtatgttctccattataaatgggagctaagctacggatacacaaaagcatacagagtggtataatataatggactttggagactcaaagtgggaggctgggacggagagtgaaggataaaaaactacataatgggtacaatgtatactactcaggtgatgggtgcgctaaaatttcagacttcaccaccatacaattcatccatgtgtctaaaaaccacttgtattagtccatttcacactgctgtaaagaactacctgagactcagtaatttatgacgaaaagaggtttaattgactcacagttcctcaggcttaacagaaagcatgactgggaggcctcaggaaacttacaatcatggcggaaggtgaaggggaagaaagggccttcttctcatggtggcaggaaagagagagaaggtagaactgccacatacttttaaaccatcagatctcatgagaactcactatcatgagaaaagcaagggggaaatctgcccccatgatccaatcacctcccatcaggaccctcatccaattcaacatgagatttgggcaggacacaaatccaaaccatatcaacacttgtaccccaaaagctattgaaaattttttgaagtttttaatttaaaaaaatgtggcacccctgaggctgtggctcgtttgaggaattctcccaaaggaaattcccaagatatgatcctgtgtgtgatgctacaaaagtacaccgtgatttgtcctgccttgtgggtatagggactaataatgttcccaaacaatgcttttccgttccagagggattatactatttaaacaaaaagcagaaacacagggttgatggtgtgaaggaaagggaatttatgagatttaacaatctagccaggtgcgatggctcatgcctgcaatcccagcactttgggaggccgaggtcttttatcaacaatttgctcaagtcttctaaaataaaaactatgaagaaggaaatctaaatgtaaccctgaagggctataatttaagagatgtgaatcattttatacactaattctaacaactgtccctgaaaacttacctatgaggtaatttctgtattataagtcccatgtcatagaaaagtgttccaatggagagaatctaggtaataaatcatgcctaaatctttaaaattacattttgtctataatatataaaggtcaatgttgaacaaaataaatatatgacagtaattatagtgaatattttgatatttatgccttttaatgacatgaagaaagataacacaatgtttttaaagtctaacaattctttcaccagaatgtttaataggaataattcatggctttctctgactaatcagatcctgcctttttaatgaaaattctaagccttgaaaagagagcaagctgacataaactaaaaagatggagaatgtgaatttacaatggttaaaactcagcaattcatgagcaacttgagaagtacatttattagagctcataaaatagtaagcaataacagggagtgtgtatactgaaacaaacagccaaagagattgaaagaaatgtagtcacaggctcttctggcacaaattcattgcctttattctgatgagcttctcttcatgggatttacggacactgaattatatccagactctgctaacttcttggttttctccctcctatcgcctaatgactctttaagctactacatgagtctaatccatgggcatcctgagcttcacaaattcacgtcgcacccagcgagaaacccaccgtcttcactgagtcattcaaagcttcccactgctggaatggcatcgacatctggctccttcgccagtggtcatagcgggctcgactctcttcattggtcagaatctcctttgccttctgcagtttctgaaaagtctccactggaaaacaaatcaagaaatgagcacttctctctcggagaggatattttaaactccaaaactatccaactgctcttactaaaaccatgactgccacttaatagctatgtgaccttgggccaatttacctcattaagcttttgtaaagggtatcataaggacaagcaagatcatggatgtaaagtgctcggcacagtttatccactccctgtattgtgcctcagtcatgtgccagaggctactcccggtgctgatgacacagatgtgaataatagacattattagcaggggaaagaaacatttgtaaacattgaaaaaatactattccaccttataggaagaaaactaccttttttagtgctgggtgtgaaacagggcagtaattaggcaagagggacagtaaaactgaagactataaagactataaaactgaagactataaagactataaagacatgactgaggcacaatacagggagtggataaactgtcccaagcactttacatccatgatcttgtttgtccttataaagcaggaaggagcacggtgacttagaggaagtagtaattgccagtgtggctggaggacacaaggctagggaaagaacgatgagggatggggctgtagagtagacagacaatagctcaatcaaccagggcctgagatgtcatgttaaggatgctggcctgctttttgtcgtaagagaaacgggaggctttaagtataataaataacatggtagatgctgggacaaatggtagcttgtcactaatctacttgaccagatggtatataatagaaaccttttatggctctgttagaaacacctccaaagtctcttctgctcctcagtgaagtaaaaactttctgcagagcagaatacaagatttatatacaggccgggtgcagtggctcaggcctgtaatcccggcacttcgggaggacaaggtgggtggatcacgaggtcaggaattcaagacccagcctggccaagatggtgaaaccccatctctgctaaaaatacaaaaaaaaaaaaaaaaatagctgggggtggtggcaggcgcctgtattcccagctactcgggggctgaggcagagaattgcttgaacctgggaggcagaggttgcagtgagccgagattgtgccactggactccagcctgggcgacagagcgagactccatctcaaaaaaaaaaaacaaaaaaaagtagccaggcacggtggcccaggcctgtaatcccagctactcaggagcctgaggcaggagaatcgttggaacccgtgaggcagagcttacagtgagccgagtttgcaccactgcactccagcctgtccgacagagcaagactccatctcaaaacaaacaaacaaaaattcatatgttgaattcttaactcccaaaatgatagtattaggagatggggcttttgagatatgattagatcatgagggtggaaccctcacgaatggaatcagtgccctaataaaagaaacccagacaactcgctcactctgtttcccccatgtgaaaacacagcaagaagacaattagctaggcatggcggtgggcgcctgtaatcccagctatttgggaggctgaggcagaagaatctcatgaatctgggaggtagaggttgcagtgagccaagatcacaccactgcactccagcctagatgacagagcgagactccgtctccaaaaaataaaaaatcaatatacaaatatcagtggtgtctctacacagtagcaatgaacaatctgaaaatgaaattaagaaaattccatttataagagcatcaagagccggacccagtggctcatgcctgtaatcccagcactttgggagtccgaagtgggcggatcacgaggtcaggagttcgagaccagtctggccaacatggtgaaaccccgtctctactaaaaatacaaaaaaaaaaaaaaattagttgggtgtggtggcaggcgcctgtaatcccagctactcagtaggctgaggcaggagaatcacttgaacctgggaggcggaggttgcagtgagctgagaccatgtcattacactcctgcctgggtgacagagcaagactctgtctcaaaagaaaaaaaaaaaagcttcaagaagaatataatatttttaaaaaattgaacaaaagaaggaactacacaatattgtcaaaagaagctaaagaagatctaaataaatgaaaagacatcccacgttcataaagatttactattgctaaaatgataataccccccaaactgatctgcagattcaacataatctctatcaaaatcccagttgccttttttgcagaaattgacaatctagtcctaaaatctgtttgcaaatacaagggacccagaattgccaaaaaaaaaaaaaactcttgaaaaaaataagagcaaagttggagaattcacacttctgaatttcaaaacttatactacaaagctacagtagtgaaaacagtgtggtactaacataaggatagacatacttataaatggaatagaattgagaatccagaaacaaacccttacatttacagtcaattgatttcaacaagagtgccaagacaatttaatgaagaaaaaaaatagtcttttcaacaaatggtgctaggataactaaatatcaatatataaaaagcatgaatttagatttctaccttaagctataaacaaatattgactcaaatggatcacagatccaaatgtaagggttaaaaccataaaaaactgggaaaaaaaaaacataggaataaatctttgtgacctcagcttaggcaagagctccttagatatgacaccaaaagcacaagcaacaaaagaagaaatagataaattggactacatcaaaattaaaacttttgtgcctcaaagaataccatgaagaaagtgaaatgacaaaccatggaatgggaaaaaatatctgcaaataatatatctgataaggtacttatatctagaatttatagagaacatttacaactcaataataagacaaataacccaaatgcaaaatggacaaagggcttgaatgaacatttctccaaagaagatatacaaatagccaacaagcacctgaaaatatcctgaacagtattagtccttcaggaaatacaaatcaaaaccatagtgagataccactttatacctactaggatggctaaaattaaaggataataattgtctagaatgtgaaaaaattggaactgtcacacatgacaggtgggaatgtaaagtggtatatagtcactttgaaaagtagtttggctgttcttcaaaaatattaagcagagttgccatatgacccaactattataatcctaggtatatatccatgagaaatgaaaacatatgtccacacaaaaacctgtatatgatagcagcattactcataatagccaaaagtgaaaataacacaaatgtccatcaactgtgaattgataaacaaaatgtggtatatccacctaaaagaattatcatccagccataaaaaggaatgaaatgttgatatgtgctacaacatgaatgagtcttgaaaatatgctaaatgaggctgggcacggtggcttacacctgtaatcccagcactttgggaggccaaggtgggcggatcacctgaggtcaggagttcaagaccagcctgaccaacatagagaaactccatctctattaaaaattcaaaattagctgggcgtggtggtgcatgcctgtaatcccagctacttgggaggctgaggcaggagaatcgcttgaacccaggaggtggaggtttcggtgagccgtgatcacaccattgcgctccagcctgggcaacaagaacaatacttcgtctcaaaaaaaaaaaaaaaaaaagaaaagaaaaaaaaagatggggctattgaaagctacaggaaaacaaatgaacaaataaaagtatcttgccatagcagcttggtccagcgagagcaaatcttcctgttgctgacgacaatgtaaatgtcccattgtataaatgatacgtcactttttccaacaggaataaaaagcttattaaattaccaccaaggatgcacatgccagttgctactcatgtggggcttgtaaagatttatgtatttatctgtgagtcaccttctcttttcacatcattgttggcttcgctttctagaattcccagaatgaaagaagctgcttagaattattctgatgtaagtccctcaacaacagttgataagcagaaagaaaaaagaaaccttatctttcctataatgtgacctttctcttgttccatccacttcaccacatttaacaaaagtgagtttgggtttatatttttccattaatgtagcaactaatcaaatgagccacacaaggtaaacacttgccagttctgggaagagagatctcattttgtaagcttataggagcaaatgatgctggaagtcttgcgagacattctgatttaactcctgggtctaccttcaaaatatagaggttattttaaattcatattttgcaatagaatttgtattacaacagtcacattttaaatgtatgccatttacaattacttaagaaataataatatgatgtcaaaatatgctttgaaaaaatctggaagaaaatataccaactgttaatagtggttctctatcagggaaagataaaagcaaactttttcttccaacattatttattaattatgttatttttattatatggggaaaaacagtaaagactataaagtaaaaaaaaaattgagacattaaaagatgttagttaacaaaggacaaattgctccccttcttctaatatccaaatgtccttgaagtttgcacatcagtaacaaaaataccattccacaggttcttagtctgaagtttactttcttttttttttttttttttttgaggcagagtctctctctatagcccaggctggagcactgtgacacaacctcagctcactgcaaccaccgcctcctgggttcaagtgattttcctgcctcagcctccacagtagctgggattacaggcacccgccaccacactcagctaattttttgtacttttagtagagacgaggtttcaccatgttggctaggcttgtctcaaactcctgacctcatgtgatctgcccaccttggcctcccaaagtgctgggattataggtgtgagccatcacaccggccttaagtctactttcttcatggccatggagaagttaatatagtgctaatctgaaacagttactgtcacccacacagagcgctggcatgagcaccagccaggagctctggggctcagtgacactatttttatagcaaagtcagtcctgtctgcagcacccacatctggagaggggaagggatttctggtggccttagatttacttttttttttttcagggaataaaagaatgatctaatcattacttataaaaagagaaaactatcccatcacgttaaatgtttaccttgggctgctacataaaacaaggaaagacaatccactgaattaaaattgccagcatccattaagcactttccacatgcaggactcctcatttaatcttcacagcagatgcatgaagtaatatactactagtctacctgttttacctacgagaatgctgaggcttggagagattgcccaagatcaactagactgtaagtggaatgggagcaatccagacaaacaagcctgtgtttatatccactactccatcatgctaccacatcagtaatttcaatggcaacagttgagactatatttagtggacgaaaaaggtatagatataagtttaatttatcctacccaaagttcctctactgtctagcttttcaccttaattagatacatttcaaaatctttccattacattctgaatttctgtcaagctaaacttcagtatccaagtgaatttttaaagatattttgaggctgggtgcagtagctcactcctgtaatcccagcactttgggaggccgaggcaggtggatcacttgaggtcaggagtttgagaccatcctggccaacatggtgaaaccccgtttccactaaaaataaaaaaaatcagctgggcgtggtggcacacacttatagctccggctactcaagaggctgaggcaagagagtcacttaaacccaggagacagaagttgcagtgagctgagattgtgccactgcactccagttcgggcgatagagcaagactccatccccccaaaaaaataaaaaataaaaaaagagattttgaaatagtctggccaggcacagcagcttatccctgtaatcccagcactttgggaggccaaggaaggcagactacttgagtccaggagtttgagaccagcctgggcaacatggcaaaaccccgtctgtactaaaaatacaaaaaaattactcaggtgtggtggcgcacatgtgtggtcccagctacttgggaggctgaggtgggagaactgcttgagcctgggaggttgaggccagcagtgaaccaagatcgcaccactgcactccagcctgggagacagagcgagatcctgtctcatatatatatttgaaatattttcatcagtaaccttaatcatccaagtgtgtaaagatccacataaacgttcagaaagttgtattaatgaaaactgagtaaacggatgcttaaatagattaaaaaacaacctctacccaaaggttgaatcatatatcaaatgcatgcctgcctagagaagatattgatgtctgtgtaccttttcattttaaacaatatttacacagtccactgtttctctgaacaagacgccttgaggcagcccatacatgaaaacccccatcactatggcaactagaaatggcaataattacacagtgattcatcatgtatcctgaataaaaattgtttgtcagggacagagaaacaactcacagtcatgcttcactgaaaagaacccagttaaagaataacctggggtggtggtggtttttaagtgtttatcaaatttttataatttttttttttttgagacacaatttcactcttgctacccaggctggagtgcagtggcgcgatctcggctcactgcaacatctgctcccgggttcatgcgattctcctgtctcagcctcccaagtagctgggattacaggcatgtgccaccacgcccggctaattttgtatttttagtaaagacagagtttcaccatgttggtcaggctggtctcaagttcctgacctcaggtgaaccacccaccttggcctcccaaagtgctgggattacaggcattagccaccgagcccgatctaaatttttataattttatgctaggacacctatcttaatattaactccagttcagacaggtagttaatatgaatcctaaagaaatgtttgggccaggggtcgggagcggtggctcacgcctgtaatcccaggactctgggagaccgaggcgggcggatcacgaggtcaggagattgagaccaccctagctaacaaggtgaaaccccgtctctagtaaaaatacaaaaaattagccgggcgcggtggcaggcgcctgtagtcccagctactcgggaggctgaggcaggagaatggcgtaaacccgggaggcggagcttgcagtgaaccaagagatagcgccactgtactccagactgggcgacagagcgagaagccgtctcaaaaaagaaaaagaaatgttcgggctaggctcggtggcacatgcctgtaatcccagccctttgggaggccgaggcaggcgaatcacctgaggtcgggagatcaagaccagcctggcaaacatggtgaaaccccttttgcaccaaaaatacaaaaattagccaggtgtgatggcgcacgcctgtaatcccagcttctcgggaggctgaggcacgagaattgtttgaacctgggaagcagaggttgcagtgagccgagatcatgccacggccctccagcctgggcaacaaagtgagactgtcacaaaaaaagaaagaaagaaagaaagagaaagaaagaaagaaagaaagaaagaaagaaagaaaggaaggaaggaaggaaggaagcaaggaaggaaggaaggaaggaaggaaggaaggaaggaaggaaggaaggaaggaaggaaggggaaggaaggaaggaaggaaggaaggaaggaaggaaggaatgtttatgcattcacttattcaagaaattgtgcagaataggtgtcctcttcagtaagtgccatgctaggggcatacgactgtgaacaagacaagcagggcgtctgccttactgagcttccagaatgactaataagcaaacatgcaataaggagacagtgtgacacacagtctactgcctgacgtacagggtgctcttgttagatgggacacatgggacttcccaactgatggtcagctgagacctgacacagaagcacaaactggccaagtagtcagggatgtgtgtgaaccatggagtgtttcaggcagaaagcatcaagcatagagggctggagtgtagaaagagcagagcacatgaatgaactaatgtaattctgagtggctgaaacatgaaattctaggcatggtgaaggagagcaaaaggggatggagaattaaggtacacagcatgaaggaatttgtgcctaaaggctcaacaatgacaaaggatgaactactgcacagtataacacagacataatgcaaagcgaaagaagctacacacaaaagagtacatactgtgtgattctatttatatgaaatccaaaactgcaaaactagtcaatggtgatagagatcaaaaaatgagagagggtgctgactttgaacaggaagggaaaagggatttctggggtgctgaagatgctccacatctctctgggcagtggttgacctggatatacatatgcacaaatttatcaagctcacacttattatttgctcatagtaccttaaacaagttaataaaaagggaaaaaaaatcaaatgagcagaagcaatagttaaatatctaacaaaagatgacctcacatatagaaaaaatgatctgtttttgcaaatcaaaggaatcaatgatttctagagaaaattaataaagaaccttaagacaagggacaaggaaaacattttcttttttcctttttttttttttttttttttttgagatggagtttcactcttgttgcccaggctagagtgcaatggcgcaagctctgctcaccgcaacctccgcctcctaggttcaagcaattctcctgcctcagcctcccaagtagctgggattacacgcatgcgccactaggcccggctcactttgtatttttagtagagacacagtttctccatgttggtcaggctggtctcgaactcccgacctcaggtggtccacccaccttggcctcccaaagtgctggaattacaggtgtgagccactgcacccagccaaggaaaacattttctaaataaagaagagtttggatttgtgcaatatggaattatagataggtcttagtatgatattatccttatagaaaaagcacttatacacacatgctatacgcatatagtaaacataactatcaaatttaagatataaggccaggcacagtgactaacacctgtaatcccagcactttgggaggccaaggcgggcagatcacctgaggacgggagtttgagaccagcctgaccaacatggagaaaccctgtctctactaaaaatacaaaattaactgggcatggtggcacatgcctataatcccagctactcgggaggctgaggcaggagaatcgcttgaacccaggaggcagaggttgcagtgagccaatatcgtgccattgcactccagcctgggcaataagagcaaaactctgtctcaaaaaaaaacattaagatataatattatctaccctgaggataaaatcagagtaggaaaacacaagagatttcaattgcactggtaaagttttaagctgggcggaacatatgtgggcatctgttagagtattttttattcctttttgtacatattatttttttccataattaaaaagaaaaatctgcaatgagaagcacttaaagaatgctgtagcaatccaagcatgaaatgatgggggcttacctacagcaatggcacccagcatgaagcgaggaggacacagtagagagagatgagaaaggtaaatcaacagtgtttggcaatttcccagatatggacatgagggagaggaaggagacaaggcttccatgacaccaactgaatggatggtggtgtccttcatagagatgggagaacacagaaaaataagcgagatttcagaggaggtgataggaaaataatgagtctaatttttgacagggtgactttgaaatgtttccaaatggaaatttcccagaagcagtcaaaaccacagtcttaagatggggagtgagaactaggttaaggatagatttgggagccatcaaaagagctggtgatttaagctacagacctggacaaggcttcaggagaaaatggggagtgggctcagaagagagcttaggagggaaccttggggcaacagaagagtcacaaaggagactgagagaaagcagcccaaagaggctggaggagaaccatgagtgcatagtatcctgacagctaaaagaaaaaaactttgtttcaaggaggaaggtatggtcaacagggccaaattgtgatgcaagttcaggggagataagtaccaaaaggtaaccactagatttgatactcaggcagtccttggtctatttctgagaaactagggaagtcagagtggaacaaatggaaaaatagcgagaagggaaatagagacatcaactgtggacttccttttcgggaagtctgggtctgaagagaagaagagaggcaggaaagtagagaagagagacaggttgcagagggattattggtttgttcatatttttcccaagcttggataggtataagcatgcttaagtgatagtgaaggaaagaaacaaaagtatgaatatatggatatattcaggtccccagtaatgaagaaatcacaacaagtttctcatgaagacaaccgcctagccgggcacacgcctataatcccagcactgggaggccgaggtgggggatcacttggaggtcaggagttcgaaaccggcctgcccaacatagtgaaaccctgcctactaaaaaaatacaaaaaaaaaaaattagctgggcatggtggtgcacgcctgtagtcccagctactcaggaggctgaggcaggagaatcacttgagcccaggagccagaggttgcagtgagacatgatcgcaccactgcactccagcctgggcgacagagactctgtctcaaaaaaaaaaaagacaaccacctggttacaaatatacttaagttatgttaacactcaatagctggtgaaataaagcatgaactagaagaattttaaaccacaaagcaacacagtacagcagaaagaaaaatagatcttaaacgactactattagaaaagatcctgcacagccctctccctttctatcatccaatagtgcaaagaaagaatacggttgagcataatagacaagagaaaattgagaaaattaagttactattcactggcttttggttctatatactactcattttcttgagaagtagcctttattaagttcttaccagctttggggttttcaggatgcttgtctgggtgacattccagagctctgactttaaattctgccaggatttgttcaacctgaaacaaaaatcagtgtttaaaataaagagtcatgccaggcgcagtgactcacgcctataatctcaacactttgggaggctgaggcaagcggatcaccaggaataagaccagcctggacaacaaagcaagacccagtctctacaaaatataaaataattagctgggcatggtgacacatgttagtagtcccagttacttggaaggctgaggcagaaggaccccttaagcccaggagttcaaggctgtagtaagctatgatggcaccgctgcactcctgcctgggtaacacagcaagatcttatctcaaaaaaaaaaaggtcaaacttaaatggcatgaaggaagaagttggggcatcaatccccaacccaaaacagccatgatcaacccaactttttttgatccttatatttctattttgactttttcctctaagaaataataaaattcagaaagcatccaataaacgctcctattgaaatagtcgttgtgatgacaatttaactacttaatttaaatgatggcccaagatacctatgagctcaaaatatttaaatatccagtccagacgtggtggctcacgcctgtaatccttgcactttgggaggctgaggtgggcagatcacaaggttaggagttcgaggccagcctagccaacacggtgaaaccccgtctctactaaaaatacaaaaattagccagacatggtggcaggcacctgtaatcccagctactcaggaggctgaggcaggagaatcgcttgaacctgggaggcagaggttgcagtgagccaagatcacaccactgcactccagcctgggtgacagagcaagagtctgtcttaaaaaaaaaaaaaaaaaaatatttaaatacccaaaatgatcaggtaggtttctcctagtaatatataaaatatccaaattcttcaaagatgcttagccaccattactcaaggataactgtctctgaattataagttataatttataaattatctattataaagctccttcttcctgtcttttggtctttttcttttatattaagaatttcaaaattaaatgaaaaagaacataattcaaacctgataattttgttaccaattaggagcttcattagagattttgactgggaaaacagaaactccagcccaaactaaaatgagatgtgagaggcatcaatgatttgatttgatttcacttacccatctaattcctattatcatgaattattaagacttggctttattaattgtaattgcaattacagcagcaggaaacaatagtggttatgtggctctagaatctgactgcttggttttattttattttatttatttatttatttatttttatttttgagacagagtctcactctgtcacccagtctggagtgcagtggcgtgatctccgctcactgcaacctccacctcctggcttcaagtgattctcctgcctcagcctcccaagtagctgggattacaggtgcccaccaccacgcctggctaatttttgtatttttagtagagatgggggtttcaccatgttggccaggctggtctcaaactcctaacctcaggtgatccacccgcctcagcctcccaaagtgctggaattataggcgtgagccaccgtacctgggaagacggcttggtttgaaatcccagttctgctacaaggctttaggcaaattacataacatccatgtgtctaggtttactcatctttacatcagatgaataatataagtagcgcacttaacacaaaacctgatcataataagaactcaataatagtggctattattaaatataagtggttaagtaacctatccaaagtcattcagctagttactaaaaagagctgagttttttgttaagttagcagtcaaactttgtttttctttttcttttctttcagagacagtcttgctatgttgcccaggctgaagtgcagtggctagccacaggcacgatcccactactgatcaacacaggtgttttgacctgctccatttccaacctgggcaggttcacccctccttaggcaacctggtggtctcccactcccggccatattgatgctgaacttagtgtggacaccccgttggcacagcactacagcccagaacccttgggctcaagcaatccccttgcttcagcctcccaaggagctgagattacagacatgtgtcaccacgccctatggccaaattcatcaggcttaggaaattctcatggggttccatatttactaaccactaattatcagttccgtgtcatccttagtcaactctcataaggaatgtcttcacttttacaatcaaagtcagacggtattagatacgcatatgtataaaacccagactaataactctattattttctttgttaaacttctgagaacaccttcgaataataggaaaagatgacttcctgttaggaactgtaattaactatgtgtttcctcttcctgggtgctgtctttaaccatcagtcaccataacctacttatataacaaataaaactgagaactagacttgtttttaaattttaaagtattaaatattctatacagtgtagtagtaagcatttttaaattagtaagtcatttataaatacaaactctctttgaaaaacgttctatcactacagaaaaaaagtaaaaaagtcaaaatccttttattcctcatccaaggaatatacccaagagaacagattatatccttgaagacatatctttttttttctttttttttttgagtcagcttcttgctctgtcacccaggctggagtgcagtggtgccatctcggttcactgcaacctgcacctcctgggctcaagcaatcctcccatgtcagcctcccaaaaagctaggactacagacacaggcaaccacacccagctaattttgcatgttttatagagatggggttttgccatcttgtccaggctggtcttgaactcctgggcccaagcaatccgcctgccttggcctcccaaagtgctgagcttacgggcatgagtcaccatgcctggcctaaagatgcacttttaatgcatatatatatatgcatatatatatatataagatgcttatatatatgcatatatatcatatatatctcacatatatatcttatatacatcattatatataagatatctaataatatatataatatatatcatctaatgatatatataagatatctaatgatatatattatatatatcattatatataagatatctaatgatatatattatatatatcattatatataagatatctaatgatatatattatatatatcactatatataagatatctaatgatatatataatatatatcattatatatctgatatctaatgatatataatatatatcattagatatcagatatataatgatatatataatatatatcatatataagatatctaatgatatatattatatctattatatctattatatatgtctaatgatatctattatatgtcattatatatgatatataatatatatatcatgatatatataatatatatcatgatttatatatatcatgatatattatatatatatctcttagggcttttaaatagataaaattatacctatatatcaaaggtagaaagttttgggggtttatcgttgctgttgttttatttttaattcctatcccactagaaaacattctgggctgggtgcggtggctcacgcctgtaatccctgcactttgggaggctgaggtgggtggatcacttgaggtcaggagttcgagaccagcctggccaacatggtgaaaccctgtctctactaaaaatacaaaaattaggtgggcatgatggcacgagcctgtaatcccagttactcaggaggctgaggcaggagaatcccttgagcccaggaggtggaggttgcagtgagccaagattttgacactgcactctagcctgggtggcagagcagggctctgtctcaaaaaaaaaaaaaatctgggctgagcacagtggctcacgcctgtaatcccagcactttgggaggccaaggtaggtggattatctgaggtcaggagttaagagaccagcctgatcaacatggtgaaactccgtctccactaaaatacaaaaattacccaggtgtggtcatgggcgcctgtaatctcagctactcaggaggctgaggctggagaatgcttgaacccaggaggcagaggttgcagtgagccgagatcacgccattgcactccagcctagacaacaagagtgaaactccatctcaaaaaaaaaaaaaaatgtactggtatttagtacatggaagcaaatgtgtcaaaatggttgattctcagtttgtttacatgcgtgactgttattttcttctttatattttctaggttttaccaatttcacattttaaaaattaagaaagtctatatctttctttcattatttttcatagctttactatcatgaagtttattacaaagcttccatagagctggctctatgtaaactggtaaagtgggttagtttatcttgaacacattgtatttatcttctggcctccctactccatgtgaccactgccaagtgcagtccattggagctgacacccccgatgtcaaggtccactaaatcctgccttcctgacccaagtccagtaggctgcaaaactgcctaccctgttgtcttgtaaacatacaaaaaattttcaactctactcataatcaaataaatcaaaatatccaaaggattgtaacgaccagtgttactgagagtgcgaagaaattaacattcatgctctgctggcgaggatgtaaataggtatagactttcttgaaaaaaattgagacatatatgtttgtatgtgtgtgtatatatatgtgtgtgtatctatctctctatatatagatatatgtgtgtatctatctctctatatgtagatcagctccatgtcatccttagtcaattctcataaggaatgtcttcacttttacaatcaaagtcaggctgtattagataggcatatgtataaaacccagactaataactattattttctttgttaaacttctgagaacaccttcgaataataggaaaagatgacttcctgttaggaactgtaattaactatgtgtttcctcttcctgggtgctgtctttaaccatcagtcaccataacctgcttatataacaaataaaactgagatctagacttgtttttaaattttaaagtgttaaatattctattttctctctctctctctctctatatatatatatatacacacatatatatgaagagcctttaatttatttcctagcctttgattcaacaattccaattctaggaatttgtctaaggagataatcagaggtaagaaaagaatagctgtaagaaggtccaagaataaaatataaattttaaacaaaaacctatgatagagcaagagcaccatcaactcagacagacatcgccactttaaattccagttccctttctagtctcatgcatttcaaggaaatcacttctgttcgaactacaagcagccagaaagagcagacagtaaaacacaaataagacagctcgggcgcagagggaggtggggggaaagtctctggagcaactgccaaacttcaccctcacaaaatgggccccagtaaaacagtgagccttacttaataagcacattcctttcccttcaggtgtaccaagatagggaagcaaaaagcagactcgggcggggtatgcctacagctgcagaaagatggatgggaacagacacacaactctccctcccagaaaagcacaacaaagagacagagaagcagtccaagcctctgataaactctcccaccctgaagccttagaaactcttagtctgtaggagagtgtgtctctaacctaactcagccagccgcccctctcaggtttattcaaaataaacctgtcaggccgggtgcggtggctcacgcttgtaatcccagcacttggggaggccgaggcgggtggatcacgaggtcaagagatcgagaccatcctggctaaaacagtgaaaccctgtctctactaaaaatacaaaaaaattagccgggcgtggtggcggccgcctgtagttccagctactccggaggctgaggaaggagaatggcgtgaatctgggaggcggagcttgcagtgagccgagattgcgccactgtactccagcctgggcgacagagtgagactccgtctcaaaaaaataaaaaataaaaaataaaaataaataaacaaatctgtccctgttgactgtcaagccgccctttgtgtttctctcctctttctttaattcttacaacctatatgtccaataataggatgtttgttatagttgattgtaatgtaactgtaggttagaatactttactcatttaaaaaattatcttgtcataaaagatttttaacaacctgagaaaatttaaatatttctatgagaaaaggtaagatatgtgcaatatattatgttatactgcatataataatatgtaagtattatgtgcaatttaaatccatgtcttatctcaaaagggattatgtaactatatatgtatataataatgataattattatcattttaaatttattgacctgggtgcagtggctcacacctgtaatcccagcactttgggatgctgaggcgggcagatcacctgaggtcaggagttcaagaacagcctggccaattgccaaatggcaaaaccctgtctctactaaaaattaaaaaattagcctggcatggcctgtagtcccagctacttgggaggctgagacacaagaatcgcttgagcctgggaggcggaggttgcagtgagctgagatcgcgccactgcactccagcctgagtgacagagcaagactccgtctcaaaaaataaataaataggccgggcgctgtggctcactcttgtaatcccagcactttgggaggctgaggcgggcggatcacgaggtcaggagattgagaccatcctggctaacacagtgaaaccccgtctctactaaaaatataaaaaattagctgggcgtggtggcaggcgcctgtaatcacagctattcaggaggctgaggcagaagaacggcgtgaacccgggaggcggagcttgcagtgagctgagatcccgccactgcactccagcctgggcgacagagcaagactccgtctcaaaaaataaataaataaataaataaataaataaataaataaataaataaattttttgatacttaatatgtgccaggcacttttctaagcactttacatagaatgtttcatttaattcccacaactgtatgaggttaatactatcattattctcattttgcagattaggaaatcaagacatagaaaaattaaggaattctcccaaggtcacacagctaataagtagcacatctaggaactgaacccatgcagtctgactccaaatacatacaaaaatacacatataaatacatacacataggccaggtgtggtggctcacgcctgtaatcccagcactttgggaggccaaggtgggcggatcacgaggtcaggaattggagaccaggctgaccaacatggtgaaacctcatctctactaaagatacaaaaaattagccgggtgtggtagcacgtgcctgtagtcccagctacttgggaggctgagacacaagaatcgcttaagcctgggaggcagaggttgcagtgagctgagatcgcaccattgcactccagtctgggccacagggtgagaatctgtctcaaaaatacatacatacgtacatacatatacacatatgcatttacttatttatatacatatacagatatagcatatatgcacagataattaacatgtataagtcatactccaaaatgttaaacatgtaggttaacatttttatttgtgctttctttgtattccacatttccttattgaacatatattaattttagaacttaaattttaaaacttagaaacttatcttttccatattctgctagcaaaatatttttgtctaagcaaggaaatactccagtgtgccatggagactaatccaattcccacttggatgaatattctccaagatttcctagccatacaaatgccctgtctctcccacagtgcattaaaattatggccatctagtaaggccatttcaagccccatctctttctgaagtctattcagatattctttctttaatttctgctgcacttatagacagtacagagcacaatacttaattgttctcaaattgtttcctgtgtattagctttggctcctcaattggataccaggttctttatacactagcatcatgtctcacctttttgttttgttttgttttgttccccaccctatgtcacttctagtactggcccaacaggaaatgttcaataaatacttgatcatagactgacagatgttcttcaagtaacataactatagtgtaataggagctttctgaaaattatggctaattcattaagagtgaattgattccagtgatggaaattcatatgatgcaaaatgtgctgcagaaaagagaagatttggctgggcacagtggcttacgcctgtaatcccaacactttgagaggccgaggtgggcagatcacctgaggtcaggagtctgagaccggcctgaccaacatggtgaaaccccatctctactaaatacaaaaaattagctgggtgtggtggcgcatgcctgtaatcccagctactcggggggctgaggcaggagaattgcttgaacccgggaggcgaaggttgcagtgagcccagattgcgtcattgcactccagcctgggcaacaagagtgaaactccatctcaaaaaaaaaaaaaaaagaaaagaaagaaaagaagattcattttaatactgatttaattgatatatattattttaattcactcagtttaaaactagatttttcccacaaaattccagatattagcaatatccctgaaataaatgagagatcctcctacattactctaatcaaatgataattaattaagtcatgaggcatagaaacaatttgagacacaaaataaataatggtaatatttgggttataacacttaaaatacaataactattaattgatagtgataaaactaagccaaataaacaaataaatgtgggagaagggatagtttttccttactgaagaatttccttactgtagaatactaataaatgtaaaattaatgagaaaaagaaagtcaccattaggcaaacaccatagtagtaactgttacaggcaagatccactgaaggatgctaaacttagtgagtaaaagtttgagaagaaacaggacagtctcaaagtaccttccccaagatatttgttaattacaaaaggaaaaataataaccctaccttggaaaaacctagcagaagacacctgacagacatcaccttaacgaagtgctcaaggtcaataaagcacatccatttcatgcacccccacatgagatactaagaaaggcacaacatcacttctgaggagttctttccaaaaatgcataacctcaatctaatcatgagaaaatatcaaagtcaaattgagggacattctacaaaatactgacagtagtcttcatactgtccaggtcatgaaagacaaagaaggtagaagaaagcatcagattggaggtcattaagggttaagcgtaataagggatcctggcttggatcctagaacagaaaaagggcattattaggaaaactgatgaaattagataagacttataatttagatcagggattgattgactctggcctgctgctgcctgttttttaattaaagttttattggaagacagccaagatcattcacttatattgtctatggctgttttctccaatggcagagctgagtagttaggacagagactgtaaggcctgcaaagcctaaaatatttgctatgccaggatcagcattaggtgaggcaagcaggacacctaggtctaaggaaatatcctctctctctccctctccctctctctctctctctctctctgtctctctcaaatttctgtacatgcgcaaccctaaatgttagtgcctccttaaattttgcatcctacacaccctacttgcctcattctagtcctgactctgtctatctagtcctttacaaaaaaatgtttgctggaccatggtagggttaactatagcaatgttaattttctgattttttggtggtttgtgcttgcgatcggtggctgcgtcactctggtaaaggtgtgcagttttgggccatgatctctgggctgggatgatccaggctctcggtagaggcaagggagcccagctatagccatggccagtacaatggtagcagttggactgaccattgctgctgcaggatttgcaggccattatgttttgcaagccatggagcacatggagcctcaagtaaagcaagtttttcaaagtctatcaaaatctgccttcagtggtggctattactgaggtgagtttgaacccaaaatgacaaaacaagaagcagcattaatgctaggggtaagccctactgccaaaaaagggaaaataagagatgctcattgataaattatactcttaaatcatagcagccaaaatcagtgaagctagaaatttactagaaggtcaagctaaaaaatgaagtaaatgtatgatgaattttaagttcattttagtttatgtatatgagtaccaagcttttataataaaatgcctcagagctataattttttttaatttctgattttgatcattatactttcattaggtatgatgttaacataaagggaagctgggttaagggtatataggaactctgttgtactatttttacaacttttctgtaagtcaaaaattattgcaaaataaaacatcttaaaaataatgcaaactcaaggataggataagtgtactaagttccaagtgcacagtaacactgtgggggccaaaacaacagccacaaccacaaccaccacaacttagcgctctgcaccaggcactgttcaaagtactttatatatcacgtattatttaatccccacaactctgtgaggtgggtactatttacttccatttacaggttagaaaactgaggaatagaggccgggcgcggtggctcatgcctgtaatcccaacactttgggaggccaaggcggcggatcacttgaggtcaggagttcaaggccagcctggacaacatggtgaaagctcatctgtacaaaaatacaaaaattagctgggcatagtggcatgcacgtataatccctgctactcaggaggctgaagcaggagaatcacttgaacccaggaggctgcagtgagctgagatcctgccactgcactccagcctgggcaacacagtgagacttcatctcaaagaaacaaaaatttaaaaaaaaaatccaatatagggagaaaggctaactgtcttggaatcaatctttgttaaattgttttgaaatggggaatatattgttttctatataacatggaaatcctcccataatttatatatgtcattatgtaaactagaaaattagtctcattgcttgttttcatggttgtattttcaatttctgaaagataattttaaaaactctctgagaaggaaaagcttcaggattactgctctagaaccattagaaaatacataattttactttaatcaatttctagcacaaactttaaattgtaagaactatataccaaagcaaaagtattatgtgggtgtctcaattcaattgtgataagtaaaattagaatatcaaattgttttgaaattataacagctaaaatgctttcgggcatgatgagttctggttaattttagagcatcaaatgaaggaatacctgaagtaaaggcaatctatccaatacaaatcaagtaaaggaaatgtcatattagtcaaaaatgtcataaaaatatttttgaaatgagaagcatacctataaaaagaagagaaaagccaggtgcggtggctcacgtctgtaatcccagtattttaggaggccgaggtaggcagatcacgaggtcaagagatgaagaccatcctggccaacacggtgaaaccccgtctctactaaaaatacaaaaattagctaggcatggtggcatgtgcctgtagtcccagctactcaggaagctgaggaaggagaatcacttgaacctgggaggcggaggttgcagtgacctgagattgcaccactgcactccagcccggcaacagagtgagactccatctcaaaaaaacaaaaaaaagagagaaaaaatgacacacacacacacacacacacacacacacatatatataaagaagtgacaatattatgacaaacatttcattaaaaataaataattgttatctagatatgatatgccattgacagaccagtaaaatacatccagtaaaaggaatgttgagacaaggaagtatgactccacctggtaaccatattttgaatattacacattaacaacgagattattttctgtaaggctgtccaaaatgaatcctccttctatgtagattgaaaagacaacagcataacttcaaaagactgactatgcagccataaaaaagaatgagttcatgtcctttgcagggacatggatgaagctggaaaccatcattctcagcaaactaacacaggaacagaaaaccaaacaccacatgttctcactcataagtgggagatgaacaatgagagcacatggacacaggcaggggaacatcacacaccggggcctgtcggggggtgggggagaaggggagggacagcattaggacaaatacctaatgtatgcggggcttaaaacctagatgatgggttgataggtgcagcaaaccaccctggcacatgtgtatctatgtaacaaacctgcacattctgcacagggatcccagaacttaaagtaaaattgaaaaaaaaaaaaaaggactgactaaataggtcacaagattatggagatataatgacccttactgtataagctagcatgtatttttttaaatccaaattgtcagccttatcaagttaaattatattcctttgattttaaattattccttcaaaaattgtttgataatagtataatttcaactgtgaataacacatggtaaaaatggtaataagctttctcaattgctataagcaaatcaccaccaacataaacaagaataacacattcttgagaagaaatatgcaactaaaagaccattataagctattctgggggcggggcagtttttttaatttcaacgtgtctaagataacttcctcagcatggcaaaaatagagattttaatcctttgtgtccagtaatgcattctattcttaaaacaaaactaagcacattttattaatgaactactgcctttatgaaacaacaataaatataaaaacattttgctttacaatgttaattttactacttagattttaataaaaataaataaaataaaatacattaattataaaacataaatatatcctaataacatgatttaataatatataatttaataatgaatatattttatattaatctcaacattatttgaaatattgaaaaattggaaataaaatatttaacaataagagaataattcaactgtggtaacacagcaaaataaaatattttgcaaccactaaaaagtgtacaaggaaagtttaatagcatggaaaattccttgttataatacgaatgggtaaaaagcaggaatcaacaagtacatataatatcctcccaaacaggtctttaaagaatatacatagaaagaatagtggagattaatatgccaaaatattaatactgttatccttgggagagagaattataaatgatttttccataatttaaaaaacctctacaacctttataattgtttattgagaactttaaaaattttgttttcttacagatccagtgaacagctacagagttttcacatgttttgtttcagaagccaccctttcaagaagtaatttctgtcacacaatttgaaatattaacataaagggatgcttctttgtttctattttgactgctcacataggagtacacattttaataaaatatattaaaatccctaattttataagaaatttcatttcacctcaattatgagtcaccataataaaggtatagcttatatatactgtgaaacactgccatcagaaattacaataaaatttcaaatatttatttttaatatactatattgtgaaacagcatatggccatgtgccagaatacacatatttaatcagaagcttccgtaaaattcccataggacactattcaagtaaaatcccaacatacatttaaattcttaactttctctgagccaaaagtgctttaaaacaacacaaggttaggtttgtaggcaatgtgactaaaaattcaaagttaaaaccttaaataaaaacttgaaatactattgtgaaaaagaatactgttgtgataaaaatattatccactgtcttaccgaagatagttcatcacatcccagtaatgtgtagtaatcttcagtatcttctgacctgtaattcagtattgcatccatttagatgacttaatcagtccttcttccctcggaaacaagaggcacagtgagcttcgaattaacaggaagaaactctttaaatctgaattagagcagcatgttccacatagcaaaaactagctttaagactggccacagtcaatacaccagatgtcatcctagacctttgtaaactctgcctctcattggctgtttacagagaagaaaagaacagtccacgtgtctattattgcagtgctgcctgggatctgtagtttgagtttatataagagatgcatgtgaaccatttgtcttatgagttaataaagactgtctattttcagaaacttgccacattagccacttctccatctcctatatatttttgtctctatcctttaaaaaaaaaaaagaaaaaaaatgtgaagcaatgtggtaaaatcttaggatgtgttaataaggataatgggagcttttcttagtgtttaaaatacttaattttattttttatttgtttattttcagacaaggtctcactctgttgcccaggctggagtgcagtggtgcagtctcagctcactgcaacctctgtctccccagctcaagcgatcctcccacctcagcctccctagtagctgggaccacaggcacatagcaccatgtccagctaatttttggtttttgttttgttatgttttaagaggagggggttttgccatgttgcccagcctggtctcgaactcgtgagctcaaagcgatctgcctgcttcggcctcccaacgtgctgggattacaggcatgatccacagcgcccagccaataacacagtcttgatttttatggagcttacgctctgatggaggaagacagctgaaaaacatgcaaaaaaaaaaaaaaaaaaaaaaaacacgatcatttaaaatagtgatttgtaagccaggcatggtggcccacacctgtagtccagctacttgggaggctgaggcagaagaatcacttggacccaggaggcagaggctgtagtgagccgagatggtgccactgcactccagactgcgctacagagcaagactccatctcaaaaaataaaaaaataaaatagtgatttgtgctttagagaaaataaaataggacaatgagaagaactgtatgataactcgggtcagatggctgtgctatttctcctgggttggttctccagactcaggagtgtctctagtctgaggtaggtccaggcaatttatgtttcagttcattttggccctaagaaacacagttcaggtctgggatttagagaacaaggtgagtggtcagggacacaacactttgactgccttaacactttttttgtttcatttttcagagagacagggtctcgccatattgcccagattggtcttaaacccctggactcaagtgatcctcccactttggcctcccaaagtgctgcgattacagatgtgagccaacatgcctggcccttaacactttaaattcccccacctgaggggaaaaaatagtttttcttttagcccacctatatacatctttttaaaggtttatttctgaagagaagcaagaaaaagcactgaaacaccattttttactaatccttcattgtacatgctgtcttgctaaaagttctatatagaattttaaggccaggcacggtggctcatgccataatcccagcactgggagaccgaggcgggcggatcacgaggtcgggggttcgagaccagcctgaccaatgtgatgaaatcctgtctctactaaaaatacaaaaattagccaagcatggtggcacgcacctgtagtcccagctactcaggatgctgaggcaggagaattgcttgaatctgggaggcggaggttgcagcgagccgagatcgtgccactggactccagcctgggtgacagagccagggtccatctcaaaaaaaaaaaaaaaaattagatcacaatatcttgatctaaatcactgataaatggccttttaatgatgtgaagttgccatggtggaaagcagtatggtggttcctcaaaaaattaaacatagaactaccatgtgaccccacaattccacttctgggtaaatacacaaaagaattgaaagcaggaacttgaaaagatatttatatactcatgttcatcaaggcattagtcataatagccaaaaagtggaggcaatgcaagtgtccatcaacggatgactaaacaaatggaatgttagggctgggcatggtggctcacacctgtaatcccagaactttgggaggccgaggcaggcagatcacttgaggccaggagttcgaaaccagcctggccaacatggcaaaacttcatctctactgaaaatacaaaaaagttagctgggtgtggtggcacatgcctgtaatttcagctacttgggaggctgaggcacgagaattgcttgaacccaggaggtggaggctgcaatgagctgagatcacaccactgcactccagcctgggtgacagagcacgaccttgtctaacacaaacaaacaaaaaagtgtggtattggccagttgcagtggcttatgcctgtaatcccagcactttgagagaccaaggcaggaggattgtttgagcccaggagttcaaaaccagcctgcgcaacatagtgagactctgtccttatttttatattaataatataattttttttttgagacagagtttcactcttgttgcccaggctggagtgcaatggtgtgatcttggctcaccgcaacctccacctgggttcaagtgattctcctgcctcagcctcctgagtagctgggattacaggcatgtgccaccatgcccgactaattttgaatttttagtagagatggggtttctccatgttggtcaggctggtttcaaattccagacttcaggtgatccacccgccgtggcctcccaaagtgctgggattagaggggtgagccactgtacccggcttaaaagtttttaaagtgtgtggtatcttccccctggctctcttactcctgttctcaccatgtaacatgtctactcccacttcaccttctgccataagtaaaagctccctgaagcctacccagaagctgaacggatgctggctccatgcttccacattctgcagaactgtgagccaattaaacgtcttttcagtataaattaccaagtcttaggtattccttcatagcaatgcaagaatggcctgacacaaaaaattggtaccaaagagtggggccttgctataaagatacctgacaaagtgggagcagctttgaaactgggtaatgggcagaggctggaagactttggagggctcacaagaagacaggaagatgagggaaagtttggaactcctgcaagactggttaaatggttgtgaccaaaatgctgacggtgatatggacagtgaagtccaggctaatgaggtctcagatggaaatgaggaacttattgagaactggaataaaggtcactcttgttatgccttaccaaggaacaaagctatatggtattcatgccctaggaatctgtggaagtttgaacttaagagtgatgacttagggtatctggcagaagaaatttctaggcagcaaagtgttcaagaagtgacctggctgcttctaacagcctatcctcagatgcagaagcaaagaaatgacttaaagttggaacttatatttaaagggaaagcagaatgtaaaagtttggaaaatttgcaacctagccatgtggtagaaaacaaaaacccattttcagggcaagaatctaagcagactgcagagcaaccacttgctaaagagatttgcataaatgaaagggagccaggtcagaggctgatagacaagacaatgagaaaaaaacctcaaaggcatttcagagatctaagaggcagcccctctcatcacaggcctagaggcccaggagaaaagaatgatttagggggccaggctcagggtgctgctgccctgtaccactatgggaggctgcttcctgcatccagccacttcagccccagcctcagctcaaaggggcccaggtacagctcaggccacagctcagaagggtgcaggctgtaagccttgggtggcttccatgtggtgttaagcctgcaggtgttcagaatgcaagagtgaaggaggtttggcagcttcctcctagatttcagagaatatataagaaagcctgggtacccaagaagaagcctaccacagggacagagccctcaccaagagcctctactagggcagtgcagaggggaaatgggaggttggaactttaacatagtttggaaagtctccctgcctgaatctcatgttgaattgtaatcctcagtattggaggtaaggcctggtgggaagtgatcagatcatgggactggatttctcatgaatggttgagcaccatcctcttgatgctgtcctcacaaaaatgagtgacttctctgagatctggctgttcaaaagtgtgtatcacttcactctctgtctctcttgctcctgctcccaccataggagatgcctgctcccccttcaccttctgctgtgattgcaagcttcctgaggtatccccaaaagcagatgcctgtgttatgctccctgtgcagcctgcagaaccataagccaattaaatctcttttctttataaattacccagtcccaggtatgtcttttcttttcttttcttttttttgagacagagtctcactctgtcgcccatgctggagtgcaatggcacaatgtcagctcactgcaacctctgcctcctgggttcgagcaattctctgcctcagcctcctgagtagctgggattacaggcgcctgccaccacacctggctaattttttgtattttttagtagagatgggatttcaccatcttggccaggctggtcttgaactcctgacctcgtgatccacccaccttggcctcccaaagtgctggactacaggcatgagccactgcacccggacttaggtatttcttttttctttttttttttttttgtgatggagtcttgctctgtcacccagactggagtgcgacggcgcagtcttggctcactgcaacctccaccccccgggttcaagcgattcttctgcctcagcctctcaagtagctgggactacaggcacaagcaaccatgcccagctaatttttgtatttttagtagggacaaggtttcaccatactgaccagtctggtttcaaactcctgaccttgtgatccgcctgcctcagcctcccaaagtgctgggattacagacatgagccactgcacctggccaggtatttctttataaaaatgtgggaatggcctaatacaaactcccacacagagtccccactggggcactgcctagtgaagctgtgggaatagggcccccaccttcccggcccagagtggtagatccactggcagctcacaccctgcacctggaaaagtcacagagtcacaggcactcaactccaacccaggagagcagcctgcaaagccacaagggcagggctgcccaagggattgggagcccacccctcacagcagtgtgccaaggacgtgagacatggagtcaagaattattttggatctttaagatttaatgaatgtcctgctgggtttcaggcttgcttgggacttgttgctcctttcttttttttccttttttttttttgaggtggagtcttgctctgttgcccagactgaagtacagtggcacaatctcggctcgctgcaacctgcacctcccaggttcaagctattcccctgcctcatcctccctgagtagctgggattacaggcatgtgccatcacacccggctaatttttgtatttttagtagagacggggtttcaccatgttggccaggctggtttccaactcctgacgtcaggtgatccaccctcctcagcctcccaaggtgctgggattacaagcatgagccacagcacccggcatgttgctcctttcttttagctgatttcttccttttggaaagggaatgtttgcccaatgcctgtatctccatgtatcttggaagtaaataacttgtcttttattttacaagttcataggtggaaggaacatggcttgagtctcagataagactttggacttgggacttttgagttaatgctagaatgaattaagactttggggaactatgggcaggggataattgtattcagcaatgtgagaagaatatgagatttgaggggtcaaggtagaatgatgcagtttagatgttgtcccctctaaatctcatgttgaatcataatccccaatgctggagctagggcctggtaggaggtgatgggatcatggagccagatttctcatgaatggtttagtaccatcctcctggtgctgtcctcagaatagtgagtgaattctcataagatctggctgtttaaaagtgtgtggtatggcatcttccccctcactctcttgttcctgttcttgccatgtgacattcctgctcctgctttgccttctgccatgagtaaaagctctctgaggcctccccagtagccaagcagatgctggctgcatgcttgtacagccttcaggaccacgagccaattaaaactcttttcttggccgagtgtcacagctcatgcctgtagttatagcactttgggaggctgaggcaggtggatcacttgagctcacgagttcgagaccagcctgggcaacacggcaaaaccccatctctacaaaaaatacaaaaattagctgggcatggtggcgtatgcctgtagtcccagctattccagaggccgaggtgggaggatcacttgagcccaggagctcaaggctgcagtgagccacaatcatgccactgcaccccagcctgggtgagagagtgagaccctgtctcaatgaaaagtaaaaatatatatatattctttataaattacccaggttcaggtattccctcatagcaatgcaagtatggcctaagacaatgtgatttttaggaactttttaacccaggaattcatagaagcactcacaaaataaatgaaaagcaggagaaaggagcaaaacacataagctatcatacagagatggaaatgtccattgcgtgttcagttaaaggtaaggaaaatgaccttatggcaaggtatgttggagagaatgcctttaatactgggattgaacagaagacctgggccagaatgtagaaagccttgatgatcaggtggaagacactgagtgagtatggatgcaataggaactgttgtaggttcttgagcatgtgaataacatgttaaacttagagcttttaagattagtctggtcagccaggcgcggtggctcatgcctgtaatcctagcactttgggaagccgagggaggtggatcacgaggtcagggattcaagaccaacctgaccaacatggtgaaaccccgtctccactaaaaatacaaaaattagccaggcatggtggctcacatctgtcatcacagctactcgagggatcacttgaacctgggaggcagaagttgcagtgagctgagatcgcaccactgcactccagcctggtcaacagagtgaggctccatctgaaaaaaaaattaataataatataaatgtatttcatacatttatggaggcttggaagttcaagataaaggtgccagcagattcagtgtctggtaaggcttactctttgcttcataaatgacaccttgttgctgtgtcctgacgtgacaaaaagggcaaggcagctcccttcaaccttttataagggcactaatcccattcatgaatacagagccctcatgatttaatcacttcccaaaaggcccaacttcttaattccatcacaatgagtattcaattccaacataaattttggagggacacactcaaaccacagcaatacacttctgaatcttagtgctctttttcccttttcacttgattgtctcattcttttcaacatctgcacagcattccaccctggtcatacaatactttatttgtctttttttttgagatggagtctcgctctgtcacccaggctggagtgcagtggtgcgatctcagctcactgcaacctccacctcctgggttcaagtgatcctcccacctcaccctcccgagtagctgggactacaggcacgtgttaccacacccagctaattttttgtatttttagtagaggggtttcaccgtgttagccagtatggtctcgatctcctgacgtcgtgatctgcccgcctcggcctcccaaagtgctgggattacaggtgtgagccaccatgcccggcctaaccagtgtcttttttaagttgcgtatggattagaaaattttcattacttattttaataaatattggcataggatattgttcagaaaaagcaataatacaagatgagcagatgttttgagggaagttggagtgccactttgttattcctgctctgttccccaaaactaaccttcaaacctgttgcagcatctcatggtaggatataattttaatattctttgggattttctccccatctatagaggtaacaaaaatcatgacaagaccactagctaatcttttggagaagtgataaataataaagctagagccactcctccttataccaaaataaattacagaaaaatcaaataacacagaagccatggaaaaaaatctcatgagcataactatataaaaattaagtggcctggcacggtggcccatgcctgtaatcccagcactttgggaggtcaaggcaggtggatcgcttgagccccagaatttgagaccagcctaggcaacatggcaagactcagtctctacaaaaaaaaaaaaaaaaagcacttgtatcccagctagctactagggaggctgaggcaggaggatcgcttgagtctggggaactccaagctgcagtgagctgagatcacgccactgcattccagtctgggcgacagagcaagaccctgtctcaaaaaaaaaagtaagcacatttatgtgaccaaaaaaatacaaaagcaaaatcagaaggcaaataatatacaaagaaaaaaatttcataattctcataacagacaaaaggctaacttccttaatatacaagtgcagacaaatcaattttaaaaagcttaacaacacaacagaaaattaagccaaaaatgccgggcttggtggctcacgcctgtaatcccagcacttttaggaggccgaggcaggcggatcaccaggtcaggagatggagaccatcttggctaacacggtgaaaccccgtctctactaaaaatacaaaaaaaaacaaaattagccgggggtggtggcaggcgcctgtagtaccagctactcgggaggctgaggcaggagaatggtgtgaacctgggaggcggagcttgcagtgagcggagatcacgccactgcactccagcctgggcgacagagcgagactccgtctagaaaaaaaaaaaaaaaaaaagaaagaaagaaagaaaattaagccaaaaatacaactactttcagaaatacaaacgaccaataaacatacaaatagtagtgcaacatcactaataattatgaaactgcaaatcaatccaaagaggataaagttgttcacctctcagattagcaaaggtttgataatacccatgccagaaaacagaaatgacgaagaaagcatttccatacattgttggatgagagtgtaatttggtacaatttggcaatttggtgtatttatcaccttttataaagcatatctatacttgacagggcaattttgtctctacaaattcagcttgtggatatacaccaaaatatgttcaagaggaccactgcagcgtcgtttgcaacaggaaaaaatatatatacaacaaaatgttcatcggtggagttgaggagggcaggagatgaataaattatgctatttgtaggatgaactattgtattgccagtgaaaagagaataaagatagctttttatgtgcaagtatggaaagatgtctaacgagtgctatcaaatgaaaaaacaggtttgagaagagtattacagtattatctctattgtgtactttttaatagtatgtacatttgcacttgtaattttttctaaagataactgcctttaaaaagcaagcaacaggctgggagcggtggctcacgcctataatcccagcactttggaaggccgaggtgggcagatcatgaggtca

SEQ ID NO: 260 - DNA, 98965 bp, Homo sapiens
catgaacagtcacttctcaaaagaagacatacatgtggccaaaaaaaatatgaaaaaaagctcaacatcacggatcatttgataaatgcagatcaaacccacaatgagataccatctcatgacagtcagaatggagatcattaaaaatcccaagaaacaatagatgctggcaaggttgcagagaaaaagggatgtttttacactgttggtggggatgtaaattagttcaaccattgtggacaacagtgtggcgattcctcaaagacttagaggcagaaataccatttgacccagccatcccattactgggtatctactcaaaggaatataagttattcttttataaagatacatgcatacatatgttcattgtggcactattcacaatagcaaagacatggaatcaacctagatgcccatcagtgatagtctggataaagaaaatgtggtatatatacaccaatggaatactatgcagccataaaaagaaacgagatcatgtcctttgcaggcacatggatggagttggaagccattatcctcagcaaagtaacacaggaacagaaaaccaaacactgcatgtgctcatttataagtgggtgctgaatgaagagaacacatggacacatggcagggaacaacacacactggggcctgttgatggggggtcggggggagggaaagcatcagacagaatagctaatggatgttgggcttaatacctgggtgatgggatcatctgtgcagcaaaccaccatggcacacgtttacctatgtaacaaacctgcacatcctgcacatgtacccctgaacttaaaagttgaagaaaaaaaaacacctaggcaaaaattacagtcccagacaaggttctataataaagaaatactgggctgggcacggcggctcatgtctgtaattccagcactttgggaggcccaggcaggtggatcaagaggtccaggagttcaagatcagcctggccaacatagtgaaaccccgtctctactaaaaatacaaaaaaatcagccaggcgtggtggcgcatgcctgtaatcctagctactcgggaggttgaggcagaagaattgcttgaacccaggaggcagaggttgcagtgagccaagattgcaccattgcactccagcccagggggacagtgcaagacttcacctcaaaacaaaacaaaacaaagcaaaacaacaacaaaaaaacaaaaacaaaaacaaaaaaaaacaagaaataccttgggaatcagatagagatatagaatcctaataaatgttagaatcttatgttctagaatgacctatgttagatcatttttatgcagaatacacaagtattaaagacacactttcaactgtgtttttattataaataccttgaagataattgttaaaacagacatctgagacaaaaattaacttttatatttatagaacaagattgaaaagttacttgttcattttttgaaccataagtttgcacctgttaagatgaatatagatataattaaaatccttattataacaaagttattagagtatgccaataatggattaactaataataacattgatatttatttcactctgatacaaactatatatttaatttcatgttaagcaacatttgatgcaacaaaatacctacataatataataatacagacttacccatggagtttgttttcataggagctgatctatgttcaatgactgcaaaccacttgaacaagttttacttgtgtttctaagagacaggttttaaataacatttattttttatttttttcctggcattaactggggacaatcttgccacaattttcctttacaaaactacaaggaaggaacactcaatatgatgttcatgtaaaatataattacctacttttcttcctttacaacatgtactccagagacaggatgacaagccagaggcacataacgcactgtctgtcattaataacaagtacatgcttttgaaatgatttcacagtaatgcttattcaaaatatcatttatttgcttttttgactattttatgaacattatagcccctcaacaagtattgcctgtttcaaagcaatgatataaataggaatttattgaattaaaaagttcaccaggtacaattataaatattataaattttgacatgtacaaagtgtcatctctgcgcatgactctcaaggtggtcatgctggcaggctcatggtgcctaagtcaggattgcggagagctgggagaagcagttctccaccttgccctaaagaagtgtcactcatccttcgaggctcttctcaaagaccacgtgttaaatgaagtctttctagtgtctcctgagaagacatgatcttttccttctttaaatccatagagcatctattttttctctataataatgctaataatagtaaaaatcacactgccttgtgattgagaacttccactatgcttcaaccatgctaaagtctacagccggtgtctttcttctttgcagcactcctgcaaagaaggtatcattctttcctttttatagatgaaaaaattgggcaaggattggaattcaggctataactgcaaaaatggtagtcttaacaatgctgttttcacacttgatttgcagttaagttatgtgtgacttttgtctccctgctctgtgggctagttcttccagcaggtactactgtgaccctttctatcccatgggagtgttttgcatagtaagtagtcaacaaaaataaatactgtatttctttctttcttttttttttttttttagacagggttttgctgtgttgctcaggctggagtgcagtgggggcaatcatagctcattgtaacctcaaactcctgggctcaagtgatcctccttacctcagtctcccaactagctaggactacaggtgcatgccaccatgctcagataattttttaaaatttttgtaaagatgcggtctctctctgttgtctgggctgatctccaactcctggacttggccacccacagtgctgggactacaggcctggctcttgtgtctgcccagtactgtattccatatattccaaacagcagcccctttttctacatttaagcgtctcttaaattggaacatatgttcaattgatgcctcgatttatatagtagtcttttcttgttttcttttcctaaaaagctgttattagttcttagttgtctcctaaccaatttaatcttagaatcaaggagtagttatgcaaataaactgggtagaactcaacctaatgagagactgctcagagaaaagatcaaggtagatttctttaggtttcttaatgctataagagtattaagcacagggggaattcagaggataatccatctgaaaatgaaagggaaggtgatcagaggtggcttagtaaaaatgaagagtcagtggtttcaagggaacatacagataacggcaagatctcatgaggagaggacacttccaaacgcttgctttcctgtgattctaacaccaaggtaagccagaaacacagctggagggtaactggagggattctgagtccatctgaccctgaactacacataatccattccccgatatcctggcaatagcattataatgagaaagatcacattaaaatgctgcaaacagtctttgaggcaaggacatgggtagtctgtcttctagctgtagctgtagctgtagcttgaagaagtcctgggagagtttggtagtgatgccatgaagggaaatgattaagtataaaatgattaacaagcctgtgttcttttgtctcctccttgtcttgctttagacatcggccttatggcttgaaaggaaatgtagtagatcattttttttttccattagcttagcttggaagagaagagagaactttaagtagctgtgttggggagagcggcttggggttcagggaggtttcatgtttttataaatagaaaagacttgagaatgtttttatgctgagaagggagagcgagaaatgagagagagagagagagagacagagacagagactgtggtagaaattagctaaagggaataattgaaggagcaagttctcaaaagtagcagtattaaatgggggctcaggtcacatagagaggtattatccttggtctgagagagaatgcctttccactgagctgcaggaaggtgttaagagtgggcacagatgtggatgtatttagagtagggtagggttgaaattgaaaaagggaatagttaatggtttctgagttttttgcggaggagatgaggctcaccactaagaatgagagggacacaaatgaaaggcttccagagattggtgagagtttgcaatgagtgtgcagtggacagtgagagaactgccctgtgctgagggcataattgagattggagactgtcttggtccatttatgctactatagcaaaggaccacaggctgggtcatttatatataacaggattttgtttctcacagtgctggaagctgggaagtctaagactaaggcactggccttggtgaaggctgctctgcttccaaggtggtgccttatggccacatcctctggaagggtcaaacgctgtgtcctcacatgacagaaaagcaaaagagcaaaaggggctagtttcttccagcccttttataaggcactaatccattcatgagtgatatggtttggctgtgtccccactcaaatttcatcttgaattgtaatccccataatcctcacatgttgtgggagggatccggtgggaagtgattggattatggaggtggtttcccttatgctgttgttgtgataatgagtgtgtctcatgagatctgatggttttataagcgtccggcatttcccctgctcccactcgctccgttctgccacactgggaagaaggtgcctgctcctcctttgccttctgccatgattgtaagtttcctgaggcctccccagcaatgcagaaccatgaatcaattaaacctctttctttataaattacccagtcttgggtctttcttcatagcagcgtgaagacaaactaatacaatgagtgatttagtcactctgcaaaaggccccacctctcagtactaccacaatgaagattaagtttcaacatatgaattttgtagaactctcaggccacagcagagaccacttgtacttggcgtggtctgtatggcattatgtgtttctgcaattgtgactatttgggggtaaagaaaaaggagaagagacagatttctatcatgggtggagaaagtagaaaagttttctgagacagagactcactgggaaagttagaccaatattagcagcagtcttttggaatgtaggtcttcacagtgtgtctcatgtttggtttaaagcacttccaaaatatcagacagttatgtctgaatggaatcacacaaatgtatcacgaagtcaaatataattttttttttttttagtttctaaaatgtgtgggttcttgttcctatatataactttctgttcttcagagaagagccacatagaaagggcaggcattggtcttatagggatcaccttataggatctaaaccaatacatgccttacactttacttacaatacagcataaaatgcctctgctaatgacttgagcattgtgtttcttggatctgtgatcacttattattttaacctttcaaagccaatagttttagagcattcaactcaaacgacttttattggcctggaaatgttttattgcagtttggctgacattttcttttaataatgtcattagcactccttaaaaatgaattctgttggggtatatagtactacctttgttttgagaaaatgttatgattttgtttgtacatgaggtgggtcccatagctacaaacattagcaatatgtttctgattcaacagaaagatctttctgattctacaggcacgcttccatttctattaagcataaatagtttggttggtaaaaagacccgaatttagatgtactttttcagaattaagttgaattctcaacatcttttaagagggagtccagcttctgagtcactaggcttaattaaaatctctagcacttagtcagtttatatgccttacctattttgtaggtttagctctcgtaactgttgttatgctgacactggtttccagtgggtcactgaaatcaaattaatgcaggcctctgaaaagtcagacatcaattgtgttcattcattaagattcccatattttaaaaggtacaaaataaggaaaagtgattctgtttaaccttgaagtatcctgaatggatggacatagactacgagcattttagtggaaaaataaaaattatttgtaagaaaaatcctaaagaacaaaaaccaaaagcaaaataagaacaaaattcctttctataccaattcttttctgaatacgtaaagactcaaggtccaaactccatttcctaggcctttggaaatgcttttagagcgtactcaatactgtacattctgtactactatcgagagcactcaatttcttgtgcattcaatttcttggtccaagtgcggtagttctcaaagtctggtgtccaccatcaggcctaggaacctgctaaaagtgtcaagtcttgagcctcactctagacatcccaaactagaaacttgatgggtggggcctgcaatttgtgttttaacaagtcctcagccgggcgcagtggctcacttctgtaatcccagcactttgggaggccgaggcgggtggatcacgaggtcaggagttcaagaccagcctggccaaaatggtgaaactccatctctactaaaattacaaaaaattagctgggcgtggtggggggggtgcctgtaagcccagctactaaggaagctgaggcagagaattgcttgaacccgggagacagaggttgcagtgagctgagatcgtgccactgcactccagcctgggcaacagagtgagactccatctcagaaaacaaaacaaacaaacaaacaaaaaacaaaaacaagtcctccaggcactctttggtttgctctaaagtttgggaacttctggcctagagcattgttctcaagtatttgtgtacacctacaccacaagctcctggagaagcttgacttaacatgagtctctcactcaggccgtgagatttggaggcagtaaatgcaggaagctgtgtgggaatctgtatatatatatatataaagtaggtgattctggtgcaggtggtctgtagaacacaatttgagaaattctgccttgaagtggaatttaagtgttgacaaaattagcatttccccccacaaaatcctcctccataactaagcaaaaacctttgaactctgacttacaaatatctatagctttcacttagcctgcagagtgcctgcttctgaagagctatgcaggcttccctcatcactgccataggggactgaagcttctgtgtgctccaggtgtgaggctttgcctgcctctgctacaggtgtgcacctgtttcaacacagggatgtatgctcaaaggatgcggcataacccacacctccacagaatgtacagtattgagtatgctcagccaagacaaaacacaaggagagatgtcatttttatttgccctgagatgatagctggaggaagactgctttgagcaaagaggtttgatccctgcatatcctgccagaggaataccctgttctaagcaaggtgacctttcaagcaagttttgagaattactgatttagtatgcaaggtatgcataaatatatctaactgtgatttggggtcagacacacactgcatatcttttttccattgaaccttttatagatcagaggtgaaaaaagagattttttaatgcagaaaggtgaagtttgtgatggcaaaaaaagggattacttgtgattttattaaatcagtcatatgttttcttcaaggtattgggaccaaattcatgcattaataacattactttgttttcattgtatttgtttttattgtcatctgacatttaaggcaattaatactgtatttctacttatgttaataataaaaaatacctttaaataattttattccagtaaaatgtatgaattaatttaaaggaaaatgttaagtaaatattagtgcagatggcaatattctgaagatgccacatgaataatcaaagtgtgggaaaccctgacattattttcatgagttcagcataatccattttaccacttttccaatgctgagctttatatttgttttctgttataaacagtgcttcaaaaaacctcttgtagctaaatatttttcatatccataatggttctcttaggagaattcacagatgtggaattgttggaagaaagggcaataattatattattttaaagtttaaaattagtgtccattaaccatttccctaagattttatgaagacatttaggaagttagtaaagcagtatttatgacctacgggaatactttcttccttgttactcaaagggttgcttaaggcagtggccttcaagtgtgttctgggaccaaatgacaatttctccccaaccagcaaagccctgtggtggggaaaaggcttggtggaagatctggtttgtagttaatgttaagtaacctttccacttaattagctttgtgatctcgtgcaagacacaacttctctaagctataattttctcatccagaaaattatactgaaaataatactttgtttatctcaccaagttgtgaagattaaatagagtgatatgtgtgaaaatagcttgtaaatgaagcatgatgtaaaatgttattggtattatgaaagcccaatatatgttctcctcttgagagattcttaaagcacaattctctgacttcacagatacgtcgtctgatgcaatacagatactttttagtatcatatggggttagcgtctagaaaaagtgaagggtatgaaataatgaagaatgaaattccagtgagactctatttctttacagattgctcctccctgtcccttactcaacactagaacctggtatagcgctgtaatcaatactctgtgtgtgtgtgtgtgtgtgtgtgtgtgtgtgtgtgtgtgtgtgtgtgtgtgtgtgtgttttagacaaggtttcattctgccgtccaggctggagtgcagtggtgcaatctcaactcattgcagcttcgatatcttgggtttaagcgatcatcccctgtcagcctcctgagtagttagaactacaggcacgcacaactacgcccagctaatttttgtattttttgtagagatagggtctcactatatagctcgggctggtctcaaactcctgggctcaagtgatcctcccacctcagcctcccaaagtgctgggattacaggcatgagccatctcgccctgccaacactaactctggactttcatttgagctttgctgcttatcatcaaatctcaatgaaaacattagttgctcagaagtcaccttacttgttaatctagaaatggtctggtggctcaggatttctgagtctgggctgggaccagagccagctactcctggcacctgtgttgctggggaaacatgatcttcactgagactctgttctcttcccataatgtacattatccaaatggtctcttgttgtgggtggattcgggtaaaaattgtcttcaccacgtggggcctcagtttcctcatctgcaaaaaaaaaggagttagatgagaatctggtcactagccggtcttctaggtctctccccacagttaagatcccataattctgcaggtcagtttatgacctgcaaagggattcttccctgagggccctcacaaggttttgaatggcagagcaaatggaaatgggggaatgtccttcccaacctcccaccatgggcaggagaggaagtgttgtccaagagggcctcagctggaccatctggaggagtgaggattccactctgtgacatcacaatatccagcccaggtttgaccttgacaactgggaaggagaaataacaggaggcgcagttactgatatagccaaggtgggacactactggagggagctagaagggatcagccagccatgcctccagttcaggtacttggcattgctaagctcagaacaggacttgccagtgtctagatgaaaaagaggagagatctcaaggtgagtgtgtctccaagcttaagaagaatagtataagcacagacggcttgtgccccagctgcgttagggtaatgtaaggttccacacgagcagaagcagagctgggcgcatcttgccaacagccaggctgcttgccatgaagccggacggtgaggacatttccgaggctgtagtccacttgtgctgctggtgatatatttctatttagaggtttttttctttcaatagctcctccccggatgacagggtagagtaaacaaaaataagttaactaaggaagtattttaatagaagccagtacaaaaacaaacaaaagtaataaaaggtgcaaagttgtattatgggttagcaagcaagactgactctaaggtcaagttttgaaagttcaaatcttgaaaggcaaaaggatacccctataaagagtaaaagagaagggccttttggttgagaagtaagtaaaacagctctgctggaacatataccggaccccccaccccgcccccagcaactcctgccagtgaaatcattgctggggatgcggacagttctgttttctttaccttgccttggggttttggcttctacaatacttgtttcttcctggagtcttggggccctgagaggctctgagtgacggcaaagaactgttctgtttaccagtggggcggagcatggggccagcgccaggccctgactcatccccatgtggactcccttgggtcttagcacactgcgaccccggagttggagcacaggacagctcaggcaggcacgctgagctctgcctgcaaggtcagagttgatggcgatgctccctcagtgggagtaagagtccatgttctgacaggtaggtcagttacccacaggggaccccaacagccatcgacaagaagaggaggagatggattctctatccacaggacacaactctaactctccttggcctccaacacatcacgaataaatatatcacagcagtaaggtcaatactctcacactctatgaaagtagtaatagtccccaaagcatgtaaaactgagagatccagataaaagcaaaatatacttgcacataaacttcatagcacacattcaacttctgtacagaagtcactgtgattttcacaattaggttatgatctaatcataaccacttaagacttgaacattaaaatctcattggcccagtttttaggcttccttcattgatagccattgaaaactaagtttaagctgaacctcagataatacccacaaaacacagaatgtcctaactcatctccatttgcatttgttgactgtaacgttccctgatccttgtgttagtcacatgctgctgcagcctgtcgcatactgcagaattttagagtcggaggggaactagaagatcatccattccacagcttcgtttccaggagaaaccacacagagaagtgtctcagctaagggtatcaagctagttagtgctggggactaaagtttaagccccctcactcttagcctggtggcctctccaatacactctgccccacaatgaatgaatgtattggttcatatttgaactaactctttgattttctaagttagaatattctaaaaggaggaaatctcatttatcaccttggtgtggttattggtaaaagcagatattctcctagcctctgcacctccatacaagataagctttggtcaatgacaagaaaaagcactgaagaccccattcaaaacactgagataacagtgaaaataaaaccagggaaattgactagctactgtaaattgagggctgattagaagtaatcctttttttcttaaaaaaacatgtatacaatttaccagatttttactttataataaatatacggtcttcctgtggccttgtcttttcctgtttaggtagataatactttgtttatgaatgtgtgtgtgtatacccttgaatgtacagatgagtaaacactttatctggcaggtgtggggctggctattacatccatccgtggtatccgacctacacttacttacctaatatatcttctatatgagccttctgtgacttatcccatgaattaatattctatttggaattaacatgatagtgtaggaggagcctccttagacttgtccagggtttgacatacatgaagctatatatgtcttgcatccgtaattaatctgcaagtttgagcccaggcagtccctgggtgcaggtagtcagcgtttttccaattaaatttattgcaaatgtactaatatcagcccaaagatccaaattctgaaagaaaatgaaatgaaatgaagaatttttaaatataaatagagacctaacttttatagtcatcagcgccatcattaaccttagagatgtctggtaagtattttctaggccattagattgttttttagccaactaaaatgtgtacttcctgtaaggattttccatatgtttctggtattacatgcaggttgcctttaataaaagataattatgaagcaattaccaacaagaaggagcataagaaagagcattccatcatggcataggctttacacagttgttgtaataactttcagcttccttattaattttaaaagttgtgtaatatactgagtaattttacacacactacagtgtataactgcagaagaaagctaattgtgaaaaacagagggataaaagaagttttagtttcaggattctttttttttttttttttaatgttttttttttattattatactctaagttttagggtacatgtgcacattgtgcaggttagttacatatgtatacatgtgccacgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaataaggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttagttttttccaatgctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttataagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggtttttgcggttttgaagtttcaaatctctccagtaaaatgaaacacaggtatgccaagcaaacttttgaaatgttttctcttgaattaccggagaagatgcagccttgacaagttttatttaagaggcttggaaggaaaaaaagcaaaaggaagctacctctctgaagatcctgagagagcagagtctcctcttgctgccgtcccctgaggcgccttggcaggcggccacactggatctccgacacgcgcaggacactgcctgtcatcccagcccagcccccatgcccactctcccaagaattgtgcaacagggcctttgtaacctgaggcctgtgaagtctgtggaggaatgtgacccagagccaaggggcgttggtgccaccagggctgagaaggagctctcctgctgtttaccctgctatcccatgggaacctcagaagggggaaggttatgctctaaaatgcatggggagtcaagtccttggcacagctgtgaagcaagcactctagttagtgtcttttcccctcatctttgctgacctccggaggcatgcttcatgctgctccagagagtagaacccaatgtgctttaatttttattgtatttgtataaatatatggggtacaagtgcaatttttaaaaatgcatagattgtgtagtggtcaagtttgggcttttaggatacccatcacctgatcccctcatcctcctttcaagccactcctcgtcctcctcctcttaattgtgtctcctactgaaagctacaagttgtggtcccattattccaatgccctgtaagggtaaagggtatcctgctgtctggggagcagggatccatattaaatgtgatgtggatggtagagtgccaggcactggtggcaggacagccccggaaatctttgagattcattgatttacaaaaccagcttcctgcctcctctcctcacctcttccatagacatcttcctccaatatgacaagtacacaatctggccaccataatacttggggttgtcccgtctcttctgcctggggaaaatgttacgagctgagtcatgaatactgtccttttaagttacccaaacatcatgatggccacacaaatggagctctaaccaaaaggaagtgaaagattcactctcagtcttgccatttaagtggtgtggagtactatggcatgtaattcactataaatgaaagttccacatttttatattaccaatattgttgtcacaaaaggtggtctcaggaaaacagacgttttagccagttgagaagacaacttacttggcaactagaagaccagtattttcgtcctttcaagtatatttagaatgcaaaatcattattattacgagagggaaagcctttttttaatgttaggatatgttcctctgcatggtaggaactgacgctatctccctccccgcatcaagcttatctcctctcatactatgtcctttcaaggaggttgttttccacactcctttctatgccaaatgaattcaatgtcagtttcaatcccgtttgtatttttgaaaacttaatatgcacctgggactgtactaggcactgtgacaacagcaaaataaaatgtttgacataagttgggctctttaagagttaagaatttagttgagacaagatgtacacctgcaaagagttcaaaagcaaagaggaaactacaaaactatgtgaaaaatgtgcgcactgtgaacttcaaagtgccccaggggctcagagcgaagaagcagtgttgtctggagtgttcaggttgctcatgagggcaggtcagcactgggacttgggaggaatcttgaaaggaagagaaacagactatgactgattgacacaaacttagggagaaaaacaatttcctagtgaaaattttggccccggcacaaccgctcttctcttactcaccggcgctcatgtccactctacctgcgctttgacaactcattcttggcgtgcaaagcaaataattcactttgcttcattgggatatgaaaaagaggagtcatggaaacacaaggacaccaggaagaataaaatgaactctaacaggtggtttctgtgaaccgccctgcatgctgaaaccagggctgtgtctgattttaattaggcacgagggcttctagagcctacaccctgaagtcaacatgttccaaaactaattcattatctttggcaaacctgttccccctttgtgattcccacctcagccaacgggcctcaccatattcccagtttctctggcgaggatctcaggtcccctctgatccccgagtcactctctactgctgcattcggtcattgaacattgagcctagggggttggatctccacatctttcccgaacccatcacctcagccagttcttcctgctgccaccctggtctgggccctcatctcctcatcttcctctaagatcactcatctctccaacctcatttctctgcactcgttggccacgcctttctaaaatagaaaccggcactccccagtttcaagtttttcccgttgtttataaaacgaggactaaactcctttgcttggttttcaaggcctctcaccttctctagcttcactggaccaagcctctccccttggctacccatttatccattcttccccacctcttatgcaccaggtagatctgtctgccttcaattttccagcttgcccaatacttttcttgcctccatggtcttgctcatgcaatttcttcagcttttctgatagttgaactcctaatccggcctcctccaggattcctgcttcacatggaccactgctttcctctctctgcttcctaccttcatcatttgtgacattctcctgacatttaaaaaatttgaccctttgcgctgaaggagtgagccaggtgggattgggagaccagggcaaagggagtagaagaatgttttgagacagggaacagcatgtgtaaagactcagaggacagagacaatggtgtattcatggagctaaacagtgtatagtagttagtagaaactgggtttgagtggacaggatggcattgggaagaagtggcactggaggaagaggcaggggcaagtccgtggggctggccctgctaagaagctggacttttagctaaagatcaatgggcaagtttgaagagttatcagcagggcagtgatgagataacatttgcatttgaaagggatgtagtatatggggaccagagaaagactggagaaaggactgtcagttaggaggctggcaggagataataagcttggtcaagggtagtgaccaagttcactacctctattcaagaaacagaggaagagagtggactttagagctttagaaaggagatgtgattaggcctggttaattgatcggcctggtttaaatggagagggtgagtgaaaggagacacctgggtttctggcatggcccagaaatgaaactatccatgccacagtatcacttcctgctgatgccctctaaagagactggatctctctcccttctcagagctgaaacttttgacagtgagggtgggggtggtcgagagcccctcagacatttgctttggagaagacacttccagttgatatggggcctggatctcattcatttgttacagtctccagggcaactagttattcaataaaccttggtgaataaacaactgtgcctataaatactgttcctggtagtcttcctgttatgttttctaaaaaatattgggcattttatcttttattgcccttcatagtgtaaatgtaatggagcctgtcttcctccccaactcagatttcagttgaaagtcttcatcaggaggcgagtcttctgccagccgggttatttgatagacttcgtagtcttcatggtgctccttgatggctatttaatgtctggtagctcagagtcatgaccagaaaatcaactgtgtcctttgacaccttcctgggccaatgtccatttcctacatcttcttttctcttcaaagtcatggcctgtacaacaaaagattaaaatcccctggagacctatgtcctttattcctacctagaaccttaaaggaactaaacataccatttcttctgactgcatcttttcttatgaatcatttcaaggcatactcatgttgtcagaaagtagttcatctccagaatcatgggtcacaatggacttgctgtgtccttcccctgccaccactgcccccttcctctactggtaagcccacctgctagagtggggagatctccttctcttcctcctccacctgcagtatgtgcttttgtggcatgttctttttttttcttttcttttttctgagacagtgtcttgctctgtcactcaggctggattgcagtggcaagatctcagctcactgcaacctctgcctcccaggttctagcgtttcttgtgcctcagcctcccgagtagctgagattacaggtgcccaccaccatgccctgctaatttttgtatttttcatagagatggggtttcaccatgttggccaggctggtcttgaactcctgacctcaagagatctgcctacctcgtcctcccaaagtgctgaaattacaggcatgaatctttccttattcacatcttgaggctgctcacagtcctcccttgtgtctggaatctcatagtgatggctttctcctgggcttatgctcgtgagagcccctcaccacctctataagttgcagaagcaatcattgagcactttcttcagccactttagcagacagtcaggtttgcatatcagtgatttcatcataactagggaatggtaaaatcatagtacaattaatatgattctttaattttaaagaactatacaaatagaaggtagttatcaatataaatttaaaaatgtctttcccagagtttaaggtaatgatattgccacaattgatacacacatatgttattataaatgctcattttagaagatgaaatataccatctgaatggcatacaaataataagtgctacttaggtcattattggcatttcctcctacctcttaaacaacataatttcaatcagctttacatttagacatcatttcttgcttagttttgacataacagaattagcaatcattaaaagcaacctattttttttaagcacctactgtattagtcagggttcttcagagaagcagcaccagtaggagagatggatatatgtgtgtaatgtatgcattttgtatatacacatatataaaataaggagttggcccatgtgggtatggaggctgacaagtcccaggatctgcactcagcatgcctgagacccaggaagagccaatgtttcagtttgagtctggaggcagaaaaaaaccaatgtcccagctcaaagcagtaaggcaggagggtcaatctttttcttccattcaggccttcagctgattcgatgatggccactcacagtgagggtggggtggggggcagcaacctgctttactcagtcaactgattcaaatgattcaaatgttcatctcacccaaaacacccacgcagacacacccagaatcatgtttgaccaaatatctgggcactctgcagcctagtcaagttgacacataaaattaatcattgcacctactatgtcatcagttggcctagtaattacctcatttaattgccacaaagacctcccatatggaaagtagtcttattcccatttactccacagctgtttatttaataaatgtttgcacattttagagatgaagaactgagcctcagataattgaagtaacttgtctaaggcagcacagctagtaaatggcagggccaggatttcaacacaagtctaaaacactcagctgggtactctgaaccagtatggccactgcctcccagcactggtgctgtgctccccacaggccctgagggttcctccttaggatggagaagagctgaaggcattggccgctggccaacactcagggcagcagcagggcaggcacacctgaacatgtgggacctgagtgcagctgggagcctggagaaggctcccctttcctttgcctttgagatgacccacagagcatgaatagttgctggtatttgttgaaagctacgtgctcgtgctttgtgtggatattattatttaatattcacaacatttctgttcttctcaccaccccactctgcttgggagggaggcagtgacagtgcccccatgaggcagccatgggcaaggactaggaggcatccttttaaactgctgtcctcagagccaccaagagtgccctaggttgccttaaatggccccatgggccagtccaatcctgttccatctctcctcaaaatctgcccatcaaaactgcttaaaatgtgcatgaatcaatgattccgcaggtgcgtgctgcctgctgattcacccacgagcaggcctgggctttcccttctttttatttgctcctcatcgcttgatacattgctgttcctcattttccatttccactagagcttggcaaaaacactgtctagttctaaacataactatgagcccctaaataaatcttgtataaaaggagctcctttgtctttgactccctgcagcactctctgtttgctctacggagtccccttcatcgtgacaacataagcagtcctcatggcattgcccagttagcttcgcccacagcaaaactctcattttgcagaggaggaatcggagactcaggagagcatgggccttccccaagttcacacagttagaagccaagccatccgtatcccagtccagtgcttctggtgtatcccacagacatcagttcttatggggtgggatgggcaggtcaaaaagcaagacatctggaggtggccttgcaggaaggcacgcaggctggcctggggccacacaggaggtcggcacctgttttgcatatttgcctccatgtacaaccatgtgggtgcaacacaaacaaaggtactggaagaggaactgggatagggaaatactttttacattggcagaagcagatcccctctggtgtgcatgctttgctggaaggcccgggaaagagctgagattcctaattgactagaatatgactcacttaggactcccattcccagaggaagtggctttggctcatattatgtgtttacagagaatcatctcatccatgtaagccctcagcactggatccacccagcggattcttctccatgacatcttggtgggtctccagacacgcatttggcttccatgggatgatgtttccagatcagacccttgctctgctcccgagctgtgaaccagatcacaggagcagagggtgaactgtcttgtttcagcctaggactctgagaatactctaccagccgaacacttccacaaggaaacacaattggtggtaacaactctcagaggaaagggaaataaaactgcttcttgctttcaagatcattccgctttttttttttttttttttttttggtagcataaagggtaaataaactttagatgccttgagagcaattgaatcatagttgagaaggcagcacaccctagaggtggaaagagaatttggatggtgtccagagatgtgggagctcgttctggatacgaaggtctcactggtaaaatcactgcaacgcttgacctgggatgctcagaattgggagacccatgttcctacccttgctccgttaataactgtctgatgtgtacatgaaacccctctgagcctcagtttcttgatttataaagtgggaataataacacttgccctgcctacctgtcccaggtgtgtgggtcaaatgaccctatgtgaacacactttgttaacaagggagtattctctctattgttgttgttttgtgtgtgtgtgtgtgtgtgtgtgtgtgtgtgatgtaagtgggaatgtcttttgctggaagtgagatgggaatgctgaggagtggtggagaatggtaaaagatcttactgggacacacagagggtgctgggtagggttgcagccccctagcactggagaccctgggtctgcagtgccagcattcaccccaccagcagatggacatacagtccaatgttggctggggtggtggatagagttaggagtattgacaaggcagcagttacaatggtgatctcagagatttcactgaacagggaaagagctgaagaaagggacccagcagataggcttggggagctcggaggtatcagagaaatgtaagcatcacgtgcatgagggagttgttggcaaggtggcagtggtgggcagaaaggcaaagctggagtttcagatttgagaggtggagggcatccaagatctgacaaggaaggcggtgctgaagggccccaggccaatcacaaggttggaatggagagagtagaagctgagtgccagggtcatctcaaagaatatggtggagttgtcacacctagggagatgggaaatctgtgagtggtcaggacatcagaggtgggggcaggtgtctggaagggctgggaggagaaggctgatgctgctttagggtaatggaggcccagaaaacagatctgcctggacgcatgctcagatttgaaattggatatgaattacatacaaattggtcattttacacatagataaccaaaagttgttgggtcatcttgtcctcaataatacaaaatatgcattaaaaactgtgctaaataactccttttagctatcgacatttttcataaaatagccccaagggcatggttagtatcaatgaaagagagccacacattgctgaattttcaggagttttgcaagccaggtgttatgttgatagcttgaaataggcctcgaagggaaatcagcaaacattacaaaccagggcttccctccaataatgcccccaccatccctggaaatctagttattaaatatttcccagcaccactgcctaggcataaataaaatctccaaatctgcccaactttacaatcctgttgtggactgaatgtgctgcgcctgtaaaagagacatgtcctaatctctggtgcccgtggatgtggccttatttcaaagcagggtctttggagatgtcattaagatctaaattaagatgaggccttactggagtagggtgggcccttaatccgatatgactggagtcctccttagaaaaggagaagagatacagagagatacacacagagtggggaaaactatgtgaagacgcagacccagggcagaacagcatgtgacattggaggcacaccacagtgacacaaaccaatgattgctggcggcacaagaggccaagagaaagacatggaaccaactcccctcagagctccagaaacaaccaaccctgcagacaccttgacttctgacttctgacttctggcctccagacctgtaagatgagacattcctgttgctttaagccatgcggtttgtggtacctcgttacggcagcctggggaatctgacaaccctgtcacagcctcatgtttgggcaggagggcatggaagttcttccacatgaacagcaaagggaaggtcgacttttacctttccctgtctctgctcctaggggaccttccctcttcccggcacctccagcacatgttttctttaccatgatctggtccttcccattaggtgccaagtattgtgggtcatgcttcatgctttcccttctaaatggcaatcaggggttgtaaacgcagatgcccctgtgggtcagagttgttcagcgtgatgcagggagaactttttcaaattggaaagtgcattctgtatttaaattaaacaccccaatgagctggccaaggaaaacctggctgagacctgacattttgggaactctttgacgtgctctgagaggtggaggacatctcttagccttggcattccccagcagcccccggcagcatttattcactgctggtgaactggctgattgtgtctggctggttcctgggtttttgttgtcatttgctacctggatctctcaggggtcttttgtcttgacctagctgaacagcgaatggagtggagatctcagaatttccacagttgctccaatgtttctcccttcagacagaagccttacaaaaaaaccagattttgtaggttataaatcccccaacggacaagctctgggatgctattgcaaaactctagtttcagaagaatgcaccaagagggcggcgtcctctccagacatgacctgccccacccggatatttccaggagtgttttcctcggcagctctcgtcatcttaggtggctgggggacaggcatcaggcacatggaaaatcaaggttgatttggggtgagaaatattttgaagttgtaactcctgtttacagtttctttctttatgaacaccagagggcaccacagtcatactgaatggtgggtcggccttgctttaggactgaaatcctggtacccaaatttttttttctttttaatttaagaactaagaagtgctgaattgaatatgtattcatttgaatattttgctcaggcttctaagaaagttgcagaagaggcttttggggccacttgctggatgttcacgcccagggcctggggcagggggacctgtggggcagcactccttgcctgccctcccacccagtcctgagattgtccagctctggtcggttctgcggcagggctggaactgtgtcccaggccagagctacctcgtgcagggacccagctcgttgcttcctgggctcatccttttaaactggctctgtgagttgttccacttagcatctggaggtgaggcctggccctgggggaatggaggattccccagggaaggttgagggattgctgaggttgcacagttgttgcctcaacagcagtggggctttggcaacagggaccagttgactggtgtgtgtgtctggggtcttgaacagtttcccactgatgccctctggtagcttcccactgacagcagagcattcatggttctggagaaatatagaaaattttctgtaggctcctaaaaggctctggaaggagcaggagcagagctactgagggcatgagaggcttcgtgggtgctgggggctctgtgaaggggtagctgggctgacctccagagagacctgagacctgggaggagagaccacgtgggagaggtgccttgccagaggtgggcagcagagggagatgctaccagcaccatctcctgtctaatcgtgagtgtctgggccccaagagggtgtgtgtatgcttgtggaagaatctgtaccagatgacacaactcattcagacaggggcttttccattctaacctctgggacggtccactcagtgtcagccatacggttttgggaaccttccgatgacactcagcagagagcaaggctgttcttagcaacagcatattgtaaatagcaaaggagcactcgatctgcaggaaagcagacggctttgcagaccagaagctctactaatgagttgatggcaatttagtgagccttggctgtttgtatgaaagagaaaacttcaacaaaatgaggggagaacgtatatctataaaagagagtatgagggcatggctgtgacctccaccagcaagttgaaacgttccactgagaagatccactgtggataatgggaactagtgcaaggccatgatctgcttggtgcagtgggcccaggaggcaggcagagggactgccctgcttccaagaccagtgaccgctgcagggtctacctggccacgagggggttccctttgtcatttacaattcacttgctccattcagtctttttatttaactgggatcaaaaaggatataattggtagcagatcatttggattccagttccagatttgtgaccctcatgagtgatgttcaggcttggcagaagtcacatgatcacacctaacaggttacctttcttaaaatgggcacctattaataatatcaaataatggatatgatatgacctgtgaaggcacttaggaattgatccagtgtgacataggtggtgtcattaatctcaggagggaatctttagcatttctttctctttcaaatatgtgtctgttacttgggctgagtgaggctccatttgaaggaggcttatttagagttaagataaagatatatcttcaggcctatgcttttaccatcaccaaacaaataggattggaaagtattttgggttctgggtactcatggctttgtagactgcttagccacattcagacaacaatttgcagagcaacttccatattagaactttttgtgaaaaaacacaaaataaaattcagtttaactcaagaagtatccaaaaacattcactaaaaaggactacttttgtcctgagcagggaataccatccttgtttttgttttctacctttttttaagctaacgttagagacatcttgggctaatgggaacagggaataactactggcaaaatcagggatcaaggttctgtttatgttttgtcaaacaaatacatctgtttgacctgaagcctccttggtttattacagcaattgcttactgtaagtaagcaacaaggtgtttaaatttcacacatgtgaaatacatattatgttgcctagcaggggccaagactcagtcaatatttttttgtagcacagttctcagattctgagctttacttaaccaaaagtttacttaaccaaaggaagcaagttcttaaccttgacactagaactgtgagttagactttattagtgaacacacttattggtagttccttgtttaagtccattaccacaatgtttttctttagctttaacacatgcaccatttggcacagtcatagaccgataagcaagggaatatagcaggcagcagtcccctggaattacaagctcctgaagcaaagctccgtaatgggtgacagcttgagctatggaatcaaccagcctgatttcaaagccagagtccactgttcactggctggttaccttgggcaattcactcaacctcctcaatcttaaattcctcctctagaaaatgagtgcataaaaacacccacttcatactttttttttttttttttttgagatggagtttctctcttgttgcccaggctggagtgcaatggtgcgaccttgcctcactgcaacctctgcctcctgggctcaagcgattctcctgcctcagcctcctgagtaggtgggattataggtgcccaccaccatgcctggctcattttttgtatttttagtagagacggggtttcatcatgttggccaggctggtctcgagctcccgacctcaggtgatccaccagcttcagcctcccaaagtgctgggattacaggcatgagccactgcgcccagcccactttatactttttagggcttcagtgagataatctagtcagtgttagctactatcactaacatcatcatcatcatcactgcctcttagtctcctaaaatacccagtatagtgccttacactgtgataaagggggaacaattcccatttgttgtataactcattccatccactgatgcattttaaatttggaatgaaatctatcaggattacagattcaaattcttaaagctcttccaatgtactttgttcccattttggggggcagggagagagtaacttcttaaaaattttccaaacttcaaccctagaaaataatctatgtatataaacgttcttagtataattcttggcacatcgtagtagacatttcataaaagttctaagagataaaaagtaaaatgggtttatattttatgatgatttttaggggagacataggcttcaagaaagtgacttgcggccacacacagtggctcacacctgtaatctcagcactttgggaggccgaggcaggcgtatcatgaggtcaggagatcgagaccatcctggccaacatggtgaaaccccgtctctattaaaatacaaaaaattagccaggagtggtgacacgtgcctgtagtcccagctacttgggaggctgaggcaggggaatcacctgaactcaggaggcggaggttgcagtgagccaagatcgtgccactgcactccagcttggcaacagagtgagactccatttaaaaaaaaaaaaagtgacttgcccagtgtttaagaaataagaatgtttttggatactcattcttgagttaaactgaattttattttatgttttttcacaaggatgccattatcttcagtaaatgttttcttgggaaactcaggcagtgggaaattcctctagagagttgctggtcggcaggtgttttccacattacttgactggagagctgtcggcagtcagatctctctgacatggggtaaacagcggctctcgatccaggcagctctttagaaccgccccatgagccttaaaaagtgcataagcccagccccactgagccagatttttgctttgggatagtctgggtgggccctgggcgtcagaattcttaaaatctttccaagtgtttctagagagagttataaatagttctctctgcttagccttcgataattctatgttttatacatgtttatagatttcagcacacattaaaattctctcccctttgtaacttctctttaaaagggactttttttttaactttgtaaaatgataaaacataataggaattaaccagtttgttcttctgaagaaacatataagcacttgattttacagaagaattgccagaattgttcagtagctacatcttagatagagtggtagtgacggctttttcattttatacaatcaaagcaaccacctgttttttccctttcccaagtaagttaacacaatgaatcttgatcagatgatttatctctttgaaatttacaagtgatggcttgagtttcatatattgcatactaataacataaatgatgtagagaggtactaaaaataataatattagtaacaataatgcctttgttcatcatgtccttgcacatcacatgttcgaaacaagtggtgtttgagcctgctgagatatgaaatttaaaagaaagactatgtaaccctaatgcttatgtgttagatagcttgggttgaatattcaaataattgatctggtacctgctgcagattctgtggtagtgcaccagtcatttcttaaaatagccctaaccatatgtggcaattgaaagaggtgtataaggggtccctaggagcccctaagggaatggtgaagacctcacaaatagagaaaacaagggaaattagcaagtaaaaccctcctcccaatcatggttctatcttaagtttcctgcctcagagacaggactttttggttcaatcttggaagatatactaagttctttttttcaaaacataaatgatccacttggcaatgcttttacaatacatttagtgcattttgaatcaaggaattgtttaatgtgcttaccatgagttatttccttttacaaatatcatttgaaactcaccatttctagaaagcctcacctggttacgtggaatatgatcccattgatctctggctgtatcttttgatatcagaagccatatgcttataggcatgtaatgacgtcctatgtatgacagcacacatcagaatgtccctttaatttctccgacttaagcacgtaggacctttgaacatgctcttccacctgcttggaatatatctgctactaccagcaactcctttatctagttcttttcagatctctgcccagttgtttttgttcagggaagctttctctaatcttcctctgttcactgattttacgttcttgcagcatctctccaaagtctcacttttccacttttttgagtgaccatttgattgctcactgcctgtcttggaaggctgtaactctttgactcacacacccagggtctgtgttgacttttgtttatcagtatatttctagaagttagtccagtgtttgaattcaataggtgactaattgttgaatgaatactgcactttctctttgaaactcagctacagtttcactttgctgaagagttctgcactacttaactttttgaaactaatgttctatgtaatactttaaagattaatggttaaggagagtgattcattgtgcaaaaagaatgacttttactaaaagtatttcttattagactaaatttgaaacataaactaaaacatacatttttaaaaagctacccataagctcaccatatttacatagcaactatttttatttcatcaaaggacactgtccttaagctgaagtcatgctggaacttgggtatttcattctaaatttgtttgtgtttcttcttcttcttcctcttcttcttcttcttcttcttcttctccttctccttctccttctcctccttcttcttcttcctcctactcctccttctccctcttccctcctctctccccctccccctcccccctccccctcctcgcacccctcttcttcgtcttcttcttcctcttctgtgatgatgggcagcttcataaactctggctggaaatccgaaggtatctaaaaaactctcaactagaggtgagagtgctctgaatcattcacacaaaattgcctgaagctgggctacctgtcttggtaaacagcacacttaaactactccttcagcctccaggaccccactgtgccaaattcaggaataacacctgtctcatgtaaaacttttttagtctgtaggatcttactctaaatcataggaattgttgtctcacgagactttttaatgtctgtgagagtatggacattagcaagagatgccttaactcttaaaaccacctcagtcagtactgtgactcaatgcctcttaactaggcgagggttaaatatgcagatttgaaaatattgggttaataaatagtgagcagttaaagtttcccccttattagtgttgcatgttctttccagtaattttaaatcaactgatcagtagtagccttagatcaaaaaggaaatgaagtttgaaggaacccacttcacatgtaaggagatgagcttatttccttaatggagagtcccggtggagacgctggaggcagttcctcagtggtgtttggttgaaccaagcaccagtcaacaaaggatcaaaagtgggctgcagcatatattttggtatcagtggatgccttgtaattgcaagctttacggtcatgcatgtttcattctctctttgttgtgttttccagagggataaccaattggctggcaaagtaacaaatgaaaagtaacctgactctattgacctgcttaaccctgcatgggggggaaggatggaaaggagcagctgtttgctttgaaacggtggaacaggtatggaacagcagcttttgctgttgccttcttttatttctttgcacatctatttccagaccagttgaaaacagcaagttgttcctgtttgcggacacagaatcggggttccgggttccaggaacaggtactgtggtttactagtaacattctgacttgccccatcttcaggttgccatttatataaggattagtgcaatgaaaagaaccttttttttttttttttttcctttgagatggggtctcactctgtcacccaggctggagtacagtggcgccatctcggatcactgcaacctctgcctcccaggttcaagtgattctcctgcctcagcctcctgagttgctgggattacaggcacccgctaccacagctaatttttgtacttttagtagagacagggtttcaccatgttggccaggctggtctggaactcctgacctcaggtgatctacccgcattggcctcccaaagagctaggattacaggtgcgagcccggccaagagcattgttttcaaatagcaaataagtaatcctgctagggagaattattacttttaaacataggatttgcattttggaagttcatttagctttaagatacattatttgggcttatgggaattttgctccactaaacaaatttctatgaaggaatcatagaagtaatgacaaagcagcaaaacttgttgatttccccagtgaatgccatggaaagtgtgtttgctgtgtttaatgatctaatctcctctgcccacattcattttctcagttgtgaagggaccctgccaagaaaggcatagtttgactttttctattttttcaaacttcacataatagatataggtgaagcttcttttgcttcgaaatgaagatttcatttcaacacgaaagatttagaaccacacccgtaggacccctggaattagaatctttaaaatttttgttaactttgagtcagtgcctattgtcattggggggttgtaccttctttcagttacatccattatcaagaggcacctgagcagtacctggtttggtagtcactctatagaggtcaatggtttttgtaatattaatggctttgtcgtgcagctagaaagtaattttaagttcagaagattaagtatcatgtactagatgttcaaaattaaatcacttaatgacttttctcgacaagatttttctccccattggatgcctgatagatgagggactatgaataaataataaagacttgaaatttgcataggaatattataattcaaaaggttacagaaaaaagagttttaaaagttgtattttatataaggaattttaaaaggttatgggcccactatttaaggttatttaaggaagagattttatgttattatgttctcaggacataacatctttacagtcattaaaggtttcaatgtattactctattgaatctgaaactaaatatcatagaaatcaataatatatgaagaatctggtttctagcttaacaaggaggcagaaaaagtagtgtgttgttgctgcttgaggcacaaagcagctttctggtcttttggttccttcatgtttcagtgtgtagagtcagccaactacttcccacattgaccaactatcttttgcttgcattttaacatgatgcaaatggactttttaaaaaagtttcttcattaaaagatgttgtctgtctgaaaggaaatatttgggaatagggcaaaagaagatgaaacagacaataaacactctatactacccattctgaatattgatcaatgcatattatcaaacaagttggctactggaatttcatttagtgggaatagattataatgtgattcaatttttaaatgaagtgatgattggaaaaaacattataaaccaaagaattagctagctactgtgtcttcccgggtgtgagtttttatctatgaaactcttcgagaaatggaatctgcctttttttttcatactagaaaagggagggtagagaagcaaaggcctggggcagagaaagacaggctccaggctgtttccaggactgttctctggaaggggctgggagcagcccctgcctgagcccatttctctttttccacacctgggataattttgaaggagggagccttggagaaaaccatcctcaaagggcaccagagggctctgcaggctccccagggctgctttcctcacacaggaaaagatactggacaggattcaggcaccctcaactccagaaacctcggagtcttcctttgtgaaaagcatgaatgctaacgttaggctgctttgctcacagacattggtgtacccagtaaaagtgctgcccaacgccaaacctaacatgcccccatcctgtcaccacccagtcagcagggaaaataagaaccaggagtttgggaatggagaggtggtaggagcatgtttaacaagactagaaacgctcagggctatggctcatgtggttcctgtagccctgagccacagggcttcctggaaatcctcaggaggttttgacccagagaccaggaatcttctttcctgtgtggcttacaaactgggctccctgcagaagttctgaaattcttgcataacccacacattcctctacttccaggtaactctactttcctaactaaccccttcaggagctccctcttagtccacgtgcaggctcagtggctgcgcagagggaaaacacttgccaccatagcccttagatcccactgcgccttcctgtggcccctcaccgtggacagagctgcagggcccctcacgtcctgcagctggacacagtgcaaggctgcttcagttcagtgtcaccactattcagagttcttgtgaggattagatgagatactagttgggggaaattgtaaattgtaaagtatcttagaaatgtcaagtgttattcaatatgacactccagtaagaacatgggctttagaaccagatagctctaaattcaaaacttgcctgtgtgaacctgggcaagttgctttacttcagggagactcacttctctcatccataaaatgagattgcaaaggagagaggtatatgcccgctgcccctcgggggctacaggctgcttgtcttctaaagacttcatatgacagtattcatcaccatatcatgaacttaccgtggtcaaaacagtgaaaggctgtccagttctcagccttggaagctcaaccagctgagatggcggcagccagagagcagggccttgctgaaggccacactccctgcagccacgttctccggatggtgcacaaactttggatgtccattattttatgaagggaaatagctatccttggatgaagaccacttgtgtcaacatgacccattcatgccctccttgtgggtggatctcagggcaagacaaatcatcaacagattccaatttattcatttaccaggagatagaattgtccctgagaccagtgaaaagaactgaatccatgtgaccagtgcattctcttccttgaggaagacttatgtaggacgccagataataaccaaaaggagacttgacagcatggagttagattagtcgaattttaacaatgagggccaaaattgctggatgggcttctctcaagagcaaccgtttggccaatggggcctgagtccttttcctccttccttgcaatagtgcttggatggcccagccagcattggcctccgcatttgtttttctctgcctgcccatgtctgctcatcctcctgaataaccgacacaagaagaacctgacactgtcagttacgattatgcagttaatcaggttctatcaggtcttgcaggcccaggagccatttatctctttaagatgattttataagatagcttcttcctgatccagcatgcactgatctcccattttaactctcagaaaaccgttttatttatcttactcctaagcttttgggggtccctctctgatgtccctaagtaccgataacaggattaaatgacaccatatacgaaagttgtcattctggtgcataggaggggctcagtaaagcctaattccctgttctccttccctttcatgcaatatgacagctcttaagacttttatggaacatagccctgtgctatgtcagttgtatttcaaagattaatataaaataggattccagcccctgaggagctcagagtatggtggtgcagggacatttaagtgaataatgttttgttgagcataaaaaccctgttgttgccaggcccactggctgtgggagtaaatgtagccttcctggtattcatgtattcattttgctatgctgctagacctcacctgtacaaatacagggccccgcctcctgcagaatcctcccaaagatgtgccagtgctcagggagagttgcagagaagagctttagtgtccaccctttatcaccattatctccattagcattagtccacaccatgcccattttaaaatttgaatcaaggatgttttcttaactccagctaaagtatatgcaaagcaacctgaaggccccccactagccaccacccagctgctcaccctcactcttcctgccccttgctggtaccctttcctacactgtgattctggagcttccaaacaccccacatatttctgagtatccctagagggtattgcaaatgttttctgaaatgactctgggccttctgccaccagcccttctcctatcaggcctggggttgggggaaagggcaggcagcagtgtcagctttctgccatgttctctgtcgctactttcttcgtaggaaaatgttggcccagcctggcctgggtgctgcctctccctatgaaacggtttcaaagttgcagatctttgttccctttagtctttacagagggcttatgcaaacatctcttcagtctctaagttctcccccagaggaactcaaaaacacattattgggtagggcaggggaccagtgggcatcatctggtctaaactcccctcatcttctctctgagctagatcccaatcaaaatttcctccctcgtctttcagtccccaaacccagaagtcctaattcatgttgatatatgcaaatagatgaccaagaaagtcactggccaccaagaccatacagatctgaggttagacttagatagaagggcaataatagaaaaatatgaaccaagttctactgcagaagcaagtggtagtgttgctttcggttcaggcttcaccttttctgcgaggccatcccctcccactctcactcaagttaagcacttgctcttgaatcacccagcggacatttgccaatacctaatatgtgccaagcacaaagcgaggcctctaatggcatggttcccaagcagaatcctgtcctctatgagatccctcgtctgtttgatctctatacttggtacttctctgaccctgaacactagtttcattttggcttatacatttggatcccatattagtctgcaacctctctgaagacctagcccacactttaggcttctgaataaatactgtcatctgaataacaacattttggtcaatgtcagactacatatacaatggtaatcccagaagattgtaatggagttgaagaattactattgcctagtgacatcatagttgtcataatgtagtgtgacacatgattcatgtctgtgacaatgctggtgtaaacaaacctactgcattgcctgttatataaaagtgtacaatgacctaggacttcatattcactcattgcttactcactgattcagaacaacttccagtcctttgagctccatttgtggcaagtgctccatataggtgtaccaatttttatctttcacactacatttttacggtaccttttctgtgtttaggtgttaaaaagtcgcctacaatactcagtacagtaacacactgtacaggtttgtagtctaggagcaataggctataccatatagccttggtgtgtagtaggctctattatctaggtttgtgtaaatacactctgtgatgttcacacaatgataaaatcccctaaagatgcatttctcggaacatagcctcatcgttaagtggtgcgtaactgtaactgaattgtcggctgtgggtgttatcataatccgtgtagtagattatcttcagtaacctgtatatctctttcctggattagtgacagcaagatccaagtaggaagcaatcaaagtgagtgagtcatagagcacgatgctcacaagcatgaaaattatgctcctctgtgccttgttaaaattgattttacaactatctgttgatttatgggagtcatgacatctcttttattttatgacatagatgatgaagaggaaatacatttttccctcaaattgaaactatcaaaatggtttcttttggatgttgcatatagagaaaaatcgataaagcagacataactcttcttatctgtactagaaatgtcaacacaatacatttgaatctgttgggtttgaatatcttagtttatcactattattttcccaaagtattctttcccaagtacccagaagccacattcaacttaaaggcagagtaggtgcagtgatttaagaaacatccacaatagttagtctggcttgaccatgctcagggagctgccactggtgtttaattgagagagtataatagcacttaggagtcctgggtgacagtgaccaaaacctagctgaaacacacaagaaaaaatatgcatgtacatttgtacatggagaggaattttattggctcaacccaaggaagggttgatagacaagctgttgtaaggtaagagttgcaggtggacccaagaacaaccggagccaggaactgaaccccactgaggctctcactctctttcaccctctcttaattcaggccagccaacaatacccaaatgttcaattgtataggtttcaccatctgatagatagttctatatttttaaaatcctagggaaggattctaattggtctggcttgggtcaggtacttcttcctggtggactaactgagatcaggtaaggccgaggcaggtctcaggaaaagcacaagatgcagtggggacctatgcactccccagaaaaagaaaagctaaacggctaataggaaaattatctacgactatgatctctggccagaactccccaaaaggcatttgttaagatggcctagatggcctctaactctatattcttcagtcctaggatttgaattattatgttgatttgttcatttatttgacaaataaaaattgtgtatatttatggtgtacagtgtgatgttttgacttatgtgtacatacatggtggaatggttaaggtaagctaattagcatacacagtagctcatttctcattttgttgtgtggtgagaacacttaaaatctactccctagcgattttcacatacatatataatatattgttattgactattgtcaccaagttgtacaacagatttcttgaacttattcctcctatttaactgaaatttagtataatttggacaacatcccccagccactgcttgtcccatatccaccacttccattgctggctaaatttggaaaatatatgaaaaagaagttaagcaaattccagaaaaaaatgaaagaccaaaaagctctacatttgcctggcctttgaggattgattctcaacaattctgaattcactgggtgtttagatgacattttgcttctatttaaccgtgtggagaaagccctgttccatttgcatggctgcctgtattctttaacaccctgattcagagctctgcttttggctctcctaacccttttctcccctctttttgtagttggtacacaaatattcttcaaattgtcattttacaaaaggtcaaaaatgagctgtcttcccctttagagagtgggaagtagtgtgcataaccttcatggctattttctcccctttagttttgcagccttagaaaatggcatgtaacatacctaaccaaagacagcggactctgtcaacaacaggagaagctctatacgaaattcttggtctgcataagggagcatcaaatgaagaaattaagaaaacctacaggtacggatttcaatggtgacatttcttctgctactagtgagttattttgtgactggcagattcctccattaaagacataagcttctcactaagaccagtaatccaaattttagatccaatgttccctgctctacaacataggagttaggaatggaaaggcatgacagtgattttatgaaagaactcactgatgatgctgggccttaggaaagggcagcctgtgtcttagacctgcagtgaaagagagagagaaagacagagagagaaatgagtgaaccaaccacaaccaattgctgtcatttttttttttctttctttgacagagtctcactctgtcgtccaggctggagtgcagtggtgcaatcttggctcactgcaacctccgcctcccagattcaagcgattctctgcctcagcctcctgagtagctgggattacagacacccagctaatttttttttttttttttttagtagagatggggtttcaccatgttggccaggctggtctcgaactcctgacctcaggcaatctgcccacctcggcctcccaaagtgctgggattacaggcatgagcaaccgcgccctgccaatcgctgtcatttaacccatctgatatagcatcactgagtcagaggaattcttttttaataaaaggagtttggtggaatgctgtatttgtaagctatacttctcaagcccttaattttgatcttttgtggtctagttccaagttagctatttttggaaaactttgaaatgtctttttattttaagtccaaggaataaaaaaatgttgagggagaaatgccattactacaacccaaacatatgagagaagctgtctgaaaattaaagtcaaaggggcaaatccccaactcaaagcacaaaaaaaatcatcttcttctacaccgaagtctagaaaggcctgtcagtgacagaagaagcactggtttggggcttcctactccaggagactttctgcactggtgctatagtatgtcagtcctctaagaattccatgatgattttaatgaatttctgaaaactctgttatttgtcccacctataaggcatgtagcctatctgatacttgtcttgacaatattttgggacctcttagggcattttgaggtatttaactgtctcttggctagttggaggaagaaagatgtgtggaccttaaccaccttctggacaggagagctgctttcagagagagaaaatctttccaagagagtgcttgtttgtttgcttgtttgtttagagttagggcctcacttctgtcacccaggctggagtgcagtggtctgatcatagctcactgcagccttgaactcctgggctgaagcagtcctcctgcttcagcctcctgagtagctaggacttcaggctagctactcaggctatcaggaccaccatgcctaactaattttttaaaattacttttttaaaaagatgggatcttgctttgttttccaggctggtcttgaacccctgattcaagtaatcctcccaccttggccacccaaagtgccaggagagctttgacagtttcacattgaagtctaaatttgctaagactcaggctctttcttacatatagttttaagtagatgaaacaaccagaaacttttgacttgtgatactctaccaggaaggacatggtgataacagaaatagtggaataatttgtgcttgtaaacatttaagattcacctgtgggttttggtgactgatgattaaactgttttccaacttgcaaaaaaaaatgttgagtacaaaattaatttgcttactgtagaaattttgcaaattaccaaaaatgaaggcaataacatttatccataatcctacctccagtaataattatcattaatattctgtttccttctagtctttttttttctatctagaaaagacatttaaaaatcaggttgtattagtctatattcttcaactacctttttttttttttttgagatagagtttcactcttgttgcccagactggagtgcaatggcgcgatctcggctcaccgcaacctccgcctcccaggttcaagcaattctcctgcttcggtctcccgagtagctgggattacaggtgcctgtcaccatgcccggctaattttgtatttttagtagagacggggtttctccatgttggtcaggctggtctctaactcccgaccttaggtgatccttccgcctcagcctcccaaagtgctgggattacaggcgtgagccaccgtgcctggcctactacccttttttttttttttttaacaaggtcttatcatgaaaatatcttgatgttattaaatagcctgatttttaatggctgtggcctacggttattttgtaatttatttagtcacattgcaagctgttattgaacatgtaagttcttttacttattccttatacttaatatacatatattataacacatattttcaattacttattttcttatgcggtataaagctatgcctttacaggaaaaaaataatcaaaatataaataaattttcagattttaatcagttacttcttgatttagtcttgaattaggttttataaacctaagtgctttttcttactgtacagaagtttaaaattaggcaaatttgttagtcatttatgacttttgttttactattatggttaaaagacctctcgcaattacaacactataaaaatattcaccgtatcttcttctagcacatttatgattttgctttgacactaaatcttgatccaattggagtttattttggcataaggaatgaggtagaattccagatctgattttttcccaaatccttagcccactaatacttattgagtctctatttttatctattaatgggaaattctttgggttagggttggaaccttcaccatgtggcaaattgtaggaactgaaatgcctttaagaagcatgttttgaagaaaaaatggcaatggtgtgaactgcaatttggaaccaaatagttacatgaaaatggtagagtctgataaaactcaatatcaatcttctagtttatatttcccttaaggtgctagggagagaaaagtctttgctgtttcattttgccctagacctatccagaggcgcgtgcctgggagctgcccacacctgttggtggacgtccttggctgaagatcactgaatttgactgaaggcttcaggctgggacactgtgctggggtaggggaggtgggagggaatgccataattgcattgtcagttaatttttgtaatatctacaaaaatgctccccaaaatggggagggaaaaaagtgacatccaacttccttgtaatttttaaaatccactttactttacaaatgtgactcttaattgtctttattaattttgtaagccaaaatttcaggtcatatgttaattaaggcattaattatgctgagttgtttgcaagtttaataattacaacataaagtctattcatgtaattagtgtcttgctattaattttgttttaatgtcatacaaatattattttttcaggtgattagggtactagtatgctgccaaaagcatctacttctccctaaattacacatttgtattctgcaagttattcaaaatgtatgagtaagctggaaatccactgagaatattattcttatattgtaggatctggatcaaagcagtcacaatatagtgaattaaaagtcagtgaaatttaataaaattaccagctgttgaatctatacaccacttggccactgttataatatttggctgtgctcttgaaaacaaggctgagttagaagacttctttcttcttttgcattttatttttaaaaagataatctttcatttgattaaaaggaaaacaggtatataaaaaagtctttctcttacctcatatcacccaagtcactttcccaggggaaacaatattatcaattctttgtatacccttctagagagatcttatgtctaaataagcatatatagaccaggcacggtggctcacacctgtaatcccagcactttgggaggtcaaggcgggtggatggatcacttgaggtcaggagtttgagaccagcctggcaaacatgggaaaccccatctctactaaaaatataaaaattagctgggcgtggtgacgcatgcctgtaatcccagctgctcgggaggctgaggcacgagaatcgcttgaacctgggaggcagaggttgcagtgagccgagagccgagatcatgctgctgtactgcagcctgggtgacagagtgagactgtgtcttggaataaataaataaataagcatatattcagaacttccagtctaagaaagatgatgtagacttttctctccctgctaagcacaactaaaaaccttggaaataacacaagagacaaccaaaagagaactctgaaaggtagaaagagaaaggttaactggtcagaaatcccaggtcacagcagcagggcattttataatcccctccaccccaacccaacaaaagataacccaggcccagcttttcccaatacccaatctagcagaagaaggcatccaggtagtctcattcttcctccagattgaacagaagtcctgccaacaacattagacaagccccacagaaacagcaaggggcaccaattgaaagctccccatcaacatcttgctgggaaatgctgtcttttcccaccaccagtctgggactcctctctctcacctagagaccccacttgacagaggaaattagtagggggattccaccacaagcacccagcccaggaatgcttttgtccccacaggctggaaaatcccttcacctaaaggcacctggctcctcagctactaccaacaaggagtgttgggagcctcagaagcgggagacaaaccaaacaaaccaaagaagcaccgtaaagactctgaaaagtagattgttattggaaccactcacaaaagtaggctagaacctgcatgctaaacctaaagggggctgcctgctaaaataaaacaacttaaatagaacccattatctcccaacatgataaccaaaatatccagatacaaacaaaatgacccatcctacaaagaagcaagaaaatcacaacttgaataagaaaagacaatcagctaactcctgtgctgagatgaaccagatgttggaactatctgaaaagcattttaaagtaaccatcataggccgggtgcggtggctctcgcctgtaatcccagcactttgggaggccgaggctggcggatcacgaggtcaggagattgagaccatcctggctaacacagtgaaagcccatctctactaaaaatacaaaaattagccgggcttagtggcaggcgcctatagtcccagctactcgggaggctgaggcaggagaagggcgtgaacctgggaggcggagcttgcagtgagccgagatcgcgccactgcactccagcctgggcgacagagcaagactgtctcaaaaaataaataaataaataaagtaaccatcataaaaaattcaacaagtaacgacaaattctcttgaagcaagtaaaaaaaaatggaaattctcagtgaagaaataggaattaacaaaaaagaaccaaatggaaactatagaaccaaaaaataacacaaataataaaactaactggatgagcttaatagtacagtggagatgacagagaatagaaattgaggacagatcaatagaatgttcccgatctgaacaaccgataaacaataaactgaaaacagagtctcagaaacctgtgggacaataacaaagatccaacatttatagcattgacatcctagaaggagaagagtgaaacaatgggactaaaagagtactaaaagaagtaatggctggaaattccccacatttggcaaaaaatagaaacctacagattcaagaggctgagagaactccgacaggataaacccaaagcaatcaatgccaagaaacattataattaaatttctgaaaactacagacaaagaaaaaaatttgaaagcagccagggagaaacaatgcatggccaaacacccatttgaatggcagcatatttctcatctaaagcaacagcagcctgaaggaagtgacaaaagatttttcaactgatgaaagagaagaactgtcaacagaaaattctgtatctggtgaaactatatttcacgagtgaatggggaaatacgttctcacataaagggaatctaaaagaattgtcactagcagatctcttcttaaagaatggctaaaggaagttcttcgaaagaaaggaaatgataaagaaaggatcttagacgatcaggaagaaggaaagaacaagggagaaagcagaaatatgggtaaatacaaaagactatccttttcctcgtgagtggtgtgtgtcctcccaccctcgatggtggtgtgttctcgctcctagcctgtactttgtattcccttaacagtatatcttaaagataattccaaggaaagatcagttcatgaaaggttttctcattcttttcttattaccatgtagtattccacgacatggatgtcccatgacttaaatagtttcctattgatagatattcaggtagtttcccatcaagtctgtctttttttctttaaaggctgtctttttaaaaccaactttttgcttctcggagagggaaaccctgtagtccagaaaggtagatagaggtggggaaagggaaacaatcttggttcctgatcccttttccatatttgcatgtcctgatcccaaactcctggagcaaagatctcatggacccagccagatcagatgcccattcatgtctaactagctctgattcagggaatcacaacttcccactaccacttagcaaggaggtgtgatccaacttttactggacgggaaagggacagtgttctctaaaaaaggggacaaagttgggaaagaaattttcagtatctccagttcttcattcttttacagaattaaccataaagcagcctcaaagacctatctcagtccctcctgtgtcaatttgtagatctttatcatagagtcttcctgtgcataaagcacctttttcctctttcatctgaaattcaaccatacttcattagtcagctgataaaatggagtccccagctacctcaaatgacagctgggaaaggtgacaagaggaaggcttttactgtgccaatccatcaggtattgaagctcttgccttattgacattttgtgaagagaaatgagatctttttttttcaagggatgccaagctctttgtggcaaagcacagtgaaaatatcaggtactactgtggatgaaaaaatatccaagtctaaaattatcctgccctttggtgctgctgtttaaaaaccatttatctagcataagatgaatttgtgatccaagtcaaaagtgacatatcacagggtgaaactcatggtatggtctcatccagggccttcattatggaataaatctgcctttagtattgcagagcataatcatcccaaaggggttgaagtctaaggctcatttaatccaattttatcattgctagatcatgtcacttaatctgaccagtgtttgcatgagataagcaaatattttacctgcttctcccactgcctaaaattcttaagtctccccttatcatgctgtctgaaggagacttatttgagttaatcttttaaattcagataggcctagaagaagtcatccatcattcatacatttgcctgaactttaaactggtgtgtcttgcctttccacctaatttagatatcgctccaagagccaacaggaattttgagttagaaagctagtgtaggagttgaggaggagggagagtcactagtggacagtgggatgattgaacaattggggagatgggagactgctgaaataagaaactcaaagctttttctctacataacctcaatactcaggttcaagaccctttaaagtgacttgagaacttgggttcactgaagagtctctgccgtccttcttctaggggtctcctctgcggaagtctcccagggcgtgggaggcagttcatctccatgtagtggcattgtccaccaagccatgttgccaccctgtagctgatgctgctttgccatttgctgtgtgggcatgtccacagtcactgctagacataaccttgggtgctagactctgctgctgcagctcccctgccactcagctgcatcaccctgccaggcacggtaggcacagaaggtgctccttgccaacctctcagtccccaagtcccgaccgctccttcaggcccagaagcctcttctgctgtttaccttgagagccgagggaacaccaaagcctgctgggctgtacctctggcaggattgaggctgggcatagtggatggctcctttcctcctctttgtgatatgctctgttagagccccctatgagttcaaagcatggtagaaaagctccttccagttttccttgtagctctgtttttctctaggacccagacacatgctcagggggtgagccagacactagcagtaatgtcgctctgcttagactctagatctcatccaacagacccccctcctcttgtgtcaaggtcatcacacctggctctttcctaagatgcattcttttccagaagattctacagttccctccccagactaagagaggtttgtgtcaggctgtaccactggttctttagacgtacccagctggggctgtcacagccgtggcttgtattcctttctggaagcctcttcagctctctgggacttctgggaggccactgctaccagctttccaaacacatcctgatgtgccctaaccccgtgcagtgaacaatgggcgacaatgactcaaagagcagccctaccgtattcctgcagcaagtccacctgattctgtgttgaactgggtaaataaagtgtattattttactgtttgttgctcagcaagaactgtgggtgtgtgattaggtttcctcttttcttgttggcacataaaggaccttcactccaaagtcattagattgttgatccatactgctacctaatgatagcagaagccaagaaggctgatcagagcacgtagcaaccaccagtatgtctagagtctctgacactatcaatggctttataccagcaagtctggttcattattcaacgaatatgtattgagcaccgcctctgtgttggccactgtcctaggtaaaatagcagtgaacaaaacagacctgcttccttaaacctgttttaaatagggccaggggaagggggaggcttaataatgaacacataagtaagacacacaacatatcagatgttgctaaatgctaggaagaaaagcagaagagggtagggagtgttaggtaggagtatgctggaagttttacattctctttgagatgttcacataaacactaaaatcactccattgaagtgtattctaaatataatgtagcagttaagagcacagggtatttctgagtgtggtggtgcttgcctatagtcctagctactcaggaggctaaggtgggagggtctcttgagcccaggagtttgaggctgtagtatgctatgactgagcctgtgaatagccaccgcactccagcctgggcaacacagaaagatcccatatctaaaaatgagtgcaaggtattcggaaagacctgaattcaactcacttttctcagcctcattctcttcataagtaaagtgcagataatgatccaatctcagagggttgtggaggattacatgagatgatgcatgcaaaatgcttagccagggtttggcacatgggtactgggtgctacaaaggatatacaagggcctgagaaccaaccatacataatggcagtttccaaactcagctagggcacgggtgcagggtgacgtgccaagaagtgttgagtatgtgaatgagaaagaatggatagagagagagagagagagagagtgtgtgtgtgtgtgtgtgtgtgtgcgcgtgtataaggggtacttagattatgtgacatttagattccattgaatacatttaaaagaatgttacaactgttttattttaacatgctgatgtttataatatgctgaaaattacattctttgcatctgtttaatcttataaaaatttttagatgccaagttaaaaatgttgaagggacacagtttctcaatattattttaagaggtgtctaagcaaaaagaattgaactgggggtggggaggacagaagaaacccaaacatcccaccgagagtgatgacaaggaggcattcaggtggcttcggggagtggcagcctgtgggggcgcagccgagccccttcctgagggctttcctttgcttcctggcccactgcgctgttccagcagagcactgcagcctcacagacagtagttcccttgctgcttttctgcctctcccattccatcagttccttgagggcagacactgtgcctggtctctcactgtactttcagccctagcaccatgctagtatttgctgaatgcaaaaaagaattagaaaatagaaaatgtctggaaaatgtctgttttctcctcgattatagtctcagcttcttcaggaccatttctcaaataattagtttggtcactttgctgaacagggagttattcactgacccaataaacagaggaggggcagatcagaaaggaaagatactagcttccatctgggatccagagcattttgtatgattctgggaccttcaagtgaaaagtagttaggggataagaaaaggaaaactaaaaaaacagccagatatgcaatttagagaatgtgtcttcagagtttaaaatctcatttgtaacataaacattggtttttatttacaccaatacatacatttttgaagtgagctggaaacaagattaagatgccccaaagtgaggctgactggtttctctagcatgttgggtgcaagagcctaacaaaatgctgggtaagaaatcatgcaaagatctagctcttccttggctttttagagagccacaaaattggagtgaggctggctgtggtggctgttgcctgtaatcccagtaatttaggaggctgaagtgggaggatcaattgagcccaggagtttgaggctgcagtgagctataatcatgccactgcacaccagcctgggtgacagagcgagatcctgtctctaaacaaaacaaaaccctaaatagatattaacgtatagacaggcttggtggcatgtgcctgtggtcctggctatttgggaggctgaggtgggaggatctcttgagcccaggagtttgaggctgcagtaggccatgattgcaccactgcactccagcctacgtggcagagtgagaccctgactctaaaaaacaaacaaacaaaaaatcaaagtgaactagttttgcacattagcacttgggtctctgtgtctcatgaataagcttaattcctccttgttgacaaggtaccaagtattctgattcacatgacagcagaagactcagttgactgttctttttcatttgacttcacatggaattttctagaaattatcttccggttctgcagaaatgagttgcctcagagtagaccaaagtgaggcaaattctgttttcaaaagaagcagaaaagagtgccatttccataataatctgtggcaaccccaatctgtggtgcttttacccatctttattagcaattacaggtgaaaacagagactgcttatgaataaagtgtaaatgtcaggggaatgcatagttaatagaagaattgtaaatatttacaaggcagagtgatgattcaagctcacaagattaattgacattaatctctatcaagcactaatttgcttcctgagttctaaaaccttccactgaaaagaagagtatgtgaggccatactcacagcccacttggaagagttgtcttccggtgggctgcataacctcccttgtccctcgtcaagtctttcacttgatcgaacctcttagttcttcatgcagtgccaatctcagtcattcctaggtgccagaatcattacgatccgtaactttttcactcactcattcactcaatatctatttagtattggataattatttatattatactatgagagatgaatatacatataatattcattgtattcattaatatgaaccctatgctcaagttcatctatcccactcactgtactctcccttgttttgcttgtctttgagacatatcttttcaaccttattaaattttactctatgtagtaaactctttaaatttactggctctggtttgcatggttgtgcaatcttctccagcaatgctggccagcagagaaacaggagtggaattagtgggtagctaatgtcatcttcttgggggtgaaacaggaaatcagaatgattaagaaattgagtaagatggtttgagtagcattcaagtgcatgaacacaagattcagcctgtatagttaaggaaattgtcagtgagactgccagtctagaaaaataggtcctattaggtttaaaaagtgagtttggggaaaaatgggtttaggaagaataagaaagtgagagcttgacgtaaagatcagaggataatgctgtttgtttttgcactgagaaaactgaaagactagagacactgggagcctgaaaagagctattggcagggactgcttctgaaaactaccaggacctgcttggagctttgtcactggaacttaagccagaagccggcaggaggaaggcctagagagagcaagtgcttgctgagagctttgactagaaccaggggtgcgagctgctattgaaagtaggagacaagatatcaggcggaggaagtctatacagccatttctcctacaccgcagtcttatcctcccttgaccttctagttcagtagagattgctggcctgaagaaaaaccacaaatgtaaattttcccccaggaaacataataaagttagatgcccagaaacttttattgggagcttgggccagatacagatattttgagctgtatgcagcctacagattctgagtgagctgtgggctggtaggttgttggaaaaggattatattatacagtacacagaaatcttagtggcgtgctaaaagctgtcagtgacccactggtgtcagaagttcaggtcctcatcccctaaagtagtgccttatgattggtgttggacatgtattttatctactgtgtttgcacaaatatcccagttccttctaccttattagagagggtaatgaactggctcttaatcagccataggaaaaaactgtagtgaccagaaagctaccttaaaaaaagattaagtattgttgtacttttaatccttacatttaaaaaatcaagtataattcctcataaagtcaagttaatacacattctagtaaaaatgtggggaaatacttttcaagcgatgattgagacacagtggtttcaccaactccactaccactagaggtcagcacttgactctccatatggttctgtacgagggaaaagaccaattctctgaaacagatcatcatctacggttcgtgttgttatctcatgccatctgtcttgaatcacaaaggtgactgcatcccagaaaatgagagaacactcaaacaatggttggggtgagttgctcagatattccatctgcaaatgtgagaaaatcataggattgtgtaatgtggccttcagtgtgtcctcagtggggccttgctggtcaaagtacttgaatcatgtactatggtagcaggtgttttagaaataattacacagcaggggtagcactggcatcacaatctgcaatttgaaaccaaatggtgccccgagctttctattctgtcccttatgaaggacagagactaatcctggcccagtggctcctgagtccctaagccctgctagcattctcagccacatactgtactcaagcttcttgtgggagggcagttgtactaggtgcaagtgcatgaagtggttgtagggggctgtagggttgaaggatttaggggctgatcaagagaaaagatatgaccacaagaggcaataacacatcataagctttgttggtgcttgggtgcttcgatatggctgtgtgagaggggccctcatagcataagactgcccaggggctttcagtgaaggggcaccatctgggagaggagggtgagggaacttctaaggaagagggggtcaaaagaggggcttacgggtctagttatgtcatccagcagcatggcaggtcttttgagtcagagagctccaaagaactataaaagcttgaggtcttataaccacaaagctccatcttatcaaaagccagcagaagtggagtgaggttttgcagggtaggtaaagcagactggctctacgtggctggaaatctgatggtcaggctattttttagataattggatgtgttaaatagacatttctcaaaagaacatatacaaatggccaacaaacatatttaaaaatgctcaacatcactaatcatcagggaaatgcaaactaaaaccacaatgaggtatcgccttactcctgcaagaatgaccattattaaaaagtcaaaaaacaatagatgttggcacaggtgtggtgaaaaaggaatgcttatacattactggtgggaatgtaaattagtacaaccactatggaagacagcattgagattccttaaagatctaaaaatagacctaccatttgatccagcaatctcactactgaatatctacacaaagggaaagaacacagtatatcaaaaagacatgttcatacatgtacttattgcagcacaattcatgattgcaaagatacagaagcaacctaagtgcccatcgaccaatgagtggctaaagaaaatgtgatatatatacatcatggaatactactcagctataaaaaagagaaaaataatgtcttttgcagcaacttggatggagctggaggccattattctaaatagataactcaggaattgaaaccaaaacactgtatgctgtcacttataagctaagctatgggtacacaaaggcatacagggtgacataagggacttcggagactcagaagggggagggtagaagggggtgaaggataaaaaactacaatgtatactactcaggtgttggatgcactaaaatctcagacttcaccactatacaattcatccatgtaaccaaaaaccacctgtactccaaaagctattgaagttttaaaaatatttaagaataaatacataaacagatgtataaaaacctgactttggtgctggcaggcttttgagctactgggtttcagcctgcagtgaagaaatttttaaaaagctaggggccaatacacaaaggctgtctttggctcatatgtgtaacagcatgtaaggcctttggtgggattaacatatagttgaaagaagacaacgaagacataagtgatcatcaggagtttcctggttctcactgactaggtaatttgtaccaattgttcctcctgctgacagcaactagaaaaactgaaagaacacaccccccaccctcccccacttcccaccgccccccacccccacatattttaaaagcatttgcgagtaaagaattactgctaactgggccctgatcttggagaacagaagctgaaaggctaagcaggactttaaaaaacagccctacagacaaaagaggagaaaacttggacactagcccaacaaggatgaaggtcctgcaattttattgagattctgaagtgctgtaatccaggagaaagggtaaattagaaggaaatcttctgtggttgacaattactttggtggtcatcaacaaccatgcctgctggttttcatgtccttgtgttgtaagtcatgaatctgggatggctctctgacccaatttaacccatagaatatggcagaagtgatgctgtgcctaaatattaaaaaggtctactagtttctgcttttgttttaagctagccatcattccagaaatttaactaccccaagaccatcttgttgtgagaagcctcatctagccatgaggaaaagccacatggagaacagagttccccagacagcagccctagctgagctcccaaccacagccagcaccaacttattgggatatatgtgaagccatcttgggagcatatctatcagctccaatgaagtttcctcaaccaatgccaagcagagctcaaaattgtccccaccaagttctgctcaatgacaacatttgagcaattaaataaaatgcttgttcttttaagttcctaaactttaaactttatgtagcttgttacagagaaataaataataggaacaccagtcttgtatggactgcaactgaacttcgagtcatctgggtagccaaggaaaccttgatctttaatattggattaagatgatcttagttttgcaaagaccacagaaatctgaaaataggaaataaaaacactttctggtttaagataatatcttcttagtcctcaaattatttcttaaatatgttttaatgcaatgtttgacacagagataagcatacaaatcaagacaatatgaacaagatttagcagaaataataggaacagagccatgagaattttagacatttgaatgatcagatacagatcttaaaataactatctatgaccaagaagataaaatatgagactgagaatttttttttaaaatcctgaaaattatggaaagggatatttcagatttgcaaaagaaacagaaactctacaacagaaaatacaatcaccaaaggaaaaaacctttaccaggttagagagttgactagaagatagcttagaagaaaataccaaagaagaattacaaaaagatggaaaatgaaaaaagatttaaaaatagaagatttattaacaagataaaaacgaagtttcattaacaagaaagaattacaaaaggatgaaaaatggaaaaagataaaaaacatagaagatttattaagttagatataagcaagtggagtctaaaaaggagagtagaaagagaatgaggaaaagccatttgaaaaaacaacatgtcgattttccaggttcatgaaagatattaaaccacatatactcaataaaagcaagtaaaataaagacaaagaactctatacccaggcacatcacaggaaaacttccagaatctaaacatgtgtaaagcctttatagcaaccagaggaaaaaatacatattacttttaaagcacaacaattagacttacagctgattttccaaccaaggtaacagaagccagaagacagaggacaaaagtcttcaatatggtgaaagaaggtaactgataacctacaattctacatccagggaaattttcaaaatttagttgaaataaagacatatttttttttagagaaaactgtgaattaatccccagtggatttgagaagaatgataaaagaatatataatttctaaaccaacagggaaaaaaagtagagtaatgagaaattaatccaacaagaaggcaagaaaggaaagggaaaagaaatatgagtatattttagaagggacaagtagaatacggtgactaaacctgaaaaatatcagaaattacattaaaaataaatatagaccaaatgcttcaattaaaagaaaaaagtcactttgaataaaaaactgacatcatatggtttttacaaaagacatatctaatatttaagaatacagaaaatttgaaaataaaaggaggggcaaagatgctatgcagatgcttaccaaaagaaagctgtatagctttattaaaattaaaatgaagacagaaagcattactacagataaggagcgatacttcataatgataaaaatttgacaccctccaaagtctaaaccaggaagaagtcgaatccctgaataaaccaataacaagttctgaaattgaggcagtaattaatagcctactaaccaaagaaagtccaggaccagatggattcacagccaaattctaccagaggtacaaagaggagctggtaccattccttctgaaactattccaaacaatagaaaaagagggaatcctccctaactcattttatgaggccagcataatgctgataccaaaacctggcagagacacaacaagaaaagaaaatttcaggccaatatccccgatgaacatggatgcaaaaatcctcaataaaatactggcaaaccgaatccagcagcacatcaaaaggcttgtccatcacgaacaagttggcttcatccctaggatgcaaggctgcttcaacatatgcaaatcaataaacataatccatcaagtaaaccgaaccaatgacacaaaccacatgattatctcaatagatgcagaaaaggtttttgacaaaattcaacagcccttcatgctaaaaactctcaataaactaggtattgatggaacgtatgtcaagataataagagctatttatgacagacccacagccaatatcatactgaatgggcaaaaactggaagcattccctttgaaaaacagcacaagaaaaggatgccctctctcaccactcctattcaacatagcagtggaagttctggccagggcaatcaggcaagagaaagaaataaaggtattcaaataggaagagaggaagtcaaattgtctctgtttgcagttgacatgattgtatatttagaaaaccccattgtctcagccccaaatctccttaagctgataagcaacttcagcaaagtctcaggatacaaaatcaatctgcaaaaatcacaagcattcctatataccaataacagacagagagcgaaatcatgagtgaactccctttcacaattgctacaaagaaaataaaatacctaggaatccaacttgaagggatgtgaaggacttcttcaaggagaactacaaaccactgctcaaggaaataagagaggacacaaatggaaaaacattccatgctcatggataggaagaatcaatattgtgaaaatggccatactgcccaaagtaatttatagactcaatgctattcccatcaagctaccactgactttcttcacagaattggaaaaaactactttaaacttcatatggaaccaaaaaagagcccgcatagccaagacaattctgggcaaaaaagaacaaagctggaggcatcatgctacctgacttcaaactatgctacaaggccacagtaatcaaaacagcatggtactggtaccaaaacagatatatagaccaatggaacagaacagaggcctcagaaatagcaccacacatctacaatcatctgatttttgacagacctgacacaaacaagcaatggggaaaggattccctatttaataaatcgtgttgggaaaactggctaaccatatgcagaaaactgaaactggaccccttccttacaccttatacaaaaatcaactcaagatggatcaaagacttaaatgtaagacctagtaccataaaaatcctagaggaaaacctaggcaataccattcaggacataggcatgggcaaagacttcatgactaaaacaccaaaagcaatggcaacaaaagccaaaattaacaaatggatctaattaaataaagagctctgcacagcaaaagaaactagcatcagagtgaacaggcaacctacagaatgggagaaaattttttgcaatctatccatctgacaaagggctaatatccagaatcgacaaagaacttaaacaaatttacaagaaaaaaacaaacaaccccatcaaaaagtgggcaaaggttatgaacagacacttctcaaaagaagacatttatgcagccaacagacacatgaaaaaatgctcatcatcactggtcattagagaaatgcaaatcaaaaccacaatgagataccatctcatgccagttagaatggtgatcattaaaaaagtcaggaaacaacagatgctggagaggaagtggagaaatagggatgcttttacacgttagtgggagtgtaaattagttccaccttgtgaaagatagtgtggcgattcctcaaggatctagaactagaaataccatttgacccagcaatcccattactgggtatatacccaaaggattataaatcattctactataaagacacatgcacacgtaagtttattgcagcactatgcacaataaaaagacttggagccaaccaaaatgtccatcaataatagactggataaagaaaatgtgatacatgtacaccatggaatactatgcagccataaaaaagaatgagttcatgtcctttgcagggacatggatgaagctggaaaccatcattctcagcaaactatcacaaggacagaaaaccaaaaaccacatgttctcactcataagtgggagttgaacaatgagagcacatggacatagggaggtgaatatcacacagtggggcctgtcagggggtgggggggtaggggagggataacattaggagaaatgtttaatgtaggtgacggattgatgggtgcagcaaaccaccatggcacgtgtgtacctatgtaacaaaactgcatgttctgcacgtgtaccccagaacttaaagtataataaaaaattgattcaccaagaatgtataacagttataagtttatgggcttctaaaacacatggcctaaaatatacaaaacaaagagttggcagaactttaaggagaaatctgcaaacctacattcatagtggaaagttttaacacatctggcttgataaatcaataaaatggctaaggatatagaagatttgaacaaaacaattaacaaacaaaatcaaaaactataaaaacaaagtacccaataagaacagaatatatacccttttcaaacacacatgtaacatttataaaaataataagacataaggcaagtctcaaattttaaaggatttcaatcataccaaatatgttctctaacagcaatgcaattatgttaaagagcaaaatttttaaatagctggaaattttccgtatgtttgaaaattaggaggtataatttaaaacaactagtggctaaaaataacaaaccataattaaaattataaaatatctataattcagtgctacatattaagatgtgaaatgcagtcaaaatagcacttagaggaaaatttatagagtttaatgcacatattagaaaaccaagcccagcaataaattttaaaaatacataatgaccaaactgagtttatcccagaaacataagcttcatctaacatttaaaaactcaatcaatcacattaacaggccaaaagagaaacaagatatctcctctataggtgcagaaataacatttggtaaaattcagcatccattcactcatagtgaattcagaagaaggacacctgttacagccacttttgacatcgtacttggggtggggggtcttagccaaggcagtacaataagggaagaaatgtaaatgatataaggattcgaagggaaaaaatccaattatcacttgagcttatataattgtctatgtagaaaatttaaaagaatttataatttaataaaatttggacatgagcttgggaagttggaagaataaaaaaatcaacatacaacaattatttcaaacataaaaatagaaaaaaattatttttatctgcaataaataattaggaacatttttaaatgtcaaaaccacaaaaaattaagctcccaggactaaatccaagaaaatatacatagaacataaaggtaaaaatgataaaactttaaaattcgttaaaaagattgaaataggtcgacatactatacaaaagtcaatctccaaattaatctatagagtcaatgcaattgcaataaaaatctcaataggttgtgtgaatgtgcatgtgttcatgtgtgtgtgtgtgtgtgtgtgtatgtgtgtgtgtgtaaattgacaagctaattctaaaattcatgtggaaatgtacaggacccagaataaccacagaactcttgaagaacagcaatatggcagaatttgctctttaagatatgaagacgtattttaaagcatcacatgttagactgttattggcccagaaataaccaaattgaccaatggagcagaatagagatcccagaaatccagggaaaggattttcttttcctaataaatggtgctacaagagtggaatatctatttaaagtaagtgagattagacatctaccctccagcacattaaaatgtcaggtatcaatgggccatagacttccatatgaaaggaaaagctataaagattttagagttatagagagtttatagaacaatatcttcctgaattgaggaacaaattggttaattcagtaaattaaaagaaagaatttgtgattaccaagagataccataaagtaaaacaacaagaaagccccagaatgggagaagatatatgcaatacatataactgacaaagaattcatatctagaatatgcatttttaaaatactacaaattaattttaaaaaccaaagtaaaaatttgtaaaggactaacatgcacttagagaatatccaaacggtatatataacagcctcatataaaccacgagattgacagacattaaaatattttaagagctggggcagcatggttagaatcaggcctcaggtgactcagagactggtagagagtggtaggtagcagtagtttgattgcatcttgaagtgttggatggggcaaggaagagaatggagcaaaacattgtaactcttagaattatgtcactgcctcaaaataggaagatcttgagggctttagataattataactataaaccacatgtttatcttatctgccactaattaaattcactatgcattttagttgaaagctgtcattagattttgaagtggaaattagaggcattgaatgctatttctaatattagctatagccacattgacaggtgaccaagagtgtagagacatttagaattaaaggctcacattctggttgaatattatgtcactttaagtatcaatgtagaaatgacaacaaatgcctttaacaatggataggtgcctattctatttaaaaatactccaagcacttccttaaactctacattctatagttgtttccttgctctatggacaacatgcaagagggtgaggcattgcacgaccacctccttgacggttgtggaattttggcagctgtctctgctcaccatacttcccgaggattcctcagagccaagagtatctgccaagaggaatcaaaatgttgctgatgaccaggaattggatgtgttacaagtggaggtgttccagctctccgaatttgccaactccattgttaggagtgtgataaatggattgggtgcatctgcccttgtgagctgacagagatccaagctgtttaaaaaatgacaggaagccaccctagaaacaagaaaatgtatgtaaagaggcattttccagagatttcttccttcctgtttttttgtttgtttgatttggagtctcgctgtcgcccaggctggagtgcagtgatgcagtcttggttcactgcaacctccacctcccgggttcaagcaattctcctgcctcagcctcctgagtagatgggattacaggtatgtgccaccacacctggctaattagtagagatgggcatgttgacgaggctggtctaaaactcctgacctcaagtgatctgtctgcctggagatttcttcctttcaaggcagaaataacagccctttcatttgattggcctagacatgatatctttggaaccatggggggggaaatgctgcaattcctatttcagggcccagagtgagaattccaggaatattaatagtgctgaaatatagtaaacataaaagtaaaaaaatgacaaaaggcattttatgctattagcaaatatttcattataaattctgcatgtaaaaaaacatgtctacaatggtcctatctataagaatttataaataccccagatatctttcaaaaaggatgaaaataagttttggttaaataaatttaacacgaaccatcattgtttgatttttaaaaatttattctgagtttaggattagaatggattatacatcatgatttatgcttttaaatattttggtaatgtaaagcatcctgatgctgagctccttaaatattcatctacttcctaatcaataatagttcagttcctaaaatagatgtgatttgttccatttatcatgtagattgatttataaggtgtactctacttttctgctttacttctggacttactgttttaaaatgaaacaatttgttctaaactaatacagtaaacaaaagcttaaggtgtgttcctacatagacgtatgataggcacagtagggagatgagtcaggtggaatttccagcagagtccctcagaaactgctttctgatccacagaggagaaggccttatgcccacaagaaaatttctatagattattaagtggaaaaccctatttagaaagaggccaaatatgcatttgaatacaaaggaagtcacagtatttgttcagaaaaccaagagttagttaggacttgtggaagattaatgaaggggtcttaattttgttcaagagagacttttttgatagctgagttgaacttttagaatatatgttgtgacgttctgttaattctggaaaattcttctggttctaaatggaagtttggtgtaaactggtcctgttgctgaaactcttaaaggtctgtaggggcgggctactgatagcttcttggtaaaaagaaacttcgcatatttgccaacaacaaatgtctctcagactcaacagtcatgcagatactgagaattcctttggaaatgtgagaggagaaatagtactattgcgcctgtgcattcgaaccaagggacatcatttagtgaaaatgtacttgttaatcaccgctagtctgaaactcaccatttcacagtatttgcgctaataaagaatatacaaatgaacagtgcccttctaaaacgccatggttcattcttgtcaaataacacactctccttgtttttcttttattttaaaagaaaattggccctgaaacaccatccagacaagaatccagatgatccagctgctactgagaagtttaaagaaatcaacaacgcccacgcaatacttaccgacatttcaaagagaagcatatacgacaagtacggatcgctgggactctacgtggccgagcagtttggagacgaaaacgttaacacctacttcatgctgtcgagctggtgggcaaaggtgaaactgaatttcctttcttcacaatctcctgtaagaccatgatattaatcactcttttagattccatctcaaaggaagtctaaccttcctgctattaaactctggtaaataaaaggagatattgcttccactgaatgctattatttaggatcatttctggtttagctcatcaaataattgtaagatacaacatgatttaaaatacttctagacattaattatatttgaatttggagcttcagattaattctttataatgactaagtaaggactgactcattgctcaaaaccaaaaataatttattagtgtgacaactgcttaataaattattacggggcaaatttagccatgtccttttctatctatagcataggctacatcagcaaacacaatactgggaagaatgagtggtaattatgtcagagactcacttggagcctgctgtgaggtagaggagaaggaaattagggggaaaaggtgagaatttactagtggaggacagggaattggagaggcagagatggggacagagagcaaaatggatacctagtcaagaaaagggcgacatttttaagggcttagtgcaatcagaattgactttcgtgtggtaaattttgtttggtttcctaggaatctctagtatatatatgtttggtgatggtttttatttgtttgtgaatattaatatccttatcttctgataaaactatgtttacacatgggtcatacatgtagtccatcaacatattttgtggacggttcacattcatataagttccaatacataataataattattaaatatctaaaaaggcaggtttactagtagtatctgtttgctattttcttccactaaatcttgctaaattgagttttatgtatgcaggaagacagagaatatgtttttgtacatcagcatgcaaaaggattcttgcaacctagcctaatttgcttactatagtcctcagagttctgtttctcagggatacctgggattcccctttgaaacccctttctctgttgttgaagacttaggggagagacaagttcctgttgagcagatttggaatttggaatgagagtgtacacaccgacaatgtcatttatgacaatagattgaacgttcataggacagtacaagcttttgtgggtttgcgtgggaacccaacctctgggcgtgacactctttccatgggaagatactgcagaggcaggtccagataattacacacatccacctgatggcacctcagggcctgcctgcataaaaatgagaataaacttccttgctttggaagctgacaaaattgatcaaaattcacatggacaagcagaatctgcccagtagtgtgagagatatgcaaaataattcctggtgtggttctttaaacataagaccacagaaaaacatatcttttccttctccttgtgccaaagcccaatttcacggcacccatcagaatggccctgcacgtagcaatcatgtgataaatatgcactacatgaatgaatcagtgtaccacaaagatacatacttataaaaatattggacacctacctgtgcctagtactgtactaagcactgtaagggataaagcaagtctatttccacagaaggcaaacaatcaagttggaataaagaacaaaacattatatgaatgaaaagaaaaagttcagagaagagaataatatgggaattgcatggtaaaaacaaaaaggacaaaaatagcttaaaaaagggaggagtttcttggggcaatggctcaagaacactgcacaggaggctgtggagactgttagtgaggtggcgggtgttgtagttgtttacagagtaatttacctaagactacgaaaatgtaaattttccatagcaaagagattatatgtttgaggatgtgactgaagctcccctactccaagccaccagaggctccacctcaaacctggggccagaatcagagatgaagcccaggtctatgaagcaggagtggggcaggtgagggctgtcaacattaaagatttctacctgaagttattgaagaaatacacaggcacacaagtcctctttgtccctcttgctcccttaattagataaaatctgtgtttcaattaaaggtgtataaacctctttctttctatttcaaattacatatttttgataaaatcttaaattgattttgctcaattcacaaaaactgactttttataacttcacattggaggagttgagagtttcttttagtttttagctataacaaacagcgagcaaacctttcatgtttttggggaaatcctgctgctgttcaccaggtggagcaaatcatttgtttatttattactttatacaatcattaattcagctggtattttataagcatctaacacataccaggtactaagtccttcagtaggaggaactgaaagatgactagctgacagtgccagcttgcaggaagctcacagtctagtccaaactgatcaatgttctaaaagtatcacttaaaaaaagcaccaaagtagaagtctgcatgaaatgcaactggggacaaaggagggagtcattgttttgggcaggatcaggaaagatgtcatagaagggatctttaagatgagtcttacacaccaggtggatattttgttaggtgactggggaactgggaggtggacgtccagacagatgaatccacagggagagcagagttataaggcaatgaaaggcaagaacagggctgtgctggtgcagggaggcattggcagagccagatcaccataataaggatcttggctgtatctcagaggcaggagcgccatcacatgggttcaagagaacatgtatttcagaaagttcactctatcagcaatgcgcagcatggatttgagggaggccagaggggaggcagggaggccagttgcgaggctgctgaagtgtccagactagacatagtgaaggtctgttctgaagccctgctggccaggatagaggcatgagggaggatgcaagagacttgaggagagacgctatccaggacttggtgaccagcaggaatgtgagtgtaggagggggaggtatcggacagttcattctttatcattctggtgagaatgattcagctcccctgggcagggggcttgctaactcatttcacctgcagaggttttgttggttggttttttggtttttgtcttgctttgctctgctcttagtaatgatcaccatatagcttaagaataaaaaaaggaaggccatactttattactttggctacaagtcatttcctctgagtctaatttactaggcaaaactttaccaggaaattggtttctaaggaagtgaaatagttcttatgtggagtaaggatgagggtgaagatgtggcctgtggggtgaactgtgaagtgttcaggtctctgggggtacctgggtacagacttgatttcatgggttctcccctcaccccatcacccctcatcctcattttgctttacctctgtttccctaggccctgtttgtcatcgttggcctcttgacgggctgctacttttgctgctgcctgtgctgctgctgcaactgctgctgtggacactgccggcccgagtcatcagtgccagaagaggacttctatgtgtccccagaggatctggaggagcagatcaagtctgacatggaaaaaggtggggtaggatgagagcagaggtagtgagtgtccattcataggcctgagcaagcaccaggtcccacggggacagctatcactatagtaggagagctcccacaaccaaatgggtggaacttcacagactgtcagctttggtacagcttctggggagaatgaaaagatagatacctttaccaggcatagagaaaagcagtgcctgatgccgttagaaagaaaatcatgaaatatgctgatgatgaatcaaaggaaatacaattcaggtctcattacaagagagtgagcactggattcagggaggattgggtgagaatgctcagggcaggagaaccaaggtagaaattttttcacagaaaaagtatttcagccggttcctttaagatctcctttgaaatagaagaaagtgggcatcaaaaaaagtcaccaacccttgactttgcttctttttaatgacttgattatgaatttgggtgaactaggagagagaagtccttctttacctgaaatatagcttctttcaggagtagcctcaaaccagcatcaaggatgggactatttgcgttgctaacccacctccgtgtgtccatgtgtatgcatgactgtgatgtagtacttgattcttcaagttcatgctatccaaaaatgaaaaaattttaaaaatgtaaagaaagatgagatctcacaggattcacagcaccaggaatactttacgtcctctgggaaatgcctttgtttaaagaagctggggtcagacctgccattgtcctgctccaccttacagccaagatcctcctgtcattctctcccattattctctctcatagttatcctggagtacagactttatcactgaatccccaaaaaacctagacagccaaataaaagaattacttgataattcagacagtggcccatttttgtcagaactgctaaaattaggaacagtgtacttttctggactgtattgtactctgattcttttgatcatactgaaaaggaaattccaggttgtcaagcactggagactagttaaaggcttccacacaccttttattccctatgaaatgcagtgttaagtaatatccaggtattacccaccctgactccagctcagaggaaggggtcttcaatcatgtaaattgtacagattcccagactctttcaggcttgggagcttagagaggacagaaggagttttcttgaaacctgggaccccttgctgtggggacctgtaggtggccaatccagcaaacagaggggttgttctgaccattttttattactgaccttgaagccaaattgtgggcccatggtgaaacagaattataactttattttcctttattcaagatgtaaaaggacaaattaatcttttaatggggtcatttataccaagaagaccaagcaagcaggattacaagtaaatgggttaaggagtaatgtatgcatggaaactccttttcttcaggaaaaggtccgtgacattgacacaacttgcctgagaatgacaatcctagcatctgaatcctatctgctcttgtaaaggagagaaactgttacaagattatgtcaggggttgctggccccatagaccataggatctcccataacatccatcagcccagcccagtactcagtcactgacaggaccagaagagacagcaagataggagagtatcttcaacatcctccactgggtcaacctaactgaacttttcctttacagtgggaaaaccaaacctaggtatcccctaggatacctaggttcaatctaggattgaacctagatatccccaatccagtgtttcacacttctctgaacagcctcacagtctttcctgttttaaattagataaaagcttcaccaggtcatttcagtagaccttctttgtggaagatttcttttctggaacagaaatccatactaggtgccagattccacccaggtttcctccctgctgggtgattggtgatgaatctacatgtctctcactgttctcagctctgacaccccagagctatcaattccatcacagaggtcagatcctggatgaagtaaaccacgatcctgtttgactatgttaagaattcttaaccaaaaggaaaagctttatcttgtttctaaatatttagcagctcctatgcagggatccagattttgtgggacttgaaatttacacaatttgggcaaacctctttaagaaaaagaacacaaaattgatctgaaagtgaatatatatttagaatgagaaaaagaaatcacaacaaattgcaaggcttaaatacttaacaataccataaatttcacaaaatctagaaaaatcgcaattgtttaattaactgtctggcacagctctgcaacacgcttcccctgaggctttgtggctgcacatccattgattgcttcttcatattaatatagcaataattttgtaatattttcttttcttttcttttttttttttttttttttttttgagatgaagtctctctctctgttgcccaggctggagtgcagtggcacgatctcggctcactgcaaccgccgcctcccgggttcaagcaattctcctgcctcagcctcccgagtagatgggactacaggcatgtgccaccacacccggctaattttttgtatttttagtagagattgggtttcaccgtattagccaggatggtcttgatctcctgaccttgtgatcctcctgccttggcctcccaaagtgttaggattacaggtgtgagccaccacacctggccattttgaaatattttctatgaaaaaaatagaaaaatctgcctttcctctagcatgtttgatcaaaaagttttattactggtaaattagaaaagtttatttcagctttacaactcattattgataatgttgtctacatttttagggattgttgtcaaattcaggaaaacacctatttagtttatttcatatagaagatataagatttggaggaattttccacagaacacctttgatttgtacatttcaaaccttgttgtccttactccaaccagtactcccagcattagagcccaatggacacattcacattttgtaacatcacctctggtttagattttcatgtcccctcagcaagtgaattggcacagtgagctgtaggaatctacctaaagtcatttctacactcgtggggctacaataattaacaaacagagttgctgcaaaccacaaaaacgtatcccactaaattaaactgaaacctatccctaactctttatccccttaatcaaatccccaaaatgtctacagtccctctgctgccactcatcagacagagaaatgtgatggaaggaaagtcaaagtggaaagagatgtttttgttgattgtggccaaaatatctgtcttttgcaaataacacaaaatgtgaacacatcgttagggccccaacaggcccttggaaggcacaggtgagggtccctgagctgaagtttcattaactgtgcagtaaatccagcactgctcttggatctaccctctccttataaggaactatgccttatttgcagttagttgtattagttagattcacgtttatactccactaatccagagctcaggctggttaaggatgaaaatcagacttcatctgaagactaagctttctggactgtggtccaataaatggactggacttgcatctgctctgcaaaagaaggggactcacttaaggttctttaagaaaatacacttgaaagagtctactagccacttaaaaatcaagtgactcaagacaaagaataaacagcaatcatcaaggtttgaatccattagaaggcactggtatgacactggggctttaagaatcttattttaatgattctgaagtttaattcaaaaatggcaaactgtttatcacttggggaatccttcattcttaggtaggatctaataaaaaaaatcttaggattttagacttgggaggaatctgaggaatcaaccctcacctctgcatggcttttctaggcagctgctcagttgaaagccgcctgtggtggggaggtttaggactttgtttataagtaagagatgcccataaaaattcagccaccaaaggagggcatagagtctaacataactctacagtccaccctcaggcaccactcaaggataccaaaacacaattacatttatacagtttttgtgtaaacttttttgtgttttacaaaaatgtggtatccacatgttattatgcccttttcctgcatctttgcagaggaaaattttgatgaaatcatatttatcagttgttttttaagttgattgtgcttttgtggtgttatgttgagaactcagactaactttatgtcataaagactttctccaatgttttctaaaagtttctgagttttatgtttaacatttagatttatgacgcattttgagttaactttcatataaggtgtgaggtttaggttcagactcttttttttttcttcttgaatatggaatctaattgttctaagaccatttgttgaaaatgttctctgtatcctctacatggtctctactatgtatcctttcttcattgaattgtctttccatctttgccaaaaatcaattggccagggccgggcacagtggcttacatctgtaatcccagcaatttgggaggcggaggctggtggatcgcttgaggccaggagttcaagaccagcctggccaacacagtgaaaccctgtctctactaaaaatacaataattagctgggcatggtggcaggtgcctgtaatcccagcgactcaggaggctgaggcacgagaattgcttgaacccgggaggcagaggttgcagtgagcagaggtcgtgccactgcactccagcctgggtgatagagcaagactccatctcaaaaaaataaaaataaaaataaatccgggaggctgaggcaggagaattgtgtgaacccgggaggtggagcttgcagtgagcggagattgcaccactgcactctagcctgggtgacagagcgagactccatctcaaaaaatatatatatatatatcaattggccatatttctatgaacctattcctatactctctagtctgtcccattgatctatgtgtctatctcttcatcaattccacactgtcttgctctcttgtagctttaaagtaagccttaaaatcaggtagtgtgattcttccaactttatttttttttacaaaattgttttggctcttctagtatctttgcttttccatataaattttagaatcaagttgtctatatctacagaaaaatcctgctgggatttttattggaattgcattaaatttgtagatcagcttggaaagaattgacatctttactatgttgaatattccaatccatcaacaatatgtatctctacttatccacgtctcatttgatttctttcatgaacattttgtagtttttggcatacaaagctggtaatgtcttgttaaatgggtacctaagtatttcattttggagagagctattgtaagtggcattggttttaattttgcttgcagttgttcattgcaagtatttacaatttctttttatattgcctttgtatcccatgtctttgctaaactcatttaacagtttggatttttgtgtgtgtgtaaattccttgggattttctatgcagacaattatatcatctacaaatagaaacagttttatttcttccattccaatctgtattccttttgtttctttttcttgccttgttgcactgtctaagatttctagcacttggtttgctgctgtgctgtcactgtcttaaaattcttaatttttgaataaggtacctcacattttcattttgaactgggtttggcaagttatatagccactactgaggatatttccttgtgtgtactataaatcaggatttcaagtttgatgacttttgccaacagaaatttttctttgaaggaactattagctacctttacatttacattaaaaaatctacattatataaagatgtttaaaagaacagaggagccaaccctcactggcaaggaagaagacaaaatgcctccagagcataatactctggttttagggaaggggaaaactaattaagatgagacaaggtgggatggggaagactaagtggagccagggctttatattaattacccatctaaattctatgttacagattattatattgtacttggagatttgaccagcatatgaagattaccacaggaaattaatttttcatacatgagcactaattttaaggaaatatggttagcagttctttcttctattattctccccatcttttatccagaaatgtcaagatgcaaagtatagtaaaactgatatggggcaatctttactccagaataaaagtaatagctacttaacactttgtcttcttataccttactatactaaaaaataagagaaaggaacagggattaactagggaaatacatttatgatttgaattcagttactgtattagtctgttttcacactgttataaagatacaaccagagtatgggtaatttataagcaaaagaggtttaattgactcacagttcctcatggctgaggaggcctcaggaaacttacaatcatggcagaaggtgaaaaagaagcaagcaccttcttcataaggtgacaggtgagagagagtgagcaaaggggaagttccacacttttaaactttcagatctcatgagaattcactcactattgtgagaatgggatgagggaaaccagccccataatccagtcaccttccaccaggtccgtccctcaactcatggagattacaatttgagataaaatttgatagggacgcagagccaaaccatatcattctgcccctggcccatcccaaacctcatgtccttttcacatttcgaaaccaatcatgccttcccaatagtccccaaaagtcttaactcattccagcatcaactcaaaagtccaagtccaaagtctcatctgagacaaggcacatcccttctacctatgagcctgtaaaatcaaaagcaagttagttacttccaagatacaatggaggtacaggcgttgggtaaatgttcccattccaaatgggagaaactggtcaaaacaaagggaccacaggccccagacaagtctgaaacctggctgggcagtcattaaatcttgaagctccaaaatctcctttgattttatgtctcatatctagggcatgttgatgcaagaggtgggccctcacagccttgggcagctctggccctgtggctctgcagggtacagcccctgcagctgcctttcccagctggcattgagtgcctgtggcttttccaggttcttggtgcaagctattgatggatctacctttctaggatctggaggatggtagccttcttctcacagctccactaggcagtgccccagtagggactgtgtgtgggggctccaaacccatatttcccttctgcattgccccagcagaggctctccatgagggctttacccctgcagtagacttctgcctggacatccaggcatttccatacatcctctgaaatctaggtggaggatcccaaagttgagctctggtcttctgcacaccaggaggcccaataccacgtggaagccaccaagatttgaggcaccctctgaagcaatagccttagctgtaccttggccccttccagcctcatctggagctggagtggctgggatgcagggcaccaagtcttgaagctgcacagagcagtggggccctggccctggcccaagaaaccatttttttttctcctaggcctccaggcttgtgatgggaggtccttctgtgaaggtctgtacatgccctggagacagtttccccatcatcttggctattaacattcagcttctcgttacttatgcaaatttctgcagcaggcttgaattcctccccagaaaatggatttttcttttctaccatatagtcaggttgcaaatccaaaccttatgctctgcttgccttttaaacataaattccaatttcaaaccatctctttgtgaacacatataactgaaggctttcagaatcagccagatcacctcttgaatgctttgctgcttagaaatttcttccaccagataccctaaatcatctctttcgagttcaaggttccatagatctctagggcaggggcaaaatgctgtcagtctctgcatgagtgacctttgcttcagttcccaacaagttcctcatctccgtctgagaccacctcagcctggacttcattgttcatatcactatcagcattttggtcaaagccattcaacaagtctctagacagttccaaactttcccacatcttcctgtcttcttcagagccctccaaactgttccaacctctgactgttacccagttccaaagtcacttccatattttcaggttatctttatagcagtaccccactctgcctgtaccaattttctgtattagtctgttatcactctgctataaagataccacctgagactgggtaatttataaacaaaagaggtttaattgacttcacagttctgcatggctggggaggcctcaggaaatttacagtcatggaggaaggtgaaggagaagcaagcaccttcttcacaaggcgacaggagacagaggagtgagtgaaagggaagtgcctcacttttaacctaatcagatcttgtaataactcactatcaagagaacagcatgggggaaaccgtctctatgatccaatcacctcccttgacatgtagggattactattcaagatgagatttgtgtgggaacacagagccaaaccatatcagtgaccaaacaccacaaatttcacttttgagtacatgttataggacattataactatttcttaatttatgaaatccaaatttgaaatatcaaatcctttcttaactgttgacttataaaaactattagaaatatttttcacctgccttaagatacttttaacaattctaattatgtatctaagactttttcttgcatatttattattatgtgcatattcaaacatgcctactccttgactctagctaaagtctaagataccttttgatgatacaaaattgtatcaatctttgttcaatagtggtggtacagggtgggatttggtagcagaagggagagatttgtttgggtttttatgtccctttaaactatatcggaaagtataatccagcttctacctttaagaaataaaggggggaagttcaaacagtggcatcttcagtattcactggcaactacagaacttataagcagattcctatgtctttcttaaaatagaaatatactcccaatgagatcccaggaacacagaggcattctattgttcttatgaatcaatcaagatcaaatggaagatagatagtgtcttgggggaacccttccccagttttgttgtctttgaaaatttgaaaccttaaaggtaaaaggtaataggtaccaacttatttcccttactttcatatgttcacaaattaggagttctacattgtgaaatttggggtggtatatttttaaaaagctcacttagaccctatactcctctagcagttgaaggccacaatgaaatcagaattccactatgagggctttacagaccatcttgagagagagccttgtttcatgggacaatgtatgtgtatgtagtgtgtgtgcgtgcaggcatgtgtgtgtgtgtgtgtgtgtgtgtgtgtggtagagagagagagagagagaaggtatggaagcaagagcccaaatcggaaccagttacctctgaacaccctggcaaagcaaacccaaaatataagatctaaattcagtttggtttttccaagctgaaggcagtagaatgacatccaaccaaaatttccagctaaaccctaaaacaaacaaacaaacaaaaaaactgtggagtcatgatttccccaattttttttaaaggagggagaataaaagagaaagtgttttatattattgaccttggatctaaaaatgtgagattcggtgcatagaaaaatctgttgactgcttaactgttcttgccactcacctggataaaacccaaatacattcacaaccacacaaccactgagatgaagaggccatatggcttgtaattagactctcactttcggccaagatattgagacatttattacatttgctatttagtattcatcacatcttactgcccaggaaaaaggcaccaaggaagagattaaattcatccttcccctttttgccactcaccactcaagcttcatcctacccctttcccccagtcaaaaggaatcaatttctaaaaataatacatggaaaacaatgcttgcaactagtcaagaatgctttgcttcttctttatatgaaaatatcaagcaagcaccatcaagctcttgggccagagcagtaagacaggcttgtcagctctgaatgctcccccaaaaagcagctcaaagtgaacccaagatttctttgatttttggccatctaggttcagtgagcaaacttactggtcaggtttattgagatagtctttcaatagcaaacatttgctgagcacttagtatttgcctgatgccatgccaggggctagaggaaatgaagacatagttcctggtactttggaccttacaaactagaaggggagaagggaagacaaatattaagtaaataatcacatgaagaactagttaatttacaggtacaataagcctgccaaaggagaagcacaggggctgtgaaagtgagcacttggggcctcacctgcgtgcaggttgaggacactttcccacgaagtgacatttaaagcagaagactttaagaaggaggaggagttgaggggtaggggattctggggatggtgcactctagaagggaccaatcttagtacaagcaaagaattgtcacagcctctccccatattcttgtggataagatggtgaatggagctttgcatgccaggcaaggcaggtagagtcatattgggctgttctattgaatagttttatcaagtaatcgaatgaagcagaagttgtgcaatgactatttttcaaagaaacccaaactgagatatgcttagacaaaggttcaaaccatcaaaatgaaacatgataagtggaagtagctggaatccccatccccaatgtactagagaagtgcaagagtggtaggattacctaggaaaggggaaaaaggacttgagagactccatggtgaaaaatgcaaaaatatagaggggaggtgaaatattattcagccgtaaaaaggaatgaggtactgatacatgtggatgctacaatatggatgaacctgggaagatcatgctagatggaagaaatcagacacaaaaggacaaacattgtatgattccatttatatgaaatattcagaataggtaaatccaaagaggcgggaagtagattggtggttgccagggcctgtggggcaggaagaatagggagcaactgtttaatggggactgggttcccttttggggagataaaaatgttttgcaattagacaaagtgtgagtcatacattaactgtatatgtactcaatgccactgaattgttcactttaaagtggttggttttaagttatgtgaatctcatctcaattttcaaaatatatagtaggggagagggtagaccaagatttgactagaaaaagaaactgaacacccttccttcagaaaaggagagtcctttgttctctgcaaattcacgcagcacaacgagtggaggaaatcacaggcctaagccaggcattaacatccacgaaaagggacagggcaaaggtgactcagcctattacaccagctaccttgagggcagtctacgccaggagctaggacagagggctgtggagtcagacaatcctggctcaggcctcagctctctaagatactggttgaggttctcggggtaattcgcctaactcctttatctgttattgtttttctcaaatattaaatgatacaaataagtatgacctgagtttctacctcagaaaaagaatgttaccatcacctttagagctccttgtttgctcttccctcctcagacgtaatgatcttaaatcatgtgtaaccagttcttactattctttttagtattacaactatatttataatcttaatggcatattgcttggttttccctatttttgaacttaaatgaatagatttatatgcaataattatctttcttcatctttatttttactgtgtaatatttcttttttaaaaaaatagtttcaacttttattttagattcgtgggtacatgtgcagggttgttacatgggtatattgtgtgacgctgaagtgtggggtacagatcctgtcacccaggtagtgagcatagtacccaatagttactttttcaacccatgtctgcttctccccttcccactctagcagcccgcagtgtctgttattcccattttatgtctgtgtgtgctccattcagcgttgtccttctgagattcattcacattgtgactgtcattcatgtattttcactgttgtataatattttgggagaacatcccataatttacttatccattctactgctaatggacatttgagtactgtccactttttgccattacaaacggtgctgttatgaatgttcttgcatgtattttctggtgcatgaatgctagagtttttctaggtatatacggaggatgcaattacttagtcaaaggatatgcacttgtacaacttattaggtaacatcaagcagttctgcaaaatcattgcactaatttacattcccactaaccggtaacgagagttcctgttgccccacacccttgcctccacttgacatcccctgatggtaaatgtgtgacaatctagtaggtgggaaatggtgtgtcattgtggttctaatttttatctccttgattaaagttgaacatcttttcatatgttcattgctcatttgggtttccccttctatgaaatgccctttcagatcttttgcaggttttaaaattatatcatctgccttttccttactgatttttaaaatattctgggtattgattcttcattgattatgtttatttaaaacatattctcccagtttgtgatttggtgttttactctttatggcattttttgatgaatcaaagttcttgattttaatgtagacagactttcagtctttgcctttacgtttagtgatttttgtggtttgattaagaaatcctgtgctacctcaaacatataaagatgttctcctatatagattttcaaagttttatagttttgccttttcacatataagagtttaatcacctggaattgatttttacatgtagtatgatgtgggactccaatttcattttttttccagatagaaaacaaattgtttcagcacactgatttctaattttggttttgataaacattaagtttcaatagatatatggagcagtttctgggctttctgttctagtccgttggtctttttttttatgcaataccaagcccatttatcacaatccctaatatctgtttaagcaaatcctcctcacttgtacttcaggtgagtcatatatccttagcattttgctttcttatataaatctcaaaatcaggtttttgtcaagttatttaacaagaattccctaagcaaaactttttaggatcttggttagaattgcagtgaatctacagatcaacaggtagaattgacacctttaagaatctgagtcttttaatatgtgacatggtatatttcaccatttattagctttcactaaggatgtattttctatatctttattacatttatttttgaatactttaccatttttcttactaccaatcaattatatatgtattttcctacttgttttctggcatatagaaatgtacttttaaaaacattgatttttgaatccaagaaactaggtaaactctcttgctaattttaattatttacctgtaaattctttagggtttctacttaactgtttgtctcatctgtgagtactgacagttttgattcttcccctccatctcttatcattttttattttttttaaaccgcaccaagtatgtgaacccagtttttgttttgcctttctgtgtttgccaagactactagtaaaatgttgaagagaaggtactttcagggttgcatcataattagtaggtttgccgtaggtttttgatcaggttaagaaaattgtcttctattcctattttgttagaccttcatatttgatcacggatgtaaaattttttcaaatattttttcttcatcagagatggtcatgatttttctcctttgatctgttaatgtgatgaattatgtgaattggttttccaatattaaaacaactttgcactccttagataattaaattcagcatagtcttcatgtattgactattgtattatttgatgaaatgagctggtcaatattttgttttagatgtttgtgacaatattaatgagagtggtctataatttccctttctcaaactttccttactgtattttgtatcaagattatgcctcatgaaataaattacgaagtattcctttgttttttacttctcttggagagtttgtgtaatactgggattctttctacaggattctgaagaactttctgggctagcatgtaactgtgcaaattttaaactattgatttaatttacttaatgtttatagaccagttaggtttcccttcttttttatttacaaaaagaaaaaatggtttcttcaagatttcctcttatccttcatacatctatagtatctgcatgattattctgttttttattctttacattggtcatttctgctttctctctctctctcttttttttaaccattctcaccagatgtcttacaatattatcagtcttctcaaataaacaacttttggttttgttgattgtttctacttaatttctttctttctttcttatttctcagtttattttgttcattttctaacttcttaatttttgtacttcttaattttcagcccttcctctgttcttacattaaaaatttaagactataaattttgaattttcttataagttatactttagcttgacacacacacacacacacacacacacacacacacacatacaatgttcttatattgttctcatcatctgagttctaaatattttctgatttctattatgattttttctttaagctaggcctgtgtatatcttaattttcaatcttgggatttcgaggttactttttgttgtttgtatctaacttgactgctctgtgatcagaaaatgtcaacactatgataccagtgctttgaaatgtcttaggacttgctgtacagcctggaacttagccagtttttataaatgttccacattgcttcaaaacaacacattctgcatttgttatgttcattgttccatatatgtctattgaataaagctaatttattgtatatattagtttgctaaggcagccataacaaagtactacaaactgggggtttaaacaacagaaatttattctctcacagttctggaggtcagaagtcagagatcaaggtagcagggttggtttcttctgacacccctcttcttgttttgtagctgttcatctccctatgatttcacatggtgtttcctctgtgtccaaatctcttcttgtaaggacaccagtcctgttggattagggcccactctagtgacttccttctaacttaattacctctttaaagaccctatctccaaatatgatcacattgtaaggtactaggaattaggacttcaacatacgaattttggggagacacaattctgtccataacatagtccttttcaaattctacataagatttccttgcttgatttcatgagttaggtgctgaaagcagtcaaattttccacagtgatgatgaatttttctatttctctataaagttctttcgatttttgatttatgattttgattttgaggttatgttattagtatatataagtttagaatatttacagctacttggtgaattaaacattttattattatggagtcacttctagccccagaaatgcttttgtcttatatcttattttgtccattaaaatatacttacattagctttcttcccactagtgtttgtgtggtaaatatgttttcatcattttagtctctatttttatccttatttttaaatgtagcttgggtttttaaaattcagtctgacaatatttttcttttaaatagagtactatatccattggtatttattatcttcaatataatgtactttgatctttttctactaacctacttttcgtgagaggcaatagagaaatagtcttgaagagaacagacctctgagaaacactgccttggtttgaatatcagctctattgctcactacccgtgtaaccttggcctagttacacagtctgtgcccattttcttatttgtaaaatggttataataacaaccctacctcatagcattattataactattgagtgagttaatatacataaagtgctaagaacactgctggacatgtaataagatatatacatatacctactttctggtaatttttttatcattatatttatcactttaagttgacatgtttttcctgtttctttttttttttttcttttaaattgtcagagtgtcttttcttatttgatttccttctgtcctctgatttggaaattatattctcttttctgttcttttggaattaccctgaaaatttatcaaatgtacttaatttgtcaaagtttaaagtcaattcttatctttaccctcctcttgaacaatacaagaattttgtaacacgttaaccctgatcaacctatttctgacttatacattatttttatattttagatttttctcaattttaagcctcgtaaatttttattattgctttgtatattcaataattatttggttttactgacatattttctgggtttttttttcaattattttctttttacagctcaattctttcatctgataactgtttctgcctgaattatatctctaaattgggtctgcagttagaaaaatttgtttttactgactgaaaatatctttatcatgctcttttaaaaaagaaatgtaacttattaagagggtttgtcaaaaaatataggttgatgtcttctttcagtatattggagacatagtttcaatatgttttagcttcacagtttttttagctccatagttttagcttccatatttgctattgagaagtaagattgcttttaatatccttgtcttttctttttttttgagacggagtttcgctcttgtcacccaggctggagtgcagtggcacaatcttggctcactgcaacctccacctcctgggttcaagcgattctcctgccccagcctcccaaatagctgggcttacaggcacctgccaccaggcctggctaatctttttctgtacttttagtagagacggggtttcaccacattggccaggctggttttgaactcctgacctcaggtgatctgcctgcctcggcctcccaaagtgctgggattacaggcgtgagccactgcacccagcccaaaatctttatcttttgttctgcaatgtgactaagatgttttaaatatgatttttttgtttttctttgagacagagtctcactctgtcaccaggctggagtgcagtggcgtgatcttagctcattgcaacctctgcctcctgggttcaagcaattctccttgcctcagcctcctgaatactgggaccacaggtgtgtgccaccacgcccagctaatttttggattttcagtagagacagagtttcaccatgttggccaggatggtcttgatctcctgacctcatgatccacctgcttcggcctccaaaagtgctgggattacaggagtaagccactgcactctttaatttatcctggcttgttcttggatctatggattggtgtatttcatcaattctagaataggctcagccatcaaatcttcaaatattgtctctcttttttttttctttctgaaagttatgttagatatgttagaccttataattctatccatcatgtcctttgacctcttttatattttctctttgtctctcttaaattttggataatctcttccaatctgtcttctacttcactaattctttctttagctgttaagccaattcatgaaggttttttccatgttttaatctccagaaattctgtttaaaatttttatgatctattattttacttaatttatttaattacttttaaaacataattcttttgtattctgtgtctgataaaagcagttattgaagtctttctgggtctgatttagccttctgctgtttatattggatcttagcatgcattgtttccatatgtaatctctgtctctctgtctgtctctctctgtctctctctctctctctaattctctgtctctctctctgtcacacacacacacacacacacacacacaacttctatttctctacctctaatagtttttattatgagctcatgtttcttgcaattttataatgatattttgaggcctaggttgaaggtgaggtcattcacttttgctaagtgcttgagagcacatcttgcactggacctctttaaactaaattatcatcttgaggtttctcagaacacagaggtattgaaaacttggtctgccaacttgtgtattcattggcttgccattgaacatttttggggcagctttctcaactcagcacccaaatcaaaggctaacaaatctctctgtagatttaggagtagatttagtgattttagagaaagcataaccattttgggcactagctttatgtgaggagatttctattagactctccctctaagcaaactctcagttttgactcctgtcccaacaagggccagtcatccaattgtacactacataatgccagggtgcatctttcatataaactatacctttcctgtagatatacgttgtagtctatatgaaaggtgccctttgataatgttcagtttccaatctgcacaactgtatatgatggttctgtctgtattcccacaagatggtgaaaactaaagttcaagttcaccaggttcagcaagtgccctccaggtgaaagctgggtttggtgctttggttttataattccataactgacaaaatttgaatagagtaaagacagtgcctcctccctttcgaagtccttaaaatggtaggtatattgatatcttatgaattgagttgatttgccagtcatgaattcaacaaaaatacctatcacttgcttcattaaaagaactgtaacatgatgagagtgtttattgctttgctttgtttatttttagatgtggactttccagtttttctccagcctacaaatgcaaatgagaaaacacagctaatcaaagaaggatctcgaagttattgcacagactcttgatattgagccctcagagagtccacagtccctcctctcagttcagtcttgtctccagatggtcgtaggggagcgtgtggggcataaagtgctgtgaacttttccatcttgttgttttatttttgggttaggaaaacatgattgctatataattttctcagtatgcagactttctctctgagtagaatttcttatgaaacacattcaatttgggtgaataaaggcctgaagagttattttaccctccttgcctgatgtaggacagtggaattgtacagcctttatgaacctgccctttatgtgtggcagatctgattcctaactgaccaaagtaatattccagaacaaaagccacttttcttacatttaacacaatattcatatctaccacgaacatgatcatcaaaatatatgagaacttataaagagtttttgtgtgtggagcctcttccgtgtcaatattcaataaagttatagaaatgtttcaagagccagaaagggatgatttttttttaaatcacatttttaaggtatatttttggaacattaaaaattggcatttactgaaaactggaaaccaggaagaaacaggttttgtgtgtacttttagattggcttaaaaacaaaacaaaacaaaacttcaacctggttaaatgttgtaagtgaaccagaaaatcattctgagcctgaacccgccccatcagcatgttgatcattttctagtaaaataatttttgtataactggctcagattagccagactaagggaaaaaaaacagatgaaggggtagaactctatactctagagcctaaatttacaccaaaacatgtatcacctcatttttgttaaaattagttgccttgaccagaaattgctcagctctgtgcatgttacacaatttaagcccagaggtcatctctgcatttgcttgtttgattcttgtatttattatgtggtagaaaccatgtgctatttctaaaatactatggcagaaaaagtgttcgtttttctagctctttcttacttttttatataatattgcattttcaagatcttgttatgtttttatataatattgtataaaatgcctttatcttttttcttgtttcttattcccacccaaaaaattatagttaattgctgctaaatatatattgtaagtgagaattagtgttatagctctgatagttctgaggtcattaaaattccactctaactctttagttactgaaattctttttctaggcaatcaagtagacagagccttggtttgaaagctaagaaacctggttctaatctaagctttcattaactagccttgtgaccaagtgagatgaaaataacatggctaatctctctatggctctgttttcatatctgccctgaccaccttccaagttgctggatgaccagataaaatggctgaagtgaaagaaatctgaaaagtcaaatgttcaacaaatgtaaggtggttttaaatgaatttgtatatgttgacgcacacagacaaatgtactatgactcttgatgcatataaactctctcacccaacaagacccatggagacacccagtattaacagctccagtaaccagcaagtgcttggaacgctgtattcaacaaacaaatgctactttccatttggaggaaacaataggataaatagcgcaatctgtggataatttgagccattccatttccttcctgtggcctttttaagcaaaaggtcaggtctattttgaaaagcaacttacaaattacaaagctcaccttctctttcttgcccagacctcattttcctttctcacatggaattttttgcttccactcctagttccccaggaagctggtccaagagtggttaagatgagaacaggacatggatcagaatcagaatcagatggtagaatcaaattgctagaggggttctggccaatgttcctcacaaagggctagtttctggttacaatgatgtgtgacaaatgcaaacacttgaatacctatgaatgagggaatgaattctgcagaatactccttcagctacagagatacaagaatccactcttcatcagaggaggagctgctgaagtatattgtgggggtctacagaagtgctatccaagaagcactggcagtcattctgaacccacaagaagtcttcccttagcagggaagcttcaaggcaagaagagaaatgctgagcgtgagcctcatcagtggtcacacagagtccaatgaacagcccgtgtcaacagctcaccacctctcctgggcactgtgctactggaataggagacttcttaaaaagttccatgagtcatccatttatttttttgctgtcttacagtagaacataataaaaaaatacatgtgcatttttctttaccaaaacacacacacacacacatatatatctcaattcttttagaataagcgacattctatatctagaatgaaaaaactgtctatacattaattaacttattattattatttttttgagacagagtctcactgcaatctctgcctcctgggttcaagcaattcttgtgcctcagtctcccgagtagctgagactacagtcacgtgccaccacacccagctaatttttgtatttttagtagagacagggtttcaccatgttggccaggctgatctcgaactcctgacctcaggtgatctacccgcctaggcttcccaaagtgctgggattacaggtgtgaacaaccgtgcccggctacattgattaacttattagcataatagttttatataaaatgccttcatttcaaaaaagtttttattgtatttggcatggaaattatttttttaaatcaatgtgtaacatactagaaaatcagctaccaaaacttgaaagatacatgttattctgagtcaaagggtaaagttttaacaaaataaaatgagttaccttcctactcacattctgcatttcttagctctctcttttacctcttcccttagcatcccatcccccaaaatagaggatttgaaagtgttggccttaggctcataagtgcatttacttgtatttgagaaagatgatttattctttcacaaattaaaaataaaatttctaagagaataataaccaagagtcgtagtgcttagtacctgacactgccctaagagctttatattgattcatttaatacaacaacctgtgagagaagtactgtcaccatcatcatctgtcattttctagactatgtaactggaacacagaaaagataagtaacttggctaagaacacctagctatggagtagagcaggctggtcctgaggccacaatattaacagctgcactatatagcctctccaggatgaccttgtgtttccaactacatttgttcttgaacatgaatcctagtctcttccccactccccatccaactctttcccagagttctctgactttcaagagaatatactcactgtgtcactccctttattaactacctttctcttcaactgccctttgcagctcaaggagattcccctaagaaatcttccttgttaattccctgtgacttcctcaagagcaaatctgaaggcttcctatatctcttacttcactcccactccttccccttcccctttttcttcctctccccgctccccgccaccccagcacttccttatttgggagatctctgtggtcttagcagctatgtctttaccaccttctcttctctgactaacccataactgcaaccctaatcaagtgaaaagttggatttttaaaaaattttcaaagtgattctagagcagctggttctaataattgtgattttaaaaattctgatacataacttcctgacataattttccaggatgtttagatagtgccgagaaaacttttaaagataaaatagcaaacatatgttgtgcttactatgtgccagacacgattctagctgcttaatataagttaactcatgtaattcacacagcaaccctatgaggtaggcacaattactatttcccatttcacagatgggaaaattgggcagcagagagtcattaattaactcaggctgttaataatgggagagccagcatttgaactcagctagtctggttgtagcatctgtctgcttaattactatgccaccttggtgccctaagacatatctgaattctgtaaacttggatttacaactgcttatttaatgtcaaaatagtgtatacattgagtatgttctaatttgtccctctcaccaaaagtggataccataagcttataaatccaagttaatacaatttgctctattattctgagtccataagattggggtgggaacatttgttactatatataaaaataaggcatcttaatatcactcatacaattagaagtaaaatattttcatgttatccattcataataaaagtgaaattctacccaatttctccattgtacaaaatatgatacaaattatgaagtaaaaatataccattgaatctgccagactactaaattagcaatgctttattatttttcatagtattatacaaaggaaatacaatttgcaaatttttaaaaagaactttgttgccatttaaaataaagaacgtgtgtatgttcatgtgtatgaatacatttgtgtgtgtatatgtgtatgaatatatgtgtgtggtgtgtgcatgtgtgtatatatacatagatgtctatataccataagcaatttattttgcttccggtcatctgtgtcattttgccattataggaagcacaacacctgccacactcctgctctactgtgctttatttttctctttggcattcattactgtacagcctactgtatatattatttattgtcttcttattgtctatttacccttccagaatgtgtgcttcaccaagatagagatttctgtctgctttgcttactgctgtatccttatcctcagctctagaacaatgcctagcacatagtacagactaaataaacatttaaataaaagaataaatgtgagtctctgaagaaaacctcctggccacaccctcccaccaccaccaatcatacctttcggaaagatgctgtatgagcaagatgatgctcccacttccccgagcatggaagactgcaagtgagctttcaggacttacagagccctgggaatgagatgggttggccttgccatctcccagtagtacaaatgttaacccccttcaaaggggaggtaggctggggcttggtctcattaaatatcttttgatgtagtgatttggcatataattcaggattgcatttgggtgaataatgcagtcaatcttcattccatatttgtggagttacctacctagaagaggacaaactttctttacacaaactgtaggggaggaaatacttccttctgtcatcttaggttctgtggctgggcctaagaattaaacgataatagcataaaacatattaacaggagaaaagcatacgcatcttatttaatatttatatgtccatggaagtctttataagaaaaatgaagacccaaagaagacattaggtccaaaagcttaagtacctttttaaacaaagaatgataaatattagggatgtggcaagacaaaggggcttggtctgggtatagtagactgtggggttgtgagtggccaggggcattgttcaatatcaaagaatttttttaaaagatagtaccttactggcaaggtacttcctgacttcaaggataaagcatggatggaagcaatccagagaaagggttctcattgtccaggccttcttgttgtgcaaccaaaagactggctgctggtgttttatctttttccttcaaggcttggttgttagcagcttcacagataagggcagtctgactcataaacccaatggcgtttgcacaaaacagtagaggtagcctatcccttcctgccttaaatcttggggctcacttctcatccctactaatacatgtcctttgtgacatttttttttcccagaatagggcattgtcatctgcattaaataccattcaggcagatctcttttctcctcaatgattttcttaatgacatccagaaattcacctgctgcctcttggtcaggaagctgctcttgttatcttgacatttttaaagccaaaactgctttctaaaattatcaaaccttcctttgctggcattaaattctccagctttagacccttccccttccttttgccttaagttgtcatataatgactttgttttttctggaattatattagagtctataggtatgtctttcttagagcaattccgtacccatgtaaaagctgcattttcaatacaagataaagaggtttttggcaaaacgtgcaagggtttcatgcctgctagccagctgtagtgacggcttcacaaaggtccttacactggattcatttatcttgaaatgcctggcaaccacagctgtagacctcaatctatggtccatattaagcaattcaactttttctttttggatcaagacttttctctgcttcttgggagcatatccagcatcatgagtggcacttcgtatgggtcctgtggtgttattcaaggtttgtggtatttcactacaattaaaaaatcctcgagacccacaagagatcactttttactgccacaggcaatttgctggagagacaaactgctcatagggagattattaaagtcacgtacatggcattttaagcagatattcgaaatacttgaggtcaccacagtagcaatgggaggtggctatgaaattatcacagtagtacagtatgtactatggttaattttatgcagctgtgatttaatattgcatctttatgtttattcacatttcttttaactgtgcatggtgccatgtacaatttgggtttgtataagttttgagaaattttaacttcttaaaattttatggtaatacatgacaaaatagactactatctacatatatttcatgcattcatgatatacctttgtcttaattttttaatatttgtaggctatttggctcatgtcaagttttttcaaattgttgcagatctccaaaaaaatttccaatatattcattgaaaaaaatctatgtatgaatggacctacccagtttaaattcttgtttttcaaggatcaactgtattaaataaggtgtccttcaacagaaacacacataaaacaagattatccattgatcagttgacaaaaacattatggccagagcctccgtttatttcccctgggagcaatgttttcagcattcactaaatcagagttcaaaatgactttatacaatgtaattacacgaataatgagaatcaagtgtaccttccctggaattccccagaatagttccctttctgacctagaaacaacatctctgtggtttctcacaaatatccttcttggagatggtgcatatttagagaaaaccatggataagtcagtaagcctgaatacagccttgctcccctaatctggatggtcatcctaaagacattgtttaatctttctgggtagagcttcctgatctgtagaatggtttccttgactgaaaggaaaaacttgaaagctctttagtgcacatatgtctaaggaataatttttcaaataaacaatggcttttttttttcacatttcacggagtcttgacacacctccttggagcactgctgttaacaaatttaagggatttcacctttggatttagaggtgagaagagaataacctttaatagatgaaacgcttttctactcccagaatgtccattttctgaccgtactggcatcagaacctgcctttcaacctccttcctcccagagtagcagctgccagcccaatatccctaacccaagtgtccatctgaggacagagagaccaagcagtgctacagaaagccctggctgtgattcaggaggcctaagatctcatatgccacttctcccctctgttaccttggataagtcatttcacatatttgggcctcagtttcttcattcttaagcaatttttattacagaatatctataattagatgacaattatgggacactctgacccatacgtgttatgtaaaataacttacatatggttaaacaaaaatgtaatgatgtcaaaaaatgcagaaacaaaagcaaatttcttcaccatccccatatagtttgttagggctatcataacaaaatatcacagactgggtggcttttaaaaagataaatttgttttctcacacttctagaggctagaagtctaagctcaaggtattggcaggtttggtttcttctgagacctctctccgtggcttgtagatggccgtcttctccctgcgtcttcctgtagccttctctctatgcatgcatgtgcctgctgtctctgtattctgttctccttataaggacaccagttgtattggatcagggtgcaccctaatgacctcatttttgcttaattacctctttaaaggccttatctccaaatacagtcacattctgaagtactaggggttaggtcttcaacaaataaattggggtggggagggaagacagaacacaattcagcccaacaacaagcatgccatcaatttctcaaaattgtgccatatttcagtttgctttatatttgaaccacgtattttttataaagtttttttttgtttttttgttttttttagaaatccctgagtatcttcgttctgtctttttgagaaaagtgacatgtgcctttatcatatctctaaggtctcccagatccttaatcacactactattgtaaaagaatccgcttctttttgaaaaataaacttcccagagccctctaacttttttttcctccccttaatttgtcctgattgctttctttgccagctgcatcactgtcaacctgagattttcttttcattgagtccctgggttggtttccttttttcttaaatcctgtgtactcctccttcttggattcttactttgctttgctgaagtacatccatggcatacacagagacatgctgctagactgcctttcaagaaagaactcactgcccagctgcaaggaggatggttaactagtagccatcaggtgttaactcctctagccaaggttctaagcctctggccaatgactgagcaaggtggtgatgctagggccccaccatttctgcccaacttgagactcctccaaaaggaaatctttgctctggagccaccaagagggttggcagaaactttgtcgggtctgcatcactgtctaatgactacccctacccaatcctgtgtcctccccttttccattcacagatgttactcccctgtaaaatgttgtgctctaattctgcatgagcttcagcttactggagaacccatccagtacaacatcctcaaataatgtttacttactttttatttgtttcagagaggaatcatagatttaaactttatgagaccttgcaactatgaactattagtcctcatatgtgattgctactttgattggcatacaattctaggcttaaaattatttctttgcagagctttgaaggccatgctcaactgtcttctagcatccagtaatgatgatgagaagtctgatcataatccaattcttattcctttgtagctagcctagttcttgtttagattttgctttgttttcctccatctctgaaagttacagggtttcatctttatcctcaatgcttttgaatgtcactaggctgtgtccaggcatggttatttttcattcatcctaacttgcatgatcctttccatctgatgaccaatgtctttcttttattcttacccctgcattgtctctgttttctctttctggagctcatattagatactctttatgtcttcaggatctatcttttcttttttttttcttttctatcttttttttggtgtgtgtgtgtgtgtgtgtgtgtgtgtgtgtgtgtgtgtataaccagatctcactctgtcccaggagctggagtgcaatggtgcaatcaatcatagcccgcagcagctttgaactcctgggctcaagagatccttctgcctcagcctcccaagtagctgggactacaggtaaacaccaccatgtctagctaattttcgtatcttttgtagagatgggggtcttgctttgttgcccaggctggtcccaaactcttagcttcaagcaatcctcccgccctggcctcccaaagtactggaatgacaggggtgagccactgtacccagtgtcatgtttttattttttgctttccatggtctgatgtcctgggatatattttccattctatcttctatatcttcatagctgatctttagccatgaccagtatgttacttttcaccttagcaatcatacttttagtattcaggaactctcttcttccctagttgctcctgttaatatcactgtattttggttttcattgctgtaactctctcttggatgtccttgaggatatccctaactacttttttgttaaatagttctgttctattctt

SEQ ID NO: 261 - DNA, 102298 bp, Homo sapiens
atagaagcctcagatgaggagggttttgctgtgtgctgcaagtatcagggagaaagcatttctgccctctctggaacatggtgtgaacttcatccctgtaatgatattgtttgaattttccatgaaaaattgtcagcatgagagtaagaaaagtgtacgatgggaaaatattgaaccaaacagacaaaaatggtagagtcacatgaccagtttactcattggtaaagttaatgagagggtgagattaaacagaaattggtaaagttaatgagagggtgagattaaacagagggtgagattaaacttgggaatgagtttgtctgaggagtgaggtgaagcatcattcctctgatgcacagggtaagggtttgtctgtaaagagatagcacaggtgtctggagagcagcgtgcatggtaacctgtcctccaggccagtggagctgtctgtctaacctggccaaggtacagtcttcatcaaaggtcaggatccagtccatgcacaagggaggagccatttgcagcagagcccagaaatgcctcctgcgacatcttgtttgtgtcatttactagagttggcactgtcttaagatgggggcatggctgacattttcaactatcatcagtgagtcacttgcccaaatgaggaccatggtattaatcttgcatgtttttggaactgtttaaaaaatgtctgatttttgttgtttagtgtctgtttttgaatttccccttctctgcagttcttggtttctatctcactgagtgcagaggattttaattgttgctgtctatctgtgcttcgcagcatgagagagcaatgcctacgggctcttgtggtgctttggggttgacgggttttatgtctgagcaagcagatgtcatagtagccatgctggattgcagtaataaatgtgtcctttttttccttctgtagcattgaaagccgaaaagagaagaaagctgactcagggaaaggtgttgacagggagacttgtctatgactcgatcttcaatttattttttacatatatatgagaagagtgtcacaattattaataaaactgctttgatcatgtattgtaaattctgtccctcaacccaaatccaccttcatactgtaagtagtgcaatacttgtttcatttctgtgtttaaacttctgagcagtgagacatccctgtgagcagatacaatagccaatgcaagaatctgtgtgttccttgctgtacgttagacatttgtaaactggattctgattgtcagttttatgagagcaatagcttccttaaagagataagtcatatttacctagtttgtattttcctactttagtgacctgaagatgcctgataatttcattcagaagaatttttgaaaggtagtcttacttctttttagtttttatagcttagcattagtgacttatttcaaaagacccaaatcaaaaagttagtttgaaagcattttttaataattgtatttatgcatttccttgatttaatatgataaatttaatacttaacaatttatatgtaactaaaacttaaagtcatttgaaaaatatatagaaacctatttacaacttgttaaggacaatcagacataatgcagagttaagtagtatttgcttaaaattcaagttgtgactaatgatcaaatactaggcttgtacgaaatgctttagaaaaactttgtaacagttttgtgggatttttcaatataaacctttatcagaaatatactaagtttgtctcccactgacaacagatgttttccaaataaacatattctatacatacttgtggaatgccacatggtgaatcattgtatatgaaattccactcctgtacagttactctgcagctaatggtcatgcactgcttaatgctggtcctgaatcatgttctcatgttagaccaacagctctccaattgtcattttttttctgcagagttttttttttccacttttaaattaaatgcatgttgtggaaaaacagtcttttaaaatgaaatttcagattccatttgagaaggttctgtagatatttcagtccatataaaataatacatctttactaaacttatataaggggagagaaagttatgaagttttggacattactaaaagtacagtatttgatttcactttcaatgaatgtgaagttaataaaactaaatctcataatgctcttggttcctaagaatgagtagtaatcatcaactttataatactccaatattccgttttataataattcagagccctgtggcttttacacaccgttaattatgtactctgttggaagtgcacatgaaaagtgaagaaaagttcctcttgtgattaaactaatgggaggaaataaatcaacaaagtctccattaagttctacattttgagaccttttaaaaattcccctcacaattctttaaggagcccccctttttatggaacatgagcctaaaaattatagaaagaagaattttaagttaataaagtttgtatttataaatgctgaaaaaatacagaaactttctgttccaaatgtgttgcctttgtgtattttataatacagatactacattgtaaacatttccattgttttatgatttagccagtgattccccaaagcagcctcttagtgttttaatatattaataactgttttgttaaaaatgatcatagtgaatttaaatcttcacatgatcacctatttgaataagcaatcatatccaatgaaattctgtatttctgagtatttttatagtcattttgttcttgtgtgaattttaaagctatccctatgttaatcctaatattttgaaatcatataaaatataataaaaatgtagtattatatatttacttctaatttcagattcctggtcaaaattactaaatatcttgaatgtaatttagtgccaagtttaaataatgtgtaaatgtgactaggatattgtgtttttcacaattaagaaatgttatgtggaaataaatatttatcctaacttccttgcacattttaaattgtgatacaaagtgtcttgtcttttttctttgttttaattagtaaatcagtgtaaaacattttgattgtttgaatataatatttaaatttagacagccccaaagctaagaactcttggtgatgtaaacaatttatgagtatgtttcaagagtaaacaatttgaactttatgaacagaagattatgagaactatataaagatatatttactcatttttccagaaatgggtgcagatgacacggtttcttatgctaggaaaaacctccaaggtcgttagtagtagtattcctcattattagaactctatttagacttccgtttttaacttccatggggaaagcattgcctaaaatttgtctcctccctgtttcttacaaaagtcagatgggaccattattctttggtagccatctggcagtgtgttgtggagataattgcattcagaattctatctaacctactgcttggtatttttctcttgactagtgagtttactttgtaattgctcctgtttcacagcctacaatattggaaagtttttttcctgtataatataatataggaatatatatattcctatgtatgtataggatatcctatatatcctgtatagatgaatgtctccttggtatagtttaaacccgagtttgaaagaaactctccactgatgatccaaaagcaacttgtatttcaacatgattcctagatctttttggatttttcttgactcttagaagtgtgacttacctgttttctatggcactgacctacctctgttttggtttaactttagcctattagctcctgggcacttgtctattttactatcattgcaagattgctctctcatttttccaatatattaatatctatctcatatattcacacaatgaaatgaaatgagattacatccatttgaaagttttatgagagtcatttggataatatgatggttctctaaatgtctacatcaagaggctaattgtagttagtccccttgaagaggcttaataatcaaagattactggtaatactttattttagagatctccttcgatgttcttcatggaatgctgtggctaactgatacaactgtcacaccaattccgttcctgttggtgtactgggtactatcatttctgctggaactttgaaaataggactatgatccttgcttctaagggcagggtggatacatagctgtaaataatgtgatatgtgctgagttggccatatgagtaaagccattttttgaatagggcagagtttgacgaaaacattatagtagaggtagcatgtgaattagaatggaaatggggaaggaaatgtactccagatgttgaaggaacccctgcctactaggcctctggtctaatgaagtatgaccagaatgactccatcttgaagtgaagagctagaacactcttaaggcacctataagattaatgcttgtggtctgaaaatagccactttccaagctggctacaacctattattacagaatatttatgaccatacagagcatctcccaccatgcctgcagaatgtccctatgtcctaagaattcagccctccttacttagagataacgttaatgaacaagcttaggttaaaagattaagggtcatgtaatatcaatgacactgaaggcccctgcctttagtgagcacatagacacattccaagtttaattgtagctctttgtaactccttataaaagtagaggcgctaacaaaggacagggcattcctccttttgctttcagaggatatcccacactgtaacgaaacggtttctgaaaaacttacttcttccactatgctctgtggctttccttgaattctctcctttgcaagatccaaggacccatttttggggtctggatcaggaccccttttccagcaacaccggaactacaaagattctcaaacctatgtcggtattgaaataaagatgaaatttaaaagtaaagctatatggcataactagagcctggcatattttatgtatggcatatttggaacccagcaaacagcccaatatggtggagtgttagaagggtagtgaagacttgtaggaaaagacagaaacacaagtcagagacattacaaatgatgttaaattctatcctagaactgttggaattttacccattaaaagttttgagtaatgaattttgaaatgattaatagagcagcacagtagagaatatagtggggaaacagtggaattgcctcctcagggatctcccttccaggatgactctcagatgacaaaactaagttttcatgatctataaatttctattaggatagaaacgaaacaggctcaagtatactccttaggtacctaacccgtaactctagacacaatagcttaattataattacttttatgtagtgcattcccttatatatggagattttatatatatatatatatatatatatatatatatatatatatatatatatatcttcataacaatgcaacagttctgtaaggtaggtctttttgtactttttacaaattaagacactggagttcaaagagcctaagtattgttctttatatatatatatatatatagcacatatttgtgtatatagttacatttgaaaaaaaaaagtgttctgaaaagcacagtgtccacagcaagcctgagactgttaaagaaacctaagtgtggtgcacagttcagacaatgactgcttcataataatccagaaaccaccttctctccgcccagccttgaatcctaccctacattcttaccctggattcagttttctgtctggatcctcttgccttccggtgtgtgtagagttaaatatttttttcatgtgacttcttttttccatttatttataaactccttgaaggtagggatggtgtttggtgttttgcccctcttttgtaactctccagagcccagatctgtgctctgctgtttacccagccagcaaaggctcttgatataataagtaaaatataccagaagatcctgctgctcagtttattaagaatgattaaaagtccaaaaagaattgtcacggacatgtcagtattggaacacagcaaatgcttaatgagtaccttcaagtgcccagcacctgaggacacagaagactaaggcaagaatctgtgtaatctatggagccattaagaagcagctacatggttgtgactagaaggagggaaaaggtgaaaggaaggtgtcaggcattgtatctatgtaaatcttcagagcaatgcaaccagttctgtaaggtaggtctttttgtactttttacaaattaagacactggagttcaaagaggctaagtattgttctttaaatgttccccattagtgagttggtggtactgagactctaacccaggtccaactgacctcagctgcagggcactgtgtctccagcaggaggtgagatgtgaccgccttcctccttatcaggttattcattctggctcatggaaccagaatcaggttatgatgattaatatttctgcttaatatgttacattttctttgccaccaatctttctgttattaacactggaaaccaaacttacccagtgaaacaccttttttgctcatgagtcacaaatatcaggaccttggatagaagaagcttaaaaaataaaaagggtttttgattgttggatggtcacacttcacaccacactcacacatgctttttaaataatttgaagagtgggttcagatgaaagactatatagaataagaatttttatcgagtttgttgaggcttaaagcctgtaagcaccaaaaaaaaaagttttctctcaattaaggaagttaactattaattcaaattcttgggtgtaaatgttaatattgtcacagaaagaagactgtgcagaaagatgatacatttctatgggccataatattggtccattcataccatgctctgagctttcctcatgggatagtgatgttatactttgtttatgtatttatttatttattttgagatggagtctcgctctgtcacccaggctggagtgcaatggcgcgatctctgctaactgcaacctccgactcccgggttcaagtgattctcctgtctcagactcccgagtagctgggattacaggagcacaccaccatgcctggctacttttttgtatttcaataaagacggggtttcaccgtgttacccaggctggtctcgaactgggctcaggcaatccaccccgcttggcctcccaaagtgctatgattacaggtgtgagccgccaccatgcctggctgtgatgttatactttataacccacacttgtctattattctcaaccatctgtatccctcagacatcctgaatacacactctaggtcactcaggatgtacacaaaagagttcttggacgctgctgaaataactgccacagagttggccaacaaaatcctcttactttatggaaaaaagtcatgcttatgttttgttgtgttttctatttagagtttattgaatcataaatattgtacaaatctagtagtcttataaatcagtattctcacatcaacttcgagcaaaagtagcaaatgccaagaagtggaactggtagcctcagtgactacctgtgaataagaaaagaaacagaaaatatgcagaatgtcacgaagcccagtatgttcattaacttttatggtagtggctctgagttatcaagaatgcattgaattatattctgtgcctgatatttaataaagtatgaaggtatgtactcatatttagcaaaatttccaacaaacatgttaaaaaataattcatagtgattttctaaaaatcttgatagaaacttaaaaaaccaaccctgtatccatagaagagatgtaagccatttctcccttcttttcgtgtatgtgcctctgggcactggtgtactctcacaggttgttatgaaaggagtcttagccattcctgtgtctgcagaggctgcagctatgaatgtcaagacaagtctgcacatcttagtggtatgactggttcctgtatgttttaaacttattctcagattaagtttatctctaacttatttgtccattttcttcttttttccataagctaatttaaaactctcattggaaaggaaaacttgtcctatgagggtcaaatgaaaactacttcgactttactcacattattactttttgcagccttcaatgcttgaaaaatatgtgctgggattacctcactccagagaaaatactgcacatgcttagaaactaaagaaatattaatccatatcattttgatattgtataaatattaaatagtatctgacttagatattacgattataatatctgacttgtatgatatatgatgttgtacaatatctgacattgtacaatgtctggcttcaattaagataaaaggagaatttctatttaatttgcttttatgactattaatgctgtccaggatgtgaacatatattactaccgcttcttgatatacaattctgcaaagattgatccagctactcacaatgattgaactgtattaagaaacagaattttgacaagaagagtcctacagattggaaggtcagtttgtggttccaatggaggagtgggagttgagatttaattaaggtgaagtgactcaatggcatgctctgaagctgtagttgaagatggatttcacaatcctctgtccattcctatgcatgactcaccagtctcatgttcaattggtagatttttttttccatttcttccatttttaggtttttatgctgtagctcaccctgtctgggaaaactttgtctagcaaatggtctgaagctaagtttaaactcataaagtcaaatttttaaaaatgaggctgttttgcaaataattgaaaaaaatgatgttttctgttatctggatattgctttgctaggccaaattcagcatttaaaattattgctttcggtcagatgtggtggctcacgcctgtaatcctagcactttggaaggccaaggcgggcggatcacctgaggttaagagttcgtgaccagcctagccaacaggacaaaaacccatctctactaaaaatacaaaaattagccaggcatggtggcacgcacctgtaatcccagctacttgggaggctgagacagaagaatcgtttgaacccaggagccgagatcatgccactgcactccagcctgggcaacagagcaagactctgtctcggaaaaaaaaaaaatttatgctttctttttttctttttttttttttttttgagacggagtctcattctgtagcccaggctggagtacagtggtgtgatctcggctcactgcaacttccgcctcccgggttcacaccattctcctgcctcagtgtccccagtaggtgggactacaggcgcccgccacgatgcctagctaattttttgtatttttagtagagatggggtttcactgtgttagccaggatgatctcgatctcctgacctcgtgatctgcctgcctcagcctcccaaagggctgagattacaggcgtgagccaccatgcctggccactttcatttttatagtaatgtcaaccacaaatagtcaaccacttaaataattgactacttctactgagccataagaactgccagaatgatatttctgatcttattcgttcttatataagcctcatcatagttccctggaataaaattataaattgtgtatgatataagtaactaaaattagtttaagttgatttctcaaaagctgtatgtatttatgataagagaaattgcacattattaggcaaaaacctatgaactgtttagcttaacacatttttatatatctaatttttttaccaaagctgaactctttccatgtttacaaggtagtctgggattactaacaaaataaacaagagcctttctagataaatgtgtccatatgccagtgcggtttaggtcttattcaagacacaagtcattacttctgaaaaaatgaaggcacatttattaaatgactgggagaaattccatagtatgtagaatgggaataataatacataacattgtattttatgttccattttttaaaatgagtccaaggaagttaaaatattcttttaattaagacactcaaagaaatgaaataagaaaaattgatgcaaggactccttcaagttaagatttgtgatacaaatattttcatcttttaacagggcaagctgatgtgttcacatctcagtttcaagctgcctctttcactaggaacatcagtatttttttttaaaagcacatttacaatgctttcccatcacccttgctgtgtttttgtagcacctatagccataactggcacctgggggcctgcgttgctggcagtttcccttacatttctttggagtcttttcaactgctgtggttttacttagaagtcagtgctttgcatatttgatttcctgagactgtttgaatagtctttctcagaaaactgtgccagtctggctgtgaacagctcttctccgaggggagctgacagtagcctgctcgtgttggtatgcttggacttgggttcccagccatgccctgctatcttctctccctaatccctcttatcctgtccctgccctagtgacatcactgcccacatcttgccatccctttaaagaagagaacaacatttgaaccagtccagttagaaaaagattaaaatcctgctcagggaatctatgcaaagcctccataaaaacaattcctatttgttgtttcagcagctgatgcagaaatgattttaaacaataaaacccgaccggataattcaaacttctgtaaggtaataatctgttgtgaagacagaagtccctacttaagatgataggtatgaaatttgggaacaaaggtaaccttaagtttcttgatttgagtgtgtattttaaagatcatcatcatcttgacagtgcagttttgagataatgaaaacaaaaatgagttttaataagctttaaatggcatggtattttgaggtgctaaggtaaagagaaacattgttttatgaagtggctcatgtgggtatatatatgttggtgtgctgtgctgctagctattccatggtcttcatcagtataccactagagagagaaagaaaagaagttagaattaggaagtcagtactcttcttaaaaaaaaaaatacgtaaattcaaatgagctctcacgagcatacatggtataaaacagagtgttttaattcctgaggcagtttataaactgaaacggggtcaaagagggggtctaattttcccccagagcttttccagggcacgttgttctgtcctgcagaagtctctgatcctcttttgcaggtgctgagagaactcactgtgaatttggctttattgaatagtgctttaaagatacgtacattttaattaaaacacccaatccatttccaaatttgactcaaagggcgcttacacagcatgcatgggaaggaatgattatcccattaagcccacttgttttaattaaactgttatcaagtgttaaatttctctgtactctagtaagataaactgtattaaactaaatgattttttttaaagcaatattgcctaatatatagcacctagaaactggaaaaactctatttcaatattacatatatatgtttaatagaagtgaagtcaaaaatcagatgtattatttgtaaacacttagattttaaactggtattttaagaaatctgtgtatttgacatttatgtaaaaggaattaatgatctgggacaaaaatttattgattcataccttgttaaataattgggaagtcattaccgggcaaacataaattatggagacataagttaactttaaaaaaagcttaattaaagtagcatttgtcttttctttgaatagtagaaaaataaacttcaacctcttataaaacactgacccaaaagatagccagtttttctcagtatcaagtaactgtcccactcctgtgcattgggcaccatttgaactgagcacagagcaaatcatgtgtgttagaggacacataaatacatatacatacatgcacacattaaaaatacgttttccttcatctgaaaatctctaatgcagaaaatgaatttgacataatacgtagaaatatcctctgcatagacaacaacagctctagccattcctgactttataaaacaatcctaattgtttatcgcctgtggttattcaacaaaagatcaccttgtaattgcaaaaactgaagcatgctgattattaagatcccactgttgttagaatagctagtaatacataccagacagaaatggattttcatatttgagctgagctattatcatgctggtttcactttagaattactctgccacacatttactgaacaagtgattacttttgaatcaaaatagggagagactgaacaatcacatgaacaggagagcagtgtcttgatactcccagcatatgcgatattgtgcttcttaaccccaaactcgctaatattattgagcattactctgtgcatggctgaaggataccactcttctgacttcacgttgaaaaaaaaatttttaatgtttttattctgtcctgtctgtggcactgctaaaagaattagcccagaaagaggaaactagaccccaccagcaacttccctccccttgcacaaagtttttctataccattgcctggaaatccactccaacatcgaccagggctttggagatctgagctgactgctgaaagtgaacgttatctgcagggagagaaaggaaacataaagtagctaatagccactccagttttctggtaccaaggggtgggaaaggcacaagaagaaagggactgtttgaagttctaggactcagcatcccatttagcccaagacaagtgacttgtggaaagcaacactgttttattgaagtaaatgtaacagtcttgcccctcatgcttttgttttgtcagtagtgaaattgcaaacctgtctgtgatactaaaaagtctaattaactgaaactcaccatctgctgttccatgaataaggaggtactcaacttgtttaaaattttcagctctgctcatgactgttgaattctggaattgggagaaagaatgtcattattcaaaaaaggatctgccataaactgatttttcacttcagtttacaaaataaaatgttttcagctggggccccctttgatacaaaatatagcaaaccgatattcaagcaaatgctgtctccatgcatggcagaatgcacagcatgccctgtgcctgggagacaggactggaagggaggatgccacatcttccctgaacatgcaggaagagggcacctgccacccagcctgcatgcaaaaccccttgagtcccagatcccagattggctgtgtcctatgcattagcacagggcagagtctcatattagtaatgtatgttccatgggcttctgctgtagttcagccaaaaagtgtattgccatggcaaccatgtgtcacatggtgccatacatgctacatttcaaagagcctgtacatagcatttgcaactaaacatactctgcaatatgtcatgtgaactttggtccacattgctgagctctgaatgaaaagcaaatattacctctttgggaacagatgttaaaaacctaggcaaatgtaacatatgggaggggaagggggtaaaaaagatcaaaagtggccttagaaaatcagtgggttgctgttgtctgcctcattctgtctattagaggagatactatttgatcaagtcatacccaaattagccaagaaataggataaaaaaaaaaattgggaagtcagctttttgagactgctatgtggcctgagccagggctcctagaatgagggtcaggagtcttggatgaaaaagccatttgaaatcatctaaagctggtcatctaatctgaatttgaggatatttaccaaagttgggatgaaggtaaaaatgccataaaatactgtagtgcctttgggagggggtgagctagagtctactttgatggtcctgttatgtgttgggcaggaaaggggcagcagcatctccatgggtttaaaagcagccagctcgtcctgcagcatcttggtgaatcaaattcaactttatgaaagccaaggtttatatttcacagatatctctgtagctcatatcagcttatatttttgatgggaaccttggtggtctggcaggaaggggatggggctaaagtaacagtgtttgtattcaagttccagtttcaatatcagtgagctatgcaactggaggtatgctgctccttgagctttgatttctataagattggaatagagtagtccccgcttattggcagttttgctttctatggtttcagttaccttcagtatagtacaataagatattttgagagagagagactacactcaattaacttttattacagtttatcattataattgttctattttattattagctattgttaatctcttatggtgcctaatttataaactttatcataggtatgtatatatgtagaggaaaaaaaccataatgtataaaaggcctcggtactatccacagtttcaggcatccactgggggtcttggaatgtattcaccttaaacaagggtgggctactgtaactcctcttactccatcacaataataggaactaagaggcatagcaaaagcatttttagggggttaaatttctgatgctgatgtgagaattctttaacagtgtttctggaaaaaagacattttatctacgactttcaggacagagccacccaaaatgtttcagtcgaatgaatgtcccaaggtcatcctggcctagtaggcttaaaacaaatgcccttcctcttctgtgcaggctggttcccacttgttctgaccatattccatttctcacccaaattgaaaattttactcatgaactctcagaataaaaacctgagtgagactccttttatttttgagaaactttttttgtctggtaagatgtctcagataaatacatctaaatataaatccatctgtccatccatcccaacatcaccatttatccctccgttgatttttttcatctagtcaatcaatatttacttattatgtactccactaaatgataagatccataagaaaaaagatttgtctatattatgcattactcttaacatctaatagagtgcaaaatatttatcaattaaatgagtaaatgaaataaatgatcaagcacttgcagtgtccactatatttggtactagttttgcagaatcaagtgttatcagctggagtgggcaaaataaaatatgctcattctgaaatgtattgagatatattttgcccactttctatccatacaccataccattcatgataatagctaacattcaattgagcatttactctgtgcctgtcgctgtgttaagcatcacatataaataagggtttataaaagcactgctatatcaaatccttgcaatatttgcgtaaaataggtctagaacaattctcctttcaagatggaggcaccaagactcagaaggtgagtaacctgcacccggtcacaactacagcaagtgtcagagctggacaaagtctgacagcaagccctttttacttcctacattgcactgcgtctccactaaaattccaagctgcttatgatgtgatcttctggcaaagaaacagtgtgaaataaaatgttaattaactgtcctggaatttgaagtgcataataataatgggtatcctttgagatcctcctaagacccatgccgtctcagactgcactaatcagaagagagattgctctgcacagccctgggtgatttgggaggcatactttgtgactacgcaagtgacgtatagcctaatggggcaatagaactctgagcaattttctgtccttcagagaggaaagggtcaaaataaatctccctaaaagacagttttgcgcagcattcaaagctggagacaagaaaggctgaggcttgagtactgaccgtaaacattaattgcctgaatcgcaggctgaggtgcccccatgtgagtcctctttggtgatcctttccactagccatgctctcagcctgcactgacttcctccctccttgttgctctccaaattaaatttagctctttgctcgcggaagacagtcaactttaacactcagacctgacccaaatatacaactgtgccacctcacctcacctccaaaagcctcatgggcctgccttgcttggcagcttgaaaagcaaaagctgctcctacaacctccctgagccatgaaactgagaaatgtcattgaaacatagagtaatagttaggagacatataaatacgcaggacagttagcaaggaatgtgataactactggagtttggaccaaaacagtttctggctgcctttttttttcttaaatggagtgaatacaggctgaaagaagacaatttttataaacaagtaaaaccctgagcctaagataaatgttgtgatgtacacactgtagctgtgatgaactagacatggtgagaaatgcaacatactgagaaaaagacgaaaactgtgataaaagtgtcatgatgcaaattgttttacattaacaatattacactacaaagaaagaaagacaaatactttaatgcagcaagagaaaaataaaacaaaagcttcccctgcaactgcaagataagtgtgccatttcaaatgcgcacttcccctgctcactgggagaagcctccagagggacctctctgtgagagggagagaggcagctgagagacatacacccactttaaggctctcaggctacacagaacatttttttccccagaaaaaggcagctgtgtcaccttgcctctggaaccattgatcattccctactcaactgtgcaccctggcttctcaattaacaccctttacagtccagtgtatggcacactttaagctgtaaagataacatacaaagccagaaaaagaaataacaggcatgaatttaaggtatgattaatgattagaaaaaaaattaattgtgctattttaacctaccaaaagaggataatccctctttgcctatccatggaaacagaaataaaaaaggaaatggatgactaagttagaagccgaatagtctatcaccaactactaaaaaggaaactcagagtgataaatgggcaaggatgcaatggtggtgcagttggcactctcctgaggctagaaacttccggagagccccgctgccagcaacagcctggcaaggagaagtgggaaggatcggtccagtggcagtgccgactccacagcatctctgaggagcttttccttcagtccccaagaagaaccatctgtagctgctcgttggatcatgctggttcctcagttaccttccaacaaataaatctttgtatttttgaattaaaagagagagctgataagaggaggagagtactatgagaaacagaaggtataacaatttttaaactacccctagtgccatctaggaaccataaggacaatttgcttcctggagataataatggtggcagctgccatgttttgaaagcttccttcatggcaggcacaagcacctcatttaatgatttcaataaccctgtgaggtaggtctgattatcccattatccagatgaggaaactgagattcagtaaggttaagtagcctcctcaaactcatactgctggtaagtggttgaaacagaaattgcggacatgttggcctaaccccaaaagctcatgtccctgactatcatattctactggcacttgacatcacaaccaaacaactcatcccatttataagatcttatagaaagagcacacagtcattgggtctaacggacagcaacccagcacttcagtaagatacgactttgggtttagcggcttgctctatgcattctcctacttgtaaccaaagctgcataaataatattaaatgatgccattttgggaagcaccattaatatcacaacaggggccacagaaaatgtttaagaaaagaatgacttcaactcactaaaacagatgttttacttatgtacatctatcaaacaactgtacccatgggatgccaaggagagagctcccatcaaccccagacagggggctccacctcaggcctcaccaagcaacactggcttctttaaagatcacacagcagtcaacattttatcagcactcaacaaacaagttaaggtttggcttaaatctgaaggtctctctccctttggcatattctgggataatagaacaaatgtcaaatcagtacaagatggcatatttacaaaattgcaccctgttttgcataacctaacgatgcagcagttcttaaggattgaacatttcaaatctgctagcagaagactgccaaatctatgactgtttcatacacttgccaaaagcctatcaaattttgagcaaaatgcaaaataaatctcctctacaagttaaatcagtcccttctgtgtgttccaggctgccctcttctcttggcaacaaggctcaggacttgggtcctatttctcttgcccttgatctgatacttctctctgtgtgtattcataaatctatcccctccccaggcttatgtcctgtcttcttggccagcatttggcctgctctactcagagcccttcttctgttatccctcagttcatcggacctgcttcacacatcgccagaaaaccactcttcctgctattcatttgtctactgtgctgatctgccttcccccaatacgtaacctattgagagcatcatgctcgtcctccccatcttccgaaatctttctctaatgattcagataagtgccctctctcccttttctaaccctcaatatcaatatgttgcataacatttttgtgcctcagtttgtgtgtccgtaaaatagaaacacagtacttggaggatctggaggagaattaaacctgataacccatgtaaagagcttagaatgatgacttgccatagaagcacttaataaatgaatgaaaacatgaatgaaataaatgaaactagaccccctctggctagggagcagagaaggggaaactctaacttcttggccactccccttcccctccctacatgctcctaaggtatagaattcctggggcttcatagtcacaatttgaaaaccacaagtctttttcacacatattggatactttgtcatattcaaattcatcttttattacctactctcttttatttctcttccaaaatactgttttttctaactgacaaagaataaacttccgaatgattaaaacgccaggcaccttgaatgggtgaatgaaagtctaccacgttaacattttttacaagtttgactaaaagacctgtgactgaccacatgagagaccattcctcactgttaggagcccactccacaaggtgtggctacagctgctgtctgctgattgacattggttttgagggttgcctctttggatctgattcctttgctcaaatctgtcaccatttctgtctgctgggactgagacatattgcagaaaagatgtttccatagagctatactaccctttagctcagatttgtcacccctccactttggctgcccatttagagcttccggtatcagctccttgaggtgggggggatgaacatctcctttcatctttgaggtctggatatcctttaaaagtgcttctcccttgcctcttgccagtagttggatgattatcttcaaaaagagtcttatggactcactgcattgggtctaggccttagtctcagggtcccctaatccacatggcagctttgaaagaataggaaagggtgctctgtttggtttgacacagccctggaggtgtaggccttagaaaatggagtatggtctggctttcagcagggcacaggctgaacaactgcacaaggcatccccgcctgttccattcatgtatgcaaatggctcttctaattccctttcctcaatggtgagtaggactttgatttaacgacatgtgcttctcttggtgatgtggatttctctaaattcttccaaatccagatcaacaatcacctaataataaatcctttacttatttgagttttattaaaaactgcattttcttccaaaggctgtaattctgtaaatagccacgtatcagtggctatttagctgaaaacatggactaagatcaaggccttacttgttacacactttggtcattcctaatcctcagtgtactgaaaagagtcactgatccagactaaacgtgaaccgctttaaaaatatttccttctgatccactgaaatgcacagggtggtgaaatcctctaaggaattgtctcctttgtcttttcaaaaaggatgtgaggaagagagaaagggagagaaggaaaaagaggaagagagagagagagagaggagagagagaggagaaaagaaaaacaacctgggaaagaaaagtaaaagatggggtccagaggggcagctggggccttggaggaaaatagaatctttgaatgtattcctgccagagacaaaagcacaggctcatttaaaaaacaaaggagggcagctttattctaaagcctgctgtgcaccaaaaataggcacttagattcagttctccacatagattcagttctccacatttcggaggaagcaacttaccacggtggagacaattcagttagtgcatttgcctcacttgtatcctgcccaccttaactatcgccctcccaaataattcctcttagtaacacattgggaacctttagctccctggtactggcagttttaatgtgtccattgccagcaatgaattttgtgccaagaaaacccgactcctggcgtggaaggattaaacagtcctcgggtgccatctgtgcagtgaagtgaaagagtgactttgtgcacccagtgtgcgtgtgttgccattggcaggaggaagtgacttctatttacatgactatctcatgcagcgaacacctaaagggggagatggaaatggccaccgcagtcaggggtagagctggagaagagggggaactcggtgggaacgaggagcctataggaaagactggaaatttatgcaggttgaaatggcagactacaactaattatcctatctcattatatagggagggctggatgaagaggaaataccccattggctgatgttatttgaggaggtagggtaggtgccatgaacctccttagatgtcaaggttgggcttgatcttgtgcttccagcctccactttttaaaatataattttttaaatgaacgttttggattcatcatacaccatgttcaagtgagggattgggatcctaggcagttgcacctctaatgtttcgggaactttcagaatcttgtaggagaaaactctttgacaatcaaatttaagtattctggttgggtcgttaacaagaaaatttgaactggaaaatgaaaacggtgatggagaaattcttgtataacaatgtttcccttcaaaaagtttttaagttaaatcaggaaaggttatacttcctaaaggcgaaggcaaagaatacaatgttgaatagcttgtacaccttgaataactaacagtactgaagaggggaaaattcagtacaagatacctattagttcaaggtggaataaaatgaggattcagagatatacaaggaaactatcaaaaggggattccaaaggggatgctactccactgagagggctgtgtaagtttctgaatgggtggagatggaggggaaatgacattccacgtggaaggagcagagggcaaaggcacaaaagggaaagccacagaaacattcagagaacagcaagcattccagacaaagtaggctactacaggaagggtgccgaacacctgggtaaagagtgaggactgggcttagttgagtacacaagaaggaaccatgaacatgttgtgggtgggagttaatctcccagctctgtgaacaatagactggagtgtgagaagacaagataaggggagacaaatcgggttattgttataaaaggagataggttatgtgacaatagcaatgtggttatgaagaaggaaatgagtgtctaaagcagcttatgggaggtggaggagaaagaatgggaagaattgagccctaagtattaaatgggacacttagcagaaatggggacaatctaattatgggactgttttgcaggggtagatgatttgtgcatctcactttgcagattgttacttttctatcttgactgagaaacagacatgaaaaccgtcatacagccactaacacaaaaatattgctatcacagctccctgcacacacacacacacacgcacacacacacatacaccttactcattaagtaagctgaaagtaattggtaaaactaaattgtctatacttgtcttgcaaaactagaaacttttgagttttactgtattttgatcagatgacttcagcatccatagtaatagggatgacatcttacaaaaacatatggatattgctcagagcaatgtattaatatgaagtcatgacacagatgaaaagaaattgtgttcttaagttattcttattgtttttctttctctttaattcactgtcttgtgaagaattgtgaacaatctttgaaaaatgtaaacatcataaatgatttaccttgtcagctgtaagtttcagggttttaaaaaaatttttttcaacctaacatgacaaacagaatcagcaaagttttggaatgatcaaagtgccagaagggtccctagtacttatgctagcacttccagctgcatcaatgtggcaccagagacaatgctctggctttgccgtggcatccacactagcacatgggggctgtcaatgatagttgcacccacaccatattttaaatgctatagcccatctgcagagcaacctgcccactggttcttccatcaggcaaccagcctgttggatgctattcagtgatttaggtttagggctttttaagggtactgcccaactgtacctacctctcacctgctttacttaaatctttgtgaaaaaaaactgtacataattggctatgagtaagaaaattatagtctcgtatatatatcttacttatgataatactgtaagaaatttcaatatatagctaaaggtttagagagtcttctgggctctaaaggaatatgttgaatttctaataggttttcttaactgaaattttataattaaagtaattatctgatgttgctttgtatttctaaatgaatgcatattgtgacctatatagcatacgataaagactgtaattatgcagaatacagtaagggaagctattggagtatctctaaaccacctgtgttatttcttttaacaagaattttgttggaaataaaaatatgtattttctagaatagatacaattaagaaggttcttaaaccacttataaataggttataaaataggtataggtcctcatctcttactctgtaatggtcaaggttgtcttctggagttgggagacccatgtaacgttctgtgtacactgagtctgtgaaagaaaaaaaaataaaaaaaagtttaattcatacaataacaacttttcttgcttttaatgggccacttcagtgtttccatatgtattcactcatgtataggaatatagagttactctcagaagtatctctatgtggttatgaagaaggaaaagggtggctaaagcaccttatgggaggtaattttttacttggtttgctaatatagccagagatgctaattcccagatccctgcatactcatacctttccacactcagccctaacccattctcaattttcccttacgatggggcaaagggagatcaaaccagattatctaaaatccaatcaataatccacatgcagaaaagtcaaatgtgaagtgctaaggggtaagggatcttaacattatcatatgaccctctcaaagaattttagttaggaagtcacttaatgcctcaattgtgttgaaattttttggttataatacaagtatgtgccctgatttatgatcatctatttccttttggagacccctaacaatgttcaattactagttgctgatttaaatcatattttattttggagatcagactgggattcactataataaaaacaaataattcagttatcatttatttgctgtatatccccatattggctcagctactccatcatgatgcaagtttaacatttgttttctctcattttgtggtgaagcctcaatttttgtggtataacagttgagcactgtgaaacagattacattaatatctgtctgctgaaatgacataagctcttttatctataaatatggttgaaaaacaggttgcataattggtttggttattttggatagttaaacatattttgcctgattttaaaaaattaaatgatacattatatatatttggcctaaaatatcagtaaaaaaattattgaggccaaattgcagtaaaactttaaaaatctgacataactgctttgaaaactgcctccttaagtgaccagattacagttaaagagtctaagaattttatcttgccattgtgctatctaggttggtggcttgaatttcactaaaattttacaagtatttcaaaactgatttcattaattttaaaaatggatatattatctaaattcaacattctaacactttttgaatgactggtattgtagattacaaactacactaatgagtgttagttgctccatatgcatactttatgccatttctatgaaaatcaaaatattgtcctccaaaattactaacagtgatattttatcattttgattaacatgaatactgactatgcataattttatatatttaaaggacactaatataaaaatagaatattttaaaagacactttaaaatatgagaacttcataaaatgctcatatctcttttaactttagcatttaaatattaatatcttaggttgtacgttagatgggaaaaatggcttttaagggcgaaacacattttcccctaggtagctgcagactttaattctgcttgtcatagaacacaatactcctttcttatttatgctaaccagatttacatgtataagaagatctgaaattttaaaaataacatttaaaaaatattatgcataactgcataatacaattgtaaacttttaaaaaaatatgccttgaaacaccatttacgtattccttttgtcccatctttgaataaaattgtttaaatttacacgtatataagaactctagacaacttctatgtattagattggtctatatacattaaatgaagttttcttctcatttcatatttttaaacttacaaagatttactccattattttattgaccactagaggtctccaaaaacaagccatccaacagaacaattaatatcaagcagaaaaatattatgaaaacaaattcattgtgtgtagatcaaattataactgtgccctccaattttcttaacagaaagatataaatgtatttttacattggtttatcttgactgggagagactttaaagagtctttttctctgggtactaccatatttctggatataaaatatttaataagctattcatcatcagccattcttttcttacactagacagaagacttgagatggggttagaagaggtgcaggaaaatcaattacctccttaccacttctgaatcccccctcctccctcatcttccatcgcttactccctcccctttgagaattgtagtcttagaggtaggtgtatgatgccttataaaataatactctctcgatgacaaagagcatattctagagtagctttcacctattaagaatgaaaaaaaacaacaaccccccaatgggtgtttccactgttcctcctctcctcttcccatccaaagccctacttgtatttgacatttaattgatgggaaagagatacatacttctctcactctgctaatatgtgaaacccaagaatcaaatcagagtaaagataaggaatgatttatctgtagaaatgtagcatggggctattttgaaattcggaaaacagaatttgttgataaaaaatcaaacgtgtaataaaatataccacccagccttgcaaaatagcagaataaatgagatcatcttattataggtatccaaaaagaacctctaagatgaatcagcctattattcgctgtaaaaacactgaaactcagaaaggaatggctttgttactggcattttgaggtcaacactccgtatctctttgtacctggcagcaattacataccatagtactcccaccgggatacaggcgccacggctattccacacttgaacacgccacttcccgatcccaggaccattgaggttacgtaccctccatatgactaaggaatggaaacagttatttttatggaggtaaaagaataaggacatatggtaagcgagtcgcagtttccacatttctcacatctttatatactgtgcctctttagagataaaaagcatggtataggaggcttaaattggccttaattggacagtatctttaaagactacactttcagagccctgatccctttcttggtaggtatatggggaaaactacggaaaatttgctgaccctagtgactgggtggtaccaattatagaagatttaaaaacaataacacgaaatctttactgactgatgcataagaaaaagtctccctccttccttcccttccctcttccctccctctttcactccttccttcttgctctttctacctcacctccctggctcatcataataaacaaaggtgtaagcctaactcagtggagattctgcagagttactgcccagagacctaagacttgatagatgtgattttcacctccaaatatgtatatacaaaagataaagtaacctgctctgagtgatattcactaacgaatgcatacagattcatcagtcaactactcacccagccccaaattgcaattcgtttgttgtccacaaatcccatttttgaaaattgtctaaaacacaaggaaaaagtccacagatcagtactgcattgtgtatagaaaacttagatgaggcacaaatgtgaaaccctgccatttgttctctgcttcattctattagagactaaaaattgctgccagtaatcaaataaacacctgagataaatatctatcattttaacctaagatccagatgaacatggtttacttttgttggagttcataaaaattgtgtgtgtgtgtgtgtgtgtgtgtgtgtgtgtgtgtgtatgattcacagaaaacaaatcctggcagtttttttcacagttttatacaaaaatttgcagcccagatgcacttttctttacataattgaatttaaatctctccagatgtttttcagtttgggagagtctgcccctgcaatggagaaagataagggcatgaaaaacttctgagtaagggcttagaaatgtctccgggccccctacctgagaacttaaacaccattctctaaataaatcccttcttatgctgggtgttgattagttagctcagtaccgtgcactcaatagaaataaatttttccttgatggattaagaagtcttctttgccacaaaactgtgttcagagatggaatccaggtaaagaaataagaaaaatattgtatgcacctatttcttaatattagcctgacatcaaaagaaatttttttttacttaaaaatacctgacaaatggaactcaaatttttagcattgtgggtggttgcagacctttgcattaacctatcttgattttgacagtctttgtgttttcatgtaatatgtcctaggttgccctaagttaagcagtgctagaaaaaaattaaaatagttttcaactcatcttttccacgtaaactttgtaaaattgaaggaggcagacatacagcaatgtgcaacagatcattcatgtataatttgatcaacctttacaaagtgaatgtatccttgaaatcatggcctgtgcatattatcagaagcctctaaggcatttccctctttgcaaagggacaaaaggaaatgtttttcttttattgaattccataaaaatttcactgaacttttgccttgtttttatctttacataaattgcatcttgcaggatgtacacttttgtgtccagcttctttcattcaacagtatatgcaattcatccatgttgttatgcttagctctttttagttgctgcaatagtgtgtgccactgtataaacgcactatttctcaatacttatttaactggggttgtatatagtagatccttaattttgtaattttaggacttttgttggtcagatttgagagaccctggaaactatgccctctctcatagaggagcgatctggatagatacaagtttatttttaaaatatcaaagcctcactctcaaacaaatgtatcccctgtttattctaaatctctattttttaattgttaaggaaaatagctaatcattaactttagtaaaagagaatttctttcctcaggaatccttaatcaattgtcatcttctcctctctccatctatttcatcattcatggatccttctgcatttcctagtctatgatttcataacattattttcaaccaccctccctattatgcttccccagacatccatgctgttggttacagaaactcaaagttacatttcccacataccagttgaatgtaattaaatataagagtcagaatgagactggattcaaatcctgattcactttggcaagctacctaacctaatagtctctatttatttaattaaaatatggggtaagaacacccacctctcggggcttcagcgacaatgcctgcaggtaaagcacttctcatgcaacatgcatcttatgagtaaccatcattgattgttaacatctcttgagccagatcacatctagttatagtcccataagtgaagagcacaagaatgagatgtggttcatacgtaacagagcccttatacatagtaccgatgatggttgtgctccacaattttcccaaaatagcagagtcaccctcatccagactgtaggagctactcctaggacttcagagttgtcactgcctatgacgtaaatgtacactgaaggaaatgtacacagtatccttgactgtgaaggaatgggcttggcttgtttagtcagatgtttactagggtacatttattcctcagtttgtccccgagtctgatgaattttgattttctgttcttagaatgtggtaggacatatgccaactccctttctagagtctcatacagagaggaatttaggaaatgctttttttttgaacttcatatcaatctataatgtaatatattgttatttaaacataacatcttcactaaaacctaccgtaaggataaaagattacaaattcatcccagaacactttaaattatttacactttacagctttaaaatgtaaattttaaaggggaaaaaaaatcagatgacctttgacttcatctcctagtcactcacctggctgcttcaatttgatcttcaacttcaaatgttcccagtcttctgttgattgcatgcatgatcttatctccttggtaaccacttcctctgccatcaaagctagctactataatgttttctgtgcttgcaaggtaagtggcccagttcagtctgaagacagtgtctgctttttgactacatgggcctgcatacctatgaaaaataccaaattgttagctttcatggttttctggaatcaaatgaggaatgcttacatttctcttctccgtggagaagtatgcatccttcccaatcatgagccttaaactgtgccagcctatggggtgtccagaatgagtcctctaaaacttagcaacacaactaccatggttgtatatttccttcaaagatacttgtcagttttgtctttgaagatagttatcaaacacagacttcataggccaagattttagaagtattaatgtaatcttggaaatcaaagaaataatttctctaatagttaagaagggggagttgtggtataaaaaaaatgatgatgacaacaataaatgcagctttggatatctttccatctcagcttaacacaatactcctggactgcaagtttatttccttctttaaggactttgacttctgcatcatatgctttgcatttcccatagcacccggcacagtcttgctcacaatgactgtaaatcattgtggaatggactgcagtatgaatgaatgctaacatttaaaacttcagaggaagaaacaggttgcattggaaaacgggcatgtcattgggcattctatatactaacaagtttaactcccttgtatctgcaatcttcacaggctaccatctaccctacacagagctgtgtgcacaatctctgtaaagctctgtaaagcactctcatttctgcttgttaatcaagaggagctccttatagctcatctcaattcatttaaatatgtcatctttgcaccatctacacaactcctggacatggatactctccaataacttattccctccccagcccatctctccactcatctgcttactgtccctgcacaggataggacaagttctgcttacatgcctttgctaatgttttccttctacttagggaggtcagtcaaaagaactttcgttttaaacaaaacactataacattctaactttaaacaggaaaatgcattcatgcatttcttgagctagcaaatattttttcacatgtgaaatgccttgctcctctcaattatattaaatttggtagattaagagcttgccttaatattaggtatatatatcaagttccctaaccccaagattaaacaagattattttttaaaatagaaaaaaaaaaaagaccctaaaagagaggaaaaggaaaataactgaacagaaatatgtattaaatttaccattttttaaaaccttttctaatggagatcaaatcgttacttactaggaagtcaaagaagataaaaatatcactcaaaaggatgcttttttagcattggagccgaagcctaaaacaaattagtgtcacgaatgaattgacttcatttgttacaattattttacttgaaaagaaatcagataacacatctggaattttaaaatatgtatcttttcctttctttgtgcttttatgtgtggttttcatgaaactgtgaatatagtggatcaaagctgtgtctgatactaatatctgggtcctgccttcctctccccactttttttttctcgctggtaacaacagagacattatgtccctgaccttcaatgtctttttccgtataatggaacaacagaacttactatatgggtttgttgtgtgaataaaataaggcaaatgatgccaagcacctggcattcggcaggtccctgcactagtgttgtttcattttgtttttaatataggaaatgatgcaagccaggacaggaagagcctgacattatggcatcatgggtgacgctagggcaattttagaaaaattaaagtagggtgtattcctaatgattataaaaaatattttacaaagctgtcatatttggaattcatgtgagttcacattcactattcaaagacttgtgacttcctaactttctcaaagacttgaagtttttaatagcgaacgctctcctctatcacttctcttcaccaaaaaggggaatagaaaatagccggcagtaatatttcaggaactaaaggaagagaaacatgaggcagccagtgggagctggggtaagggaactgtcacgactgttaatgcccatctcttgcttgttaaaatgtccaggaggttaaggatgaaaatgcagacttaagaattcctttgaaattcccttggagttcagagaagcaaaacaaaagaaaatctatacaccattatgtcagaaaaggagtatctcccttctctattaagaagatgtgagaaaacacaggttgggttttgtggctgtacagtgaaaggaggaaatagtaaacagtgatccaggaagagggaaaggacgcatttggctccatttttcagtaagctgcactgagaaaaatatatatgactcaatacttctaaattgctcccttctcttgaatacttacacatctaatagtagaggatatttcttggatttatcaaaatgaggaggcaagatcatctgataccaaaattctaaacaaacagaaagattaattagtgaggtaagaaaaattattagcacaagattttgttcctcatgtccgtcagtagcaagtcatttctagagtttaacaatttgttaaatgagagtagaaaaggaaaatgaactgcttggattcagcacatttttaagatataacattttctttcaggttaaaatactagttaatgttaaaacataaagttgtttctaatgtatctattaaatacattggtgcctagtaacataaaagtgcatcttagaatttctaatgttttgtttttatgattctgttctttggcatccgatctacttatctagtttgtttatggcttatgttctaagttttcctccaaaatgttttcctcttcttgaatttccttgaagctgtttaggatttttagttggccccaactctattttagaattctgatttaataacatttttgtaattcttattgccatcccagaccgcaaagctgagttcccattttcagctctgtgtttcacagaatgagatcgggtttatatggagcaaactgttgcgtacattctgtatgatctcccacgggtctgtctcattctctgtgcttgatttaacatcagtttaataaaatttgtccctaaataatgagtcagtttccttcgttcccaaataaaagatgagttatactaatagatctataaaaaagtgtttttccacatttaaataaaattattccagattcagtagatttaaactgtaggcaaaaaaattcttatctctagagctatttttatctaacatttatcttcctttttgtttatgtttgttacgattattttacttgaaaagaaaagaaagatttgggagtaaaatatatagatagatttatcttcaatttatattttgctgactattgttatgccttctgattaaatgtgcttgtaagagcaaaatttaagtctctattataatttcaatagaacaccaaactatcagttgaccatgatatttttaatgaatatgcaaaacccatcatttgatctctgctttgtttgaattggcattagttgatgggaaggtgttttagtcccacttttttggagatgtatagtctttggtttggggggttctttctattcacagagtcccaccttcccggctccctcctccctgacctacctttcatccctcctttctgtactttgaatggctataaccacctccccatccccacagctccatcctacatcctgtctcaagtcacccgtctactaatgtggcttccgtgaccctaaaacctgcaggggctccccagtgttcatgactgaaatagaatgtcacatctcagtattcagtgccttctgtaccaggttgtcaatgttagctctggaaaactctaagctcttgcccctcacgtgtggctcaagggtaagcagcactagcatcacctagaagcttaatacaaatccagaaacctggaccttccttgacctgctgggtcagaatgtgcatcttaatataagatcccaggagactcacatgcacattcagtttgagtagcactgatgtaaactgtttttcacgaggatgctatactttcctgtgcttttcctgatatttaaaattagatgtgttgaatcttttctattatcctaaatttttttaaaagcctaaaatgaatcaatcctaatataacagattcctccctcccctataagctgttagcccttagtggaaaaaataaagaaaaacaaacaataaataacaagattttctactcaaagaaacccattgttcttactggtctctgaacataatccatgattacacaatcaagccgggaccacactatgggaggtcagcagggtttggaaaagttcaaaatttatcttctgagactgaagtttcaatattttatagccaacacgaattgttttatacaactatctcagatatccttgacctctttgggttaaaggtgaaatatgctaggatgtcattaagttaaacacacaattaatattagtagaataatagagtcactaatgggataaaagtgaactaacgatagagcatgttctccaaatcccttcctttttgacagaataagttttatgtagaatggtattatattttaagacaaaaggatgtaaaattagtatttcttgtgacaaaacatttcatggagaaataaccttttaaattagatttatatataatatgaaatacatattttcagatcgaattactatagttagagtgcattggtgtttccatgaaaagtactattccaaaggaatttaacttacttgtttcattcaaaataatgaagtccagttttttggagggcatctggacattctgcagcattttatccaaagctgaattgtcttccaggactctcagccctaaagaaatacaggagacagcagtcattcattacaatgtgaaaaatgtggattatgtagtgcaataatgagcaaacatgaaattcactgatcggactacacatacttcaggttataaggcttgtgttcaactcattgtcaagacacaaagccaaagaaaatcacacaatgctaagtacatgttagacttatgcaacacactttcttagaaacaaatgaagagtaaaatatgagaaaatacctttatcattcacgctgctgtgtagagtatagaggggcagaccaggacctgttaacacaatgggggaaaaatgttttggatgaatacttttttagaaaagatagtatagatgacttttcaaaaataccatttgttaccatttaactttgatagaatatataaatattataatgcataagaagtttaatacatgttagctgtttctcctccccctctctttaaaatagttgcaatttcagtgtaagaagtattactggaaaggcacagggctcagtagaatgaagtaggaaatgaatctgtgccctgctgggcaccttgggcacattatcatctctgaacttaatatactcatctgcaaagtaaaatgtgagctgacatccttccccactctaaatccgtgatcccacagggtttttcaggctctgcccaggtgggctgcagagccctgtagccagcctccctagggagggacagatctccccccgctgcccccactcccatggagtcccagagccaggcggcacatctgcacagtgcctgacttggataagcgattcctttctggcatgcaaaagtgtttttctcacaagcccatatcgtcactgtttatcccaactgtggtagttgcagagtggaaggtaatgtatagaaaagctattttgtgagctctttaattttatgtgtttggatgataatattaatttttatactggattagaaagagtgaaggcactttccatacctggggatgaatcctggctcactagctctgtgacttaggacaacagaactgtgctttgatttcctcacatagaaaatgaggataataatatctacttgatagagatttcttaaagattaaacaagatcatgaatataaagcttttagcacagtgcttagaataaagcgcatgcccaagaaataattgctaaaaaaaaaaagtcagtcatagtaaagaaccataaagaaaagcataataataaaatatactagtgagggaagactcagataactggtttgaaaacatttatttatttttgtgctatggacagttcttttcagaatatccagatcctttctcccattttgagaagtaacctggcacactgtttaaaagggatggctcgggcggcagaggcctgttttgaatcctgttgtgcctgtaactcgctgtgtgaccacctgcataagtcacttggccactccttgcctgggtttcttcatttgtaattaataatagcaacagcaacagaagatggagcagtgagcatgttgggtgacacgcaccagccacatacattttctcattgaaagggacgagtgcataaaataatcatttaaaaccccacaatatgtatgtatttaacgctgaagtgcttctgttatacacaagggtgtgtgtttgtgcatgtgtgagtgtgttcggtctaaggcaagctatgcaagtctctcagtgataaggggaagaaaagattgtttatgctcactacttaaatgtgagtggagagaaggggacttaggtgatttcaagagctcctcagattcaaaaggaatagagggagctgcttcgaagtgagtaacagcggcgactgccctccctcccagggagctcagacttaccggaacatctcagctgataatacttcgcctctttactgaatgacacagaatagtactgacacctttccggattcagctcacaactgaggcatgtcacttttgtatagtcactaagttggattctgtaaaaccaacggtggaaattaagtgcttgaagaaaagataagtgagaggaaggaactgaataaagccatattctagtttcaaagacagcagcatgccaacgcaatctttaggacttttttttttttagcatgaaataaatacatgaattaatagtaacctcaaaccttccattgtttggaaatatcacaaaacatcgaataaagccattctctcttgtggacatgtagattgatttatgaaggaataaaaagtgctcaatagcaataccagtttaatattagttaggacaaggcaaaaaataaaaatagagttcagaaattgttcgtcagctaaaatgactcaagtcaacaacttgacagagctcttacttataaagattccttcctcctggcattcctttatattcattactaatgtagtatctaggaagagaaaaaaatgaaatatatattaattatgttttttaagaagtcagaggcgatccaccgcactcagaccccaagcctaagtgtgcacggagcgcgcgcacgggtgcccgccgccctccgccatcgcttccgtgtccctcacccccgagaagccatttttctccgtcatctctacacataaaggtcttgttcttaacagactaaaatatgtaaaaccagagatttcttccttaattagagtgacaagtaaaaacacaaaagaaggcttctgtcaaaaaaaaaataggactaggcagctagcctgaaattgagaccccactcattgatcccgatcgttgtattttctgtcttataacataagctactagatggcaggagccccatgttcctgagagcagcagagccactgctaaagaggggcttcaaaagctacttcgggcggcggcaaaattcctccgcgattagaccaataaagaatcataaaagtgcctcagattctaatgaaaaataacacccccttttctaccaactcatatatggcagttagcctctgcaaagctttccattttgcaaagagtaaggccgggacatggacagataaaattgcctttccaagccttccaaaaaatcagtgccagctgaaatttaacaaaatgcccctcattgctagttcggcgttccacaacgttcatgtaaaagaggatacagctcttgtaatgtaaagcaggtaagagcaagaggtagagctgcctggtggcatggtatcaaatctgctaagcatatgtgaaaatcattaaggcttccgtatgttaaaaagaaaaaaagtattgaacacattccaaaaagactactctttatttgtaggagattttttccctacttctgggcaaagagggcatgattatgacaagtaggtttatatcctatcaattgttacaatactcacagataatcactggttagagcttctatcccgatgacttcccaggtgccttttgtaataaatgtgcagtcctgatggttttttttttttttcaaaaaaaaaaaaaagattgattagagactctctctgttcaaagtggaggattaaatcatttatatcaggaattcaaataaccttggattttcttgttgggtttccccacctcgttccacatgacacaatacaccactgaggagtttaaattaatctgatttttatacacattgatccaccttaccaaatgatttccacttcaagttggtttccaaaaaaaaaaaagaggtcaacatgaaataaaatatgtaagaatactcacttttttatctatttggaaatagcaaatgtgtctgtaaccttcttcattgctgatgatcttgtagaagctattaccatcaagggtaaaatgaggttctgaaggcctaaactagaaaataatagagaacaaaagaacattaaagcacagtgtctcatctcagtaccaactttagttttagaaagtcctgtccaatacctacgctcaaaaatccatgctccatttatatgccaaattaaaattagtgtctcaaaaagaaaattatctttctataaaatgtgaacaaaaacaccatactcataggtaattttcgtgagcagtaaatgagagaatgtatataaagaggcttgtagaaaacaataaatagaagttgttgtgatttggagacatcttttctctatggatgataactatgacttctggctgcaagcacctggaaaatagcattaacctttcagtttggagcagtaaatttcctcagtgtcacaaatgtgctctcttgaaacagacatattattttatattgtttcaggttgggggtggtttgcaatttggggatatttttctttcctgtttttacacatatttctttttgaaactcagacttagtatttaaccatttctggactacatactataaggaatgtctgttgtatatttcatatgaaaacattcatatagttattattataagccttttcattttgttaaatatgatcaacaatttacaaaaaatatttgtatagaaatatagaacaaatttccatttttttacagttcaataaaagatagtactcagaacataatgcagtttaagtagaagagagtctatcccagcctgaaaggaatatgttggtttacgattttgatttcctagctacatttgagagcaggtaggagatggtcttttaaaattgttggttcacttcgccctcgatgtttcctctctcatcagctcccattttgggaaggaagaaaaatgcttccctcttctatttagtgattcaaagcgaattcatttatggagcaagctgaggcgtgcggtacacttggtgttctcattacagagctttgaaacacattcccctctctagacctgtgttcacagccttatctttttaatacatttccctgtttcccctggatggagttgtgcctagtagaaatgtgtgaaaagtggcatctgtctggttaaatacagagaggaaaaaacatatttttttcaaagagtcgtgaggaagtgtagcgtgtctcttgccatggaggaaaccacttttcatgttggcaaacctctcccctctgcccaatcaatgcctgaagaaaaaggacgtgtgaatgctgccggagctctgagcccagctagaaggggttgtcttcttggactggggacctcacctctatgatccaagaggtataaaatctttacattttgggggtcactttatttccctcttaaagggggcttaatagaagtgatcataaaaattaagtgagattcattcctcatctaccatgcaaggtgacatgatgactggagttccttcatcaactcattacattctatggccatagcaatctgggtggtaattctgtgcaatgtgtatataactcagtgggactgagaagcatgacaagtccctgagggtcaccacactttcctggataaagctctgcatctggacgcctaataaagcataagcctgcaagtatgatttcctccaaagagaggtgcatagtgggcactgtgtggttgctgctgagtttttctgcttgttatagtgacctctccttaggtaactgtgcaggctggggacagaacctgtgttttctgtctttaaagcacataacttcaaatgtgaggtcactggataccttggccaactttcagccatggttaccctttaacttgctgggagttacaacttgccaggagtgcgctatgttttgtctgctctgcttttgatttttcacttgtccccttactttttccaactgtgtgtgttatatattctctacaaaaagatatctttatagggagcatttacatattttgagaaataggttaactaatattgctattaataacgtatcacttagagccctagttttaaatagctgcatatcaaatagctgagtagctgactcatccataaaaccccacaacttataacacttactcttccaacccagccagtagtactcatttcaatgtgttgccgtgcctaggaagggaaagagacaatgacagcatttcaaagagaagtcagatgaaatctatagccataatttgtggtaatataaatagagctgtacttataataactgagagctatctccattcatatatttctatttatgttagtatttttcaagtcattacattagatcatttgactctcttgcctaaagttatatcctgggtccttctggaagctccactggtgttttaaatccagcatgcacaaaactaaagagaatttcatttgttttcctctgtcccaccagcctgttctactccctcattcttcttctagttagtggcacctattcacccaagccagagacctgggggtcattctagattcctgccctcctcataatcacctccttcagcccctgtcacctagttctttgacttctctgtccttctctacagctaagggctttgttcatgtcctcagcaggttgcccagggtctgttgccagaatctccttgttggagatcctgctgctcttctctgctgaccttagttagcaatagataggcctgtcccattgtgatagtcttttctttaaaaccttgaaacaactccccatttcttacgagataagtccaaactccaggaatggcacctgagcctttgcctatatctctagcctcattgctccccactacacctctcccccagtccctagttcctgcatgttccaagctattcacactggatgcctttgcacagccctctgcttctatggcgttctgtccttatctgctcagcacacggcaacttaccccaggctactctatagctctcccacatcatctccttccccagtctgcctgcccttagtagagctgatcatcttcttttgcactctattccctctgtaccttggttgaaccctttttagggtacaatgaggtattatgaggatttcattggcagcaagcaaagagcttgggttttgcagtttgaattctgactgtgccctgtgacctgcgctagctcctcaaacgttgatcctcagcttccacagtgacttgtataccataagtggcagcttttattatttactttgataatattcccaactagaacagaaacattttgggggcaggcatgctgactaattcactttttaaaaaaatccatagcttagcacagagcttggaacataacaggaattccatgtttgttacataaattaataagtgaatcaagttatgtgaggctccaggtctgggaggtgagagtctgccctgagcctagccaggatgagagcagggatggtaggtgtgtaggcagagggtctgtgactagataagggggattggggaggtatccttggcatatgccagcaaacctcttccaggatccacccctcccaggctgcaggctcccagagggactttaactttgaccgtcatcctagttggacctcatggtctcctggctagaagcctcccagcacctcaaggttggatgaacagagttggcctcaggattgccaccctctcagactggcagttatttatttccattctaaagctgtttcctgcttaaagacagtgacagtatggtaatgggtttgtggcctcatgtatttgttttgtttcacacacactcagccagttattccccattccctacattatctttattaaaacacactctgttgagcttgcaggtgctggccctctttggtttttaaaatatttacatcagattctatcttgtggtcagtcaccccctctccacttcccaagtgatagtatccataactaaaacagtatgactagtcagtgtaggagaaatagaagcacctcgggatggcaggttatctaggagttttattcaagattttattgcctcaggatcagacagagtcagaaagaagagaaactcaaacttcatttcctgattcccagccttcactctccccaactgcacagaccctctgatcacatgttgctctagaagcagaacatccccattcagtctcaccactaagcagttccatcttccactggattcatcatagtcacaaatatccatgaccgaatagttctgaatcctcctgagccactgcaaagaaattctttcttgtgttgcccatgtcacatcacacaagtagtgatccctggaaggaagaaagaaaggaaggacagagagagagaatgaacatgactattgccagaccttggtacaaatagacattttactcagtgaaaagaaatcaatcttaatgggaagtagaattataaatggttaatgaaaccatttaatataatatttcaccttttcttaaagcttaaagtgtaatttaatttggaatgaaaattaaaatatatccaacaggaaaagcagcaacaatattctacagtggcttaacatgcgtgactcaaaccacgagctcaggatttatcaagtcttcagcttggcctttggtaatgccagggagtcaagggtaatgttttcgcatctcctttctgctgtcttgagggaagtgaggccacagacactggctaagatttgactgtttcttgtattttacatgcttctccagaaaattctttctattagggtgaaactacagctaacccttttctcaacttcattttcaaaggggaaaaaattgactcacacctccagaaactttgaaaatcaaagaaatatattctaaaaagacatttctcaagagtcaaaacatgaactctgcaaagaaatgaaaaaaccctgtggtattttcacataaatttatgtaaacagaggtatctctagtagtgcatcctccccaacacatacttaaaaaatttttggaaccaccttctgatttatagtgaagtgcatggaattcattgtttacttttctgctggcctccctcacattattggcaatggatagtttatgctttttctccctcctcctccccgattgtggttttggattactattcacaaatccctgctctcgagtgtctgattgcagccttgctcttttttgtcagagagttccaaatgagtgtgttcatctccctcttcccgcctggtctggtggctgtatctcctccccatcccaaatgctctcacacaatccacttgccctctccttcacaggctggacctgcccctctccttgcttgactgcaagctcttttacagggtgtccccagggcctagcagaatgcctgactcaacacaggcactaattatatgtccgtggaatgcagcacagaagaaagcaaagccctctcctcacctgtgggacctgtcatattgtcatactgaaggaccatagctttgtccttcttcagaattcatagatcaatttccatctccactcccttcgcagacacctaatcacacaacagacatttactgggcactcgggatggattaggtgctggataaagccctttaagcccctcacagcttcatcatccccattttacagctgggaacacttaatgtgcgaatgtgcctggtgataccgggcttccatgctaccctgctgtaaggcgcaggtactgaaacaggaccgaaccccttcactcagccgcagagcactgcatttctgtaaattggggtcccttttcacttcagtccttttacttgcttctgaagaaactatatactacctagtctgggtggctggtattctcaggaacacaccatgagtttccccagttgccccctctttgttcagtcttgctctttagcctgaagtggctgccaagctctaacttccttaggtcttggcctaaatgtcccctcatccacgatgtcttcttggaaacctccttctcccacaccactctgccaggtctcattgcactcatcacaaaccgccaggctgcaggggctgagagtgcaactgccactttccatgccgggaaacagagacatctcatccagtctgacgcttctgcatctgcccaatgcaggggagctaaatgagaacctggaaaggtgaatacactttacccaagaaaggcaataaatctgtgcaaagagaatggaagtatgaaaagcacaacagaaaaatgaagctttctgaaattagttttttagaccagacgttggaaaactttttcaattaagggtcagagagttaagtattttaagcattgtggtccacatctctgtcactactccactctgcctttgtagcacaaatgtagccagagaccataattaaatgaatgagttcatttaatattccactgaaaagctaaaatttgaatttcattaaactttcatgtataatgaaatattattactcttttgatttttgttcccaaccacttaaaaatgtaaaacctgggcagatcacctgaggtcaggagttcaagaccagcctgaccaacatggcaaaaccctgactctactaaaaatgcaaaaattagccaggtgtggtggcacacacctgtaatcccagctactcaggaggctgaggcaggagaattgcttgaacccgggagacggaggttgtgatgagccaagatcaagccgctgcactctagcctgggtgagagtgagactcggtctcaaaaaaaaaaaaaaagtaaaaaccattcttacttgtggaccacacagaaatgggcagtggactgcatttggcccataaaccctagtgtgttaacccctgtcctgtatcagtggttactattttttcaggccaaaaaccatttggacaatctgatgaaactgatgtacctctctctaggtgggaaaagcctctccactgacatacatacaacatctgaaaattccatgggcatagattaggaatttgggctccagcaatattcttctttttaaaagtgctctggtagagcgaaggggtatgtgatggggggaacaactttttgacaataattagtggatcacccagtactaaatagctttatctattaacagtcataaattaaacatcaggttcagaaatcagcaatataaaagcaacctttccccatttgaaaacattgagtaatggaatttgggaagtcagccaggaaactcacgtgcatcagtcatcttccctgcccattttcagatcaaaggtttatggtcctggactctgcatggcctgggttactctccatgaccccaggtgtactctgcaccctgtgcatgctcagcaaggcagttcacccgtggcgcagacaggaatttttgaattttcttataaacatacttcccttcagtggcagccttgagccaagattatgccagtctgagatgtcaaagaatcatttaaaaaaaaaaaaaacaaaaaactgccaggtgcagtgactcatgcctgtaatagcagcattttgggaggccaacacaggtggatcatttgaggccaggagttcgagaccagcttggccagcatggtgataccctgtgtctactaaaaatacaaaaattagtcaggcatggtggggcgcatctgtaatcccagctactcgggaggctgaggcaggagaactaattgaaccgggcagacagaggttgcattgagccgagatcatgccattgcactccagcctgggtgacagagtaagaccccatctcaaaataaataaataaagccaatggctcaattgtactttttactgaaaagtttaagtcccacttaaaaccagaaaaatccaaccagcaggattatcatctatgctttgcatactgcatgctgcttttattctgcaaaaacaggccaatactgagtagctttcttatgtaatggttttggtggggtagaagagggaccacccctgcagtccaggccttcctgagagcctggacaacttacccaggttagacatatgagccagcaagctcttctaccttctgcagctggattagtccaacgggaatatggttgattttaatactaaaatgacggagtaatttctggatgtaaaataataagttcacacccatgtggagtctactatgtgccaggaactattctaagtgcttgacataagctcatgaccaccctatgaggtgagtactgcagatcatgctctgcagacaaagaaacttaacagcagaggatttaagtaacttgcccactatcgcccaactgggaagtgttggagccgggattcaattcaagctgttggcttcagattcccagttcatactcgctccctctatgaaacctccacccatccatttggaaaatgttgctagctagcttcaccttcttgtttcttttcagcataaagttcctcacttaaagaaatctattcctagagagcttgtgtgtaaactaaattaattttataaggcaaattatatgtgaatgcactgagagagacttgttgaaaatcacacaacagagaatccccttgtaaagtgaccacctgtcccagcataatgccttgcaaacagtaagcatttaataaatgtttgttgggtaatattaattcccttaatttgtgtaaatgtttcttttggtacattaaggatacttaaaataaggtatttatcatcaactggaaatcatattggagggaaaaatgctacaaagagcaactgcaaccgtggaatgattaattcagtgaatcacccgaggaagcgggcatactgccagtgctggcctcaggctccatgccaccctctgctctgatggggatgccaaccctcccaggttcgctgacaaatccctcaggagaggaatgggtgggatgagatgaagcagatctgagggctgcagcacccgtacacccgcacagtcgtagcatgcaggtcctaatgtgcagatgtcactagcttccagtttatttatatcctgtgtgacaatctgaggctttgatgttgcagctttataggccaggggtcgtaacagttcagagaagacacagcaagactttatatctattgtgtcatccaggagcagagagagcagggatggggtatgtcatgagctgggtgtgatgagccccagagccattcaacagatgttgggtggggttactacagtagaacatgccctttccaatcccctagattcaggccacagaatttttggcagagaggagataaaaggagggatttctatgcaaggtcattttgaagtctatccatagtgctggcagcgtgaaccactattctatacacacaaagccatctagataacttactcatccattcatccatccacccatccatccatcctctgcttatctattagtttattctacaaatattggttgggcatatgctatgtcgcaggcaccctactacacactggagatacgattgcaggattggcctctactgcgtagaacctgtcttacttcagtcaacaatgaatgtactgctctagataaaagttaggagatttatgattttacattatgtgctgttttccttcaaatttttgagctttccagttctcattatgaacaacgaacacaaaatagcatcataacaaatctaatcaactttagcactaaatcaatgcaggcagcagggagactcaccctggttcaagttcaggccttagttgttggaaacgcagcctggctgcccttctcacttatcagagaagcagggcttccacccatttctgctaattcctaacaaagtcacaaaccagcctcatcctcctgtggatttcacttgctgcaggctctgtggtgaagggatatggcctaacaggaaaactaatgagggtaacatgggcagaggaaggagaggcactgatcctggccaggcttcccactccaggaactagtaaatcaccaggtaacaggctgagcaggttactaagaggcgtaactcacctggttttgcttggccctgctggatctttgcatgaggccagaaaacggtgtatcatcatgtactagagcatttttcccagagagcatctagagtctagttctagaaaaaccgcaaccttaccagtgttaacagagaccagagctatattttaaccgcaaccttaccagcgttaacagagaccagagctatattttaaactccctaaaaaacacattcctgtggcatttccaaaaaaacaatattctttggtaatatacattccacacaaaatctccatagtgagtcttaagtgtgacttaaagaactactgagaacaagaacttattgacgaattcacataaggccaaaaatccgtcctgagaattgcttgtttcttgagcccagcacttcacacagctgtgccttggaaacggatctgtaagtgggaaagacttcgtctctttggggaataaatgagacagcaagagcagagcactgagcacagtcccagcccatgagaaggactcaatacatttttaactaacttattcaaatattttggtccagcaggcataggccttggtcctattcccaccttccacactaacttgctgtgtgaccttgagcaaatgactttacctctctgagcctcggttctctcacctgtacctcacagcggtgttgtgactgtgtcctggaaccactccaggttctgtctaagctcccaggactattgcgggaaggagggaggacaaggactagacctgccaaaactgagaagcaatctcccatttgctttctggccatacacttctatattatatctcacttgaacaaaggtttccaggtccttaaaaagtttataaaccattgataagttctaaagcccctttccgatggaatctttttcagagcaggtgctcatggctcatcctccctacaggcagatattggtgacagaccaaaaggccacaccaggctctgctggtcttctcctgggaagcactgacttttccatactctgttttttccgcctcagtgtccttcctcctcactgcaccctgctggaagccaacctgctcaatctgcacattctccagggggtattttttgttcctggggtcgtgaaaaccccatgttctcctcctcagaatgcctccattctattgctcgtatctctcttatcactcctgggggcatttatctgaatgttttctatcatctactgatgataagcgctacaagggcacaggctttctatggacatttgggagtagaaacagaggctgcccatcaatgatgatgattaaaggtggctggatggaatcgaaaggcagactttgaaacctttgggtaaatttttactccattggacaaacccagaaacatttttaaaaacttactaatcgattttccccctgaatgaatgggttactacagacatttctaaccaaaataatgaattactaaccacggagcacagcccacagccttcctgatgtacttaatgcaactccagagaaaatggatgcttccgtactgctgtgatggtgccttcaggaatctgagggcaccagctgtaatcacacagagggagacacgaagcagtatctaatagcttgttcgttcaagccagaaagtcaggtttgaatatagattcgtacttggtcattttcttaatctgtaggcctcattttcttatctgtgaacaggcacacgatgacagttgttggaaagacagactgactttaaagagtcctaagataaagcatgtgataatccctgtgtctggtacatggtgagtactcaatgtatgctagttgttatttaaaaacagcaacaggccgggctcagtggctctcgcctgtaatcccagcactttgggaggccaaggcgggcagatcatgagtcaggagttcgagaccagcctgaccaacatggtgaaacctcatctctactaaaaatacaaaaattagccaggcatgcacctgtaatcccagctgtactcaggaggctgaggcaggagaatcgcttgaacctgggaggcagaggttgcagtgagccgagatggcatcactgcactctagcctgggcgacagagcaagactctgtctcaaaaaaacaaacaaacaacaacaacaacaacaaaaaaaaaaacagcaacaaaaccaaataaataacagaaatgagtaaatatggagctatcagagagccgtaaattgtacccagtatgttggttcctttacaggaaaataaacaaggggctgaaggtgctccatggcggaatttcaaaccactgacatgatttcaggaagtgaagtcttggagcacaaaatgaccgtggagctccctaaacttaatccacagatttcctgcatttctctaggccttacaaggctctttgggacctgaccttgtcccttccactctcttcttcagtcaaaaggctccagtcaccccaacctccttgcatttcctccaacaccccaagcacatctcctctgcagggcctttgcacttgctcttcctctgccccctgctattggtgtggatggagccctcctgctcttcacatcactgccacagttcattttatccatgaggattccctgacctcccctcatcggccccatccattttgctctgctcaggttttcttcaccacatttattgctacctggcatattacactgctctttttttatctggttattgtctgtctcccccaatttgaatgtaggctccataacaccaggggctggctgctctgtccattgtcatcctcatctctagagttgtgcccagcctgaggacgtgaagatgctcaacaaagagttgctgaaggaaagaatgaatgactgtcagcggggatgacacagtgggaggctgtgatccactttgccattcacttttgaaaagttctccctagaaagtgtaaaactgtttacaagccaagcattcaggacaagagtcttaccctatcaacatagaagcaggagcagtgatttgtatggaagttgcattggtgactgagctgagagagtctgtatttacaacaaagaactttacagttggattcacagctcctgcctaggaaaaaataatcacagaattggtattgacaaaaaaaaaaaagtaacatcgttgcacacattttaaaactgcacaaaaacgtctgcattatggtcataaaattatcacaatcagacatgttccaacaatttaatatacataaaatgaacataagggagagtcatgaaatgcaaccttttcatggtcaggcagaaacagaatatgtgtatatatatatatatatatatatatatatatacacactatataaaacttgaaggtccaaagcacttctgtttaaataatgaatgtttatatctttataatttatcactttgtgcaagcaaggataaacctcttaaaatcaactttattatttgcaaatataccctgtctccctgagaccaaaagtctttgatgcctgtcagtatgaagaacaccttgggttctgccaaagacaccatccaccagaaaaatcagtttacctgagtcaacggtgtcaattaggaagccatcatttccactctaaattcaggttcactatgttggagctttacaatcaatattatgactgaaacctataaaacctttttaaatatacacatagatcttcgattgacagattagttagaaataatatgatatttttagtgagaacactttatggagttttttttgtatgtgccagtttcgctcatcaaaaaataacattccactgaaaacacatctccatatttagtctctgatctttttttttcttttaacttcctctgtcttcctaaaatggcagctcttcataaagcaaattgagtgagttggtaaaaataaaaatccccttttccaaatttcttacagaaaaaacactttactattagattctcctgcagacaatactgtagccattattattacggtactagtgaagaattcctggttcccttctaaaccccatctcacccggcttacgctgcttaacaaagctcctcaattttagtaaacacgcaaccctgacgaggagaacagctttgaaaaccaagacgtgacactattattccaaatgtaggacatgaaaaatttacattagtgccaaatctataatagaaccactaaaactagtcatgtatcccgttaactagtaatacaatctgatatataactgagctttgcaacttcgtcgagggcacaatccaacttctacaaatgagacgagcttctaattcaattatagcctctcttttcctccattcaagcattttcattccccttatctctttctaaagcattttccccattttttctgcttgtcattcctcaaagtttttggagaaattacaaaaccttaaatcacactctttcctgggataataaaaatactttaaaattgccagatgctgttgacttcagcaagagtaatcacagcaagctgttgaagagagactgacaatattttcattagcaagaagggattaaatgaaaccattctcttcccatcaaatcatggaaccactgtacaaacaggagcacagacctttggatatggaacccgtacagtctttgggtactgcagtgactcatcagagtagaaggagtattcaataagtgggacttctgtgtcgttaaattgggcatatgctaaaaaagtgccgtttggagaccaccacagagcagagtaggcactgaagacttcctctgaaaaaagacacaaattgttctgttacaagaagtagctgataaattggctttggcattcaaaatattgttctcattagctttagtaattacagtagagttcaactaatgaaccactttgcatttgctgggcttccaaaatcagagtaatacaaatgaataaaaataaaatcttcaaggatatatctggattgtaaaaataagtaacccgttggaccattttagaatattttagcatgcaatatttaatataagctctacatttttttctttatcttataatcctctaaatttatgcctcaaaacatactaaaagtaaatttcacacaggaggctgattctcctttctaattttcaaacagtcaacatgccagcatactctccccaactgggctcagtttgtactgagcccgcagggtactggtgggtggtgtgtagctccaggctatcaaaccaatatggtgcccagagtttactactcttggcacaaacaaggtgtgggaaggatagatttagaatggcaaggaactccattgagacccctactgagaaacatctccttgcccagcccagaaactgaaaactcccttagattaacacactgctctggtgtatatgctgatgggtaagagaagagggtcaaagagggaggcaaataaaagaccagatcttgctttccagtacattgtcgggcttcttctcaatctctggcaaagatagctcttccctatgattattatggggtctatacatgagatattcaatcactggctcttaatatgttgaaaactccttcaccaaccgggaatggaggaattaagtggactgggtggagacgcctagatattccacaagtctcatgtaagtgtaaatgtaaaagcaaaagcatagaaactagaatcttagggttgggaaatcatgcattctaatcagttttcagatgcctgatacctcctttcaagttacttccaaatgctttttttcaacaacaagaataatagcaaaaataattactgtaataaaatgtaataataattattgtgatgagcagctgacattcaatgagtgctaactatgcgccaggtattgataagcaattgacatctatcatctcagttaaggctcacaataacccattgtattgataaagtgagacaagcttgaagaggatcagaaatttgtctaggatcacatggctaagaattggtagaatcaaaaaccaacccaaatctcctttgactcatgcttttcatctcagtgctatactgccctttcctgcctctattttagtatttccagtaatagaaaacctacttccgggttaagcagcctattcttcctttgactgcctcatatctatatcactgatctatacactcttatgtagcaatttagaatttacaaaacatatcatatttagtctctgggtggtgattcatagctcattgcacaaagaaggaaactgaggcatggagcaatccagtgaattgcctgagacaagaactagaacccagcccttatgactccaagtcatggtttctattatagtaagaacttgttcatatactgagttgacttctcattctttgcaacttttacccattgattctggtctataacacagctgcaattacataaaatcaatataatcagaccaagattttgttttttagaattacttgtaagtgtaattagcaggtagtgatgtttgtcttgaattagtggttatttggaatgcaggacatatttttctgtattgacaatgtagtaatttccttctaggaactgaagctattagagaggcccaaattggagctgtgaagctgttctgcatgtgaatggcctagtcgtgaacatgcaaaagactccctccagcaattatctactttagaaagaatgaaagtgttagctgccctcttatcttccagagggccagctgtttctgagagagggtcacagctttggaaagaggccactcttgtcaaggatcctggaggctgggttgtgctgtccaagggttaaagaatctctaagtagctagtgctagtaaatttcattgtaagttttagtcaagcacttatttctaggacatgaaaagttatctttcttttaatgtgatttgttgttgttgttataatgagtcaactaaacttgacttggacttggtaagaactaaaattaagtcatgaagaaaaattatttttttaaactacaaagaagaaaaaaataatacgatgaaatacagataagtctttctaataagtatgaggaaaccttgtgaacagtttggagcagcctcaaaatgccttttatcttggcaaatacagacacaaaaaatgtttttctaatattttctaagtttctaaaatgtgttcctaatagtttcgacaactctgtatcctaaaagggagaatattcctttttaacttttttagttttattagtcactttttcctaagcctttctaattgcttttttattcttaaaaacaggaaatcataatttgtccaagttcaaataaatacaaatcctctataaaataggcattttcttcccctgtactctccaacctgtatatattattttatcatcttctcaatgtgatgggattatttagctttccttagtaactttcgggttaggtaggcttaattagagaaatatctgatgttaatctggaggcttttatgttccagtaaaggcagaaaaggtctacctacacagaaaagccctttgtatcaatataacagagacaagaggagtattgtcaggcaatgaggacagaggagtgctaggaatagttaaattcttggtcaaggagacatctggtgctgtgagttctaagagaaatctgatgacattttaaacaatgaaactttttttcaatctcatttaaattttcccattgcaaaagaaacatttaactattttaaaagcttatagattttctgatttgaaaaagctttaaagtttctaccttcataaacccagtcagttattccattatatattatatcttctttccccgtccatgtgattctgtaacttggtaaatttggttcaattttaacataaatgtcattgttccaaacatatgcctagaaggaaaaaaaacaagcattgatatctataatacatgtcatatttttatcccggaattgtagaaacacttatctattgcaaatgtaaggattaccatagtcaaatattccattcaaacaggaagagtcatttactccttccctctcattcttaaattacaagtgtacagcctataatcccaaaataatcctaaaaccattaataatgtgttaaaaatgagaagtacataactaccactatttgaatgctaaagtatatgagaagaccgagaaggctgaccacttctacaggatgatatatgcttgtatatttctttattgggagagtgagtagagagaaggcagttgcattctggaagagagaagttcagctgcagacaaacattagatcctgggcaataacactatgttctatagtgaagtattgagttcctaagatgtctgctttgtatcagggttagtaacttctgcctatgaaaaatttgagcctatatttttctgacaactggagagactcactaaccaatttatgacccactggtgaccatgtgacccactgtgtgttgtttggaatcctctcttctgtaatcagctgcctggaaaaaagatgaaaggaaatattatcaaaaagaataactcacattggggtttccttaaaaatatgacagtaggaaagcctaatagattttattgggaagtcactgaccttttatttaaatcataaatgtcatatgaagctgtgtaggaatgcctccattgctatgaaagaaaacagacatttcaggcttctgtgatacttgataatttggccactcactataggagaccaagatgataggtttggtaatatatgattgtataattctcacatgttatcatatcttataatttcctccgagaattttgggattcagaagtatcctagagatcatctcatacaaactcctctggagttcatctacaacctagctctggcaccacctcctccaggaccacagtgcaccaaaaatgtcattttgtacaaacattatccctagcactcaccatagtgtgctaagattgcctacttagaaaaatgtaaattttcacttttcacctactttattggcaaaagatttaaacgatatatgatgctattgctgatggtgatgtgaagaaatgtttaacttcatacactgatgatgaaaggtaaagtgttataaagtttttggaagccccctggcaagatatattaaaattaaaatacatatatcatcaatattttaacaaccatctcaaaaagctagaaatgaaagtcaaattttcagtgactgcagaagcatagggaaataaaatttttttttaaaaaggaagtcaaactaaatccaaagtaattagaagaaatgaaataataaaggtaaaagcattgataaagtagaaaacacataatagaaaaaatcaacaaagccaaaactcaagtcatcgaaaagactagtaaaattgcaaacatagtaaaacttaggagtaaaacagcacaaatgactggtatcagaaaggaaaaatgggatatcacaacagactccacagatgttaaaagatcataagaggctattataaacatttttttgccaatacattttaaaaattagagaaaagcaaaaaatttcttgaaaaataatttcttaaaagtgagaaaaattctgaatagtcttatatctaataaacaaattgaatccagatataagaaactttacatagagaaaactccaaggcaaaataactttaccagcaaacttcttgttatttattcaaatgagttgagaatttatgcccacacaaaaatctacacacaaatgtttatagcagctttattcataactgccaaaactgggaggcaactaagatgtcattcaacaggtgagtggataaacaaactgtagtagagatccatacaatggaatcttatttaatgataagaagaatgagctattaagccacaaaaagacatggaggaatctcaaacacatattgctaagtgaaataagccaatgtggtaaggttacatattgtatgattccaacaatatgagtttctggaaaaggtaaaactatggagagagtaaagagattggtggttgcttggagactgggggaaggaagggatgaatgggggaaacacagggatttttagcacagtcaaagtcatctgtataatactataatggtgaaacatgtcatcatacttttgtcaagagccatagatttgtcagaatccaccataatggtagatacatgccatatatttgccaaaacccacaaagagttaagcctaatgtaaactatggacttaaattaataatgatatattaatattggctcatttgttataacaaatggaccacactcatgcaagacattaataataggggaaagtgggggagggaggataagggagtatatgggaactctctgcttattttctataaacctaaagctgttctgaaaaataaagtgatattaattaaaaaaaaatgaatcagagctaaccagatgacttgaaaggagtttcacatggtatcattgagtgagaaatgcaatttacaaaaaactataggattttatttttatagaccaagcaataactaaaaacatccctatatattttcagagttatatgaacaagaagaaaaatataaaaatatggaaagatacatattagactttagagagccaagtgaagaagggaagaaataagaccgaagataaaaatgtatatgatcacatatttgcatttatgaaatattatgtctgaatatagatgcatataaaaattaaaggtattttcaaataagttacttgtctatacgtctgccttctttaccatactcctagaggtaagaaattgtatcttatttatctttggatgcctggagtctattctagtgcaagccacatagtgagtgttcaagaaatacaacaaattacaataaaattctaattgtatcaatgaggatgagacggatgaaataggtatcccaaggacacctagctatataatagcagagctgagatacaaagtcagagttcctaaccttaactatttatcacttctctcccttctatgctctcatgtcaacaaatatttattaaattctacttttcgggagtcatacattcctttcttgaatcctggattattttgacacaccccatgcttgtttctgggcaacctcaagcaaaatattcactaaagccaaaaggtgtggtaccagctaaaactattaagatggattgagatcactgagcatgacaaaccaccatgggttgtaaaagaaaacccatgatgtttggtatgttcacttcatcttttgaaacagattcattattctatttagtttataaacactggcagctatcatctatcagacattactggataacacagagtccctcccctggagcagcttatagtggaatggaggatatgcaatagtaaatgacaataaaataatcacaataggatgtgccaagagatataatggaggtgggtgggagaggcaggaatcataaattaggccttggggaggcagagaggattatggaaaagatgattctttggctgaggttagtgacagagggtgactgggaaagagtaaaagagcatcatagcaaagagaagccgaatgcaaagataggaaagatcacatttaagagcaaaggctttggagtcttctaacctggattcaggctttcactgtgtaacatgaagcaagtttctttctaagcttccattttctttttagacaaatgaggataatgccggcaacaatctcagatgcatgagaatgcatgagaagcacttagcagggttctggaacattgtcaacatagaatcgatgacacaactattatctctatttccagagcactaggcaatgagcagagatgctaggagaacattcataccagactgtgggggtacttatccactcactcactcacttgctcatttatttatttgtagccacaacttggaagtgatagcactaactcagtcatggagaagtcacatagtaggatctaaaaaacactaaaaggtagacctccaaggaaatgtaatcaaattagacttttcttttttctagatacatttcataagagtcacttagtcaaaacgtatatgctgtacagaaaattctactggactctcttgaaagtaaaaaaaaaaaaagaaagaaaagtagtagaagatatagatccttagtttcaatagctttataatttagcactttgcaataaaacatgtattcatttaacaatgatgttcagcatctgctatgtggccctgtcctaggcacagaggtgtggcagtgaataaatcacagggaaactggcaccaaataaggcaggcaaaaaataagcaaagaaatcaatgacaaaatatcacaaaatgttgtgatgaaactaaaatgggttaacgtgacagagactgatttgtggggtgtgggtggaagagcatggcaggggacaatgtttgacaaagtgacccaagaaatctggacctgagttaatagagagaagcatatgatgatggagaagcttccatgaggaagcaatagcaagtgattttgcctttagatgggaatgagggtgatgcttgagaaaaagaaagagctgtgcaattaaaggttctcaactcagcatcatggaatctccaggaggcccacagctatgctgagttagttgctttagggtaggccacagatatccgtgttttttcaaaagctcctcaagtgatcctaaggtgcagatgagacgagaagctctggccaagcatgccgagtgcaggagaagcgggtaggagatgtgttcagccgggcagactgtgttcaatcacacaggcctcaggatgccagggttagagctggtgttttattttgagtgtgatgggaaggcactgtaggtggcataggtgtggcataaactaatttagaatttaaaagtagtactttcgatactgtctgaagcatagatggcagggggaaggggacagagtgaaaaaagcaaaagcagttaaatacacgggtaaactccagtgacacaacaaatacaaatctccaaccgtggctggccaactaagggccaccaggggaatacacgcattcgtgcacatcaaatggcttttgttgaacctggctatatagtaaggtgagctggtattacctttctgtttctaccttaccttcatatgttagtctttaacatggacaactgttattcaggggttctcagccctggttgccattacaatcacctatgacagtttaaaatatactgaggctcatcaggcacagtggctcatgcctgtaatcctagcacttggggaaactgaggtgggagaatcgtttgaggacaggagtttgagaccagcctggggaacacagtgagaccctatttctaagaaaaaattgaaaattagcagggcatggtggtgcacacctgtagtctcagctactcaggaggctgaggtaggaggattagtcaagcccaaaatgttgaggctgcagtgagccatgatcataccactgcactctagcctgggtgacagaatgagaccttgtctcaaaaaaagaaaaaaagatactgattctggctttaccccagaaacctctgtttactgatctggggattgaacctggacactgggaagttttaaaagtttctcaagtaaattaagtgaatgtattctatagatagaaataagaagcacttaattaaacaaacaataatccattaattggcaacagatgtgtcaaagttggtacaagattccgattcacttacagttaattttaacagaacatagagtcttcatgtccaggagagtgagcccagcccagcaaatccagggtaaatattacgattaacagtcaccatcctgagatggtaaatgcagtagggaatggtttgcttggcctgagtacagcagtgttggtgtgtgagtgttggtgtgtgagtgttggtgggtgagtgttggtgtgtgagcgttggtgtgtgagtgttggtgtgtgagcgttggtgtgtgagtgttggtgtgtgagtgttggtgtctcctcaatattatttatcctagaaaaggaagatcaggggtgggaatccccagctttgtattttgcttgcaatacagggtatctttacaaatttgtaatcttcactacatgtctcaaaacttcctatacttgaacaacttgtcaaatccatgagtaaccaaaaagctgtagttaaagttatggccacccatatccatcctaaacatgaagaggatgtatgattaagctgtaacctttcctgaatgtgtgaggatgtggagttgagctgggtaactggggaaagctgagtgctcttgatggaatctttacgatctgtggtgaggctctcctccttagaatagtttgtatatggtggggcccgaaggttgggagatggtctgggccatcttgcggaatcttttctggaggatggaaagtttaactcttccttttctttttctttctttctttcttttttttttttttgacggggtctcactctgtcctctagactataatgcagtggcacagtataggtaactgtagcttccaactcctgggctcaagtgatcctcctgcttcagccttccctcctaagtagctgggactataggtgcatgccaccatgcccgactttaactcttttaaaaacacatatctatggaggctcttactatacataaagctgtgacaaaggaaataaagggttctgtcattaggtgtacaaatcagacatgtaaacttacttttaaatatgtgtgtaagtacaaatttttattgacttatgttattagtatatattagaacaatataatattaactgtgctttctagtatttgaaagcactaaaaatgaatttcttttaaaacactgaacttgtctttaagaatgagaatgactctgattctgaattaatgagttttagtgcctattacattacttagatattaatcttaagtatccatacacttgaaatcggttataacatagcatactcttggattatttaaatgttacagtaagaaagcatttattttaccttcacgtagttgtattctaagagaataaactgcccatcaggagatattgaataatcattgatagaatgtccaaactcatcctgtcaaacaagaagaacaaagaaaaattgaacaattccatttcattgccatcactgtgcacttacttcatagggggtactgttctagacatgtggcttgtgctttgggaagtcctaatctagcagaggtggcatattcacccacacaaatgaccgtgatgcaaggtaggtggcgatcaatgttagaaagccagaaagggaaggattaatcctaagaggaaagatgcctgcgagagtgaggatgaggaaaagaaaactttctcaacagtgggaatagcgtaagcaaaatgccaggcatgggaaaggacgtggatgtttagagactctttaagggtcatgtgtaacctgaatatagtttgtggggggcgctggtgtcagacagagtggaaggtgagaggacaacaaattagaaaaatagctgggacctaaatataagatgtggaactagatctatttttttgcatgtggaagtgatagaatcatatctatcttttacaaagatactctggtgacacagtggctgaaatgagagggaagagcggagggctgatatcagcctagatatggggagtgcagtggtctggtgtacagaatgcagatagggacacaagttagagcactcattaccacaagattaaatgagggtttaagcgaggactgtccagtggaaatggaaactgagagatacctgacatgcagagggagaattgtcgccaactatgggggatgacaggagtcaatgatgattctgaggtttctagcataagtgacttggaggagaattaagtaacttttaccaatactgggaactcacaaaaaagaataagatgctttcagtgtgctaggacagtgggggaaagataaccagtttagcttgggattttgagtttgaaatcctcatgtaggaaccagcaggctactagaaattaaagtttaaatctgggagaaggttagcgttaagtgtgtgtatacgagagtcaagccagagaggagggcagtaatgctgtggggttgcatgaaattcaccaaaggagagcatgcaaagtgaagagggaggcaaatgaagatggagccccaaggagcacttacatttaaaaatatgggcagaggaagaggaatcgtcaaaggagactaaaaagtagccaaggcagggagcatttcaagaaggagagaaagatccactttgccatatgctgcagaaagagtccaacaggttgagaaatgacagtactcgtgattccaaaggtaatgaaaaaaatccccagaattctatgcatgaattaattacgtgattaaacatacaaatgtactgttctccaagaaaactgagctgtttccatattcagcattgaataccaagatattattttcttgtttgtagagatattcatgatctaaagagagaaaacacccagatcaaaatttcaagttgttattaaacatcttcataagctgaaaattacagaatacagtttaagctcacaaataccaaataggcatttctaagttgagaaaacatgaatgatattatactaacattcattcattttttcatcattattgtcaaggtttcaattcacatttaattttttattatacatgtcaaagaaatacttgggttcctttcagtctttctccctttgcacttcaagtagaaaaagaaaaaaaaaactctctatagaatttttaaaaacaaggattacctcttctcagtgccataaaagcccacatctcgacttaactagaatgaatgtaagcataaaatctgccctaccccaaaaaattcttacctgaaatccatcttaaggagtataacttcagtctataagtattttttaagtaatcagttagagtgtaagttttgcgactgtcagctgtagcatcatctgctggttgaaagaaagagccaaatgttcatttcagtaagatggaataacctaagttttggataaaataaacaaatggatctctacaatataccctgctcaaaaaattcagaaatatactcacaaaatgcaagacacattttaaaagacttcagactgaatggatggagtaaacatgcatttaactatgaagtgtgtgagagtgtgtgtgtttcactctgctgtattatgctatattagtgggctttactttgaaggtctagatcagctatgtcctatagaaatagaatgtgagtatattttctagaagctatataagaaacaaaattttaaggtaaaaataattttagtagcacattttatttagcccaatacatccaaaatatcattttgccatgtaaccaatatttaaattttatgagaactttcatgttctttttttcattctaactctcaaatctgatatgtagtttatacttacagcatatctcaatttgactaggtacattttaagtcaatagttatgtgtggccaggtgttcaacgactactgtagtggatggcctggagctagatcatccttttcagaggctttggggcccagtttcaggccctcctgcttctcagagacccttaggacatgctgatcacccaattcagggagcttcattaatatcatcacttttctttgaaattaacagaatttgtgtgtttctatattctaccactggtgacccaaattcaaagtctgaaaatcatttttgatacttctgtctgtttttccaccatgcccatctaattgaccctcttgattattcctggaaattttttttctgggtatccctgacattagattctcccaattctctccctcctctgcaccaccactagaataatttttctaaaccactactttcattctggtgatcccttcgccaaaagttttcaatatttccccattgcctacaggaacaagattaacactccttagcctgaaactcacagccctccacgaccgacacaagactgtcttatgtcactctctccttgcagggaccctctcattcactcttatgaccagcccactgaacccagaagatcttgggcttttccacctctgctcctttttctaaaccacttctctgcagtgtcttccctgctttcctggttgtcataatcactaccctcaaattcccatctctttcatgaagactagttctgccccctctgacttttgccccaacactactcatttcgctcttgtcatttaatgacaaaatagttgacaactcttttgctctgcctacccatgtggtgtcctcagttaggccatgtagtctttgaagacaaggctttgctgtttgttcgttttaatttttacgtcaacctttagcacctaacacagttcaattccacagtaggcacacactcaaagagtttttattggttaatgtaggatatcatcctagaagcataatcaagccaacgtgattcctcttctccaatcccagagtatgtccactgataaaagagcttaaagtattttttctcaaatcctctactttttccacatacacacaaacatacactcacaaaatcagccaccgttataaaattcctataactgcagttcttacaatttgggggactgggaagccagtagccctgtcccttgttaattttcttgcaggaaatgccttccttgtaattttcttacagaaaatgctctttcaaacaatgttcttaagattttatttcttcaaatgtggtacacatacaccacggaatactatgcagccatgaaaaggaacaagatcatgtcctttgcagggacatgaatgaagctggaagccattatcctcagcaaagtaatgcaggaacagaaaaccaaatgccacatattctcacttataagtaggaggtgaacaatgagaacacatggacatatggcgaggaacaaccaacactgaggcctgttgggggtggggttgggggtgggcagagagagagcatcaggaagaatagctaacagactctgggcttaataccaaggcgatgggttgatctgtgttgcaaaccaccatggcacatgtttacctatataacaaacctgtacatcctgcacatgtaccctggaacttaaaataaaagttgaaagaaaaaaaacagataagaagacttctgaggtgggccattccctcagttaaaaatgataaagctttctgctttcatcattataagtaaagataataaagaaaatacaggttcaagttgtaggttaataaaagattttatttcttcagatcttatctgataatagccttgtacctgcctaaaacaactttgtttcaagaaataaaaatgccacatttcactttattactttattgattttatttaaaccttgttcatttaataagttaaagagagctttaaaaaaactaaagtatttttttttggtcaatttactcctgcatttcatccctaaaagttagtaggagatttgtgtttgctagtagaaatatagcaagcgggtaaaatcagtccttgaatttgccaaccttcaaacaaggagtaaagccttatgctacagaaaatatttgaaactcatattgagaatagtaactggatttgttcacaaaatgctctcaattgcttgtattcatccaaccactctttcatgcatcaaatagttaaaaagtgagtactatttgaaaaatactattaaggagttatactctgttatcaagaggtattagtttaaaaagtacttaaaacacaccctaaattagtgtaatttgaaatatagatggttatttgaaatagatgtaatttgaaatatagatggttattgacatccacaatcctcacatctgtgagccgctgcaccaggcctagtccacagtttttgaaaacccatcatctctaccacattcaggctcccttctgctcatgatggctccctgtgaattggatccataagctcatttcccagatatcaactctgatgccacacttgctagagcccaggacatccctgcaaggcccaggcttaccctggtctgtgtgaggttcactcggctgcgttagaataaccctgcaacccagtttccacatattagctgccagtccaagagaagagcggctaaattggagcaagcagagcaacacaaatgttccttgtttttagccttgccatttgataagcagggcacattggaagacggttttgaaacatctagataagcgagttctgtgagacaagagtgccaactccaggttttgacctttagcaagttcatagttggctgccaagttacaacctattttgtcaaactcttatgagacatgctcatgattcgtcttccttgtctacttgctcactgacagggcactgctgcggcagcagatgaaggtctttggctgcttgcatggttttcttagttcggcctgggacatgttcatttgacttatcagttcaaagcattgtgcagccaagtaaagcacttaatcatatgttacccatcagcttatacagaaacttgagtttcaaatctttaatttaaaaataaaaatatagatttataattttatacttttcttctttagctaaagcaactattagcttgaaccgcatgaaaataccatttttattagttaaaaaaggtagaatagtggcatttaaaatggctcaatctaataataaattcttatcaaagtgttaaggtatcttaatgaatccttgctgtagtgtcaaaatcatttctgaaaaacaataattccagaatgataaaatccaaataagagagtagtatagttccacgggatatccttgctttgatcaattgcttctgtatgattacaagatattttgaatattgtcactcattcatactaaacttttttgtctgtactaaattgacatataatgtttccactccacaaaaataaactgttttggtaaataaatggctaatgaaatacatctcaaaagaaatgtgctcgttacggcacataactgtggaaagttgttaaaaacaggcaaaagagttatctggttataaagttcctgtgttccatatggtaatcagctaacattccatattgatgcttgtatctatgatgggtataaagaaataaaacgagtgttactccaaaatttgctttagcaaattaacagccttgacacaggggtggtggaggaaaaatcaaggaggtaaaagaagaaactgactgaatgtcccttcatcctgtggctatattctccagcagcacatgcaggctgccacccatctccatagattcaacaaacaccactcaagggattgagcagctggttgctttgaatcagagagcctggatttgaaaccaggtccatttcttgccttggggccttgggaaaattactgaatctttgctatgatttgaaagatggtgtcccatccaaaactcatgttgaaccttaatatacattgtggtagtgttaagaggtggggcctttttgggaagtggttagtgcttcataaaagggctggagggaggccaggtgcagcagctcacacccgtaatcctagcacttgggaggtcgaggtgggcagataacctgaggttgggagttcgagaccagactgaccaacatggagaaaccctgtctctgctaacaatagaaaattagccgggcgtggtggcacatgtctgcaatcccagctactcaggaggctgaggcaggaaaattgcttgaacccaggaggcagaggttttggtgagctgcgatcacaccattgcactccagcctgggcaacaagagcgaaactccatctcaaaaaaaaaaaaaaaaaaaaaaaagtggaggacaggggcgctggagggaactcgctgctgcctttgtgaccctctacctttcaccatgtggggatgctgcctggagagacaatgccttcgatggggtggggcctcaccagacactgacctgcctgcattttaatctggcacttctcagcctccagaactgtgagaaatacatttctgttctttaaaggttacccattcttaggtattttgttataacaagacaaatggacctagaaagaaattggtaccagagaaatggagtgttgctgttacagatacctaaaaatgtggaagtggcttggaactgggtaatgggtgatgctggaatagttttgaagtgcaggctagaaaaagcctagattacatccacagagtgttaaacacaattctggcgagggctcagaagaagaagagagctgtggatagaacctcggtcttctcagaaattatctaagtgattgtgatcagaatgctggtagaaatatggcagtaaaggacccttttgatgagatctcagatagaaataaagatctcattggaactagagaaatggcctttcataccagaaagtggcactcggctgaattgtgtctgtgcccttctggaaggcagaattagaggataaacaaggatatccggcagaagaaaaaaatgtattcaggttgctgaatggtttctcctgacatcctataggaaaatgtgagaagagaaaaacaaattatagacagagttcataatcataagggaagatttggaaaagtctcagcctggcctgatcctccccaggttgtaaagactaaaaggcaagttcagagagaaaacccagggtgtggccaagcaatgtttaagtttaataaggagattagtatggagaataggaagccagatgctattcatcaagacaatggaacaacaaccctgaaggcattttggagattattgctgctgtccctcccatcacaggcccagagtgccacggcctaggccaggggtgtccaatgttttggtttccctgggccacgtgagaagaattgtcttgggccacacataaaatacaccaacgatagctgaataactttaaaaaaaaaaaacaaaaataactcataatgttttaagaaagtttacaaatttgtgttgggctgcattcaaagccgtccagccacatgccgtccgtaggccacaggttggacaagcttggcctaggggaaaggactatgtcaaaaaaggagccttgggcacccatgggacctcatcattgactcccctgcacctccttgtctctgctgtcagcattctggtgcagcactcttcagctgccacatatatgactcaagcaggctcagctgccactctagcatgtataagctataaaccttggcagcactcatgtggtgctaattctgcagaagcatagagtgcacaagcatggggacatggctacctccacctagatttcaaaagattcctcagaaaggctagcggcccatgaagagaactgccacagaagctactgcagagtcccagctagggcaatgcttaatggaactgcggggcaaggctacccttgaggccccacaactgtagagtcaccagcatgcaatgtcagccgggagagtcacaggcacaagacttcaacccatgagagctgcaccatgggccgtgcccagcaaagccttactgggggggtgggggtggtcctctgaggccttgggaacccaacccccaccctagcatgtctgaaacatgggacatggagtcaaagattatttttaaacctcaagatgtaatgttgtttaccctgttgggctttagatttatttggcacttattaaccgtttcttgctatttctcccatttggaatggaaatatctatcctaggcctaccccaccattgtattttggaagcacacaacttatttgatttcacagagtcacagctggagagcaatttgcctcagggtgaaacttaccttgggtttcacctaatttaggtaaaaactaatttagatgagactctggcctctagccttctgagttgatgctagaaaaagttaagatttggggggctattaggatggaatgaatgcattttgcgtacgaaaagcacatgaagtttgggattcaagggtgaatgctatggtctgagtgtcccccaaaattaatgtcttgaaactaaatctttgttgtgatattaagaggtggaaccatttgaagtgattaagtcatgagggctccccactcatgaatggttaggtgccttataaaagggctggagggaactagtctaagcctttttgtctttctactcttctgccgtgtgagaatgcagcaagaaggccctcaccagaccctaaatgccaatgccttgatattaaacctcccatctccagaattgtgagaaaataagtttctgttgcttataaattacctagtctgtggtattttgttacagcagcacaaactaacacaccttttaaagtttcattttaaaaatctataacatgagactaatagcccatggggattttcaatgattaaacaagataatgtatgtcatatgcttagctcaggacttagaacttaagaagcacctgtagatatgttacactgcacattattgttttgttccaagcatatgttaggcaaccagaatacaaaaaagaatataaaagagtctttcctctgaagcacctaacggtgagattaagaatttaactgcaataaaataacagccagttaagtttcactacgttcataatgaaaaatgatcctaataaaaaagcatgaaacaattacattgagaaaaatatttaggataagtgcaatctaatcatttcctaagtgccagtgaatatcactttctcccttctattaatacatgcctaacaccatccatagcctccatattggaagtcagcagttttcagtatgaagggaaaatattggacctaatggaattagagaatgtctgaagactgatgtttctctgattactatacataagggacattagcatataatcacaatagcagatttaccttgtcaacaatagaacactgtggtacagctgggtgcagtgactcatgcctgtaatcctagcactttgggaggccgagatgggtggattgcttgagctcaggagttcgagaccagcctgggcaacatggtgaaaccccatctctactaaaatacaaaaaaaagtcatcctggcatggtgtacctgtaaacccagctacgcaggaagctgagtcatgagaggttgcagtgagccgagactgtgccactgcactccagcctgggcaacaaagtgaaactctgtctcaaaaaaaaaaaaaaagaacactgtggtacatccaggggcatatgataaatgcattgccatctagctggaggctgtagaatgttgggactgccaggtgaccaaactttggttagggacataatcattttccaatgtgtccacctgaaatagtataatgcacatttcctagaatagcaacacttcgaaaaaaataaaacatcttaatggggtttagttccccctcctcctatgcctccttctcctcctcttttgcctttccactccatccacactggccacccagtggccagacacaccaggctcatgcctgcctcagagactttgcacttgctatatgctcttcctggaatgttcttcccccagatatggccagtgcttccttcctcacctccttcaggtgtttatttaaatgctgcattccttccctggactagcactgcagccttcttccccatggaattctctactactctttccagcattactcatttttcccttagcaatgataccatctaactgattatacattttacttttttatattgttcactgtgtgcctcccttaattggatgtaagctccgtgagggcactgattttattttgtttcattctgtttactattatattactacagcctagaacagtgcctggtatacagtagacactcaataaatagttgttgaatgaaaacataaaagtcagacaatctgaaaataagcaccaacagctccaagtacaatatgtgaactccaagtggctgtagtgtaggaagaggagtgagcttagccagataggactagacagagtgagcacaggagcctctgaaacggcctttgcaaaaattatgacagtgagagaaatctaaactaactgactccatcttgcctctaacctcacaaactaattacctttgctcattactgggtgcaggccaagcaaactatggaaggaatttagtttatagtttaactttgcagcaaggatggtaatagtccctcccaaaactgacccactctgaggactgagattgcctttctaagacgaagaaaaagccacacagtgaggactataggaggggcctgaattctgccaagatgtaggctagtagttaaatgataaccagccattattccagaggtcagaagatttgtaacttctccaattgttcttatagataacatcactattgtcaagttgtcaagacctaagactggtctttgagatatttttcagacttttgcattcagttggacctgctgactccacctggacctgtgactcataccaaggaactaaatcaaccagtcctgtgaccgtcacccataaaatgactcagtgcataaagaccattttggacagtcctatgatttcatccccaaccaatcaacagcacccattccctaggtccctgcctgccaaatcatccttaaaaaccctaacctccaagctttgagggagtcaatttgagaactgtctcctgtcctttcacttggctgttcctgtgactatgaaattctctattgcaatatcactgtcacagtgaattggttttatctgtgcagtgggcaagaagaacctgtcagactattacaactcaggttctagaccaccactagctactgttaggtcagcacacttccgtaagcctgagccagtcacctactggctttcacctccaaatatacatacccttccttgctcagtaattctggggaagggctctacagctatatttccaagaagcctcatctgcaggattcttgctaggttctgttaataggagaaaatagagaaaaaattggatggcaattagagaagaggagggactcctcctttcctccttcttgctgacagcatgcacccagcagtagcacctgctccagcctctagcttcctttgtaatatccagaacctgcttcatcatgcctcacggaggtaccagtagcagctagggggattataaaccttagagctttgatctgagatcttctgtgttcctccttcctgcagttacactttctcagttacctcagagtttctcttttgctcttttatctgtgtaaccaattttcatattaaatctctctgctgaaatatctagtgtgatttcttttttttgagacagagtcttactctgtcacccaggctggagtgcagtggcacaatcttggctcactgcaaccactgccttccaggttcaagcgatttttctgtctcatcctcccaagtaactgcaactacaggcatgtgccaccacacccagctaatttttgtatttttagtagggacggggtttcaccatgttggccaggctggtcttgaactcctggcctcagatgatctgcctgtcccggcctcccaaagtgctgggattacaggcctgagccaccatgcctggcctctagtatgatttccctaactggagccaccacgcctggcctctagtgtgatttccctaactgatataagaactgattcatcttacctattgtgatgaaattaaataattagaacttaaatctgttggaactttaggttattttgagccttgagaggtatgtggcctgagtcacataccatgcagctgtaacttctgctttttcctgtaaatgaccagaaaagaccctgtggtgcccgaggtaggaacccctcagatcatcacccctgctcatggaatgttaaagaaatcttagttggaatatagcaatctgtaaccaacaaaatcactgtaatatacatactgaccttgtatggaaaatgttgcaaccctgttaactgcctatatgagtgaaactttcaattcctcacttggtaatgctaaccccatttgtctggagtatgttttccaagaggtcatcctcaagctttgcacttgaataaactctatatttaatcgtttttctgaatctcgttattcaagttagacattataacgaaagtatttttaagtggtaagaatacaacatctagacctggagttggcaaacattttcttaaatagctggttggtcaatagtttaggctttgtgggccttatggtctttagtttctgttataactactcaagtctgccattgtaacttgcaggcagctacagccaatctgtgagtgaatgggcacagctgtgttcccataaaactttccttttaaaacatcaggtggccagtcctgactacagtttgacaatctcatctggacattcctcaaaattgtgagcaccattaaagcaaaaacaaaaactgctcacaagactggacttgaaagacaaatgttgagactgaaactccaattaccctgaaacaatatcagcatacgactccaatatatgtagcagaaaagtaaaagtgggcagaatatgtatgtctcagtattcaagtatcagatatctattttcatcttaacccaaatatgaacatgttggtaaagaaatgcaaggctggaaggactgaccgaactaagccgagttacactgcctggttccctctgctatcatgcagagtcaggaagctctacacacacagggagccagcactaagcaaggtggcaggactgctttatccctttctgaaatgaatttttttttttctgattatagtcactccctcttttcttgataagacttttctgggaataaacaagactgatacaataatggcccaaactaatacgtacagggcttctatgccccatgaaattgactggcattaggccgtgaaatccgaggtgatgataaacacttgaaaggtggaaagttcttaagtgtatgactaaatgactcactggcccgtgaaacatgcaactattttagcaaagggctagtttctcttcacatatacttaaaagcagttgcagtgagacttcagtggagggtattatagtgcaaactaagaaagatcagctcatgtttaaaagaaaactgagtaaaggaaatctgcatttatggaaactgaaagctctaacactgactcattgaagaagtctcccgaagatttataagtgtaatcaacaaggctactctttgtgacaagcatttgtcatccccgatataagaaaaaacaattattggaaaacaaaactgccacaggaattgccccattcccagtatttgccaggcaaaacattcagcagtatggggcaaaaattactatactacctgcgtctggagctgttaaaacaaacaaacaaaaaatgttataaacatataaagaataataattacgcattcttatggtgttcttctagtttgctgggttgttctaggcaatgtagactttcaacccacttattcttcttatgctcattcccattttacaaataaggagactgaggcacagataggcacagccagtaactagactaaaattctgtgattagtatgcaccaaagccacatttggaccaggcaatatggcgccaaagcctgtggttacaatcactcttctaaacctctctaaatctttggaacagtgattgcatgtggtaaatgctttcttggcatttttttgtgaattggtggagatgaattaggctttatggaagtgtttaaattcatggtttgcaactattttaaataagcaggttggtagtatccttaggacttgggtcagttgaaacttaatttgttctgcttcaaagtcaaaagagtgcaaattcagaaaactctagaattttccctctggacagtaagaaggatggcaactctgtggcttcctagaaggtaacttcctagaaaggaagttttaccatctctattctcttttccatgggaatacccaataactttcatcatctttttcctgaactcattaaaaagtagtcacgtaagctttaaaataggtttgttttcttcccttttttcatgttctctagattttaaatattatacaatgctgaacaactcaggtcctgcagtatacattttgaaaaaattataaaattagccaacaaaaaaattcaatgattcctcctttacagcaaaagctaccataggagcttattttctaccaagctcatcagttctgtggtatctgtccctcctgccattgttcaactctttccttagaactctgagggagaggtgagcttcctccccgatcattccacaccccaatctatgactcagatgcttgtcctcttgttcccaagggatttttttaaaatcttaccttttccctctaaaacacaaagctccttccttccttccttccctctttctttccttccttcctcctccctccctccctccctagcttccttcgttcctagcttccttccttcctagcctccttctttcttagcttccttccttccctccctccctccctccctccctccctccttccttccttccttccttccttccttcctctttctcttttttacttgaaacagggtctcactctgtcacccaggctagagtgcaatggcactatcatggctcactaaagccttgaacgaactcctgggctcaagcgatcctcctgcctcagcatcccaaagagctaggattacatgtgtgagccactgtgcccagctgcatcttcagtttctttccactgctcacttctgctctgtggttaaggatgcagagtgtgtactgatcttaaagaaatacttacctgatcctgctgcatccccaagccatctggacaaacttctcaaataaacagtctacattcatggccttcattttcccactattcctcttcatgtctcttgatctatcccttactacttagtccacattcatttctctctcctcatcttattaaaatgtttattttctgtaccacatattttgccaattaatcaagtaattttatatctatttaagtacttactttaacagtcttttcttaaccaaactattaataagccatgaggataaacgtattctatcttttttcaaacagttgctagcacttacaaattgtaggtatacatgatttagtactgagtggtttataaatataataattttattcagaattacagcaatattaataaatgttcattaaaaaaattttcttgcctgagctccaagataatttctttaattcaccaaatatttacttagcacttactgtgttattcagtgttctaggcactagagacatcacagtgaataaagcatgaaaaactcctgcccttatgaagcttatattttaactgggggagacataggaacagataatgagtaagcaatgccatatgctaggtggtaacaagtgccatggagccttcacaatggaaagccaatgaacgatgttaagcagaaaaggacatgatttgacttatgtttaaatgtggtcgccagcctgggcatggtggcttacacctataatcccagcactttgggaggccaagacaggcaaatcacctgaggtcaggagtatgagaccagcctggccaacatggcaaaaccctgtctctactaaaaatacaaaaaaaaaaaaaaaaaattagctgggcgtggtggtgcacacctatagtgccagctatctgggaggctgaggcgggagaatcgcttgaaactgggaggcagtggttgcagtgagctgagactgcatcgctgcactccagcctgagcgacagagcaagactccatctcaaaataaataaataaataataaattaaaacaattttatcactatattattaatggttttctattgctatgtaacaaatcaccacaaacttagtgacttaacacagcacacatgtatcagcttagagttctaaaagtcagcagtccagcccattttgctgagttctctgttcaaagtattgtgaggttaaaatcaaagttttggctggaatgagttgtcagctggaggctctggggaaaaattacctgctcccaggctcacacaggttgttggcaaaattcagttcattgaggttgtgagagtgaagttctcatttacttgttgactataagccagggctgctctcacctcctagagatgacccacattcctggccatatggcccctccatcttccaagtcagcaatggcatgttaaatccttctcatgcctgggattcctgactgcctgttctgtgactagccagagaaactctgcttttaaacagttcatgtgattcagtcaggcccaagcaggtaatctccctttcttaaagccaactgtgcatcataacgaaacttaactacaggaagaaaattcatcatatccacaatctcagagattagtacacaggagcggaggagagggttcttgggggtcaccttagcattctgcctaccacaatcaccttgtctgttgtgttgagaatacaccatagggaagtaagaaaaaaaaaaagagagatgttggcaataatttaggggaagggcaattgtgtctttgaccagggtagtaggagatgaggtggtgaggtagggtcaaactctgagagaatatgaagatacagatgataaaactgccgacacattggatgtgacttgtggatgaaagagaggagttgaggagaacttgcatggatattggcctcagtaactacaaaaatagaattgccatttgctgaaataagatgtactaagggaagacaaagagttttggaagatgtcagtatgagatgccaatatcacatccaaatggagatgtccagtaagcagttgtatactgcacctagagctcaggaaaaggtctggtttgcaggtaaaattggaaagttgccaagttgtaaatggtatttgaggccatgggagtggatgaggtcatctaaggtgaaaaaggaaaaggtcttaggatggagccccagagtagtccaaggtgagaagttgaagacatcaggaagaatacctaaggaggctgggaaagactgcacagtgaggtagaaggacaaccaggagagagtgagagccccgaggggaggtggagaagaaggatgactaattgacaggcacacgagacacagagtgagaagcaactcccaatctgcaacacagagattagggaccttgacaagaatacagctgttttagtggtgtggtggggataacccttattccaggaggcttaagagaaaaaaagggagaggggtaacagacagtgataatagaaactctttaagaagttttgtggtaaagagagcagagaaagggagtggtaggttggcagggatgagggtggaaaaagacagtttccttcttattttttaagaatatgagacactactgtatgttcatgatcaaatagagatggaaaaaatgatgttgccacatgcaaggggacagctggagcctaatctttcagtaggcaaaagggatgggacccagggcacaaacaaagggcctggtcttgggtaggagcctgagcattcattcctctaacttgggaggggagccgatacaggtgaatgcactgatgagccggtgagaattgaagttctcttctaatggtttcagttttcttatcaaaacaggaagccaggtccttagctatgaatgagcatatggaggaggtgttggaagtttgagtggagaggagatacctggaatagttcaccagaaaagcaagcgagtgagcagacagggaaaatagggccagattgccaggaaggaataagggtccactggctgctgggttctgggttctcctttcagtacagccaaacccttttcattttaagaaaatcattaccatgcagagtaattttttcgctggaaattttaaaacaaagatttgagtcatcaattagattttttttgcccatgttagattaaattatagcttctggaccttgtgaggttattttgtttgcttttgttatttactattttatttttatggccattaattattttaagtcctactttcctgggttaactttagcagatctaagttttaccattttttaaaaattttgcccatcttattttatgttgactatttctaccactttctgctattatgaactggatgaaatgtgacagtttatgtggattttctagaggtaaattgtcagtaattcccctcagatgtttcttacctgctctattatctcagatttatattttaacattgcaattcaattattttctcctcttgatcactttggatgccaaaagaaagaaagggctgaggtcaaaatgtccttgagatcagaaaggcagcaacaaagcacactgatttgcaataaacccagttaggaaagaaagtgaggagaaggaaaggagagaattacagctccagatttttggagatcagagctggcttgatgtctgtcctcttttgttgaaaaattaaatctttctaacgtaatgaaaagagagcaataaccaaatacacgatatgcctacataggccgtctccccgatttctgtctttcagaattttcaattcaacttaggtatttgcccttctccttccatgtgctagcaaaagaagatactttccaacctgagaaaggtgagtcttgagtagtctggttcaatcacggcaattcattctccttgccggtgattggtttggatatggacaagtgacacaaatgtcgccagtaagatctgaaagtttgcatctggtcagaggacttatggaaatggttttcctccctgatacagcagaacatgaatgaggaagagcatcctcttctgccctgtgaatgagctgtatgagcaagtgctgggttgagctgcagaagccatgctcaaccatgagatgacatactggagatcaaaagacaaaactccaaggatggcagagctgaaaggtggaaaggccccatgttcttgatgtgttcaggccattacattaacaaacccaagaaccactttacttctgcacttccaattataaaagatgctaatgacaatacagtaataaaacgctatcattcaaataacttttggccaggtattgggttccttgaagcccaaaacatcctgatacaatcctcatacagcatcagggggctgtaagtcagtgaggatggacacggaggtgcactgcatgcctcagagccagtttgggggctgaaggattggaaggataatattaagacccattaattattaatgctttatgcttggttgtttatgtagaaacttcctggggcagcatttatcatttggtcactagtgcttccatagcactttgatcatttactagaagggcacttagctcttttgattgtagttaatgtttatgtgtcttttaatgctgtcaattatttgaggacaaaggccatatctattgtctttctatccctagggacccacaaagtacctggcatatagaaaatcctcaataaatatttgccaagttggagaattaccttctgtcaacaaatctgtgctgggtgaatatgaagtaggaggtgttcctgagcacatccttgaaaggggaaggctgatccaataggaaaggggagttaagccagaggaacctctgcagacaagctctgataaaaaggaaacagccaggaggcaagagaaattctttacttaagctatctagccagctgtccaaggagccatccttaccttctctccttccctcactcttcacatgcctgcacattgtcttacctccaaaatacatcctgcgtttcttttttttttttaaacttattttcacctccagtgctaccatccttctccaagccaccatcattgatcacctggacaaaccacaccaaccccaaactactatccacacaagagtcagaggcatatttttgaaatgtgaaaagatcatgtcacattcatgctgaaatcctccaggagctcaaaatcatacttggaataagagagaaactcctttctgtgtctgccggtcctctctatcccacttgatttctgtcatagcatttattaccatctgaaattatttctgcacttgcctataatttgcctgctctatgaactgtaaaggtccagtggaacagggacattatctatactgcttagggctagatcttagctcattttgtattgctataaaggaatatctgaggctagtaatttatctttttaaaagattatttggatcatgattctggtgactggaaagttcaatattgggcatttacatctgatgatggtctcaggctgcttctacttatagcagaaggtgaaggggaggctggcatgtgcagagatcacatggtgagaaagaaagcaagaaagagggaggtgctaggctctttttaataatcagctgttacggaaacgaatagagcaagaactcactcacccctgtgggagggctctgatcccattatgcagataccttccattaggcctcacctccaacactggagatcaaatttcaacatgaggtttggaggggacaaatacgcaatcatagcaggccatatcccccataccttcaataacacttgacatgcagtaagcattcaatatatgtttttgaattgaaaaatattgtatttagccactgttggaccttggccctgaagaggttttaaatctcatactgaaagagttttatgcctggaatcaaataatggaagaatataatagagaaataagagtcatccatgaaacttatggacatgagtttgagcagggtgggctttagaacaactgaggaaaacaagaaaagagggttccagcctcacagaaatggtattaggccacagaggccactaagctcagttttggggtccccagttttaagaagtcagggaaggggtggatgataagacctgcttgatactcacctctcctactccctctacctcagttatacatcctgagccaccatggctcctagagtgccatgaataaaatctctagtggctttggctctgccttacattacctcctcttctaggaccctgaactcataggtctactttcttcctcactgaaccaaataattaagaaatgtgcacattaatgcccccagttaaagaaagcacatagtttatctttaaatttgtaaaagcttcctaggaagttataattttgaagaacaatataaaacaatacaatgcttggcaaataataaaacagttagttctaatttcatggtttcaggttactctcaaattgagagacacaccctcttttggaggtcataatggagctgtgaagactaaagttaaaaatatttacaagatattgatttacagcaatgaaaggattagcatccaaccataaagtaatgattaaacattaactcagaaaaactctcaccaaggcatttctataaattagccattcatgggaaccagcaggctcagggaaggttggtagtcaaaagatttggattcccaagatccagtacttacttgcaaacccctaaactttcacgtgtaaaaagtcaagatattaatatatctctctaaaatgaacttctctgtgaagatcaaatgaaataatgtaacttacatcagaagcaaagcaagtgtaatttagtgccagtaggtaaatctgaatctattattactactaatactaaaaatcgaaaccattcaaaagcttgagatgtcagtcattgcctatatacagctttatatgagaatgaaggcagcagcagtaggctcttcctcaggatacttaacacatagagattagaagccatgaaattataatatcgctatgcaaatgagaagttataacaattatgctaatatggccaagttgattttatacttgattacaagctgacagaatgatatggagttgaacagtactgagtatcagctgtagagtcacattgcctgagtatgaatcccaactttgtggaactttgagcaagttccttaacttctttgatagtcattggagccagcctccatcatggttcccaatgatctccacctcctggtatttacacacttgtgtagtgccctcccacattgtatcagggttggtctgtgtgaccaatagtacacagcagaaggaatggtatacctgccacttctgaggctaggtcataaaaggcaactcagcttcctgcttagttcctctcttggatccttcattctaagggaaagtagctaccatattatcctaagtataatttagtgcaagtaagtaaatctggacctattattactactaatactactaaacagaaccattcaaaagcttgagatgtcagtcattgcctgtatacagctttatataggaatgaaggcatccacagtaggctcttcttcagaatgcttacgacacagagattagaagtcatgaaattataatataattcccacatggtggggaactggggcccacacactagggaactgaggcctctagctaacaggcacatgagtgagcttggaaggggatccttcagccccagtcaggctttcagataacatcttgattgcaacctcatgagagaccctgaggcagaaccacccagctaagccactccaaaattccttatacacagaaactatgagataataaatatttattgttttaagttctgaggtaattcattatgcaattacagataactaaagtaccctctcaaagtttctataaatcttctgtaggaatggagagggtaatagtacctctctttcaaagagttgttctaaggattaaatgaaaaatacattgaaagccctcagccccaaatttagcacttagtaaatgcatattggctattattgtagcttgcatgccttctcttcctcaagcaaggcgctcctgcatgttatttacagccacattctccatgggcctcagtaatttcttaagtcataaaatttgaaagacacgatccagctccagtctttttatattgtctttctctgaccatcaactgagtagtcttcattttctctctctttgtgatcccctttgagaagagaggcagagatttctaagatagagaaacttaaggcatatgctatggctagggaagcaaaacccaaaataactggcctgaaaaagactaacctgctgacctcatgagcattccacaaaggttgacaatagttaactgagcaagctggagtcaactccagcttttacagagcatactgtttagaaattgtcccctgaaacatacaaagctttcattcaggcgcatttctgtgctttaaacctggaacagatcctggacttcctcaggcaaacctcatagatgctatcttttctctctgattattcctgtctccttcacatttgggttttctcttattactgatggatgggtgagcagtcaaatttcctttccaccgaaagaaggtatagaagaaatttaccactaaagcagtgaaaggagcaaaagaagagatatacttcttttccataataaaattcaataataataaaactatttgacaaataaccaaatatttcaaatttcagcatataatatagtgtaaaagaaaaaataaaggaatcataaatgctgcatgtgaattttattaccactaagccatgaagagttctacaattccatacaagtatttttacgtatttctcactgattcttggggaaactgaatgcttacatatgcaatatcctcctatagtaggatgattgaaaaaaaatttaaaacatacaatcatttattatatacacagaagagggtgaacttttgattgtgcttggtgaaatgaataatatgacttcaaggagtttttattcttaaatatatgacaatagtattaagcctctctctctctctctctggctccccattcactagcccccgtcctgttctgggtgtgtctagttttgctaaagtaagcatttcacatggaaatgcttgacctcttaaatcaacctctcaggggatgaacttgggtttgctcatggcttcctccttccttttggctgtttaattctttagtttccacgtaatttaggtctttgctttgtttttctatcaaattcctttccttccttccttcttcctttcctttcccttccccttccctttacatttcctttctccctacttccttcctttttccttcactctatttgtttacttgaaagcttgattgacaacatggagggcatttcttgggtgatgactttgacttttttgtaaggaatgctgacctttattatggcacagcccaggaaaggtattgctgatttagtgaaaatgctgcattcctgagcttttatctttattcctatgataaggcagaagtgttaacaagatgacttcccttttttccttaaacatacatacatacaagttaagaaatacagacaagaaattactagagtggtaaataaataaagccaccatgaaacaacatctccacctggttgtccaagaggtatccttagccaccctctcctttacctctctctgtttaaccggttaccgaagtccagtcattcacatttctgagtagctctggagcctccaaattctgacctgtactgtaagtgtcctgggccatttccctcacttccccctccagtgttgctccattgcaactcaccttcccactgtcatggccaacagttcaggcatgctcaaaacatcattcactgcatcatctccagcttagaatcaaactcttttgcctgtttcccaccctcctctggggccctggatccttttataatccctaacacaggatgtgatctcatgtctctgtgttgaaacacagggcatttgcattttctggaatatcttatctccagaaactgatgttaactattcaagcttggcccacaaaagaaacctcttataagaagtctctccgccgggtgcagtggcttacacctttcattccagcactttgggaggccaaagtgggcagatcatgaggtcaggagataaagaccatcctggccaacatggtaaaaccccatctatactaaaatacaaaaaattatccgggcgtggtggtgtgtgcctgtagtcccagctactcgggaggctgaggcaagggaatcacttgaacccgggagggggagactttcccagaagtgttccttctaacctccagagcagtctgctcaagcacctctaagttatttttttgaatcataagagtagttatatggaaacaagttgagtctctcaggaagtcctcctcaagagaacattcttgaaatgtgttcaaatttcatttggagaagataccaggtgctatttagcagaaatggcaaaacagctcttcctggcctgtataccctacccagcaaaacaaaattctcagagttaactgcagcaagcctcagatccctaggccttttcactggccatctcaagtggcttatcaaagtacagtattccttccaacttgctttaacggaagttctgataattacagttttactcaaacttccagcgatgctgtgatgcctcagtgatgttttggagagaaacatacagattatttctatttatatatgtgtgtatccacacacacacatacacacatatatatgtaaaacaagtcatatttgtttgcatgttcccactagcttatacagtccttgaggtcagggcctttatatttatatttacaaaatttaatctttgtatttgcagcaactaacgcggtgcctggaacataatgtaagcctgtaagccctatatttatcaattgtatgactagcacattcttctcccacaaggctttgcatgtatggtttacacaaagagttgctttatgaaaatagttatattttaacagtccacaagagtcaagcttaagtggactgtcatttaatggtataaaatagtagcaaccactggtttcttcaaatttcattagcagtaggtcaacccattcagttatttaacctttggcacatttgccctggccttgaattgcacagcaagcatggttttcatagctctacaatctaattctgaactgtcatcctaaaatctagataagactccttgagtatgcaagcactgactatacattcctcagttgactaaatcttccagagagaatgctttaactggctgactaatttatagtgtgtaatgctgaaatgaaagcaagtgtttaaaaggaaagtaaggccaggggagactgaaactagtagttctcacttgcttgcatcctacagtgagtattccattatgtgagtgttttatacatttaggcaagctaaaaagacatgaaagtccttaaataaaagaatccaccaaaacatcactgattccagacccttcttaaatattatcgtgtataccagctttattatttagctctgcaatactgctaaattggtcaattacttccctgcctccccaccctccaactgaattctcaccacccttgagggaaaacagtctgggttccctgtggaacatcatttctcaaaactgtattttggggcttgctttctcatttttcctttccatttcagatatccttactgctgtctttgggctctttaaacactgccttttttcctttttcgatcacacccaaaaacttttctcaaaaattacatgtaaatttaaaaatttacaaattaaatttaaaattgaaattttaaaaatcccgactctccctaatttcaggaagcatgcatttattatacataacaagacgtgaaagccgcaagagtttcagcctaaacactgaagaccccgcgaagtgaatccagctgctgctctacaagcagcaacaacaactgggaagccttctcagctacacttcggggcactggtccaaccccacgcaaaatccctcgtttcccttagcgtggtaagacggagcctgacctgagctccaactgtcctatctttttcaaatgtttcaaacttactgcctttgttcagcagaaccacgggcacggtgatgatggtgacaagcgcagcagcacccagcagtcccagaagaaccttccacggtgtctgcaagccgagcagatcaagtccaattagagggaagcgtgtggccccagtttccgtaggagggtcggggctgctccagaggcagcaggatttgcaggtgggagtgcgttagaagagggagaccgcgggctgggggtgggggtggcgtctggagtgcgccagttggagttctctaaggcgggtgcccttgaacttgtgccttcagagcacattagcgttggtttctctacccctgcccgggttcgggcgtgcgttctgtgagtggctctccgggacattcaaagctcgacgccagggtcctagcagaagccagggtccgaaagctaagcgagagctctgggacgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtcactcgccgctggcaagtttcggccccgagttaaacattagtgagcgccgagcccgctgggtataaaggcgccgcgggcaggctgcagggcaggcggcgcgggagcaggcgcgcgtggcgcggggcactggcatcccggccggggggagcccgcgagggccccctgagggcggtgtagggcgctgggcggcagccggggcgcagagtgcggggcccggaggagccgtgggggaggggaaagggcgcgcggcctcggatgcgcagaccctgggccggcgactcggggaccctgctccctcttagctaaaaatgacgtcggcgttcagctcctccaacctcacgtggacaggcgagggaaccgagacccagagagggcaggggactttggcaaactcacacagcccaccgcaggcaactggaactgaaacccaggactccgtctcttgccagtgaaagttatgttaggaagcagtgaggggtctaaagcagtatgaaaggcaaagagaaaaggtgattgttccctcttgaatggcccttggaagctgagtatctggattcaccctccctagggaatttcccgattgtcttgcaggcttacacactcatcaagatgacaaaaataatgacagtaacacttatgtggaacttgactttttcccaggtgctgctctaagcatttactgtgtttgttttacaggaaggaagactgtacacagagaataaataacttggccaagccattcagctaggaagttgtagatcctaaattaagagttcaaggtcttaatggctactctatgcggcctctcatagtcttttcaagggttttggagaagaataaaagatcaggtatggcttctccctcccccagctctctattgttccctaaaggattattcattcgttcattcattcctacatcctcccatttattccagtcatccacagatgtttgagtggttacaatgtgccagcctcccttctaggtactggagataaagtgggacaagagaggtgaggtctggacccttggcactttcacgataaaatacacaggtaaacatttgcctttagggccccctgtgattacttccactcttgcagataagaggataaggcctcttcagcttgttcacagcagctgaaaagcaaagcctctctgtcagtagaggtaaaagattaagaatgcagagtccgatggggcattaccacatgattatgaattaatgcaattttccatcttttatttccaatccaggcattgcttttgaactcagtcatcttttcccccttgcccactagttgcttgtgatacatcagtatcctcactcacccccaactccagaggctgaaactaactctcctcctccctcttccaactgctgaggaagatgagtcaatggtgttactggaccctgtgaactgatgctgtgaagagaggccatttaacacggactacggggaatggtgccacagggggctcagtgctgcccttcactctcagcattttgctcactcagcattggtaagccacatcagcctcggtgaaggaagtctggagagttaagcctgtgcttcatctccatgccagcaccatggcactcattgtacattcagcaagccccaaggaagctggcaggaggctggctgacatctacgggacaggtcaatttgttctctggagggcactccatgagacgcaaatatcttcacaccctgtgcccatttcaagagactctctcacatgcctcccccaccttgacctctgtgtcaccagtctttcaatcttgttttttccaaatccttaaggtagcagctggccaacacattagccaccactgatgagtcagtgtagatcttacattgggccatctcttttttcttgcaaaatagaaaagcagatgttctgctcaaagttctgtttgtcagtaagatttccctttctgctgtgtttcaggacatccctgggagggactctgatgcagcagccatctacttattgctagtgccagcttactttgcataacattgactcctttccctcatctgttgcctagttgtaggaaactccttgtgaagctataggtgtgcactgagggagagacattgagtcaatgggagcaggcatcatagagtctaagttttctgctagtctgagtttcttgtgccttgtggacctggtgggcttatctcctttatcatatagatacaattttcgcttaataatagcatgctcctgcaaatgcccaattttatcatgtggtagattaggcaacactcagtttattagggtagctaggttgtgcagttacttgatgttatggattgaattgtgtccctccaaaagatatattagaatcccaacctttaggacttcagagtgtgacattatttgaatatagggtctttacagagttaatcaatttttttgaatcttatatagcttttatttcagtgatcaaaagaatgcagtaaatggaatctacactaattaacattaggcatgcacctctacctgaaactgctgttagcttatgattggcctaaatctttataacttatttaggcacatcattgaattttttgtaccctgatatacagggtaagttaatttcttccttgtggcagtctagtaataagaattatgttcactggctagattcctttaaaactaaagacctctagactctcaggctgcctaccttaccttgagactatacttaatatggatatttaagcaaatcatcatataggaaagggagatcatcaagaaaactgaagtgtactgtataaacactcttacagatatttttctccagcattgataatcaaacactagataaggatactaaattattcttcccccacttctgccctttctgaaaaacacaaggatctcccttgaaatcgaaatgactccacacaaatgagagatttttatgtatgtggtcccactatcaaaataataggaagcagttaatggggctttgagaaaagcatagtcccgtgtacagtaatatgcatctaaatagagttttccattcacctgtcaattattttcacaagattagcattaaaaaatacaagcaaacatatgacccttaagcttcacacacaaaaaattggtctttgttcattctcagatgacaggatgtcccaaaagtaacaaaagatgggagccagtcctctcatagctgtttcttcaatcatcccatcaacagctcttcatttattgaactaccttccttttccaaagaggtaatgctgagatcagtcagaaaggctttctgagaaaactggcttggatttctgggtctgttgcagtcaattcaagatgaactggcttgtatcaatgaagcgctcaatgcagttcacaaaacaggcctcagcccgactgtccaactttggcccaggcttgtccatgcacttctcccaacaaagttcagtcatctggtgcaccagctgctggaagcgctgcttttgagtctctacctcaatgaaaatgctgcaactgcgggtccactgcacccaaacccgccgcagaggaagagcaggaggaatccatcccaggacaaccatgcttgcagagacgaactccgcaccaaccttcacgtgtctccacgacctagttaatcaatttaaaatgaggtcactagggtgggccccaatccaatatgactgataactttataaaaaggagagatttggatacagaaagagacagagtgaaaaccatgtgaagaaacataggaaaagatggcagctacaagccaaggagaagcttgcagtgtgtattcatctgttctcatgctgttaataaagacatacctgagactgggtaatttataaaggaaagaaacttaattgactcacacttccacatgctggggatgcctcacaatcacgcctgaaggcgaatgaggagtaaagtcatgtcttacatggtggcaggcaagagagcttgtgtaggggaactcccctttataaaatcatcagatcttgtgagacttattcactatcacaagtacagcacaggaaagacctacccccatgattcaattacctcccactaggtccctcccacaatacatgggaatcatgggagctataattcaagatgagatttgggtggggacacagccaaaccatatcattccatccctggtccctcccaaatctcatgtcctcacacttcaaaaccaatcatgccatgctaacagtcccccaagtcttaactcatttcagcattgactcaaaagtccacagtccaaagtttcatctgagacaaagcaagtcccttctgcctacgactctgtaaaatcactagcaagttagttacttcctagatataatggggttataggtgttgggtaaatacaaccattccaaatgggagaaattggccaaaatgaaggggctacaggtgccatgcaaatctgaaatccagcaggtcagtcaaatcttaaagctccaaaattatctcctttgactccatgtctcacatccaagtcatgctaatgcaagaggtgggttgccatggtcttgggcagctctgcccctgtagttttgcagggttcaggccccctcctggctgctttcacaggctggcgttgagtatatgtggcttttccagttacacggaacaagctgtccctggatctaccattctgggggctggaggatggtggccctcttctcacagctccactaggcagtgccccagtggagactctgtgtgggggctcatatcccacatttcccttctgcactgccctagtagaggttctccatgatggttctgctcctatagtacacctctgcttgggcatctgggagtttccattcatcctctgaaatctaggcataggttcccaaacctcaattcttgatttctgtgcacccacatgcccaacaccacatgtaagctgccaaggcatggggcttgcttctctgaagcaatggcttgagctctacattggccccttttagccacagctgggacacagggcaccaagtcctgagactgcacaaagaagcaaggcccttggcctagcccatgaaaccatttttgcctcctaggcctcctggcttgtgatggaaggggctgcgtgaagtcctctgacttgccgtggagacattttccccattgtttggtgattaacatttggctcctcatttctgcagccagcttgaatttttcagaaaatggggttttcattttaattgcatcatcaggctgcagattttccaaacttttatgctctgcttcccttttaaacataagttccaattccaaaccatatatttgtgaatgcataaaactgaatgcttttaacagtacccaagtcacctcttgaatgctttgctgcttagaaatttttgccagataccctaaagaatctctctcaagttcaaagttccacaaatctctagggcaggggcaaactgccaccagtctctttgctaaaacatggcaagagtcaccactgctccagttcttaacaagttcctcatctgcatgagaccacctcagcctggactttattgtccatatcactttgcctgttaccaggttccaaagtctcttccacatttttgggtatctttacagtagcaccccactcctggtaccaggttactgtattagtctgttctcacgttgctaataaagacatacccaagactggataatttataaaggaaagaggcttaattgactcacagttccacatgtctggggaggcctcacaatcgtggctgaagacaaatgaggagcaaagtcacattttccatggtggcaggcaagagagcttgtgtaggagaactcccctttataaaaccatcagatctcatgagacttattcaccatcatgagaacagcatgggaaagacctgtaccccatgattcaattacctcctactgggtcactctcacaccatatgggaattatgggagctataattcaagatgagatttgggtgaggacacagccaaaccatattacagtggatctttctttgtctcatagtcctcaggaggaaccaatcctgtgatgtattgattttggacttatagctcctagaactgagagataataaatttctgttgtttcagccacccagtttgtggtactttgttatagcagccctagtgaatgaatgaatatacttgatccatgatcatgctttcagtctctacaggatcccagtagcaagagagatgccactttttaagtagtgaattgtcactggttattgtaggcagcctccaagatggcccctaaagttttggaagtaatttattatgcaacagtagataactaataaattggcaaagagtatatgacttttctctaagagtcatatatcttctgtgattctctcactgggttttgccagaggcttcatacagtgtctccggctgccacatacattttaaataagtattgtgcttgttaggtcataagatccaagtacaacttgcactatagcctaaacatgcagagccttcttttgcttcaggatccattcaaaacaggcagcctttaaagttactgagtaaatgattggagaagtatagccaagcatagtatatggtgtctcaaaaatccaaagagttctggcaaatagtgctcctcttcatggtggatgtacaaggtgtagtgacttgtctttcacattagaaaggataccttgacatgttccagaccactgaatcccttgaaactctgcaaattttccacggattttattctctaccctgtgtccacatttgtcttactaaagcatgtaaggaacttgctacttcttgttcatcaagtccatgtagcatagttatcaatgcagtggactaatgtgggtctgtgggatggcaagatgctcaaggtcttgggagattttaatatgacagaaagcaagacttgacatatccctggagtaagatagtgaaaatacactgctgttccttccaggtgaaggcaaagtattttagatacttcttactaatttgactcaaggaaaaaagtgtttgcaggtgaacagctcagatgtccatgttgtttgattcagtaaagttaaacatctgaaatggcaactgagttattttccataatccatcctagttttgcacaagctaaatgggaaagttaattaagtatgggatgggggaaatagcacctctgcatctttcagatttttacgtagtggcactaatttctgcacttagagatgcagtattacttttagttttccatattgttgtgcagggacagtaccagggtcttccacttggtctttcctatctaccttaatgtcccttcctgggtcaggggataaatgagcaaagaaatgtaggcaggctctaagagctgggaaaagcaaagaaatagattctcccctagagcctccagaaggaacagagccttgatgatgccttgattttatcccaggaagacctatttcagactctgacttctagagctgtaagttaatagatttatgttgttttaagccactcagtttatggtaacttgttactgtagcagatggaaacttaacataaagcaggacaacagtgatctttttaactccatcaaaattggcataaacccagggcccatatttaataactccagggaggtctgagaatgtcccttttcatggggcattttcaaacttggctataagtcacatgtcaggtgtgtactgtgacagcatttcagagtccctcctgaaaaagatctgacctccatttcaaacaaggttttctgggtctattaactgctttgagtctgagaacttgatgagagtccatttattactactatgaaaacttaagtcaaatttctgcccattacacctagaattcttttgatcatttaaatcaagctataatttagaatgctacctattgacttcattcttaagtatctcgtgataaatgagccaccaccatagaagtcaaaagccctgattatcatattgttcctgccactgtttatggcaatatccccttttgagaacctgagtcctggagttggggttacctagggtgaactctagccttggagggatacagccactgccagattgcagcacaataaagcagataaaaagcttaaggagtaaatacctcagtctctttctcttctctcccttcagtatcttgctcgttcctcccatctgttgagcccaataaagacagagggctaaggagcctggctaatagcaaatgtatattcagggatcaacctgcaaggctgtgcaatgcagggaagagaagggtggagaatggatagagggagggggaacttgaaaaagagccacataaccaggcaactccatatagtacttattatttgctaaactatctccttatggagactggaaacattccctttattcctttatcttctcatccatcattctctccagtgcctagtaaagtgccttaaatatattagcagtcagtaactgttggttaaataaattaaaaaatgaaatgataactgaagaaaagttaagatcaaatctttctctgtgttcttgggggctgcaactagaagacagaaagaaataggatctcatatgtggagagatggcagggtggagggtggggaggtgaggagtggtggggaacagggatggaaaggaacagatttacttcttgccctcagttctgaaggttatgtaaaggacaatacaagggtacttatttgttcctttgatcagtggacatttgccctccacctaatcagagaacgctgctctacctgtgtgggaatgacttcctgctgccttagtgccaaaccccacatttcatatcctttggactgaagatcaagtctcacatcttccaggttatcttcaccgtctgtttctgttttattttctcttttccctaccaaccatacttgagaagattaccctgcttgtgttccaggttgaaccaacctttaacaaaatttatttctacaaagagatacgtattaatagatgacaactagctggctagatcatcctatggattttgatagatgaaaggaagtttcaggcccaagggataacacacataagggcttgagtaagaaagctggaagatctttagggaatatgtattacttgcattttgccaggatatagagtattccagaaagtattgggaaatgaaagttggtcatgaacatattcttgtcttaagttcaatattcagtatataccaaggagccactaaaattttacctgggaaagaaacccaatcagacttatacttcagatttaaaaaaaaaaaggcaatagtgtctgttggatggaatgagaaagggaagaacttaaactggggggagagtcagtaaactcttggtcttagaaaattaattgggtaagtgcctctctgcaaagtttgttgtacaagcatgtaaaccatgcttatttattcttgttaaaatataactctaaaaactttttctcagctatggtcatggtgctttccttgccccaattatcagtaataccaaatgagggattgttctagcactcagcactccgtaaaggagtgctttttctacctttcagactagaaccaacccaaggggtaagggcacttttgtgctcctctttggatggtatcctttggatattctgtgggttttttaatttgaagaatttgcttatattagcccctgacttaagaaaaaaaatatgacttaatgaagagaacgtgtttgaaacccatggagcctgattctcacaaagtgtctgtagctacaatgatgtctcctccttagtgttctccaagctgtgaacatgggctagatgtggtggcagggtaggggagccagagatcacctccaacccccctgtagctcttatgtagctcttctagattcagccatagagctgaatctagaaaccaaattgatatcaggcagattaacaagagaaaagtaaacagatgttattggtttttcatgtacatggggatcttcataagagactgaagtctgaagtggccaaagcaagatactttcatactttttagacaaagaatgacaaatctgagaagaaatcacaggacaaagggaatctgactaagagcagtacatttctaggggagtcactaggagatacatgagggtagggtgtaaacctactggaagataaggactacttcattaagtatgtttattcaggttcattgcagcctcctatcaccagtctctgttgacaagggctattttcttgctccagtaagaaaatattcctcccacagtaagaaatatttctattttcttgctccaacaagaaatattcttcccagaggaatctatggcttgccacaagcaggaaaagacaggccaactaacccttactgaggctacaattctcccaatgctttcaacttgaaataatcaatataccaatttggcatattttgggatgccatgtctttcattcc
